United States Patent 7,745,391 (HUMAN THROMBOSPONDIN POLYPEPTIDE) - sequence listing, part 290

SEQ ID NO: 926284 - protein, 310 aa, Homo sapiens
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPGDPLRFHAHYIAQCWAPEDTIPLQDLVAAGRLGTSVRKTLLLCSPQPDGKVVYTSLQWASLQ

SEQ ID NO: 926285 - protein, 115 aa, Homo sapiens
MMNLSQEFGQSTARVVLSAASAAKTGMEGAGIIWKIWERLHSYVRCLGWMTPRLLSDVLVVKVWSLNQQRQHHLGARQKGKFLSPTPDLLNQSETLKERHLEVGGEVCREKLEMY

SEQ ID NO: 926286 - protein, 137 aa, Homo sapiens
MILVRINKRFLLGQEVGTGCVEGGDPRICIHSFPDSFIFSFIRSFIHSFVHHPWTRGLLSIRAELGSRGHGSKSDPCLSLNSSGTSAEKTDPHNGKIYTDRKYISDCLGLEWVLRLGVMAKEYTVSPWTNENILKVI

SEQ ID NO: 926287 - protein, 362 aa, Homo sapiens
MSHKEVHMAEKPYGCDACGKTFGFIENLMWHKLVHQAAPERLLPPAPGGLQPPDGSSGTDAASVLDNGLAGEVGAAVAALAGVSGGEDAGGAAVAGAGGGASSGPERFSCATCGQSFKHFLGLVTHKYVHLSFAGAYDLLLHRRSHRQKRGFRCPVCGKRFWEAALLMRHQRCHTEQRPYRCGVCGRGFLRSWYLRHTAWCTLASGPSSAACAQALRAVVQPGRAPAAARCGPAPALQRCGKTFRYRSNLLEHQRLHLGERAYRCEHCGKGFFYLSSVLRHQRAHEPPRPELRCPACLKAFKDPGYFRKHLAAHQGGRPFRCSSCGEGFANTYGLKKHRLAHKAENLGGPGAGAGTLAGKDA

SEQ ID NO: 926288 - protein, 163 aa, Homo sapiens
MALSKRAGRWLAPRSARRNQLAKHRRRIYKMGPLCDALGAVSSPAPGACETRRKWDGSFSLPPQKRKDCGAGEVGGNLSLARSLFITPWPAAISMATLAPFQCAAPGLSLSLSRSRSGRVLSLGAVPASKWAGLVSRKKILFFSNQKACLVFEWRLQSGEEYL

SEQ ID NO: 926289 - protein, 249 aa, Homo sapiens
MKFEFSLEKIWMGLPELLVKRVVAQLAGALDFLHSRGLVHADVKPDNVLVFDPVCSRVALGDLAVDSWGLGVLLFCAATACFPWDVALAPNPEFEAFAGWVTTKPQPPQPPPPWDQFAPPALALLQGLLDLDPETRSPPLAVLDFLGDDWGPVNPKSQAWYPWVSFLTKASPRPAVPWHLPDRTRSLACGGSRLQDGDELDPNPRPQHPAEGPELETVFPKQEGMLPGWEVSSLHTTRHPGLDPSWKRC

SEQ ID NO: 926290 - protein, 348 aa, Homo sapiens
MPGKQSEEGPAEAGASEDSEEEGLGGLTLEELQQGQEAARALEDMMTLSAQTLVRAEVDELYEEVRPLGQGCYGRVLLVTHRQKGTPLALKQLPKPRTSLRGFLYEFCVGLSLGAHSAIVTAYGIGIESAHSYSFLTEPVLHGDLMAFIQPKVGLPQPAVHRCAAQLASALEYIHARGLVYRDLKPENVLVCDPACRRFKLTDFGHTRPRGTLLRLAGPPIPYTAPELCAPPPLPEGLPIQPALDAWALGVLLFCLLTGYFPWDRPLAEADPFYEDFLIWQASGQPRDRPQPWFGLAAAADALLRGLLDPHPRRRSAVIAIREHLGRPWRQREGEAEAVGAVEEEAGQ

SEQ ID NO: 926291 - protein, 121 aa, Homo sapiens
MPAGFDGGSLGGPGPSRQPSPWEGTRAGRSLLRSRTPGSAHPPRMPLLLHPQKFQPLRFPLSRRLEGKTQAAALWRLDHRGACLCPLFPHSRVTTARRSCSGLQTQHFGMARQEDRLSPGA

SEQ ID NO: 926292 - protein, 189 aa, Homo sapiens
MKHPPPAPQFNLRLATLLALWPREALEPKQPDPSPSFRGAALGVGLPRGWPSPSKLVNYFSGKLVNYFSGEGMVGSLPNPQASRDSQHLPTCGRGHRSFLPLPIPDLGIHFLWLQNPGCVLRGRTALTRVASAFRAPGDVGCSGGSLGAWLASVPTFEVSSGWMVGGAGARRGVLLGRVWEEFAGNAGA

SEQ ID NO: 926293 - protein, 141 aa, Homo sapiens
MTRGGGASPTAPSPLPTRPNLGPPPELLLACLARPAPTCSGRVREFRASRRIPLDSQAFPSSAGSRNAPEQSLSRNCKSRYLKRGIAAGLHFPETIEALAPPGLRALTARECWEMESGSRIRGRKNTYFSCKNKFLQPLLQ

SEQ ID NO: 926294 - protein, 143 aa, Homo sapiens
MGAQGRPHQGAETIYCLAFYMKKFADPWSRTILGTHSLLAFPTPVLLLTQILHNEDCTKSFVGTNSLNPLNTSTHYHLLNKHLLNTYCVPGTEDSALNKIKIFVLCYEKKQSGVKRERVMRGTVLYRMARKGLLEEVILEQNG

SEQ ID NO: 926295 - protein, 678 aa, Homo sapiens
MPSADIDECGEIPAICANGICINQIGSFRCECPAGFNYNSILLACEDVDECGSRESPCQQNADCINIPGSYRCKCTRGYKLSPGGACVGRNECREIPNVCSHGDCMDTEGSYMCLCHRGFQASADQTLCMDIDECDRQPCGNGTCKNIIGSYNCLCFPGFVVTHNGDCVDFDECTTLVGQVCRFGHCLNTAGSFHCLCQDGFELTADGKNCVDTNECLSLAGTCLPGTCQNLEGSFRCICPPGFQVQSDHCIDIDECSEEPNLCLFGTCTNSPGSFQCLCPPGFVLSDNGHRCFDTRQSFCFTRFEAGKCSVPKAFNTTKTRCCCSKRPGEGWGDPCELCPQEGSAAFQELCPFGHGAVPGPDDSREDVNECAENPGVCTNGVCVNTDGSFRCECPFGYSLDFTGINCVDTDECSVGHPCGQGTCTNVIGGFECACADGFEPGLMMTCEDIDECSLNPLLCAFRCHNTEGSYLCTCPAGYTLREDGAMCRDVDECADGQQDCHARGMECKNLIGTFACVCPPGMRPLPGSGEGCTDDNECHAQPDLCVNGRCVNTAGSFRCDCDEGFQPSPTLTECHDIRQGPCFAEVLQTMCRSLSSSSEAVTRAECCCGGGRGWGPRCELCPLPGTSAYRKLCPHGSGYTAEGRGGCPCPQDPQGGKKRGSLLRVMCLYCSRCWNV

SEQ ID NO: 926296 - protein, 331 aa, Homo sapiens
MMSAQPSLAHVVPTGTATTPRAASAVNATKASPWSAQAMAVKVQPSFGWDVNECDGPHRCQHGCQNQLGGYRCSCPQGFTQHSQWAQCVDENECALSPPTCGSASCRNTLGGFRCVCPSGFDFDQALGGCQEVDECAGRRGPCSYSCANTPGGFLCGCPQGYFRAGQGHCVSGLGFSPGPQDTPDKEELLSSEACYECKINGLSPRDRPRRSAHRDHQVNLATLDSEALLTLGLNLSHLGRAERILELRPALEGLEGRIRYVIVRGNEQGFFRMHHLRGVSSLQLGRRRPGPGTYRLEVVSHMAGPWGVQPEGQPGPWGQALRLKVQLQLL

SEQ ID NO: 926297 - protein, 208 aa, Homo sapiens
MFTSSKNILTDLPRMMFDQTSGDPAAQSSSHKKFTNTLGIPGKLGTRPAAPPGLAPRPPPRPPPWLAPSPRCSTAGPASSICCHGTCWGSKAPPPTVGHHHSSRGNGRARTEAETGLRHLQAEGHRPPPPAGEGHRRSLPLSLWKKPALPTPGWQSSGLQNREDTSLLWEHPGHVPLLRQPQVAAAQGPGDPAVNKIGKIPALLEVAS

SEQ ID NO: 926298 - protein, 151 aa, Homo sapiens
MDQVLGSQYRLRVQKGVLDQHRALLQGAPDAMELRELTPWAGRPPGPRRRAGPRAAARACALEVRVSELGLGYASDETVLFRYCAGACEAAARVYDLGLRRLRQRRRLRRERVRAQPCCRPTAYEDEVSFLDAHSRYHTVHELSARECTCV

SEQ ID NO: 926299 - protein, 389 aa, Homo sapiens
MDPLGPAKPQWLWRRCLAGLLFQLLVAVCFFSYLRVSRDDATGSPRPGLMAVEPVTGAPNGSRCQDSMATPAHPTLLILLWTWPFNTPVALPRCSEMVPGAADCNITADSSVYPQADAVIVHHWDIMYNPSANLPPPTRPQGQRWIWFSMESPSNCRHLEALDGYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFHWRETLRPRSFSWALAFCKACWKLQQESRYQTVRSIAAWADLGDRAGAPRVTVPVR

SEQ ID NO: 926300 - protein, 1320 aa, Homo sapiens
MGQTKSKIKSKYASYLSFIKILLKRGEVKVSTKNLIKLFQIIEQFCPWFPEQGTLDLKDWKRIGKELKQAGRKGNIIPLTVWNDWAIIKAALEPFQTEEDGISVSDAPGSCLIDCNENTRKKSQKETESLHCEYVAEPVMAQSTQNVDYNQLQEVIYPETLKLEGKGPELMGPSESKPRGTSPLPAGQVPVTLQPQKQVKENKTQPPVAYQYWPPAELQYRPPPESQYGYPGMPPAPQGRAPYPQPPTRRLNPTAPPSRQGSELHEIIDKSRKEGDTEAWQFPVTLEPMPPGEGAQEGEPLTVEARYKSFSIKMLKDMKEGVKQYGPNSPYMRTLLDSIAHGHRLIPYDWEILAKSSLSPSQFLQFKTWWIDGVQEQVRRNRAANPPVNIDADQLLGIGQNWSTISQQALMQNEAIEQVRAICLRAWEKIQDPGSTCPSFNTVRQGSKEPYPDFVARLQDVAQKSIADEKARKVIVELMAYENTNPEWNKPVTTIQQLSPATSGSAAVDLCTIQAVSLLPGVPPQKTPTGVYGPLPKGTVGLILGRSSLNLKGVQIHTSVVDSDYKGEIQLVISSSIPWSASPRDRIAQLLLLPYIKGGNSEIKRIGGLGSTDPTGKAAYWASQVSENRPVCKAIIQGKQFEGLVDTGADVSIIALNQWPKNWPKQKAVTGLVGIGTASEVYQRAATIEPPKPIPLTWKTEKPVWVNQWPLPKQKLEALHLLANEQLEKGHIEPSFSPWNSPVFVIQKKSGKWRMLTDLRAVNAVIQPMGPLQPGLPSPAMIPKDWPLIIIDLKDCFFTIPLAEQDCEKFAFTIPAINNKEPATRFQWKVLPQGMLNSPTICQTFVGRALQPVRDKFSDCYIIHYIDDILCAAKTRDKLIDCYTFLQAEVANAGLAIASDKIQTSTPFHYLGMQIENRKIKPQKIEIRKDTLKTLNDFQKLLGDINWIRPTLGIPTYAMSNLFSILRGDSDLNSKRMLTPEATKEIKLVEEKIQSAQINRIDPLAPLQLLIFATAHSPTGIIIQNTDLVKWSFLPHSTVKTFTLYLDQIATLIGQTRLRIIKLCGNDPDKIVVPLTKEQVRQAFINSGAWQIGLANFVGIIDNHYPKTKIFQFLKLTTWILPKITRREPLENALTVFTDGSSNGKAAYTGPKERVIKTPYQSAQRAELVAVITVLQDFDQPINIISDSAYVVQATRDVETALIKYRMDDQLNQLFNLLQQTVRKRNFPFYITHIRAHTNLPGPLTKANEQADLLVSSALIKAQELHALTHVNAAGLKNKFDVTWKLAKDIVQHCTQESTRMFNACSPKLVGGSTYCQSHQ

SEQ ID NO: 926301 - protein, 498 aa, Homo sapiens
MITIEEGRRLRCCIAKIVVIPLSLPFALLKVTEESSPAPSMWGDREDMTVSNLEEGPHQTPIMLALSSWTSGLQNSDQQIMRSISLLRDAETCVQGDTMKKQGHQELLRDHQELHIEEAESQGSLWVQPQELLPQAQVQDHSWFQDRDDHLPLGKLWALGEKSRGQTCLTHAHLGGVTLPGAAPGAAVQGGGELAVPELVLHLWREQSVQVKALVMQDALEGSRCHREKDQIQKKPGTGHPATELQEEAPDTLDSTAARLMTALLKVTEESSPAPSMWGDREDMTVSNLEEGPHQTPIMLALSSWTSGLQNSDQQIMRSISLLRDAETCVQGDTMKKQGHQELLRDHQELHIEEAESQGSLWVQPQELLPQAQVQDHSWFQDRDDHLPLGKLWALGEKSRGQTCLTHAHLGGVTLPGAAPGAAVQGGGELAVPELVLHLWREQSVQVKALVMQDALEGSRCLREKDQIQKKPGTGHPATELQEEAPDTLDSTAARLMT

SEQ ID NO: 926302 - protein, 275 aa, Homo sapiens
MKGSRRPRSPSDSCTESKSDHAGESGSSCTPSNAPKRQKVEELGPHPGAEPAPVQPAPHHPAQLPLELPQLPQRKMIIAILEPGMVLHLRLGQEFLGLDPQGALRLSLLNVQLLVVPEQLLMSLKDLLYPAHARWLLLTSTETVWEIDIENGSVRAQRAENVCVAPSVKEGEAPQGFLPLMGPPANLVHGVSPSSWRVLYLKPDYRAAVPQGSSQMPKPSPWRQALPEEFHLDLHGLEPLPTSALRPLPPSPSPEPRICHKFLWRPTCKARRRLF

SEQ ID NO: 926303 - protein, 173 aa, Homo sapiens
MEERRKKKKAARRRRRGEEGEEDEGRKKGRKRREEKEEEKRRRRGGEKGKEEEKRRLGGEKEKVKERRRKRIREGGRGGEEKEEEEGEQEERERRRWRRGEKGKGGGEEERRKRRKKGEGEKEEEEEERRRRKGGKGGRGEQKEEERRRSGGVGGEEEEEERSRRRKRRREGG

SEQ ID NO: 926304 - protein, 165 aa, Homo sapiens
MGGQGHQKGKEREIEGNRQVGIEAKRATRQDPPLEMLIEGPPRWLATKEGKILSPAANQWKLLKTLHQTFHLGIDSTHQMAKLLFTGPGLSKTTKQIVRACEVSTTDSWTGLLAHALMLMTSKAPLLKKSQPHNPYYAPVQQEAVRAVIGPPPQQHLGFPVEKGD

SEQ ID NO: 926305 - protein, 156 aa, Homo sapiens
MCHNAPSVQHQGAESINMSQYSLSEGPKNEDCIISVRGPELCTHTPCSEQGPGMRGGSHNIDDVPSDMPQLILWTGLCNKGESHNLADGHRDTSQCIYLLSLRTGIRQKNHISSGLCPGIIYSPFCDLSPGRKGDSHYLGVGARGMSQCHLLANMK

SEQ ID NO: 926306 - protein, 146 aa, Homo sapiens
MLTGPGIVPSAESDWCGTPVKQIHQALDGSPNSREPELGLERHETGRPDSSPLAMSVVHKKALAWPCLKLPRQFSLCHVYSLPQGICFGRPDGYRLAMSEVERMVLAFPRLRPSRWLWLAAVSFSLGVTNQEREKQGGRERERETE

SEQ ID NO: 926307 - protein, 148 aa, Homo sapiens
MLVVVERERRVNKKYKDLVPSKNAENSETFLSEGNKIISARQYCQSIPKYLRVFSFFRYVVVSAPVHNDSEVYLREVEENRPTTYVKNLSSAKPDPSAKKVGDNCPTLYSACVLQCTDIRNAAPHITMHRTATDVSRAEVKEACLEVK

SEQ ID NO: 926308 - protein, 746 aa, Homo sapiens
MFQGWILLLLGSPLIHAEPLYILVTPRVLRVGSPESIHIQAHSDSRQPLTRTLKVNLTVWDFPMRKTVLARSQLILSPGNNFMDQAPVTVPESLMYLPKPGQQYVIIRATWAPTSGSSFMEKMVLVALHAGYIFIQTEKTIYTPEYLVHYRVFTVNHKMDPVTRTFTLDIKVVFPDEGLGTWTIEASYQSTPKQKFEAAFDVKEYGPELDAKCWVLVLQPFGLDRATKEGAGLGGDEGAEQISEGLGHVSLQKDTLMAAFQGPGEDFIGGSIFVNVTMFSSGGEMVQAETSGVKIIQSPYNIKFTRTPQYFKPGMPFHFRIPPQVFISNPDGSPASRVLVHSQDQKVYTSAEGLATLTINTDANLDKLPIEPEEQASAKMTAWPYLTQDGSGNFLHIEVKTLGTEVGSSIQLSLNTRHQDPKTKDKITHFTILLKVGLKNDRFFQSLEPNSQVELKVTGDAEATVGLVAVDKAVYVLNSKHKLTQKKVWNVVEEHDIGCTGGSGKDRFAVFKDAGLDLKISTGMDSLASSGTGFGADEEEDFDDLFLDDMPVRTLFPESWLWRKFTLPKSKSGISHYPISVKVPDSITTWQFVVVSLKAGQGLCVSDPFELTVMKSFFVDLKLPSSVIRNEQVQIQAMLYNFRDRQAKVRVEFPHKETLCSASKPGAPSHQVVVVPPTSSKIVHFVLLPLETGKVDVEVKAVGYGVQDHVKKTLLVRVMGTPNSLAAGADSGASTRSRLGRWAQDR

SEQ ID NO: 926309 - protein, 134 aa, Homo sapiens
MEKNILHCNYLGVSELLSRDLMVLQRAVFPAHTLSLACLHVRCVFAPPLPSVMIVRLPQPCGTGGGTARGKGRRLGTVLCLARGNKRKSLAQRVHRGKFWDMDHERSFGFLEKSLNVPLRSFDFFLEPLEPWEI

SEQ ID NO: 926310 - protein, 134 aa, Homo sapiens
MRSMASPRQMRFPGGTGEGRRKGRTCTGHGDVGVSGLTTPLSLSCLIGTSGLMTKVASKLSVPDEVVGDTHGHDVYQSLYFVDDGICVGHLDPVIHPWEPVTGASSGLDAEHAGEGQGTVNLAEELIIKCSVMM

SEQ ID NO: 926311 - protein, 506 aa, Homo sapiens
MAFKGWSAHPGVVRAQHLTRLAEVIQKHQRLLWTLESLVTGRAVREVRDGDVQLAQQLLHYHAIQASTQEEALAGWEPMGCTVVALVPPASPAPLLLAQLAGELGPFPGILNVLSGPASLVPILASQPGIRKVAFCGAPEEGRALRRSLAGECAELGLALGTESLLLLTDTADVDSAVEGVVDAAWSDRGPGGLRLLIQESVWDEAMRRLQERMGRLRSGRGLDGAVDMGARGAAACDLVQRFVREAQSQGAQVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVKDDG

SEQ ID NO: 926312 - protein, 169 aa, Homo sapiens
MGPTLNHLNNLLRLPFGCGEQNMIHFAPNVFVLKYLQKTQQLSPEVERETTDYLVQGYQRQLTYKRQDGSYSAFGERDASGSMWLTAFVLKSFAQARSFIFVDPRELAAAKSWIIQQQQADGSFLAVGRVLNKDIQGGIHGTVPLTAYVVVALLETGTASEALYLLPIP

SEQ ID NO: 926313 - protein, 211 aa, Homo sapiens
MGTGSSSERVHISTPNKYEFQYVQRPLRLTRFDVAVRAHNDARVALSSGPQDTAGMIEIVLGGHQNTRSWISTSKMGEPVASAHTAKILSWDEFRTFWISWRGGLIQVGHGPEPSNESVIVAWTLPRPPEVQFIGFSTGWGSMGEFRIWRKMEVDESYSEAFTLGVPHGAIPGSERATASIIASSAFSMPIHVLGIEEAQELIPTPPLRDS

SEQ ID NO: 926314 - protein, 138 aa, Homo sapiens
MHGCIFRFAGILGAEDAKLLGFHACPSEPASIPPRLHTAPCFRPKAMAELTRGPPDLQVAKIRGRSMVSRAESHNHSPPPLAVSGVAPSSVPHLGGPSPHLLFLTPCGSSCLASQSQCKNLDTSTEGAEFTRSFYCSP

SEQ ID NO: 926315 - protein, 155 aa, Homo sapiens
MCLLYTETPHFLEWVFCSHTGTKTLSPYIQFITKVIYSGCKRCNQLLGYDPDIIRIPLSKKQFEAVLRLSIYLQIAFSDYTGQIEHELPANKLLHFLSHMPVILPTKIVYSPIPNALTLFTDGSCKHGKVTVWWRPHHSVTQSGLTSTQRAEMGP

SEQ ID NO: 926316 - protein, 190 aa, Homo sapiens
MIPVQKCQKAPSHIPRALWPGLCIVAITSICPIVPCLPCGLYVTPCLPLVPPWLDVNWPVNLCPLVHVLTVSPGPVFHALCHGTLCSASQGARVAWDLGPVDLAWFQSSAFRPALAYHSCLWASSWFHHIPGAVAQIPNPTPPPGSPTIGPNWPSGPPFAQKRVAPATLRTTLPRQNKPDPVAKINSLKV

SEQ ID NO: 926317 - protein, 152 aa, Homo sapiens
MVWLCVPHRNLISSCKRGIKKDQVASCHLPFAFPFHFPQPVTLLSWWAKSGTFRKITAECLGQGLRGGVGVPEDKHHVLNYSWELIIKTIELMKAKQKEEAPLYRDRVRGAPSGERKPQVQRKTVGYIRRLEEAVPDFHMTQGIGLTSCEDI

SEQ ID NO: 926318 - protein, 134 aa, Homo sapiens
MDSIGFEVLKSDFGYCVESGWTGRSERLRASEEAAEELKRQSKGDSRATALSSALGPFSPVLERTLLNPFSKHPPLLVSDHCPYLTKCQIADPQHVVIMACLQQESCIFAVATEGTKPQSCSPELAHGIYICKK

SEQ ID NO: 926319 - protein, 135 aa, Homo sapiens
MPLEGGPDCFCLICIVLIVKPFFKKNLFPSYTKMTPTFAHQSPLDVSFPFPPLFTDSSLQTILVPKSDPVSPPPVAAHAWRGRKNEEEWGGRERMCECVSIRVGKVHLTRRPAFVSGIVLEAATLMVYCIQEVHA

SEQ ID NO: 926320 - protein, 141 aa, Homo sapiens
MTFKDRVQAVKPVTVCSGQSGNWQGSCPPPSCRGTAVISPHCTAAVCISPNAIPPPAPAPTLQQALVLQEFEEERSVRTRDFQASWKRWGRTPCHPMKCGTAFRTSSCPGNKKNEYDYGAAFHTVTHDPVSQTPLLWAVVM

SEQ ID NO: 926321 - protein, 137 aa, Homo sapiens
MATWASQCVPGLLHPSNIHSILINAPVLCTKHCARLWGHSTLLFHRGEENGPHLLLRFGVCVKIKPDNACEVLSSRPGPELLPNVPETVDLGLAKADTRNDCTYLGVKNTGTETKYRAYGDQQVPIQEDNTEQRAWR

SEQ ID NO: 926322 - protein, 157 aa, Homo sapiens
MGRAAVAWTSDGRQQPRDRPQTCPEFWIGQLMWSMVGLADGVLEQSALVPGSACEQCWSVFSVFGLVLEYTGMGLATGSAGLSLDPESVAVGLVPGTIEAGLKAWVWFGLVLGWAWRLVLLGLACSLVPRKLTWSQGPLGRPDVEAADLVLGSTGRA

SEQ ID NO: 926323 - protein, 125 aa, Homo sapiens
MPSSGTIFLSWLWPEAIVQTPFSWTQRLEGVYLSLFLNEVKWASRWELYWKTGPCEESVTLRIRDELLTLLSEGLIVCYTLNNSSSNSSNNKHFLHFSSIISEVLLPYAVVTLVEKWCSDTGKRR

SEQ ID NO: 926324 - protein, 161 aa, Homo sapiens
MWGDTPYILHPRRVFQDPTKWVAYVGATYLSGSEASTVRAQVVQIVKHPLYNADTADFDVAVLELTSPLPFGRHIQPVCLPAATHIFPPSKKCLISGWGYLKEDFLVKPEVLQKATVELLDQALCASLYGHSLTDRMVCAGYLDGKVDSCQVRATEPGVPE

SEQ ID NO: 926325 - protein, 146 aa, Homo sapiens
MALLTPGPPLTFPSHSHLNRFLKGPLHRVFPLPETHCHSFTTHGFGLTSIYPPGLGLTDGTRSSRGVWRLSATGLGQRADDPGDPLYYHLQGSGFSCPQLRTLCCVSVLDGPGGWLHVNFSFASFWLCYEALSKFFWPLRKWGFPR

SEQ ID NO: 926326 - protein, 272 aa, Homo sapiens
MSSDITQCPRGSVKSPWEHLALVTTTDVPDIAHVTGPQPCLSTLSTNQHLEVGWELPVTASASFGSGDRATEGCELAQPQVTLAVGGPPAWSRDPPRHLQTELDGPMNTDLAAGKMASAACSMDPIDSFELLDLLFDRQDGILRHVELGEGWGHVKDQQVLPNPDSDDFLSSILGSGDSLPSSPLWSPEGSDSGISEDLPSDPQDTPPRSGPATSPAGCHPAQPGKGPCLSYHPGNSCSTTTPGPVIQVPEASVTIDLDVGNSRSVMIYSID

SEQ ID NO: 926327 - protein, 251 aa, Homo sapiens
MMKQLPPAPPNTLNFNGAHRKRKTLVAPEINISLDQSEGSLLSDDFLDTPDDLDINVDDIETPDETDSLEFLGNGNELEWEDDTPVATAKNMPGDSADLFGDGTTEDGSAANGRLWRTVIIGEQEHRIDLHMIRPYMKVVTHGGYYGEGLNAIIVFAACFLPDSSLPDYHYIMENLFLYVISSLELLVAEDYMIVYLNGATPRRRMPGIGWLKKCYQMIDRRLRKNLKSLIIVHPSWFIRTVLAISRPFIR

SEQ ID NO: 926328 - protein, 143 aa, Homo sapiens
MDLIVILPASPALTPRPGVGASGTGRDRRVLLWNVQREVVQAVTALARQATQRPPMATARRRSPSRLRPLVADARKVFSEPRAFASQPLVLQAGVIVVVIVGIIIIIIIIIIIINSYLCNWLRDRCVPEAGLMSIGSGTTADC

SEQ ID NO: 926329 - protein, 155 aa, Homo sapiens
MPFSTWLLHSFCFHDRAPVTKGLLTNQPSHLLLPMTLHVFLCQPTYFSIQSKLPDSPPEDTGHKRCPFGDEQTQEDLTISFKSLLSVVQARELDRIPVWPSKQLEKLQPQSNEKLGKYLDTEKLHVYPGRNYTFIVIFTSKHYSLSAVIFYENFY

SEQ ID NO: 926330 - protein, 160 aa, Homo sapiens
MTMKKKQKRKKKKEEEEETTMMTMKKKQKKEQKRKKKGEEEEKEEKEEEKEEKEEEKEEKKTTMMTMKKQQKRKKKKEEEEETTMMTMKKKQKKEQKRKKEGEEEEKEEKEEEKEEKKTTMITMKKQQKKKQKQQQKKNKRKKKKNNHNNKEEEEEEEMK

SEQ ID NO: 926331 - protein, 200 aa, Homo sapiens
MPVSPEYSTFASMKADTRTRDKEATQLTWTKLPQGFKNSLTIFEEALASNLKAYTLPNDNCALFQYLVATYPQGFKIWMNPITPIIRLCHPNIIWSVINASATIAPKDEAFYKFLKPWLGDGLLVNASDKWSCHRQMLMPAFHFNMLKPYMKFFTDSVNIMHVNSLNPEFQLKPWGGGTTDRSGLEFWLCWVAFSIAFPL

SEQ ID NO: 926332 - protein, 316 aa, Homo sapiens
MPSQNYSIISEFNLFGFSAFPQHLLPILFLLYLLMFLFTLLGNLLIMATIWIEHRLHTPMYLFLCTLSVSEILFTVAITPRMLADLLSTHHSITFVACANQMFFSFMFGFTHSFLLLVMGYDRYVAICHPLRYNVLMSPRDCAHLVACTWAGGSVMGMMVTTIVFHLTFCGSNVIHHFFCHVLSLLKLACENKTSSVIMGVMLVCVTALIGCLFLIILSYVFIVAAILRIPSAEGRHKTFSTCVSHLTVVVTHYSFASFIYLKPKGLHSMYSDALMATTYTVFTPFLSPIIFSLRNKELKNAINKNFYRKFCPPSS

SEQ ID NO: 926333 - protein, 156 aa, Homo sapiens
MGFLAEATPELGVGGRPSCMDDTWRCPLWEVQELGPLAAVSGLSDVIRGLAANLNSEHSQLHATLPSGRGERFVVFEDVAVDFTLEEWALLDSAQRDLYRDVMLETFQNLASVVKQYEYNTYGKVFMHRRTSLKSPITVHTGHKPYQCQECGQAYS

SEQ ID NO: 926334 - protein, 134 aa, Homo sapiens
MARRTLEGTVGFRSWTPLSPGLFLVGWAWSISNSSPEGKGPFIDRAAVEVPAGRVPGQHPDILAKKEPYGGRNDAGAGQSHLHPRQVFHLGPVNSTKLQPKCKEFKSLKREIGFTAFIKMIWGLCYDSITPNPQ

SEQ ID NO: 926335 - protein, 150 aa, Homo sapiens
MSEWPERNPMEGLSMLFIREQTSPPPPDIEIVSNKSCSIPSISEQSGKGMRVATHSEGPEDETVKLETGRCSLSVWGKQIQAAMRKPRKQSERNQSPTGVMWPQQSPGESQLSRGLCGWAGRGHVLEGASLELVVCRTCPSDPRVAVEEC

SEQ ID NO: 926336 - protein, 155 aa, Homo sapiens
MPGQAYSAQYSQTVSHPSTNQAPTLLSFQDQIRPGTFRKRFTILDAIKNICNSWEVLKISTSTRVWKRFIPGFMNDFEGFKTSVEEVTADVEIARELELEVEPEDGTELLQSYDQTWMDEELLLMDEKRYNHHCDQSAAINIKAGSPTSKKSMTC

SEQ ID NO: 926337 - protein, 175 aa, Homo sapiens
MIFLGKPSRSKSDLRSQRPLQSLGFSLSPSALSHTWSPRVVMLQENGPDPEPKKGFLDFAQERIQERNDFSSSALAVLVSTVIWRPQSERKNREALAGGGVLQAAAWTSSRPQITISCQRALLFTLPPALPWELSFKTPKNYLKAREQRGIGLHTANATLQGIEPPHCRCHPPGH

SEQ ID NO: 926338 - protein, 182 aa, Homo sapiens
MRPAALLWGMMLPRLEACAPLSQETTYPQFLHIWVNEETKLVYFQGTKDTPLEHHLYVVSYEAAGEIVRLTTPGFSHSCSMSQGTSQLQFASCGASKLAGLCSGRALGRSSVERAQRHPVELITPFHPQNFDMFVSHYSSVSTPPCVHVYKLSGPDDDPLHKQPRFWASMMEAANGPGFELQ

SEQ ID NO: 926339 - protein, 150 aa, Homo sapiens
MNKRTNSATWPGLLSPLAGQKQPRLLRAWHGSEVLVKLMGVFAVPPLSADTMWIQVRTMDGRQTHTVDSLSRLTKVEELRRKIQELFHVEPGLQRLFYRGKQEKSTETSNACERKEQREDSQIDTLGWRLALESIGSGLLNFFFQSSASK

SEQ ID NO: 926340 - protein, 134 aa, Homo sapiens
MPAESFFSAQLKTQDFSASGLRFLLDYRVQEPVDFRPVTFQIPQLKVCWSLLEVHSRPCLPGYHQRRCKTANIAEQQILLLILPLEALSQRGTWLYEVKGKSPNPLYFLSEAMPRPALAGSPRAAPTFRAVPMR

SEQ ID NO: 926341 - protein, 154 aa, Homo sapiens
MATRIRFLRKISMRMTITSMMQSIITLNRKKKISLNIPEEGIIIIGDDSSMFFIVPEDLPVGQDVEVEESDIDDPDPVIPRLENSIKLCIFLKVHLFTFPMADSDLLNGVCVEGSYETAGEIIDNSKQVAEEMWNHLNSGKMMRMQFPDPDEDG

SEQ ID NO: 926342 - protein, 155 aa, Homo sapiens
MAQRTWSWVTYCFRVHSQDQCQQACYLKQGQMWFLVRPLVDGAGGKTKAKWGCSRVHRGMELFPEKTPKIDREVTDIVAKEGGNWEACMESPSTKTSSWPSTGPKEGVSKGTPRHHTPNTTLWDPRDKRSHYPHRHLNWQEELLRDQTEAEIEPA

SEQ ID NO: 926343 - protein, 177 aa, Homo sapiens
MDATTEHNPVSRNIYFASIAHALPLARLYIWLCSSTCRPVDGADGGPRPPHSLPGLGVGVSEKHLAKASVSAGVGQLYRGPATAGTRLTVGFQVGLSGASAKFLGGSVFSWRPKEDYGGSPVARIVKVCDGEVGPGASHLIHPFLGVRASLHSTPSQLRRLPGSTVPCFPWVPLVLW

SEQ ID NO: 926344 - protein, 142 aa, Homo sapiens
MNVDSWLCSPEEEAPKADTGSFWCLRAAGSGLLHSGAQDPTMTWQMQAQQMRWAAEAGASWRISDAEGPDVQCRQLKVHLLGVGPGDRNGKTVGCPLRELRAGEKDIHTIQDQSLNKDPFADSNGLHRDLRFNPPGQSLVPI

SEQ ID NO: 926345 - protein, 157 aa, Homo sapiens
MNEQTCQRFPACSSSVSSCQDGAGSGPSGKGDALPDPGSPSGAPAARTRLSRHQRRPGIYEFAGAEASCRLQPSQPRKSRSPRGDSLPRQPGPRVPQVRPVLPGRPTPTRPPHQGVAREGGPRKVMIRLRRATSEPATRSPGQPQNKTRIPELQWAF

SEQ ID NO: 926346 - protein, 381 aa, Homo sapiens [sequence omitted]

SEQ ID NO: 926347 - protein, 200 aa, Homo sapiens
MAISVRRCRSVNTRRCFLGCRARSFCCSCSLRLQAAGERRAGGRAGHSATVWPAGERQEAHAARRMRRRGEGTRWGKANAHKVPGRAQKQQECRERRRGRQRGTQGRTETETGKQQGQQGDNRKVQDAARGRWRQNGRRGQAGKADAVGVGGGQRRGHSVSAPLQAWLPPPPAPFSMEPTQAPPKPHTPQTPSYPQTLPT

SEQ ID NO: 926348 - protein, 588 aa, Homo sapiens
MVTPVTWMDNPIEVYVNDSEWVPGPTHDRCPAKPEEEGMMINISIGYRYPPICLGRAPGCLMAAVQNWLVEVPTVSPISRFTYHMVSGMSLRPRVNYLQDFPYQRSLKFRPKGKPCPKEIPKESKNTEVLVWEECVANSAVILQNNEFGTIIDWAPRGQFYHNCSGQTQSCPSAQVSPAVDSDLTESLDKHKHKKLQTFYPWEWGEKGISTPRPKIVSPVSGPEHPELWRLTVASHHIRIWSGNQTLETRDRKPFYTVDLNSSLTVPLQSCVKPPYMLVVGNIVIKPDSQTITCENCRLLTCIDSTFNWQHRILLVRAREGVWIPVSMDRPWEASPSVHILTEVLKGVLNRSKRFIFTLIAVIMGLIAVTATAAVAGVALHSSVQSVNFVNDWQNNSTRLWNSQSSIDQKLANQINDLRQTVIWMGDRLMSLEHRFQLQCDWNTSDFCITPQIYNESEHHWDMVRRHLQGREDNLTLDISKLKEQIFEASKAHLNLVPGTEAIAGVADGLANLNPVTWVKTIGSTTIINLILILVCLFCLLLVCRCTQQLRRDSDHRERAMMTMAVLSKRKGGNVGKSKRDQIVTVSV

SEQ ID NO: 926349 - protein, 141 aa, Homo sapiens
MRFPLSRSLGLVFWSILPPSQQCIHSKASESPVEPAPPLQYPPKGVLSPPFLDSERSWPPHWGTESQAAAASRCPVTLHPTQGCHTKIRCLIHRPSKAPQADAGFPAQNWNSFPNARTRPTSGARRGTHGPAFRGEADAAS

SEQ ID NO: 926350 - protein, 149 aa, Homo sapiens
MVQRQPYESVRERAVCTCDHPDPVPSPLTLSCCSHCGETGPTPPLTPAHLRPPVHSHFLRSPPGPASPGLTPVRRENIKHRPGLHTGGPRGCSVEAPWTDGEAEALSTGPPRPPRPCVDGRQLCPGTLSPLDMAGRMDFRSHLSIWQLY

SEQ ID NO: 926351 - protein, 295 aa, Homo sapiens; identical to SEQ ID NO: 796404

SEQ ID NO: 926352 - protein, 183 aa, Homo sapiens
MAAIASAASPPACGTAPRSLPQHPGQGFIGVRCILEVAAGAPQSGFQSLGGCAERPEGAVGGKIYQWGLRFPGSWRKVLALCLLGSSNPSPCYQYLRGQACSPGLQAGWEPLAQALGLQPRVGGGQMQGRAPLRRRHRSAESDRWLIEHFSSFGDFCGFSVNRSLGPRSHRPGAEEPPPHDRR

SEQ ID NO: 926353 - protein, 154 aa, Homo sapiens
MDALFPEQRGVKTHCVLGVPPPALEPGAGRILHAHLSGGQRLRRCLGQTRGLGWGCPDLDPHPYSQGAEMGRDSSWPPPPARRCWGLWAGSPGVVAAAEGDEATLIPACSSRSNQGRSIAEAAAGASLLLLWGGGWVRGSQNWGQSVLSAVWPS

SEQ ID NO: 926354 - protein, 309 aa, Homo sapiens
MKSWNNTIILEFLLLGISEEPELQAFLFGLFLSMYLVTVLGNLLIILATISDSHLHTPMYFFLSNLSFVDICFVSTTVPKMLVNIQTHNKVITYAGCITQMCFFLLFVGLDNFLLTVMAYDRFVAICHPLHYMVIMNPQLCGLLVLASWIMSVLNSMLQSLMVLPLPFCTHMEIPHFFCEINQVVHLACSDTFLNDIVMYFAVALLGGGPLTGILYSYSKIVSSIRAISSAQGKYKAFSTCASHLSVVSLFYGTCLGVYLSSAATHNSHTGAAASVMYTVVTPMLNPFIYSLRNKHIKGAMKTFFRGKQ

SEQ ID NO: 926355 - protein, 269 aa, Homo sapiens
MDHGDPELQPILFMLFLSMYLATMLGNLLIILAVNSDSHLHTPMYFLLSILSLVDICFTSTTMPKMLVNIQAQAQSINYTGCLTQICFVLVFVGLENGILVMMAYDRFVAICHPLRYNVIMNPKLCGLLLLLSFIVSVLDALLHTLMVLQLTFCIDLEIPHFFCELAHILKLACSDVLINNILVYLVTSLLGVVPLSGIIFSYTRIVSSVMKIPSAGGKYKAFSICGSHLIVVSLFYGTGFGVYLSSGATHSSRKGAIASVMYTITYIT

SEQ ID NO: 926356 - protein, 221 aa, Homo sapiens [sequence omitted]

SEQ ID NO: 926357 - protein, 128 aa, Homo sapiens
MGYTHCDIRSNISKNIMKNITGCTPSEYIAYDIRSTPPVTFCTPQVTLEVTLGVHMVYIPCDIAEAPVQPFRGRKFMDRKRKVTYKRMEVKYTNSWMGYLSAFDEFEYGLKGWPALMAQKQQISKISL

SEQ ID NO: 926358 - protein, 142 aa, Homo sapiens
MYLVTVLGNLLIILAISSDSHLHTPRYFFLSNLSLADIGFTSTAVPKMLVNIQVQSNAISYADCIAQMLTCSDTHVNYILLYVVAGLLDFVPFSGILFSYTQIVSYILRISSTDGKHKAFSTCGSHLFVVSLFYGTGLGYLP

SEQ ID NO: 926359 - protein, 192 aa, Homo sapiens
MKEDSDIAFHFRVYFGHWVVMNSRVNGAWQYEVTCHNMPFQDGKPFNLCISVLADEYQQQSASPSTLPFLEFLPRWQNDSPFPSIRAEITCFIANLENHLAETTCYLQTNEGRLSKVLSNSLFFHTAQVRHHFDHPHPLSPCSLPQFVHLQPYSWVCSSPTRIQPNTQIPEVPTHSQCYSSFLSSTFHSHME

SEQ ID NO: 926360 - protein, 144 aa, Homo sapiens
MRGKSRASHPLAHVRLGIQNQPGVTESQVWLARLASSSPKTLPFTGFPGNHGNTGRGMGDPWPFYKLKALLGSASCRSGAARNSRQGWQQVTVTAPETRGLLCCGTTGNQTEPLAPPILLPLYCSLMFTAAKSGRARGVRALVV

SEQ ID NO: 926361 - protein, 181 aa, Homo sapiens
MCRICKWIFGALCGLLWKRKYLHIKTTQKHSEKQIYDVRIELTELASSGVKLQTFTVSVTALKAVHLEFSIPPSGLVVSVTSGVKLQSFTLSVAAHKGSVDTKRASKHSKYPFEDSTKRLLPNCSTRRKVQFCEMKAHITKGFGRKLLSTFYVKILLFHLRWQRAQKYPNADCTKRRFPNS

SEQ ID NO: 926362 - protein, 161 aa, Homo sapiens
MTEAGSPGKFLIRRVAQSGECFYCIVLLFYYPIAFYYQRTLFYEIRPAFWRESLIFMKACGMLLTITPAFQLVSPQPGFHSTLQVASLGDDVRASRMDDDVQGDSSLLYPSHRKEELSLMVPSWEIRGFAVQVGTKSLQTSSSADFERSTEHCKSRFLFQS

SEQ ID NO: 926363 - protein, 235 aa, Homo sapiens
MSWLTLCVNLTGLRDAQIAGKTLFLDVSVGVFLEEDIKLPGPHAFSLRLNDTTSFPASSAYGQHVVGLLSLQNCVRKVLIINLCCLHTLMKQSYPVAENFHGKELRGGFWPRVSKELNCQQHHEINRTLRWPQSCWPLDCSPGETLKLKTQPGCAQIPDSRKSQDNKRVLSEAAPFEPLTGPGNLEMNPSELSALLRSSLHPGRSCSLVTVTCDPCADPLDHRCTFSFIQITLTF

SEQ ID NO: 926364 - protein, 126 aa, Homo sapiens
MTEEKHEHRDACSGGSSCGRGDHRALQDRQTHGCGHSEPAAARPGTHSCGPTGRETAFPWAWLWFSLGGGAQEDPRLSGHMSLCSPPLPQVTVSAAGGTGQAPVESGLGVSLGGLLSQEVTAGSQS

SEQ ID NO: 926365 - protein, 144 aa, Homo sapiens
MRVEKIYTYICTCNYICACTYTSAYTYPVLTPAPNPTMHLHLCLHLNLCYTYISAYTYNCATPKPVPAPTLCYPYTCATTTLCYTYTCATPTPVPAPTLCYAYTCAYTYSCAYTYTCACTYTVLCLHLCLHLNLRLHDFCNILY

SEQ ID NO: 926366 - protein, 194 aa, Homo sapiens
MAVCAREAVAAPGSPDEGPRTHWLWSLEGGAGGGAWRGRRAGRARSRCAGAGAGAQPSVAGGFWRACGRRATQSVSDRARIGVRAAWFWNFLHFRTRDEQTSARRNQSGSLRTRTSRRGFRNGGPAPESPRREAGSGEMKPLVGWVIKLSIPGKGQVHTMCTWMWCPKQDTASLNPASNAQPISTYEEISDKPK

SEQ ID NO: 926367 - protein, 207 aa, Homo sapiens [sequence omitted]

SEQ ID NO: 926368 - protein, 658 aa, Homo sapiens
MGIEEFSLERRSLLTFSSDVQGLLTTGFEQSDEDVLWCIEVSDEGVLWCIEESDENVLWCIEVSDEDVLWCIESDEDVLWCIESDEDVLWCIEVSDENVLWCIESDEDVLWCIEVTDENVLWCIEVSDEGVLWCIEVSDEDVLWCIEESDEDVLWCIESDEDVLWCIEVSDENVLWCIESDENVLWCIESDEDVLWCIEVSDENVLWCIESDEDVLWCIEESDEDVLWCIESDEDVLWCIEVSDENVLWCIESDENVLWCIESDEDVLWCIEVSDENVLWCIEESDEDVLWCIDEDVLWCIEVSDEDVLWCIESDENVLWCIESDENVLWCIESDEDVLWCIEVSDENVLWCIEVSDEGVLWCIEESDEDVLWCIESDEDVLWCIEVSDEDVLWCIESDEDVLWCIESEEDVLWCIEVSDEDVLWCIEVSDEDVLWCIEESDEDVLWCIESDEDVLWCIEVSDENVLWCIEESDEDVLWCIEESDEDVLWCIEESDEDVLWCIESDEDVLWCIEESDEDVLWCIESDEDVLWCIEVSDENVLWCIEVSDEGVLWCIESDEDVLWCIEVSDEDVLWCTEVSDEDVLWCIEVSDEDVLWCIEESDEDVLWCIEESDEDVLWCIESDEDVLWCIESDEDVLWCIDEDVLWCIELPSFGSYA

SEQ ID NO: 926369 - protein, 150 aa, Homo sapiens
MAESLLQGLVHIFLLNLSSQVYTIPQITIPIGPRCGQGVTVCGTTNLAALYPYPRNLWNFELESNNLGYLAEEISKQQSIQDWAWMLLTAYLIWPGHVVVKKSPFSGEEFKRTAEICISKKVPSANHQGNGEKASKAFHSSPSHQRLRGL

SEQ ID NO: 926370 - protein, 142 aa, Homo sapiens
MNKGLSQQNYCPRAPDEPGWEIQRPLLTAIDSATLPACCVGRGSLAETASSGRNYCQLHWDILYFSGNPKPETRWYAKSRPADLPTKEECKGCHQKFLWISVKLEAGIENPKRISQHIAYFQVISTVYVAVVQVGIHVPRTK

SEQ ID NO: 926371 - protein, 152 aa, Homo sapiens
MLPPFALSRIYGKAWLSRQKPAVGVEPTWWRTSTRSVWIKNVVLNPPYRVPTGALPSAAVRRGPPFSRSQNGRYTNSFQPAPGKASGTQHQPLRAALGVEPCKTTGMEMLKVLGVYLLHQCALNVGHRVKGDYFGALKFNGCPAGFQTCMVL

SEQ ID NO: 926372 - protein, 127 aa, Homo sapiens
MACTTLGLCRAVDFPGTEFHDPPKHDVAAVSHTLRNRRVVKEKRRRRGRRRKKKKKEEGEKEEEEEQEEEEEREEEEEEQEEEEGGGGEEEEEEEEEEEEEEEEEEEEEEEEEKKKEKKKKILRAKF

SEQ ID NO: 926373 - protein, 146 aa, Homo sapiens
MRTRRLSKPVYPTFCRLLFLATLAADWMVPTHIEVSKLKKYKYTQRSNVCCTLGPKQFPQEFAHDGRWLFKHCNSYVSFNSTDISKHSNTPSKQLSHPISGSQSPEYLWVFEDSNSQVQNPLSKEWLKVITVTHGVFPTTLCHVIF

SEQ ID NO: 926374 - protein, 146 aa, Homo sapiens
MSLPDSSEESSGSPSTAFKLQKAENSKNQNASPPPKEHNSLPAGEQNWIEKEFEELTEVGFRRSVITNFFELKDHVLTHCKEAKNLEKRLDEWLTRKNSLEKSFNDLMKLKTTVQELREAYTSFNNRFDQVVERISVIEDQINEIK

SEQ ID NO: 926375 - protein, 160 aa, Homo sapiens
MRGPAQAKLLPKSAIQAFAGLVRPLVLALLLVSATLSIVVSWTDSLIQTVLNSDISTPNVNALTHEKQTKSSISQISTTLPPTMNTEKSGGASVAPHPSPTPLSQEEADNNEDPSIEEEDLLTLNSSPSTAKDTLDSGNYGEPDYGTDYGTRLLDHGPQG

SEQ ID NO: 926376 - protein, 502 aa, Homo sapiens
MGPGRYITRGIPGVDASVHRALCDEKALEQDLPGVSRGSSEAAASGPGTHQLLGLQAWGRFPSLCAWASCLLKQGDGSHPHRAVLQCLLVGKFRGKEKTKGEVEQHRAEELLQILARSDHINGGSQAGSEQEERLPGRRKQLLGSSQGLIWPVPVGPGQGTVHRAETQGAHRHCCDGNCRADLPPLCPGLFYSPGTLRTRHGPVGVPDMMSAQELVACLCREGEQHLALGELPLATAFYLAAFSCHAPSALQSVRTALAQARGAAVVATLESWCRGDSQIPAIHWDGMAVVSLTGSLASAFLGALCPDHPAAILHLLAGLLARGRHEEVVQRCSALLDSHAQQVLELRLTRALAWVLSGVQAADGVAAYLQAFASSADRTVAFIRTHQRPHLPALLSALQDYLSGHPEAGHSAGQQETGGQRLLAALDPRGTRSDTLSPEALLHSGRFEDCLAACSRALEAHPTGSEPQGNTCPKNCASIRPKSLRSRDSPHRQHQHKHGLR

SEQ ID NO: 926377 - protein, 322 aa, Homo sapiens
MFESGGIKISLPGGREPNYRSARITAQAELPLSPNYRSGRIAAQPQLLLSPNYCSALMILDLHWLQDLPSLQGPRPCLQFRLTLQSPAAACAQMQHPGKGSWVDGPGGNQFLGDGPATRKRETPEAGRPVPGTLQPSHGQDDGLGCGHQDSRVSPCPGPLCTLASVFLVPLEGSHLQEPGETEGLAVGAGAILGAACVETSYVHGPRRARWLQIMFPICGAFKGWAHEDSAPSLLFLSSLHPPGPRILRMELLLSPENNCKMLFRFKWKNFAAKGREVIPLRIAQNGHSRCVATEKVLEQTTKVTAEDSAEAPSTESARIPK

SEQ ID NO: 926378 - protein, 451 aa, Homo sapiens
MITARPVGCITGKLSGCRGISTHAAISTHAAASTHATISTHAAAFIRAAASTHTTISTHTTITHAAASTHTASPPLSAELSCSSRDEDPGESVLSTLLPVSHLVATLVIRSTAMVPIRFLHCIHLHIVSMADTHTSHPLYTPPHRVHGGHPHISSTVYTSTLYPWWTPTHLIHCIHLHIVSMADTHTPYPLYTPPHRIHGGHPHILSTVYTSTSCPRRTPTHLIHWIHLHIVSMVDTHTSYPLYTPPHRVHGGHPHILSTVYTSTSCPWLTPTHLIHCIHLHIVSMADTHTSYPLDTPPHRIHGGHPHILSTVYTSTSYPWRTPTHLIHCIHLHIVSMADTHTSYPLYTPPHRVHGGHPHILSTGYTSTLCPWRTPTHLIHWIHLHIVSMADTHTSYPLDTPPHRVHGGHPHILSTGYTSTSCPWRTPTHLIHWIHLHIVSVADTHTSYPL

SEQ ID NO: 926379 - protein, 253 aa, Homo sapiens
MHGQPSRAVVTASEASPGAYGDSGMVPSAHTRPSPMPAAPAPSGASPALQPSSPAAQHRHRAASTTPAVPSSPAPPQSCQHHPCRTQQPSTATELPAPPLPYPAARHRHRAASTTPAVPSSPAPPQSCQHHPCRTLQPGTATELPAPPLPYPAARHRHRAASTTPAFTQQPGTATELPAPPLPYPAARHRHRAASTTPAVPSSPAPPQSCQHHPCRTLQPGTATELPAPPLPYKDSLVAAFKHVACSCHTRLT

SEQ ID NO: 926380 - protein, 145 aa, Homo sapiens
MQRGRGSGCRDSRYNRRLSVHWDGGLACRRTTGHPAQDTRPCEQQLLWPWPLPDMGYTWGAGSKLQDPRDSQWEEGPKLAEKGTGSVAWDRAPQSPCGEEELLRAELSQPQRVFPGWTWRCPASPTQPFAGRLGRHPGPGPTLTK

SEQ ID NO: 926381 - protein, 146 aa, Homo sapiens
MELQTGGAQCQKGIRTRGPQISPQDLRCRARLRDLLLFKYQKKEVAVKSFLQGVAGSPEQDLFLGKSSCGDRCWAARGFRAGVLSFSITTSANTTMTYTRVGLRPVHIIPHELGAPRHGPSLQNQYHLVLQVNRHKRLLVRKSWQS

SEQ ID NO: 926382 - protein, 152 aa, Homo sapiens
MDDTRGPRTAGLRTQCLACLAETPEHRAGLASWEVQAGQVPLQLRCSPRPPTLSAGQHHPCNEGPKLVVPWRGCPRPPFFPGVAPRLLEERSAPSPAPAWCPVAPGQSEPNNLLTPGLYFQLLEKQRETPRLSPAGRPGRQEAPAPLCSPRL

SEQ ID NO: 926383 - protein, 235 aa, Homo sapiens
MGTEGRQGPRRPAATPARETLPPLCPEPSCHHSMSEAPEDGILPGSFGANISDGMAQPDTPWLTHPGSHSHLRMRRVEEGGLDQPGTCGTRRRKPMQRVTPVAPPLPKEEGGPGTRSLDQPPTCTTRHRKLMQRVTPAWRRLDDSSSTGPQRQKQMGDLGDWGGGDSERPRSPFGVMRTRESDWTPVLLALAPGPRPAPCRWLRKQKPLRRPELLSTGKMTSDSSHWLQTDQHKK

SEQ ID NO: 926384 - protein, 256 aa, Homo sapiens
MQLHFRVVGVAIDLPVWVPKPSVDLKICMYDRLYQDSVLVHTRSKAALRLKFEVCKELRAHLELLPETGYIQAQSSYSVQLKFLPRGHVLVGSVREQEGGVMRLPALMFQRRRSSHGIHSLPEDAGRYFDKETRVLEAPMTIWVADQNKPVGFTVHAIVTTSDLELSPSEVDFGYCTIYEAIRTEISLHNHSLLPQEFGFVRLPKFVDVQPNDGFGTILPLETLQFCVIFQPTKAEEHRFQLTCKSEINRPQDFEC

SEQ ID NO: 926385 - protein, 140 aa, Homo sapiens
MVSNVEKIRCLLLWDGCCYWVTFWGGKAGDAGPESPHAPGWRPGRHGASLLLLLAADCRLACPLKSGYGVESRLSWSFAVATEDRSDYPSGPWLEMRITATMSYHLLPIRMDITKKSKNNRRWCGCGEREHFYTAGGNVN

SEQ ID NO: 926386 - protein, 140 aa, Homo sapiens
MFTPRSRPAVALAYRLAPPVHSACKGGGTWKTAEQRKVGLSPRERPADPALSRDTIEQSGLARKEVYLALELHFGIIGVWKVQDWASVSDEGLRLLPFLAEGRGEPRSCGERGSKGERRCWALFNNQFFKDLLEVEFSHP

SEQ ID NO: 926387 - protein, 135 aa, Homo sapiens
MGADEDNDERVGSQRASWGHTVFRFYIECVGKPFEQGMTGEPHLRLCLEEMEDSTIGKLTCLQALCPIHKCSAQLCLINASCYVSYAGPVVLKPECILENLPSQHICVLKCPCFLYDQFYRRAAIGKILKNSFLP

SEQ ID NO: 926388 - protein, 140 aa, Homo sapiens
MVFTLLIWPTELKIPGEGETVDEHQKQRRGRASRGRQQEGTWQDVGEEVQRFYAFPGHATFQKPPGVPLTGSPLIPVLLGFSGGFNTQALIKPLTIGHCDQLKPSTPLPSLDNVGGTESPNPPLILSLVFPVTSPHPEAS

SEQ ID NO: 926389 - protein, 155 aa, Homo sapiens
MLPNKCVSSIITPQYSYGSLLVLILPVAYLLSPSPLYCRGGRVIHPSPAQKGPKAEFLQKPLAQRSGLAGSSSNPHSIRGSPRRPFLQLPATLTDCFSCLGNEPFLLSMTKSCMAQVPEATLVTGGRMAVFSELHGELSVAFHPWRHLQKESLFY

SEQ ID NO: 926390 - protein, 139 aa, Homo sapiens
MNKPLTPPQLVSPALILKGNRFSCALSVNVAFALPSVWETHPCSHVGSAGVCSVFPLHLTRVQRGGADLRPRGTADPGGYQWTPGLKTRVENSSYSYIFKEGQMCELPSLGTSSMSCHHFLTTTNLGTRVRNFSSLLHG

SEQ ID NO: 926391 - protein, 162 aa, Homo sapiens
MNILTKCLLGIVFCSQVSEPGLEAIPRGYHLVPLKGRQHIQARPGAHSGTPTPGSIPTFRQEKLAHYGTSFFHFKLAVKILIKHGMLFIFRVSPSVIPAVCRKLIQAHLRQTGTELPWNHQCLRHGLRAGLVAGIGGSEHAATHSGIQRSWGSLNWAGVSFN

SEQ ID NO: 926392 - protein, 138 aa, Homo sapiens
MAQVPEATLVTGGRMAVFSELHGELSVAFHPWRHLQKDKTKSASIENKGTTGYGFRDEHVDPGRASGTQAKNFRCKRMKKISCFSVDLPSLWKTSLELLKVNLQRLLMKKAKNQRETGSWIQSCLKTQPWMYQLCNKI

SEQ ID NO: 926393 - protein, 175 aa, Homo sapiens
MAFTIIPAQGSVLASQTKGGEEKGVGRETWEENQCRERMRGGKSYICCHFLPGQKTSQMNLQHSEPARATALSPHSQAVHAPLGRAHAEGHPGWRKCLGGGPGACTRLDLPESHENWSEKCHAPRDFCFILEIKLDGACKVFNTRSGTWEVFKISKRCEYCCWWFHFILNVVKYT

SEQ ID NO: 926394 - protein, 151 aa, Homo sapiens
MINMPEASQGVGSRIFSIPCSLFATKKGREILRTKNGALFSHFHHLYPSPSDKGSSTRFEKNIEKKKNLETGQFGEAFGEPGVPKRPTRQLQLTRGLVREEGEAGRGISRTQLTGHQPERASWGLLAGPLPSPGSSPPQTSGLCTQTAACQ

SEQ ID NO: 926395 - protein, 139 aa, Homo sapiens
MLQSTMTPGLLLANPMPMSTQCCPTLQQPGKDTCLAWVALTIKTPDVPTFMEKPGMAQCPSEAAKILLCCHTILSFCNVTSWLTSSSAKRCRGALPGPPTLGNAFVLPYIFLDILTLLPGQKVIPKAPPQPLSWPTLST

SEQ ID NO: 926396 - protein, 142 aa, Homo sapiens
MALGREMENGRNLPGPLIQMPKLLIALAVPQATWTDPGVGGYVIGHGYGGGPTPPPWDHMEYQDYVSHAYMMPSVHPRTGSMFSSNILQGASPMAAFGGLLPLWSSWELVDAGEHARARCTLETSKSNLLVCSNEIKAIKES

SEQ ID NO: 926397 - protein, 115 aa, Homo sapiens
MLADYAEISRKRVATSRSLGHCHGKGQGVAMECGHGNGKLTWHNGRHVSRKAASTPPLFQLFLNLVQCSSPTFGVESHLLPQNHHHNQDLECITPKCFFMSLAPCFQSPTAPSEY

SEQ ID NO: 926398 - protein, 155 aa, Homo sapiens
MISSDSMSHTKVMLMQEIWGVHSRSPSAGPGHPPQITFYRLGAPTRRSPSAGLGRSLQITLCMSRAPTKDHLLQIWGIHPRSPSAGPGHSTQITHRRSPSGRSPSAGRGRSQQTTLCRVRPGGLRAAGTEVFGGDDTDTPQTSAGCPVSKCPAEM

SEQ ID NO: 926399 - protein, 119 aa, Homo sapiens
MDFSGKSWIWVLHPSPQPHLKTERKCFKRVAWGSWCVPCSQEDTGACGCLHLGDPEVADLSAEQERDSFSSLGTACSPEFTGMPPTGCAGINAFLQGTATPTERLPGDGPPGTQGLRPW

SEQ ID NO: 926400 - protein, 128 aa, Homo sapiens
MADSWEQGKEERWGVSILDVNLFIPFVVSPHLQPLNSKDNKTPISCRDRNGYFHGHTWKTRRLEKTWGWHLTAQYRCTAPRAEKGAVCVLPCFFRSSRKRPCYPPGANTKEEKGVFEDDRKVVHSNPK

SEQ ID NO: 926401 - protein, 179 aa, Homo sapiens
MPRGEGLLSHLHAALQSFIGFSSSAHTPHPLPFLCPSSMKMTCPKISARIHMDSNIIKVGSTALRIWRRVSCPCPPGPPSPGSEAAILSQPSSDPGRAETHTTLHDAVCPGHFCSPKISTCNVYVAAVNDEFLHFGNGQSESSRTIYRNFEMENTWNACFDWTLPGQSEDLRASGHVVG

SEQ ID NO: 926402 - protein, 135 aa, Homo sapiens
MKTMMMVLVTVIIVVVVMVLVRMMMVVVVTVVFVMVAMMMVVVRVIIVVVVMVVVTMMMVGGGGGGDGGGDGGGDDNGGDGGGNNDDGGGDDGGGGGGGGSKDGGDDDYHLLSSYSATQRSKGSQPSHEPSKIGR

SEQ ID NO: 926403 - protein, 171 aa, Homo sapiens
MGSRLDEARFNVQAAVRMGLMETVQVIGMKDRCPGLDMGIISILVIWANSVSWVQGHPSGGLDDMKLSQRKIMCGLAIVALQANTPCQWYTTINISVIPVAVGWLGLKAPTGGALLGSSAVSVWCSLSGPCRCLSIGFCKVPGAAVNSGGVSQQGSTEEVRIRNGLGTGHG

SEQ ID NO: 926404 - protein, 150 aa, Homo sapiens
MYSQNKGLLHKEGQLATVTWETKGGFSSSGGSGMPERGTLWLPLDDPLCTKHAGPGLKRASAVGLLDHTGPESLGEDDSEIQSGSPAVGAQETIRPNIPGLSTGLVAENWGISPGLKALKGPTSPLAVCISCPLQGASPKGRTGWKIWGS

SEQ ID NO: 926405 - protein, 141 aa, Homo sapiens
MIMNDCVTGFQIYHTIIVIVILGCTPSTYKKKLTVKQPQAGPSGRIPEEDIATTGEIRSKRKMNGKGSHQRTLMGKWPSENPKESWAKIQGGNGAKELDISHSLTHWQLSPWVTKCRHYLRLNSHVFFEDKGLLLKGSWRL

SEQ ID NO: 926406 - protein, 209 aa, Homo sapiens
MDKSTLLTSKIDAGLLMSAPQILSHPSTHWLCLHAVATILSLPLSGSDSSDIVSLAVKILLMSIDSCDSHCILSSVPQLITFKPNIHISHGHPMDTGWDRSPKPSRKTPFSPFSILTANHQPNVKERHNHQNILANNIGHWKSHVPGKPLALDKPGGLVCLPSNTTARVYSKKIDIDVYQDLTKALLPEHYFKHENTANGLNVQQQSSS

SEQ ID NO: 926407 - protein, 134 aa, Homo sapiens
MAMADCPKLGRFLKSPDLELHYLLITNASTCQYPTSNSIVPGPREFQASPESCQEETTPHREVLSALQPHWQHDLGQGMDLKVPHLMREKFILEVMFAQSLSSGAEDVGQGCTSSTRGPRDLFLPEPVVSIDTS

SEQ ID NO: 926408 - protein, 156 aa, Homo sapiens
MSFWYVLESGNLQRVCPAGLPRCHGTQGEAKDSPAATSKSGHKQWLLSANGSITLPTIYLHFQNKQPSKANSPVQLACLPDRGSCGTCVPPGKAGSSADHRWLSGCQGSVTQGKRDEREWGLSPQGAPSLLGGTCLNALSQNQYLKRSPHNVHWKI

SEQ ID NO: 926409 - protein, 160 aa, Homo sapiens
MRVALEAPQYPSHLCFIQLVGFCFVLALTHSPIFCISLAKEIHKTSSHSRGRKIDSISSWENLQKSLFKKSRYSEKKYPDALCGCCGLIKTFSLQDHIKLDCIWNGPANIAKSCNLQLENNLEGSFSVASLDKQEVVGPSLLWNGPAQKERGQKEYWERF

SEQ ID NO: 926410 - protein, 126 aa, Homo sapiens
MSGLVRRKHVIRGWLVQPANFLPVCLPVPGTGFFCPDSGKSTCMTPFFWSPGSVCKEAREENCSWAKASCCFLTPSLMTVDSGGTKPSEIRCWIDPKYQFTSPERTSSSACPTMPTGYECQGEHGK

SEQ ID NO: 926411 - protein, 178 aa, Homo sapiens
MPVGFTPWPVEGKVASAGLYGLKSGLGRPHSCGRFKCHKAMVLPRHPQSLSHLTSSIHLPISPNECRVPKLPPPTTASFAAPGFIAATFQTSLLPWEELVEQLAFLGEIHWLLLHHSDHASSSLPSPPLTLLEDGEEADRGRKSKTRKGLAPPFSRIEILQITHNDCGKNWQIKDSWY

SEQ ID NO: 926412 - protein, 152 aa, Homo sapiens
MITNTAGFLNSGTVDARGLMTFCPGGCPASIVGSSAAPRLTPIDASGTPTPPSYHFWRGREFDGFCNNEIDETDGRCQEFSRGQGDGEATALCQKQGREREDTKINRNKIPENKALLIWRKQKEGESQHGRFKMVTTEIFYSTGMENQLSSW

SEQ ID NO: 926413 - protein, 135 aa, Homo sapiens
MTAAAVPITSSRHLGERLINSFPEAGEMPLLQNNFPSQMFYQFLEMVESVHGCDASGPFQCRYCPYSASQKGNLKTHVLCVHRMPFDNSQYPDRRFKRSRVDSEASGNFEEPTAVKAGSSADLTEEGGKGQEETN

SEQ ID NO: 926414 - protein, 143 aa, Homo sapiens
MHTHVCGMSADRHLLSRSTLKQQTWCSPIFMGALCPAKGKPGLFPRAWNGHGKGVFLAEARISRWFRNRIYPAPDPPGPVTWPLSDQDLQEPLSGNAAKVHVSYDLLHSCEKMLLVLSKQFYHRLKKPRKKIGSQRQPYAYLT

SEQ ID NO: 926415 - protein, 176 aa, Homo sapiens
MINAFCVVLGQDRPLGSNQEPALPSLAICLKHLVIRCKPHTGAFKLKCAVTLPPTLAFVTQPGCPSLCRGEQFGDGNPTAGTGNSPWLSRDPAGREAGPVSRPGCPLPPGSMDMSPANGLAFQSREKIAHECLLYPSGSSRSQIFGSCRKGEMLVSFMPPPLLRKERACPHSCQSP

SEQ ID NO: 926416 - protein, 141 aa, Homo sapiens
MGDFLPHFQGGLDQIPASPLPKPNPLQVLDSLAVQERNVYMNIVARIVSGHRYIFTFRVESFGGHRGAAVPLQRGCLLREVLASAGWTSLHCSMGAQSLERPFCVDVIESSDVHAPPVHSGILSDRSNSVHSHPPRPLRSP

SEQ ID NO: 926417 - protein, 192 aa, Homo sapiens
MLTFYITTDRYCTPACATDLDLVFKKKRKKKKEEEEKEKEKKKKKKTEEEEEEEEEEEEERRKKEKKKERKKEEEEEKEERTEPKNLGQGPVGRRLIFGSDFREFGIENWEDRKTEGRKVNLGAYLSTGSIPIGPGLSRKNFHFYFILGSCVCRCFTSISFHTPVGLCRTRGWLYPLKLFDSSVLSKASVLT

SEQ ID NO: 926418 - protein, 122 aa, Homo sapiens
MPNDTQLESSLGPAVLAPTTRFQQGFQRRRINPVIVTPIMKNPQRRQSDTKTTKPREDCQGVVDPGGCCVDEYETSQVIHTLSKTLWSQDGLAQRSEADAEVSDQAILGHVGFREPKSASEA

SEQ ID NO: 926419 - protein, 474 aa, Homo sapiens [sequence omitted]

SEQ ID NO: 926420 - protein, 125 aa, Homo sapiens
MLARLWNKGSAYTLLGALPGCSGTTNLNSTFSQQGVSGAYFPNQRVFLKPDSIAHKDLELTLKVTAAPSFTLEGFGVMLWLLFLSLPAAPGPALSFTASSAYSVLWVAGAQLTLTQMFLLNFPIN

SEQ ID NO: 926421 - protein, 148 aa, Homo sapiens
MSVQQCSAGKAELELRTGVQEGFLEEEESTWPNGFLQEKCGGQLLAPTSPLGSEPCLMRLASKDSIPRALVLAGLDFFRGLKAEGPSGGQRQEGYVPCLAGGTPPTLSPAALTQNCQLGAGRMLVWAGQLFASGAHNSVYHRHALCTY

SEQ ID NO: 926422 - protein, 142 aa, Homo sapiens
MSWTQSQPPQWYQFHKYCFIKLSVSVQRDGFGNVAKLVAMRRKTPRCQCHFACPHCASCHSAGPSVNSRSWPDICPKDVKQLRVKARPFQALGFERVVYAGMEGLLGEEHPPERFEQLFYIPNTKAIVSYLPVSAHTNLLCF

SEQ ID NO: 926423 - protein, 139 aa, Homo sapiens
MQTSSSGGQHHTNGDPVDMGSSCSCNRTQFGCVLLKHQTQGSSSGLGETGTWVPSAMAHGLSPSCCSSPVPSLSSQAPGRVGMGAHWVQIQERPAGSSLSLKQEAPEQRPQRLPSGPAAALGLAQVSLAPRGSSKPLQL

SEQ ID NO: 926424 - protein, 140 aa, Homo sapiens
MNTPVCLDLPQEALWLYDMELVTYGKQPQPDYSISPITEMVWMFIPSNLMLKCDPQCWRWVPVGGNWVMGVDPPRMAWCPPHGNEVMGIGVVLMITDDGTRTERVGSDGLKIPIKWLDGQSPVKAQKGGKFVGIEILAYL

SEQ ID NO: 926425 - protein, 174 aa, Homo sapiens
MSLCMYPLFSSLITSPLCLSHQPLPCAHHTCPLPCAHHTCPLHCAYQTCPSPVPITPVPSPVPITPAPSPVPITPAPSPVPITPAPSPVPIKPAPPLYPSHLPLPCAHHTCPLPCAHHTCPLHCAHHTCPSPVHITLKATRSHTILSLVHPGIPSMPLPKLHSFTLPRTLSGAS

SEQ ID NO: 926426 - protein, 141 aa, Homo sapiens
MDPNLLTVRQPEMNANVHRNKWMDAALKLEYTQCPLWKQLTVVLQRWVGAWTTVAAVQWSGVQPERGATRWHAAAPCCVEESDTQEQMLSLSCAEHTAASPEGRKGVQRLQGAAGECAVTAVGAEGGMRGDCRGRGGRNAR

SEQ ID NO: 926427 - protein, 173 aa, Homo sapiens
MRPPYVTVTDIVGSSGSVLLCHFSLVPPYHLGSITLRPYHPGGHITLRPYHPAAVITRAASPCGRNHPVAISPRLHHPAAVSPWRHHPAAVITWWPYHLGSITRRPYHPGGITLRLYHPAAVITRAASPCGRNHLVAVSPRLHHPAAISPWWHHPAAVSPCGRNHPGGITLRP

SEQ ID NO: 926428 - protein, 352 aa, Homo sapiens
MDDDDVPSWPPTKLSPPQSAPPAGPPPRPRPPAPYICNECGKSFSHWSKLTRHQRTHTGERPNACADCGKTFSQSSHLVQHRRIHTGEKPYACLECGKRFSWSSNLMQHQRIHTGEKPYTCPDCGRSFTQSKSLAKHRRSHSGLKPFVCPRCGRGFSQPKSLARHLRLHPELSGPGVAAKVLAASVRRAKGPEEAVAADGEIAIPVGDGEGIIVVGAPGEGAAAAAAMAGAGAKAAGPRSRRAPAPKPYVCLECGKGFGHGAGLLAHQRAQHGDGLGAAGGEEPAHICVECGEGFVQGAALRRHKKIHAVGAPSVCSSCGQSYYRAGGEEEDDDDDEAAGGRCPECRGGEGR

SEQ ID NO: 926429 - protein, 385 aa, Homo sapiens
MENTDLADWDVEGQVFIQTQKTPKVLNCKNLSNSNNLNDGRMKSESDWIKKEGKGVAKVGGDTLWYKSPWQAALTPDLSCPQKQLEARGETPEGETFAMAEHFKQIIRCPVCLKDLEEAVQLKCGYACCLQCLNSLQKEPDGEGLLCRFCSVVSQKDDIKPKYKLRALVSIIKELEPKLKSVLTMNPRMRKFQVDMTFDVDTANNYLIISEDLRSFRSGDLSQNRKEQAERFDTALCVLGTPRFTSGRHYWEVDVGTSQVWDVGVCKESVNRQGKIVLSSEHGFLTVGCREGKVFAASTVPMTPLWVSPQLHRVGIFLDVGMRSIAFYNVSDGCHIYTFIEIPVCEPWRPFFAHKRGSQDDQSILSICSVINPSAASAPVSSEGK

SEQ ID NO: 926430 - protein, 355 aa, Homo sapiens
MQLEKMWKVSNSQTNPTSIKKEGKGVAKVGGETLSYKSPWQAALTPDLSCPQKQLEARGETPEGETFAMAEHFKQIIRCPVCLKDLEEAVQLKCGYACCLQCLNSLQREPNGEGLLCRFCSVVSQKDDIKPKYKLRALVSIIKELEPKLKSVLTMNPRMRKFQVDMTFDVDTANNYLIISEDLRSFRSGDLSQNRKEQAERFDTTLCVLGTPRFTSGRHYWEVDVGTSQVWDVGVCKESVNRQGKIELSSEHGFLTVGCREGKVFAASTVPMTPLWVSPQLHRVGIFLDVGMRSIAFYNVSDGCHIYTFIEIPVCEPWRPFFAHKRGSQDDQSILSICSVINPSTASAPVSSEGK

SEQ ID NO: 926431 - protein, 151 aa, Homo sapiens
MRWGRGRGRGITVGVACLTFRPSPRSTLSADAGPECYELQVCVKDYCFAREDRTVGLAVLQLRELAQRGSAACWLPLGRRIHMDDTGLTVLRILSQRSNDEVAKEFVKLKSDTRSAEEGGLGNSTCEGQERRTVETTRRVARLELSQQGGS

SEQ ID NO: 926432 - protein, 136 aa, Homo sapiens
MGAQGPTPSCAYLSCFAPSPPIHRQYALSAQNRFPFRLGSAPHARTTPLRFRARPNPWFLVPAPPLRRPGPAPPPASRFPGPARAAPVTRTRDGGGKMAESGGSSGGAGGGGAFGAGPGPERPNSPGDILICFHSL

SEQ ID NO: 926433 - protein, 305 aa, Homo sapiens
MPDIRKRKPIPLVSDLSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLGERSWEEFGRGA

SEQ ID NO: 926434 - protein, 871 aa, Homo sapiens
MANLSPLALPCSCWDGGSLDFRPGSPPPHLLGHFPGTPDGRGPWEHPLVQEAGEGILSERRFEDSVIVRTMKPHAELEGSRRFLHHRGEPRLLEKHAQGRPRFDWLQDEDEQGSPQDAGLHLDLPAQPPPLAPFRRVFVPVEDTPKTLDMAVVGGREDLEDLEGLAQPSEWGLPTSASEVATQTWTVNSEASVERLQPLLPPIRTGPYLCELLEEVAEGVASPDEDEDEEPAVFPCIECSIYFKQKEHLLEHMSQHRRAPGQEPPADLAPLACGECGWAFADPTALEQHRQLHQASREKIIEEIQKLKQVPGDEGREARLQCPKCVFGTNSSRAYVQHAKLHMREPPGQTTKEPFGGSSGAGSPSPEASALLYQPYGAAVGLSACVFCGFPAPSESLLREHVRLVHAHPHWEEDGEAYEEDPASQPGTSQDAHACFPDTAVDYFGKAEPSLAPMWRENPAGYDPSLAFGPGCQQLSIRDFPLSKPLLHGTGQRPLGRLAFPSTLASTPYSLQLGRNKSTVHPQGLGERRRPWSEEEEEEEEEEDVVLTSEMDFSPENGVFSPLATPSLIPQAALELKQAFREALQAVEATQGQQQQLRGMVPIVLVAKLGPQVMAAARVPPRLQPEELGLAGAHPLDFLLLDAPLGGPLGLDTLLDGDPAMALKHEERKCPYCPDRFHNGIGLANHVRGHLNRVGVSYNVRHFISAEEVKAIERRFSFQKKKKKVANFDPGTFSLMRCDFCGAGFDTRAGLSSHARAHLRDFGITNWELTVSPINILQELLATSAAEQPPSPLGREPGGPPGSFLTSRRPRLPLTVPFPPTWAEDPGPAYGDGAQSIGGAGLEGQPLSFPGSILSHFTKYVDDFPYNHPAI

SEQ ID NO: 926435 - protein, 177 aa, Homo sapiens
MSETLPNRRDRLPQKTPASLPPAAAEAEEGAFPLCLGPSGHSDNRYPFRSTINPSPVTPATIAGPTYPWTPSWSCPQASSPQTSAAGSDVRDPTSQGLPPPPARLLASPGRGALLLPWQGGPGLDPALGVPARSGQWDRPVLWPRAAPRRLRRSHSCVGLSNRHRELFKMQAMSLPC

SEQ ID NO: 926436 - protein, 149 aa, Homo sapiens
MGTLRGLEPSPGGTSSLGKKKLDAHTPSVEGSGLGQRKAWNLGRAWGTRVVGPGLRTTATFHAHGLTLDLISSCSPLNCDILMSPNSVASNLFGTRDWFCERQFFHGPGCSCPPVSGGFGQLEALAEDLKSLSAPQYTDACWAIFVFSP

SEQ ID NO: 926437 - protein, 259 aa, Homo sapiens
MLFTAEYSGLIRCAFGTWWVNHPQAHTDPFVERQNAGGGTGQVWAELSTSVAVMDSDTTVRCKPQVEKAFHLPRVEGILKTVQKMRMYERRMQENGLVPTTMPKAKITSSLVCVSEPESFSRGMRSQKKWEISEPAQKQQPTDRGAHENQVTLWVDNGHEAVDGHYCQEKAVHGPEQVEGIHLEDAGASSPGTTLGELLHWRNLFLKTSPICAGVLQLQTLSAFPPHILPQRVCRWHHQGEGPGKPPSPPTARGSRGQH

SEQ ID NO: 926438 - protein, 159 aa, Homo sapiens
MSLVVHPNQKTQASREKDSGKCSLTWPSTYEASDWTLEWYSQKNSTLSPSYELTANSKWHRKMVSFGLPSLLRGPLIRRAESTPKTTSLSASGKHIKTLDAKARVGFPDWQHSACTVPHGCPQKTALGGDSWKLCTWDIPGCFRMCLCPRLAFICFLSL

SEQ ID NO: 926439 - protein, 128 aa, Homo sapiens
MIRSCTFYARASARASLYLQLWGHCGAGGGWRPGKSPGWRGLMSDISQARALELLDREFAGTVMQHTTQHNSTQHNLPQQSSVRCTGLQQSMAQGPGSHDTPYKRILGDDCDANLTIPLQFKKGHGNR

SEQ ID NO: 926440 - protein, 143 aa, Homo sapiens
MAGGDDFHRYLLVGLKGAAQKPINLSETTEVVQGPDEPGTLLESLQEAYQTYTPFDPAAPKNSRAINLVFVAQAATDSKRKLQKPEGFAGMNNSQLLEVAQKVFDNRESEKRKQAAEAAEKAADKASKRQAKILVVAIQEAKK

SEQ ID NO: 926441 - protein, 133 aa, Homo sapiens
MPSISCTTMLLLHLGGIALPYELNSLKNLRRAIDFQFVQPFVVVRMGVTSSLHAGMETRSLDLYFLFLVIKFSFPYTFVNISFSCGNFQKLSQAKLELLSQGYIIEARYQTARDDPYSLKPVKLFKLINPQGA

SEQ ID NO: 926442 - protein, 122 aa, Homo sapiens
MNCCIWIREPPDIMLAAHVAEYDNAYQEWEILSGEGICVGVSVCPTREGPAQHTVCFALSKEPQLQVDFHTGMDEDSDIAFHFRVHFGHCVAMNSHEWGVWKCEVKSDNMPFEGGQSFDLRI

SEQ ID NO: 926443 - protein, 130 aa, Homo sapiens [sequence omitted]

SEQ ID NO: 926444 - protein, 162 aa, Homo sapiens
MLSQVPGPPSSASLCVASWQLRSPGFGGDNEGVSAYHHLPPKMPSPSFLRVIASPMGDSHLLALPDGEGASCCTPHSLLPPPLSAFLPPHLDGTKRQPQMHLPFYDSPVPWASEMYGKCSNILLTPTPTITHTLMAFHLPHPWAFAYTDWAGLGDSWGQQSP

SEQ ID NO: 926445 - protein, 149 aa, Homo sapiens
MWQSGGDHYLAQRARPLPSDPIHPTDPTDAEPTEPQPTDALAALSRFPVELGSKRDLDTQVGRLHHLAVAGGPGWGPARLLRRGEGLAAGTSVAAGSRSCMEGVASVGQSAVVPNTDCVPSSVVPDGALRVNMTLGPLGMKCSGMRMRP

SEQ ID NO: 926446 - protein, 271 aa, Homo sapiens
MYFFLSNLSFADICFISTTIPKMLVNIQTQSRVITYAGCITQMCFFVLLEALDSLLLTVMAYDQFVAICHPLHYMVIMSPWFCGLLVLASWIIMSPWLCGLLVLAFWIISDLDSSLHSLMVLSLPFCTDFQIPHFVYELNQVIRLAGSDTFLNDMAMYFAVGPLGGVPLAGILYLYCKIVFSIRAISSAQGKYKAFSTCASHLSVVSLFYGRSLGVYFSSAPTQNSHSGAAASVMYTVVTPMLNPFICSLRNKDIKRALNQFIRVVPFFRK

SEQ ID NO: 926447 - protein, 140 aa, Homo sapiens [sequence omitted]

SEQ ID NO: 926448 - protein, 229 aa, Homo sapiens
MQREIKLGPVAPQLDALLVNKQTLAHFAEPVVGDLALAQQLSHPPVNLVLRAAEAGGGEARSTRVRVHHLGGLQGARFARDALAWRRLLQGAAAFDHLHAEAPGLDVGGAAEVVGHVRVQHAVLGLPHGHRLLPAAIGQNVRGPRHGLSCLAPCWGPNACVLAALSRGNMALLPALGCPKRFQLSRSHSVACRTWPFFQLQGVRSAFTLGSLGLAVPTVIHLRVSEQKQ

SEQ ID NO: 926449 - protein, 125 aa, Homo sapiens
MDGHWACFQLLAIINNAAMNKHRQISAGVPAFHSFWNTPKAELLHFVFPTDKHQGRSWSVAIKNTAVTSLEWVPFHAFAIPRSTLVSQQVSALVRGCDSSLRKYGNLLPFLAAAPPVWTAYGKHP

SEQ ID NO: 926450 - protein, 166 aa, Homo sapiens
MGRNQSRKAENSKNQSASSPPKERSSSPSVEQSWMENDFDEINSVEKSLNDLMELKTIAQELRDACTSFNSRFDKVEERVSEIEDQMNEMKREEKFREKRLKRNEQSLQEIWDYVKRPNLRLIGVPESDGENGTKLENPLQDIIQENFPNLASQANIEIQEIQRTP

SEQ ID NO: 926451 - protein, 139 aa, Homo sapiens
MLTAWRVSLVLTLTLCVLQFFPYGTVGGADMRSIIFKNHAWGREEKQDKGALTQDSFSPLSQEKGDFQSIQTRSLIQWVHVQVCYKGKLYDAKGLTSIDPIIQTVNVVPNRNSVLVLIPPSLLLDSTGCVVPIFMSICI

SEQ ID NO: 926452 - protein, 151 aa, Homo sapiens
MTAATSLGDECYGCRGPCEGGAEWPGHLATSLNNPFIFFVDSSGGEIYSPAQLCSLFLTLQPWFRLSRTFTHYVLDLCDGASPLPLHHILEHMEAFPRLFQLASFLLSSIELRSPEAEVAREVFPREMELELWLGGIVPIWTLSLCFTICN

SEQ ID NO: 926453 - protein, 145 aa, Homo sapiens
MKYVWLPSLFIPSPSDLPWEHRIIIPESHETFPFSKAMEKATSNVNVRISSKSNWTVEEMKASLSSSTPDKTGLRVLQEWLGSREFLEVCSSTPAGYLPHPLVPRGGHSVGQLASSKAQDGFSLKTLKRYMVDAKAFGVDNGSPA

SEQ ID NO: 926454 - protein, 162 aa, Homo sapiens
MTKPHAKKLITKELGSQIAPKLHETSPHLCADEWPTLEPRLFLPSLETTEQVLQIGKETSPTQWGKSFKELSPEDQKHAWFTDASTKYIGGNQCWKAVAYNPIKNKSISDEGRGGSSQLAELVAVPLSYSEGDQRDFSLLYQLLVNTKWSYYLDAPGNKANG

SEQ ID NO: 926455 - protein, 167 aa, Homo sapiens
MAGAQSQRALVTEPHAKQLVTKRARVQDRTKASRDLSSFVHGRVTASGAQAVSSCCGDKSSIVWENPTRLGCPNSSEQAGGKAKSADSQRMQPLLPLGAQAQGDHSSVPEPLAGAVGVPAGRPCPDMGHQVLKSGSRKHKHGRVQALGTGDLPQEVSKYTKGNLEVT

SEQ ID NO: 926456 - protein, 330 aa, Homo sapiens
MLSGGFEAMPGMLPTSLRPLPDTFQPVLQPQHVPPLNTFQQPVQASDGRRARQPWPQQLFRGNQDSQGSDEVMMPRTTTQVEHDLRDELHGRPPSAGAVPRPPALPDVPQQHREKAWKQGKRKAFCMAQHLLRKENKKTASDPSRAGQREGGHHLGEWMWVSKTNTGYVAWSWEEVESMIDSFICFLKKVDDGAAAQPQGMEFTASSPSTFTGGAYNTIVKLFPDWPRQDLDSVWDLLLLSKQQRIKFPDILHVHRGALTKVTGSRRLVGGGMMEVRGLMAQARPPLIGSNHQSASGQSCTDQVPADELLTNQAPGNQVSADKNLLKGVR

SEQ ID NO: 926457 - protein, 174 aa, Homo sapiens
MCLLPRKEPYVPSTHRHWRASDCSVTQRQAASRVGEHLCECVCHTHVHTHVLITVTLGPMVSIRASMGAPQSLPSPYGSVLGMQTEDGGKEASGTNCLPEVTQQPADQFPLTQSLLTRTGLLIQDTGRDGQPQAPGAPTRLSGPISKGTVRGPGTTWTCHLALFLSLGARGTEG

SEQ ID NO: 926458 - protein, 158 aa, Homo sapiens
MWQRMELSRRPCKTAEVQQQKKQTFRNFTQRGVDLDQLLDMSSEQRMQLNSARRRRLNPGLWRKQRSLLKRLRKAKKGAPPTEKPEVVKTHPRDVLLLPAMVGSTVGVYDGKTFKQEAAPVTGPSAAELISWERSRSANCAGDAVVTAGGMQATIVQP

SEQ ID NO: 926459 - protein, 473 aa, Homo sapiens
MSLAIHSTTGTRYDLAVPPDETVEGLRKRLSQRLKVPKERLALLHKDTRLSSGKLQEFGVGDGSKLTLVPTVEAGLMASRPEQSVMQALESLTETQVSDFLSGRSPLTLALRVGDHMMFVQLQLAAQHAPLQHRHVLAAAAAAAAARGDPSIASPVSSPCRPVSSAARVPPVPTSPSPASPSPITAGSFRSHAASTTCPEQMDCSPTASSSASPGASTTSTPGASPAPRSRKPGAVIESFVNHAPGVFSGTFSAHMSTPLPELMSSHPWTPVLDMRDCARAGHSRPPLPAGTLHPNCQDSSGRPRRDIGTILQILNDLLSATRHYQGMPPSLAQLRCHAQCSPASPAPDLAPRTTSCEKLTAAPSASLLQGQSQIRMCKPPGDRLRQTENRATRCKVERLQLLLQQKRLRRKARRDARGPYHWSPSRKAGRSDSSSSGGGGSPSEASGLGLDFEDSVWKPEVNPDIKCEHHVL

SEQ ID NO: 926460 - protein, 150 aa, Homo sapiens
MKTTARPTPSLPPPQPIQHEDDEDEDLYDDTLLLNEYFVSPNLGDAEFLGLSRSAQHRLKTKVDSVHYGGTNDANNEDPARYYCYRNGVPIQTPREGSWISRKKEFRQYDLLMLLNIPWRKTLLCWDGPNQLQTQTADVCPACALCQEWG

SEQ ID NO: 926461 - protein, 144 aa, Homo sapiens
MTREDRPWRGEGGSGSIQAEGTAQVQAGYDRAGPWWELCTCHVPATVQGPSLPPASGPQVPSCPRLFAWAVPSAWNALPPMWLFLYSHLVHLHILSDQHIAAVPRLRFHRLSRCPGACRYAALRFCNSGMAWAPAGSSWNPGMC

SEQ ID NO: 926462 - protein, 155 aa, Homo sapiens [sequence omitted]

SEQ ID NO: 926463 - protein, 137 aa, Homo sapiens
MPDGPRTTPSPSCLESPEDHTHVHAGTRVYLPKTSTGPTQLCSHSRAQVDPQTWDEASSSATFPVSPPRPDVPWQMRSLSSVGEREPNSRALSIGQLATLVSASVSLPAPWRREASHPLRPHPVSLGPFLASISGEP

SEQ ID NO: 926464 - protein, 134 aa, Homo sapiens
MKSPNLVIGGFTDTLSKKKEKKKKKEKKRRGRGRRREKRKKNKEQPRARPLELGSRSFSGDLEMSVAPVLKRFLHHHFQDALQCRSVFLHQEAGERPGVGGIKDAEAECIRYSGIFFPGGACEEELGRQRGSSV

SEQ ID NO: 926465 - protein, 158 aa, Homo sapiens
MATFLLCSHMAETEQTLWCLFLNCTAVLPVGMEQPVRDQADTGSNPERFGSDTEVNLHPAGSDVLTGVPLGCGAVAGVIRFSPNEGARPELDVRVKPVLECPGCPDLELGDGGCRAETNLRTGESISDLIGGFEKPSVPLGASVSPSVQRDDGDDEMR

SEQ ID NO: 926466 - protein, 151 aa, Homo sapiens
MFQKHMGRSLAYNRNSLPAEGTACAKALRQDLTWGVGGTTRRPMWLEQKINKFQAVTAPSARVLEGSDNLQVPGPKGHNCIYNGLFDYCSKTKPILTDTTGMEAFDTTEKGALHSASFESLHAYIEFAHSCYGTCLIAESAFAHNPPSSWP

SEQ ID NO: 926467 - protein, 429 aa, Homo sapiens
MPLCRPEHLMPRASRVPVAASLPLSHAVIPTQLPSRPGHRPPGRPRRCPKASCLPPPVGPSSTQTAKRVTMGWPRPGRALVAVKALLVLSLLQVPAQAVVRAVLEDNSSSVDFADLPALFGVPLAPEGIRGYLMEVKPANACHPIEAPRLGNRSLGAIVLIRRYDCTFDLKVLNAQRAGFEAAIVHNVHSDDLVSMTHVYEDLRGQIAIPSVFVSEAASQDLRVILGCNKSAHALLLPDDPPCHDLGCHPVLTVSWVLGCTLALVVSAFFVLNHLWLWAQACCSHRRPVKTSTCQKAQVRTFTWHNDLCAICLDEYEEGDQLKILPCSHTYHCKCIDPWFSQAPRRSCPVCKQSVAATEDSFDSTTYSFRDEDPSLPGHRPPIWAIQVQLRSRRLELLGRASPHCHCSTTSLEAEYTTVSSAPPEAPGQ

SEQ ID NO: 926468 - protein, 165 aa, Homo sapiens
MGSSGVFDYWRHGGVFCPFCSYGRNWASLGAGVPQVQPLDPTGPEEGEGQVGGFTERGMGGTQVPRCHPGNTPPAPRWVSTACRGQGNGLQAGQWGRRGGALPHQAARPLAAGVQWAGAGRELPGPGRGCRVQPRRILWKGGRGGEGRGSEGGVQEMGNLQYLRG

SEQ ID NO: 926469 - protein, 139 aa, Homo sapiens [sequence omitted]

SEQ ID NO: 926470 - protein, 154 aa, Homo sapiens
MSLIQRGNLDTETDPYRGEMMPPLSPASWRCRQGLLVHPFSRRKAWILHQEPPEGGAGGTGDIILRASHSQCAPDLIKIQRRPEFPDDTGAAGGKLHPQLWAPGPQEWLGQDGYKENLIAPELKPNVFEESCQDSVKVTQDASCCGEGLSLGLS

SEQ ID NO: 926471 - protein, 142 aa, Homo sapiens
MLGEQGEQGQIIFISCCQGQILGHSTWFWGTATHCCRPTEPVSSTPLLPIPGYSFLHHVLRVAPPALVPGSCPWGASGNVRRHCWLSELGESPQMVLNILELTDSPTSMTTPNVIAEEWRALRVQTLLPCVGAGDMAMRLCP

SEQ ID NO: 926472 - protein, 244 aa, Homo sapiens
MGFQGLNWAERQEIPTLIKKCPWSDKSCHTGQSSVFCTAKLSKPFVTISNSNPVENEDTAALTCETEIQNTTYLWWVNGQSLPVSPRLKLSNDNRTLTLPRVTRKDAGTYECEIRNLVSANHSDPVTLNVLYGPDDPNISPSYSYYHPGENLNLSCNTASNPPPQYSWQINGKFQKSAQELFISKITKKNSGIYICFVRNSATDSRCFTIKKITVTGEDVEKWEEKEPWGRLLSCVLVLKSLAV

SEQ ID NO: 926473 - protein, 143 aa, Homo sapiens
MACAACVFSSVEILKMSVVPLTYSQFFHQEMKDFTGSSTWTGIMDPREDCHSGDFGGMDWRPEATPRPKSLGRGWVQSCCGAFHMGPFPVEHESSQGFQGGPLPGRIRRNVAATRCRLLSGPEKRDLFSSFATHVCTVCIRME

SEQ ID NO: 926474 - protein, 246 aa, Homo sapiens
MLLLDQILAFIEKNAALAAAREFGDTWYLSQVNDRMTAKERDKFLTGQQAIPTMDPHWDFDSDHGDWSHKHLLTCVLEGLKGIRKKPMNYSMMSTITQGQEEKPSAFLERLREALRKYTPLSPESLEGQLILKDKFITQSAADIRRQLQKQALGPEQNLQELLNLATLVFYNRDQEEQAQKEKRDQRKAAALVRALRQTNLGGSERTEYGAGQSPSRACYQCGLQGHFKKDCAMRNKLPPRPCPLC

SEQ ID NO: 926475 - protein, 149 aa, Homo sapiens
MPSVRTVTLSARVRAFILEVSETKNPPVPDTKRYLIQQVDQYYWYYLLVSIVAILLIVKVRLLLQLRFKGNRENWGHECSQRSDCLLVYWPHLLYQLPSFSGKNGQRGAPSLTTHSFFVRDIDLLHWFLLNKSWRRALITSSESVTHPG

SEQ ID NO: 926476 - protein, 249 aa, Homo sapiens
MQVYYPGDLQSHSNDFQGPKYSNNHLKYPSLPCLSLTARDLDWQVAMADFIRNISFNLPASKLLNFLQTMPVKFVSIVVSEPLLHAITLFTDGSGKTGKAAIVWQDAMQNWQYRIQEHFKNYTTGRVRCLDIGLTNFPHQDVNILSDSTYAVYSITHLDLAHVKGITNEPLLALSLAAQDSSLPVITLFTSHIFALILGYLVPCQKGMLELMLWYDHRCGLQILLLFCELKLIMLFFIRTPAVLNNSFI

SEQ ID NO: 926477 - protein, 149 aa, Homo sapiens
MRYYPHHGSGKEWYPKVYGAGAASSSFTPPSPVQAISPVTYFGVDDGEDSWEFDGQSDHPKQHRKQAAPFRTSPTIQEVVEGRKETSERLGAECLGNRARRKLGLLLISKKNVFMQSGYIWGYILYEWVFSECIFLFMTHILPLIGISK

SEQ ID NO: 926478 - protein, 147 aa, Homo sapiens
MLPPFISSEPSSALRLSYELQSLPVTNGLARWPGTWKEHYWKTGDKEIWRRATPVIAQLAHEHSGHVAGMEVVFGFSNTDFHLPRQTWLQPLSHASLLAAETNTESKNDTTPQGDQPATWRAFQDYHATWLRSTENYNSPIQATLHY

SEQ ID NO: 926479 - protein, 270 aa, Homo sapiens
MPSTTTAALTPPHAWWVLLGSQCPNARGRWQCQGSRVQGPTFSKLDGAQTAAGAGASRARGLGPGLEQPEDAAETAGLSCTAVVSCAVGSLLSISSATGPARPPPWPGPAAAAERPRGARPRRLHTQQAAKKPSASTSSASPTTSSALCSGKKEAKAPASVTFTPASSAHRPQAQHSAGDGRPGTRPRARSAGAGTGGPSLFSAGGIGLRTPGTHQAPSCRRPGTAQLPGASSRWSCGQLPGASSRWSCGHTARGRRQQGILTSSPRLRL

SEQ ID NO: 926480 - protein, 145 aa, Homo sapiens
MPLPPPPESPFPIPAQPLLTQNSSANKDTAHGSCSLGYGDADNDAASHQPESHAGQLQAAEVSAADGDVHAGPPGALPPAGSSCCATAAPLGQGLHPGGVEQPVCRRILQRDRVLAHLKRPRPTSTAHSASVECSRSQGPGRARL

SEQ ID NO: 926481 - protein, 149 aa, Homo sapiens
MRQKYPSGRGIPLISSILGRRPLEAGWKPSVYKCLKTISQPSDLTLNMAPVGIVPSNHLVFQAQLSMEPTMKAAQEILSNLAPSLLLGCLHVSLWGCRLEQPPLSSKLFYRKPSDCPSLDAPSSFLHSTASFLQGCPEDTVQAAGSETN

SEQ ID NO: 926482 - protein, 225 aa, Homo sapiens
MSKFSGNFSLSTFTPTVQLTTQPNPRSNINSNNLHLGVHHPFPSPENEVDDTEVNVSKKKGDGDILNDLMKTAGTAKVREEVLGDYLKTLKTEFTMGMVRASSPVALGVRIPAMALPMRAQFDVTVEQLYSIFTMKDLVQKFSKSSAVLEAEKGGKFQMFVGNITDEYIESLTNKKIIMKWRCRNWPEGQMELQFDCKGVPICKEENMKFCWQKQHFEEIKDLLR

SEQ ID NO: 926483 - protein, 168 aa, Homo sapiens
MFTFQALAHLCSLAATQAGCFLCSVVQVSLYPSPSICQDCTHPSQGCISYSFPAECDTATACSFTWNLKYPTILGRGAGDWCPWEGRDSESHHPHCAVSLAVLVAEPSLGWIGAPWKKVAMLSGASTQDKACRMADFCPAQLLHIPHYPPALPISTLHPFPLTLSGPS

SEQ ID NO: 926484 - protein, 171 aa, Homo sapiens
MPRQKFAAGVGSSWRTSTRAVQKGNVASEPPHRVPTGTLPSGAVRKGPPSSRPQNGRSTDSLHHLPGKAEDTQHQPMKVARREAVSYKATAVELPKTMGTHLFHQPDLDVRHKVKGDHFGALRFDCPAEFQTCMGPVALLFWPISPIWDGCIYPMPVPPLDMDEIGNHHSQ

SEQ ID NO: 926485 - protein, 141 aa, Homo sapiens
MGRKKKQSLLEEQYSQTSVWVSLLPGSSFCHVYDSKTTCQSGLSVKACEDPGSRNGADIVASKEDGTGKGILSQFVQLLEHSSDEIATPEGLGVLVLKFIHHKGTRASEQRGLGYPMLSSQCLLTFIHLLRSRKATNQRLK

SEQ ID NO: 926486 - protein, 200 aa, Homo sapiens
MEYMTPSHSPSHSITAEDSDSYLTQKMAVTGGCQTCKPPAIFHSFLLPAFVLSKAKVSVCALQPENQEGGWCSCSVKAGRLETQEELMFLFESAGRKKTEVSAQDSQAGGVQLIGRGPPHEEGLKLCKGEAPGGSHVADSLRILVFVSSKTAAQTHPESRSTKWTHKINHHSILERQCLWGLVHVNAEGNSLRREAFVLH

SEQ ID NO: 926487 - protein, 186 aa, Homo sapiens
MTLWKKQNDKDSKKDWWLPGTGEPNQGHGSSCWGHYPKGGDDMAVHKPGAQLCPELVPSGWFLVSLTSKMKPRTLTVCGLTDFMSEATDLCKEEEEEDKEGGGGGGRRRRRKRKNKMEEEEEEEGEEGRGRGGGRRRRRRKRKRRRKKKEGGGGEGERRKKEEEKEEKVEKEKKEKEKKKEFVNVH

SEQ ID NO: 926488 - protein, 155 aa, Homo sapiens
MLKLRMRFQEQRGRGHVGRRWGSKRRGPGFGVLLEDSTISLRPVHPADVCHPSAILSPKTWTESHLGLLWPACGPIPVPWSATLLSRTPAVRLKGRHRVRHSGLCMAKLSQVLSEAVPGACCSPSLYHVADPAWFEDSLPTVSFLGCSCPMSANT

SEQ ID NO: 926489 - protein, 121 aa, Homo sapiens
MVSGRSAGVCGLLFPGRLFLGDCCSPYWLSRIFLMEVIGMCLGREPHSFLLFQKEGREENNIEIMLSKFIRLAEIFKFFDVSIGIRGEGPKMLFDLGKISKRETNMDMDNSFSSCDLSERE

SEQ ID NO: 926490 - protein, 490 aa, Homo sapiens
MGDVLWWLLLKAVAAPGREKWPENTSLLVCGLPGQSSVLPTWDIFIESSPPTPCSWHQNLAFLASSLSALTQGPSGPQRCVQSVRQSQRKGTLLINNIFAIIPAILMGVSKVAKAFELIVFSRVVLGVCAGISYSALPMYLGELAPKNLRGMVGTMTEVFVIVGVFLAQIFSLQAILGNPAGQAIQKELTQTQRRVQALPYHGPNEAEIIPFPAIKEYPGWPVLLALTGVPALLQLLTLPFFPESPRYSLIQKGDEATARQALRRLRGHTDMEAELEDMRAEARAERAEGHLSVLHLCALRSLRWQLLSIIVLMAGQQLSGINAINYYADTIYTSAGVEAAHSQYVTVGSGVVNIVMTITSAVLVERLGRRHLLLAGYGICGSACLVLTVVLLFQNRVPELSYLGIICVFAYIAGHSIGPSPVPSVVRTEIFLQSSRRAAFMVDGAVHWLTNFIIGFLFPSIQEAIGAYSFIIFAGICLLTAIYIYVGTG

SEQ ID NO: 926491 - protein, 197 aa, Homo sapiens
MNERQAVSLTFCFFLTTTLKCSQTSFSMVAVLGNVATGLAMPRQQPLVMELVKYASKSLLTLGLENNTRLGFGRCSPEGAGKAEGSLRQPVGSGSGSLPRKGLLPTQTIESMGPPTRGKIDCFHCLQAELSNGNGGSTWATGDAGFQCLFILPLVPLGPSAVTLLTRIQCLPASLGASGPLPSPSLWLFLLGQYLMP

SEQ ID NO: 926492 - protein, 136 aa, Homo sapiens
MRYVKVSDMKMLAAFSKSLKRKIDRSSIPDFLMNLSSTHAVKSFIDHLLKVLQSKQVNPIDALKAKEGFGKGFWCDLRMDFQPQESHLPLLPSICHCPKLEGATTTLNKFSFGITFTPTQTHMEAEVTFSQCGTDT

SEQ ID NO: 926493 - protein, 219 aa, Homo sapiens
MIRQLHLLFTNIRCSAASAADTQANRLKEEFRTHGKEVKNLEKRLDKWITRITNAEKSLKHLMELKTTARDLRDTCTSLSSRFDQLEERVSVMEDQMNEMKFTKVEMKEKVLRAAREKGQVTYKRKPIRLTADLSAETLQARREWGSIFNILKEKNFQPRMSYLAKLSFISEGEIKYFTDKQMLRDFFTTRPALQELLKEALNMERNNRYQPLQKHAKL

SEQ ID NO: 926494 - protein, 135 aa, Homo sapiens
MSAFFPPPPAPPPPTPPPPTLAAWVTKQDLVSKKKRKKKRKRKKEEKEKKKEKEDEEEEEELSCSHVGGFEGLILYHLNFWAGSRLHGAHPRGWVFLSQSTDSTVNLLWQHPHRHTQNQDFTSYLGIPQSSKVDT

SEQ ID NO: 926495 - protein, 183 aa, Homo sapiens
MVDKLFDVLLDWPLFTFTWTGPDTHRSQQLTWAVPLQGFRHSPHYFSQAFLHDLLSFHPSASHLIQYFDDLLLYSPSCEWSQQDTLLLLQHLFSKGYWVFPSKAQISSPSVTYLSIILHENTCALPANCVQLISQTPAPSTKQQLLSFLGIVVYFHLWIPGFAILTKLLYLSELEKMSHFEMN

SEQ ID NO: 926496 - protein, 133 aa, Homo sapiens
MAFLSSAVGGAAPSASPWDLAGPHMLTSGPQLSLAPALAGPLSSWGVCWILGVRRPQMSDIIAGRWHAPCSRRSVPWVSVLPCGQRDPGSAQQCSVCRVHTEPRAARSPCLGGLCERTYHRADGRLLVATVGP

SEQ ID NO: 926497 - protein, 146 aa, Homo sapiens
MQGVTWGVTDLLALTVCSEQSMGLPWTSGELYTSNRSCPTAQSCGGNKDLSKAKQHLKTPVIGDGLQLIAKHLWPKPSQKMKVRAASLADTELKKKAQREQEKPVLQEPPEGIKIPTPYVTAYPTLPRPAAPWEPDSGASTPQLSP

SEQ ID NO: 926498 - protein, 167 aa, Homo sapiens
MAAGKRRSSLPRWDGGRAETLLTFQTGQPGRGAPHIPDDGRPGRDTPHFPDGVVAGQRLQSRHFGRPRQAAAPCPRAPWARPLLQPLPPGRRSPARRQRLRQLRCPLNSILPAVGRQLLRSVAAAAPLHICSWGPRASAPRLSRLRTALGRSAAAPTTTRGHHGRTV

SEQ ID NO: 926499 - protein, 278 aa, Homo sapiens
MRGRPIPKVPSLIATHVASQGTLRRGAQAPRGIHLNPVEPVAWSTGIKLPPEVEVISFRTSLTDGPEGLMGPGAQTPGSSGSNCHYSTGSPGENLFKTVKQVVKAYEVYLKDNLLNKTASSSLNPKGGKLCKGDLADKLHPHVKTKGHPTPSEPTLLLVLFVIQPGSIDTAHYVQGTVLGALALVIITSRASEGCGPAAPVPGVAARTWWWPSCPRREVGGAGLAPFLLFLPPGRPADRWGEVGMKVSGLRLRPQASHLASSRGGHVDQICDPDLLAQ

SEQ ID NO: 926500 - protein, 138 aa, Homo sapiens
MDRKSKVTYRKWGRNRVFRVGKPCLKLLTSSDLPDLNFILFLSFETDSVSPRQACSGMTAADCSLNHLGPSSFSHLSLLSSWDHTHVPPCSANLLLLFLEDKRQTKALRHQVKEGRALFSWEFQQDSRLQQLSSPEFY

SEQ ID NO: 926501 - protein, 147 aa, Homo sapiens
MEATEESERKREEYSREAFICSTKQPLDSRGQCLSKAVDKLLQKSLRNSFLEHNRNEKYTISHKKLAEPELELVWISGIRLEAYLLPTGEIVTCPLSQHYVDVTLAFTLQSQDIVTYFWAQRQGDGPEDRWDCDPHMKTQLKVRMVK

SEQ ID NO: 926502 - protein, 181 aa, Homo sapiens
MAAAQSSLGFHNFGVRAASPSAAPTVRPFGSSSRQFLLVLLFLASEICQQGQIFRNHAWLSPPPAWRAAPAPLTGAGSSRGPAEHSRNRSSSRSAHARGRLAQERLSCNPASRPSSVRRKPRPTRAFPGRVLSACGASSSYQLPAATSASIRGTLRMAQGPGDTVKKCWGNINFSMVPSES

SEQ ID NO: 926503 - protein, 149 aa, Homo sapiens
MESVVENKFGSILQMDMMDMLALMCPCRVLSSLAILHTWLLVNQTVVLGGEVKLRCEVCRDLAFGGEQQQGGHQCHALLTMLKRRWPGNCPIRHAAGAERAASGMWRGLCLSLQSEYGLVFAVLRPLVLEAHPLWPCDLQVLGDPQLRR

SEQ ID NO: 926504 - protein, 245 aa, Homo sapiens
MSFIGSSQDFSRTWDGHALLLLLIIQEIYLSLGWNIGLLVGQEYETLTFQTNRTFVCRSGTKLPEEGTGSNLTVLQTPLVILRQTGSGMDLQQIPADLQKRGLTVRRKTNEQKGIVATSTKKTSTQRPPSEDYQHQIPKVDKSMKMGRNQCKKAENSKNQNASSPPKDHNSLPAWEQNWTENEFDKLTEVGFRRWVITNSCELNEHVLMQCKEVKNLEKRLDELLTRITCLEKNINDLMELKNTA

SEQ ID NO: 926505 - protein, 146 aa, Homo sapiens
MAHFDHQLRVPAGAPEEDQASCLVTTPTPSLGQQISIHLPTVYSQPTMFLTLKPEPRLECSGTIRAHCSVDILGSCDLLTSAFQVVGTTEVFWLFYSYEFSCEFRNSLWILKGNVCLDLNGIVLHPDHFEEICILILLNFPTIDMM

SEQ ID NO: 926506 - protein, 185 aa, Homo sapiens [sequence omitted]

SEQ ID NO: 926507 - protein, 149 aa, Homo sapiens [sequence omitted]

SEQ ID NO: 926508 - protein, 229 aa, Homo sapiens
MDGLVSLTKLVSASGVHLWGLQSRSKGHRSNGWNGKLAGGHPSTLKAIPMAGIQQARREGDLEPWQFPIRTQPPDQQGNITATFEPFPLKLLKELKQVINQYGPSSPFVMGLLKNVTVSSQMILTDWDALTRACLTPAHFLQLKTWWADEASIQAAHSAQAQLQINITQTNFWGKNHRVGPPDRGKKKTADPEISPKGKHWANQCHSKFDKDGNPISGNAMRVPSQALF

SEQ ID NO: 926509 - protein, 141 aa, Homo sapiens
MHGNLCKFNGADMSVLHTRKLAEILKISGTLILKANPIFLSWTEIDEFCTGQLDLLSKKGHAHRILQGPQTISGIHVPDVQVCYIGRCNAIAGEWLEFKASGSYPVKLYESGVHRLMLLSPMDSAFFLGVFTEVQILAFSE

SEQ ID NO: 926510 - protein, 164 aa, Homo sapiens
MELLAQVKSSKHKTLKNNKSTTCDKCGILVGLSRQLTMSKVKLMALAGVKVDHMALIGSTIVQAQQRDTIMIQCSNDLRGLIRKMSATSVGLGRQLAMSKVDHLALAGSSTIQVQQRDAIMIHCSLHLPTASIGPGRQLALSKVSQIALTGSSIAHITQHEAQK

SEQ ID NO: 926511 - protein, 184 aa, Homo sapiens
MTMAVLIHTKKTLFKCEECGKAFKQSSNLTEHKRIPTREKHYKCEEFGKDFKWSSNLPENEIIHIGEKPCKCEECGKTFKWSSNITGHKIIHTGEKLYKCEECGKAFYSSSNLTLHKMIHTAEKTYKCKECGKSFSQYSHLTTHKGIHTGKKTYKCKECGRAYKWSSNLTEHKITQNWRETLQM

SEQ ID NO: 926512 - protein, 157 aa, Homo sapiens
MGPCLRQAALEGELLACLMMEDQQGNHVHEPIAFKTYKEIRKSIRENGATSPFMKGLIEAIAYNFHMTPWDCFLKHILTFCLSVPWDENSSSVLSTTKEKHHVTKTSGTEIADWAKIVHFLKDDLHGKAANNFRKIQEKLPLMGTYTVVQLDLFCKW

SEQ ID NO: 926513 - protein, 429 aa, Homo sapiens
MVDETPEKSYKCKERGKIFNWSSTLTNHKKIHTEEKPYKCEEYRKAFSLSSNLTTHKIIHIGEKPYKCEECGKTFNKSLTLTIYKRMHTEEKLYKCKECGKAYVWSSNLTKHKRMHAGEKPYKCEECGKAFSQSSTLTTHKIIRTGEKRYKCEECGKAYVWSSTLTKHKRMHTAEKPYKCEVCGKTFHRFSNLSAHKIIHTGEKPYKCEECGKAFIWSSTLTEYKKIHTREKPYKCEECGKAFSRSSTLTIHKRMHTREKLYKCEEYGKAFRQSSTLTAHKMIHTGEKPYKCEECGKAFNSSSTLTKHKIIHTEEKPYKCEKCGKSFNQSSILTNHKIIHTGEKPYKCEECGKAFNRYSNLTKHTIVHTGEKPYQCEECGKAFKWSSNLTKHKIIHTEEKPYKCEECGKTFNQSSILTNHKKIHTVEKP

SEQ ID NO: 926514 - protein, 149 aa, Homo sapiens
MLWLCSSVHTPTLPGRPEPLGRAVGWCTGEAQISPGLSGHPGYPESGALLEGQSRGSPEARAGANRGGEGTGQRLRFGGVQGSGDRAGEIRWEIGRVGGGAALVLAEGSSSGGWVPRLPGRTENDPVSAARRGREPGRSLNRGQPQGFS

SEQ ID NO: 926515 - protein, 386 aa, Homo sapiens
MCVNGVCLNEDGSFSCLCKPGFLLAPGGHYCMDIDECQTPGICVNGHCTNTEGSFRCQCLGGLAVGTDGRVCVDTHVRSTCYGAIEKGSCARPFPGTVTKSECCCANPDHGFGEPCQLCPAKDSAEFQALCSSGLGITTDGRDINECALDPEVCANGVCENLRGSYRCVCNLGYEAGASGKDCTDVDECALNSLLCDNGWCQNSPGSYSCSCPPGFHFWQDTEICKDVDECLSSPCVSGVCRNLAGSYTCKCGPGSRLDPSGTFCLDSTKGTCWLKIQESRCEVNLQGASLRSECCATLGAAWGSPCERCEIVADPACARGFARMTGVTCDDVNECESFPGVCPNGRCVNTAGSFRCECPEGLMLDASGRLCVASRSAGSPARIYL

SEQ ID NO: 926516 - protein, 277 aa, Homo sapiens
MPLWLKNVDECARDPLLCRGGTCTNTDGSYKCQCPPGHELTAKGTACEDIDECSLSDGLCPHGQCVNVIGAFQCSCHAGFQSTPDRQGCVDINECRVQNGGCDVHCINTEGSYRCSCGQGYSLMPDGRACAELLERPQTTRVTIAILTWLQVVLGPGEQMCTGWSIRAKLSTVPNPAPPDVDECEENPRVCDQGHCTNMPGGHRCLCYDGFMATPDMRTCVDLMLSSPTDVDECDLNPHICLHGDCENTKGSFVCHCQLGYMVRKGATGCSVPRGVP

SEQ ID NO: 926517 - protein, 397 aa, Homo sapiens
MNARLEDTTVTVTPPVSTSRGVSAVDLDECVSQEHRCSPRGDCLNVPGSYRCTCRQGFAGDGFFCEDRDECAENVDLCDNGQCLNAPGGYRCECEMGFDPTEDHRACQDVDECAQGNLCAFGSCENLPGMFRCICNGGYELDRGGGNCTDINECADPVNCINGVCINTPGSYLCSCPQDFELNPSGVGCVVQNLCPGGEGFQPNRITVILEDIDECQELPGLCQGGDCVNTFGSFQCECPPGYHLSEHTRICEDIDECSTHSGICGPGTCYNTLGNYTCVCPAEYLQVNGGNNCMGDPYPHSSPVVANYRYEEECLLPASTTAHVKMSWPSSVTRKMCCCSYNIGQAWNRPCEACPTPISPDYQILCGNQAPGFLTDIHTGKPLGDPWNPPFYFLTL

SEQ ID NO: 926518 - protein, 162 aa, Homo sapiens
MQKSPVFCVAHAGSCRLALFLFGHLGTAEDIFLLQVYTCTNIFLTKEEENTHDNFSPCFAAGHVVVPGIDDRLLLLPILYSLCLQQTPQQFNGIVVVSPGGSISPSGTKTTRDSAVWNTMTVDKAFCESTDGSFGRSIACGIGKPISGVSVYSSEDKPLSFV

SEQ ID NO: 926519 - protein, 158 aa, Homo sapiens
MEFKGYLLDIHCFGSVMHNTEHLVYITGITFYSGLALLAQVSGAGPSRGIPEEDIVIIGDNSSCMLLPLKTFHWDKMWRWKTVIWMLLGPLKRADWWHKYNCQCCCCPLPAPWKNERSAIYSYCKPESSLVMLPHNLSLESSKAGIMKEEMFCCDEAA

SEQ ID NO: 926520 - protein, 124 aa, Homo sapiens
MKLDPYLTPFTKITSKWLKDLTMKLTTTKPLKENTKEKFHNTEFSNNFLDMIPKAQTTKQITSVGDDVEKLEPCKPLVGKLNGAATMENSMTVPQKVQPHSSLSSGHICELPADAIGSLFQEAI

SEQ ID NO: 926521 - protein, 136 aa, Homo sapiens
MEKEEEEEEGGGGGGRKEREERSTGWERNSHAKSKAKRVSTDKTASRQNRCLGAEDGVGCLRNRKEGHVAGGRQTGQIKQSIAEQGKKSGLYSNFHKMNEIGHVTLNNPFLASVSIFLNLLGMGKKPCLMYISEIV

SEQ ID NO: 926522 - protein, 157 aa, Homo sapiens
MWVWNEVLLSLGSDSHHQTAMTLSLIVSEGNSCRTAEPTSQLSKNNLNANPKILKPWYKSCFSQTRSRHWDGSGPGTVAARLPGLTGGCFGKQRPASPGSLSWTPESRVLLEKAKACPMSGRNRLAEQQIQILMKKKIENTELAILFKAWSLKNKAR

SEQ ID NO: 926523 - protein, 135 aa, Homo sapiens
MDNKCTLFGSPWGKGRHLCSFAPKLLRACTDRNRCQQGETNTLILPDDLSQMWIEVSRGPQDEELSYPVPCTCPTPTCHVTTDVPSVPINGIIRKHAGEHQGKVDITVEHRKPRTASRRGEQGVLPLPTLPPPLG

SEQ ID NO: 926524 - protein, 148 aa, Homo sapiens
MANLRFYNMISEISSKSDMLESSDRNLEFLVNSVRCEGLLRGLHIGILQLAGWSPGDGQLQSGIFLRSTSLVGRLRLLGMFQQAQGTPVGRSVNTGCLTMSWMGSQLDEGCVRSPGKRSSSKAVLSRFPNGLTLSDFEFQLHRKNTSV

SEQ ID NO: 926525 - protein, 172 aa, Homo sapiens
MGKKQNRKTGNSKNQSTSPPPKEHSSSPATEQSWTENDFDELREEKKRIKRNEQSLQEIWDYVKRPNLRLIGVPESDGENGTKLENTLQDIIQENFPNLARQANVQIQEIQRTPQRYSSRRATPTHIIVRFIKVEMKEKMLRAAREKEESGGQYSTFLKKRIFNPEFHIQPN

SEQ ID NO: 926526 - protein, 161 aa, Homo sapiens
MAKSAKQQRWQPAPPPGSFISRRYNAVTSGWLEFQARASYPEDVQESNLLLARVAAAFAGKPRKLGYLRLLAHVTFKENKIQVCPIPNCKSFRCLQNQSQTSYHVHIALFDLAPSYHSYFTFYHFSQDDMSYLLSKQLSFIDGSDRPIALMYAHFTLLVRL

SEQ ID NO: 926527 - protein, 137 aa, Homo sapiens
MSDTPGMVLNTPLNGAHEGGINGPSPCTKGCAKGWESRGEEIRCCPGSRGAWGPAGEKNVRPKQIPDMHLLSLMIFKCQGGKLREGARGKTAEGYHNKLPQTSEDTYLPLDLGPTKITQDDLILRSLSTSANTFFSK

SEQ ID NO: 926528 - protein, 175 aa, Homo sapiens
MRGTVVRAGKTKLARPNSSKSWQDLELEGLVETLKDCKHTTDMIRQDGLRNHSEDNSGCVLVVLRRQLWLHFGGWFEKNLLLLRERESTGSWKETAANQRKETLLWVCFGATPFRIQEREKPRDRECQRKGGACSVCIYKSEFTSVDFEGVFPPKDLRAVIRHKRDFSLYWLSFS

SEQ ID NO: 926529 - protein, 134 aa, Homo sapiens
MIIWNDNQNSPSHFSSRIAASCLVFAFVERSKAGTGVTTAPSPVSPCALGHFPKPWLDPSMPLGMPTPSLLLGFPSEMLGGRGDNSGVLPGSLSLTSWEPPNPFSIDWAHVRPPQSQNLSGIFFPLPFSGLTPS

SEQ ID NO: 926530 - protein, 143 aa, Homo sapiens
MLSERSAALLFKRQMQKHPLPHLSLRNISSHLIEVIPHASGSSMFLMSPTESLVAHTFCSMAIELAPLHPLDLTDTGPIMTLTQPSGSSAHPFYLLEKCPSCSQCPGEALTTLSFSGFLVPRVLHHLLGLPYALPSPLRMVPL

SEQ ID NO: 926531 - protein, 124 aa, Homo sapiens
MATGNQSHFKASIKAFWFSQHSLNIQLEILCLLFSHFKVFSAVNKRPPHSNLCNYYCLCTFNYRNHRNPHLTFQLALHLRQPQAEVLVIRMPLGVRGLAPLKAEPETKAYIQALFWDYDPREQK

SEQ ID NO: 926532 - protein, 231 aa, Homo sapiens
MGQLQASALVSDATYVIICMDVSGGVDEVVCVDVSGDVGEVVRVDVSRGVGEVICVDVSGGVDGEVIRGDVSGCGCVDGEVICVDVSGGIDGVVICVDVSGGVDGVVICVDVSGGVDGVVICVDVSGGVGEVVCVVVPGGVGEVVCVDVSGGVDGEVICVDGPGGVGDVICVEVSGGVDVSGGVDGVVICVDVSGGVGEVVCVVVPRGVGVCTIPGDNNNSSRRSSSSELS

SEQ ID NO: 926533 - protein, 155 aa, Homo sapiens
MTAIPAAVRPQQLSPQQLPPQQLPHSSSSPNSSSPMAVSPTEAPLTAAPQQQLPHSSSPDSSSPTVVFPMAAPAVPPTAAPCTASPSEQLPSLPPWTGSKSGCILWGRHELFLVLPTEALCVIMVLRTCTGLQAASSSMIWRWCSHHAGPSQLCV

SEQ ID NO: 926534 - protein, 153 aa, Homo sapiens
MGEQEDLQTALTVHNQSFEQQTVRKIKAGRHSSSQGPPVEDEEECTQGLNCPELQTLDTSPRDGEAKQPVPQLGEGLSMGQEKDAPGWGIEDMEGWGGARQEFKCCPHRCHTAYQAPIILPQVTAVASSLVSLPPPLCPYNLPSQQPEHPLMT

SEQ ID NO: 926535 - protein, 193 aa, Homo sapiens
MLPCCVPGLVLGTQMEDALSKWGPCTPGPIGFPPMLIGAQSPEGAKVSGGWHVSTALSMCTPSRAVTVPRLSADFALRLEWVLTAGGSQAVGAGISNPARTGAAFLGPQECRDARVHSCGLGGYSCAQFGLGCRAPACSMEQETMGLQPQLGLLWLHLGSSCPTNLEGFRSKYPFLQEIFLLSFSEPPQHSII

SEQ ID NO: 926536 - protein, 151 aa, Homo sapiens
MRQGALWTQPQWDLMPRPRSDTPCTPTNNAAMKAGLQLRADHQGGSARQHQETTALDRICHWPDSLAHSRHFAKNFHLTEIIKKYTDHYLHREDVRRKDSELNSKPSCSDFHFTVGKGKPTGSSLLLLQARHTVGAPSQKSSPIRPDCRTL

SEQ ID NO: 926537 - protein, 149 aa, Homo sapiens
MGRRSPPCLLPPAPQAQCQYLEGQSTQGHQQPDPSRPPTPSTSTRHELIPSLVPACQGQLQRLVRGVGSSVIESSAFSSVTPATFHSFLVTLQPSNQGICDCDHVLDEVTVTHGINDGDIVLLCPELLQKDVDGMPLIWFGCVPTQISS

SEQ ID NO: 926538 - protein, 194 aa, Homo sapiens
MDLHRSFGPTPLFDRHGKCHSLTPPISHNRILIIPIIIPIIIIPIIIITITIIPIIIIPITIIPITIIPTIIIPIITIIPIIIIPITIIPITIIPTIIIPIIIITIIIIPIIITITTIIIIPNITIIIIPIIITITITIIIIPITIITITINITIITITIIPIITIIITITIIPIIIILLLITIIVICMEASLY

SEQ ID NO: 926539 - protein, 153 aa, Homo sapiens
MAPIALWLLAGSYQAALCIHLWPWVQVTSPSPPFRPQVVTAPHIACQPWVSWSAIPSSPKHPETPTPEPRVVRRVHSELVTIILTLIVEKLKCVEKASGGGRQFLAFPGFRQTPLQFQPPSSCGILPVCLSPLRIMTPVIWDEGPILLQYDLI

SEQ ID NO: 926540 - protein, 141 aa, Homo sapiens [sequence omitted]

SEQ ID NO: 926541 - protein, 136 aa, Homo sapiens
MRNWPCLLCPYRFFGWLERNSFPRVLIINIPCWEKNLAIALLLAHPFIGSLQEEKYGSFCPTPQAGRPYGCLPLFPKNCYYSVLFQGALISYCSNIHVLPSICTVRYNYHSGPETVSAACPQLDYFPWNPDPLSDI

SEQ ID NO: 926542 - protein, 203 aa, Homo sapiens
MQVTLWHPCPEDDTYGGEKPNPCSIITIVITINITIFTINITIITTMFTIIITIIFTMFTIITITIIILHHHHHDLHYRLHHHHHHHHIITIFTIIITINTIFTNTITTMFTIITITIIITIFNIITIVTNTITIMFTIIITTMLTIIIIIIFTTITIIITIIFTITIIITIFTINITIVTTMFTVITTIILTIIIITIIITR

SEQ ID NO: 926543 - protein, 172 aa, Homo sapiens
MIGQCFMPACCLPALGLERLLMVRLDGENASKELSAIPGSNSSPLELSLLPLHQWLYATYDPRITYDLCIIYDPHITYDLWITYNLHIICDLCITYDLHIIYGLQVTYDLHITCDLHITYDLYITYDLHIIYGLHIIYGLHITYDLHVTYDLHVAECSINPKSSADLACSFP

SEQ ID NO: 926544 - protein, 142 aa, Homo sapiens
MQEFLPRRRQGKATVEHSAPLPNRIRPGETDQLGPGVLFCPRTSLELDLVSRRIFLAQQPRSFRRWACQGKLCFLPLRGVLLPLRDLLTEAGKSRICFPKEQAEPHTAKSQNGFQGREPSVDQRIQMTSLVWDSPQEVYFIL

SEQ ID NO: 926545 - protein, 170 aa, Homo sapiens
MVGVSKRESVTVKDANPEETGRPQSEIFFESPDPAMPEAMHTWIFQVASPPGHVWSEQGTGFGAGTWGVEDTPPLLEKTTRLYLEEWSPSSPHPVGIQQTESSGVGGGGTSKHLDQEPQGFFSALYLPSFLTFTCSQGCEKPGSLGAQASDLQSRLAEALACAGKERVKA

SEQ ID NO: 926546 - protein, 331 aa, Homo sapiens
MYSHNLYFHDFPGCDDDDGNDGDNGDSDDGDDDDDDDNDDGGGDDDNDGNDNDGDNDNGDDDDGDDNDDDGGDDDNDDDGDNDDSNGNDDGDGDDDGVDDDDDNSDGNDGDDDDSDDDDGDSNGYDDDGDGNDDDDGDSDDDDSDNGDGDNGDGDDDGGGGDDDDNGHDDDGDMMMMIVMMVMVMMVVMMVMVMMVVVVQLRKRAEASVSEAKVGPEESVQGGHSPKELLKEQHACPEQEELKVIVKAIFKHWKAVTWTRAFKYIKHPALYLAQNRCSINVSDDNDDGDGNDGDDDDSDGDDDDGGGDGGDSELTNQFPTNHSGMKASKKS

SEQ ID NO: 926547 - protein, 197 aa, Homo sapiens
MGRTGDGSRAPLCALNTSSLLDVITRGRGLSLLWKLVVLEETAPVMLEPLSGCTLQGLGPGGGTVAEAAALGTFLCQQICWTAATPERGSLCMAGAHRSTEYRAPPGLSRRASRAAARGANCNWQVNSSQPGSGTASPVLRGAVNTAVPAVLPTKVLQGLGSGWPHQATDRGQSLESSGQGETPCLGVNVGLDRPLC

SEQ ID NO: 926548 - protein, 213 aa, Homo sapiens
MGSGNRRLTGSEAQWTPCRIRRGGSQQWVCNSIDQQWWTGSKSSARAGTNMDQKSVLLQDLIEGGVEQARLGPVLGLALGLDNCSPAQSRRNLGPKHLSTGEAKFHDQSRGAGDGPAKGKSTQVRPGSSRYPDSIREGPPKRCPNPQQCPLLPTFVGLNESTQLRKAVCSRRREGVCKAMFLEYTKGNRHNPNVALQTLNAAAYPGQAATSSS

SEQ ID NO: 926549 - protein, 166 aa, Homo sapiens
MPLLLDVGAILLLWQEALILRTFSQHWMGLLCSGRPLEAALKNPLDPISPVPGGKKARAGQCPPGDANVDEFSLQYRRGHSNSPEMKCHLKATQIINREAGPTLSCTVSSTAAGILLSWFTPGSQIPGQWGHQGDAPINWHQKPQIEKRQSRFQCNGKCEWGRASP

SEQ ID NO: 926550 - protein, 134 aa, Homo sapiens
MSYKPALFGFLFLLLLLSNWLVKYEHKLTLPEPQQEEEKPKTSENDSKNSKAVNTKEVNRTHACFALQDEILQRLLFSEMKMKVLENQMFIIWNKMNHHGRSSRHRNFPMKKHRMRRHESICPTLSDCTSSSPS

SEQ ID NO: 926551 - protein, 139 aa, Homo sapiens
MSEYFRFCFVTCSVLDPNKPQSLRCTELYTVLLEPAVPGEDRGVLWAGNMSCPLAENRWFPHMTCFGQWDVGRRDAAVTHLGWLLHLTTAVRTWLDSLLKDERHTEQSQVSPVTPSKFNYISQGQPTSASNDGTPQTCK

SEQ ID NO: 926552 - protein, 136 aa, Homo sapiens
MIRGPQGQPEMKEESFHGSFLGVGSALYMHKDFWSPRNMLTLFNAPYLWIFNFPDPPFKFLGQHIVCFNWYYCLLCCKDKQFLLIVFSKHPEDRAFPTAAMLLVLTATMAAKLLLFKATTQEEQNRTLLGLLQAFD

SEQ ID NO: 926553 - protein, 163 aa, Homo sapiens
MQCMWVCQPCVASTHRSTCTAFEGAVFAPCKRGTLCLSASSLVCSGERGPFKEVGLEKAALGLGTPVFSVTYNHPGPTSLPTFRLVESQNGNLGPQPMRAVFEEGLFILDPRVPVASAQNDRHYLCWLICTASVDTACASSAERELQVVWHLIGMIGLPQVCL

SEQ ID NO: 926554 - protein, 132 aa, Homo sapiens
MSAKTRTVLGTLGWLDTLSAETKAQVRCHVSQERRAESADASQARGGMSQHEFDDTKADFLGCYHVPDKPDPQKELNTWLEWGSGDLEGLRGQEVAILIECQKEPGIGTTAGNQTNGSWQGDSDTVLLITVK

SEQ ID NO: 926555 - protein, 230 aa, Homo sapiens
MVYPRTHWVLQLPPPRCHTAVLNTSSSMTTRLSLLSTWASAGPLSPQCPPPSLSGSASYLFLTLGHDISIFAMGETFLGQSTYHGWELSSSSISTVPVGPSSELSSLTGGVESLPKSLQLTPTPVTTLACLMWRLKGKAVLVMQGRQALKWGLAAGFLALPRKEFKGKPEVEGNSFVKEAVSQLCDCCCRAGLPHRQRVAAQGSFAVTFIPTFNDMQIKGRFMQKDLGKG

SEQ ID NO: 926556 - protein, 116 aa, Homo sapiens
MWVLCPCDTSENGQGWPSPLPGPVPGASPLPPLTPHESPFCSPEMTTVETHGAFMNSPIFTGYPLCADTVPSAGDTTLGAQCGAKEEDGMRDGKAVGEAAASRMMNREVVKQSCST

SEQ ID NO: 926557 - protein, 136 aa, Homo sapiens
MRNCCFICTSQLEPAGASLTEVLLAKRGSHSDRISPQPQGIWNKFGPGPYMSKTCISAQGPKWEVPLNMPDFTLNSPRAFVGIGPIFMDRVFGGLGPYGRRKHETEVQRIQDETHKRVDRQGCLGPCFTLRQTQVP

SEQ ID NO: 926558 - protein, 285 aa, Homo sapiens
MAQSQSESHKNIPRVCTQLLLEACVQATVPIFIYTSTLEVARPNSYKEIIQNGHEEEPLENTWYAPYPHSKKLAEKAVLAANGLTLKNGGTLYTCAVRPMFIYGEGSPILSAGINEALNNHGILSSFSKFSRVNPVYVGNIAWAHILALRALREPKKAPSVRGQFYYISDDTPHQSYDNLSYTLSKEFGLCLDSSWSLPLSLTYWIGFLLEIVSFLPRPVYTCRPPFNHHRVTLSNSVFTFSYKKAQQDLAYKSLYSWEEAKQKTMEWVGSLVDWHKETLKSKTQ

SEQ ID NO: 926559 - protein, 463 aa, Homo sapiens [sequence omitted]

SEQ ID NO: 926560 - protein, 160 aa, Homo sapiens
MLDSGHPAPCPRPLAVQVKPGFGKHQPVCPRPQPVLLCHPSALPSGLLCPPGAHRLTNIVTASCWWGRQWLSFGLLFLSENTAASPASRSWLVVRGGHLHAPTSVAACHCAFEVVPDFPVCLKLLAVYAAAGPASPPAGPFHDGASRWGLGETATGPPGG

SEQ ID NO: 926561 - protein, 151 aa, Homo sapiens
MRDRRPRLAPPQNVTLLSQNFSVYLTWLPGLGNPQDVTYFVAYQRCQKTPNIYCVAGTVSTHVMNLISQQLSEDKFNLTDTFPAVHYDKMFQVPLTLGLKLVVCWGLSDLWSQTEGCTFSFPGFEGFRFGLSHYGFFLSHLADGLSWDFAL

SEQ ID NO: 926562 - protein, 143 aa, Homo sapiens
MARTPQIIQFPKLSKYIPSSCSQILYLLKVICNFKINTASAFVIIRGHRRVAKNLSRSTSTFRLRSSKDLLSHLMQSWPEDRDGRGQRRVVQEGPALGTIWRGLNPNSGISDLKIRRLSWIISLGGPNVIASILIRKQEAEEE

SEQ ID NO: 926563 - protein, 141 aa, Homo sapiens
MMILLENTMSPETLLSYPEEGIVIIGDDSSMRVIAPEDLPLGQDVEVEDSDTDSPVPVTEPELGNKQQLLKCPLFPHFKSCINVMMVVPKQNTSSLTRHNLCRVKGPSEGLLKNQLLKGRLIGEKVLWLALGQRGFVLETR

SEQ ID NO: 926564 - protein, 180 aa, Homo sapiens
MYEEQALCRHRICWHFALDVDFPWTVLVEAQNKRVVEETSVPLEITQVVINNMDPKGHSDEVSDRNKDHVTENWRKGDPWYKVAMNLAKFCPCLSALWKSQSTLVVGVWLWALLSKVMEVGPLGAIKISKNDPESLMVQAENCHRSVATTDSLHQAPMPSGAMRSKRRMIIRGNGSFSER

SEQ ID NO: 926565 - protein, 308 aa, Homo sapiens
MKRKNFTEVSEFIFLGFSSFGKHQITLFVVFLTVYILTLVANIIIVTIICIDHHLHTPMYFFLSMLASSETVYTLVIVPRMLLSLIFHNQPISLAGCATQMFFFVILATNNCFLLTAMGYDRYVAICRPLRYTVIMSKGLCAQLVCGSFGIGLTMAVLHVTAMFNLPFCGTVVDHFFCDIYPVMKLSCIDTTINEIINYGVSSFVIFVPIGLIFISYVLVISSILQIASAEGRKKTFATCVSHLTVVIVHCGCASIAYLKPKSESSIEKDLVLSVTYTIITPLLNPVVYSLRNKEYFNTIPAPPTLCR

SEQ ID NO: 926566 - protein, 336 aa, Homo sapiens
MCIIPGLGLPRVRNRGKSDRPFSPPEGNSEILKRKEKQEQEQQGGAPPPTSLPSVGHKEKTFSSDEDGLELFSPQNLKALMNVVKGVEVIREMEATEEEGGKGSPCLCCYTNTARAMGHSKSHGHKSNWECVPKKLHGMKNENREKANCPRGTSKAVPVVAFKALLNLPGDKNPGPAELQVAGTSCNIPVFAELWALGPSESCDTPPFTELQAARLNKSCDMPPFAELQAVGLNKSCEVPSFAELQVAGTSCNIPVFAELWALGPSESCDTPPFTELQAARLNKSCDMPPFAELQAVGLNKSCEVPSFAELQVAGTRERAVTFLGVSGLGIPQAKL

SEQ ID NO: 926567 - protein, 143 aa, Homo sapiens
MGAVCSMKSSNDPLRYSWAIYAVQSSDSCTVTPKRWADLNVVGIIQFIEGLTRTKRQKEEFVPFASRLPVEPLYWDLHHQLPWFSGLQTRTGITPLAFLDLQLADSRRFLATGPGQQTDSSGACRKHDSALLILSYTLRLHRP

SEQ ID NO: 926568 - protein, 144 aa, Homo sapiens
MKVGKKQCKKAKNSKNQNASSPPKEHSSSSARAQNWKENECDELTEIGFSRWVITNSSKLKEYILTQCKEAKKLEKRLKELLTRITSLEKSKNDLMELKNTAQELRTTKHGKEQPVPPTAKTYQIVKTIDTMKKLHQLTGKITS

SEQ ID NO: 926569 - protein, 165 aa, Homo sapiens
MASGFIHQTGPSFARLLQFAGGPLQILFTWVPPHPGGVTSGGCRTAKMAACFFLWELQSAAPVPTGTQSQGDQGSVHKPLAGVAEIPTGRSHSVRRDESGSSLKMQSGHSLPQLLCCTMGNSSWFQTTSPSGTGRGKQQTEAAVMAAAPSPKNSVVLDGLQPSGS

SEQ ID NO: 926570 - protein, 312 aa, Homo sapiens
MGIPSWSTKDRKPDSVHGSSNSAEPWPVQLLWAGDVYSTDIHTNFRDCHGSSPRGLRRPPLPLTSKIPEGPGYVGVISEFVGEELFPPPVLSAIPSPEPREGSLVTLRCQTKLHPLRSALRLLFSFHKDGHTLQDRGPHPELCIPGAKEGDSGLYWCEVAPEGGQVQKQSPQLEVRVQAPVSRPVLTLHHGPADPAVGDMVQLLCEAQRGSPPILYSFYLDEKIVGNHSAPCGGTTSLLFPVKSEQDAGNYSCEAENSVSRERSEPKKLSLKVHLSTEPGREILKSMESGEPHGGSSHVVTRGVTIILAAIP

SEQ ID NO: 926571 - protein, 196 aa, Homo sapiens
MTRVEEIFHQNSGPSAARLLEFDGGPLQTLFAWVSPAEAAEQQILQNGKCCCLILPLEASYQRGTQLYEVSVSPYWEVYALPPRNEVYRGRQASLSGSGLQRFRAFQLLCLPTQASAMVDAPPPALLPPCSSISDCCASSKRGSMGMGPSEPGYNLLKSPHIRRLNHHHAANYNNVSWGHLDNYSAPPEKDVPCHC

SEQ ID NO: 926572 - protein, 142 aa, Homo sapiens
MCSEGETRLKSIKTMISCYSKDLAQLEPIWGETRSLADISILVIQSLSKCTYFADLGLTVTLTAPTSFYPNNNAMHPFVHVSLWVIVKTSRGIAFELYSFSKKFMYPKYDFIPTNCSLECLHQSILQYSIQRLLYPYISLLF

SEQ ID NO: 926573 - protein, 137 aa, Homo sapiens
MNNFCSSTLKRTNGDPCYSDAPEGEEGSRSALWELAPDQPCGSWPQISPAGVGPRSALQELTPDQPCRSWDTDKKLRGLGEGSSDIDKVSSPRAAVAVGVLMISENQGGDLNNGKEMKRMLWCGDYWHLARESFLED

SEQ ID NO: 926574 - protein, 218 aa, Homo sapiens
MGSSQDISEDRRKAANMAVPKDTAVFSRGDRKARRRARFKRSNSVTAGVQADLELEGLAGLATVATEDKALQFGRSFQRHASEPQPGPRAPTYSVFRTVHTQGQWAYREGYPLPYEPPATDGSPGPAPAPTPGPGAGRRDSWIERGSRSLPDSGRASPCPRDGEWFIKMLRAEVEKLEHWCQQMEREAEDYELPEESESRHRNKGTLGTMASCVLRRP

SEQ ID NO: 926575 - protein, 138 aa, Homo sapiens
MDGLEPVKRMVLIRAMQRQKLVMLEKRRKAQERSSKVLDTDLVIVNNWQGVLDTDQAIAAGWWRLLDTDPVTVPGWWRVLDTDPGIVGFDCDFGVGMQGTLNSVLPAVLRKGLELVRSFWVTSDTNSFFLNFFYFLLF

SEQ ID NO: 926576 - protein, 128 aa, Homo sapiens
MDDRIFSRKKTQKSWSEDSDIAWVYVKFQWGRPHNTLDTQEPGKWDLIAHSAMIRAGQKIDTGNTANKVEGKMQSERSRRTTIFFTEHFRYARHIFIMTFYFETVQNSQKLQTSAIMPMYPSSRFSQW

SEQ ID NO: 926577 - protein, 154 aa, Homo sapiens
MSRPRRLSWKLSLTPKPGQASLLGSPIPALPTLYHHYLCPPLNFESQQNGARTVLFATGSLVSPIAGPNTGLRIHDCPLKEMSSWRQPSAGVARVSDRRCRQGSETSEFRFLAYAWGLGHSKPHYPYLLPNQENGNLSADVTSFQWLNCSLCHS

SEQ ID NO: 926578 - protein, 157 aa, Homo sapiens
MKVRISATASVNLGPAPEQLCGGKRHQLPLQVKRGIEVEAILGRMQPTGRKLEKLDLGKGCGERRRDGPSPCLWQSQRVSVRQQTKNPGDSRRGLGGSPRELEPRGRGEELGSWGPGGKAVPRTCRASEAGLEFGSGHESQQGLSWAQSPPHDLRAE

SEQ ID NO: 926579 - protein, 139 aa, Homo sapiens
MLRVTQPANGRTGLEHQLTGCRVCALSQFAVALSTLCVRQFTGTLGPRNSPILQMRKLRHRSSNIPEDTQLGRRIEHIRWEIIKPLMPNAKIIFGEKLLTPFSKQKFYDGKNLSCCSPFVTQKGPILFVSICLSEFELG

SEQ ID NO: 926580 - protein, 133 aa, Homo sapiens
MRGWSSVVQYLALSDSGRLMCEGQIEEVAGKDPPMTSGPQTDQPKEHLINFKSACVLKNLKPLQLTPDLKPKPLVFFCNTTWPQYQLDNGSKWPENSTFDFSILQDLNNSCRKMGKRSEVPDVQAFFYTSVPP

SEQ ID NO: 926581 - protein, 150 aa, Homo sapiens
MAHQLIVPWLPLPWPRVATSAAGSHGSFSEAACWVLAWTPSIEAPQLAGTLASCRLDPVGKRDGQSVPGHWAPAGAKDPSLSQAGQTFVCGWLRRAPPPNPAAWQGMHLLGDLGDLRMGTVPGGLSPKPGCRHYGFSTLSSLEVFARAEP

SEQ ID NO: 926582 - protein, 142 aa, Homo sapiens
MRLILSFMSPIKGRRERQRRLNTYYAPGPVPSEDSALLSMFPQVGSQHPSSLNLLEDGRSALDLDLAWPGGHLQPGQEHLPIQVPWDACSAEPQGPGRQPSPGTTSCRPGGILLMPLQGEPHQLSSCFSFWFIILTTHEHRL

SEQ ID NO: 926583 - protein, 183 aa, Homo sapiens
MRLSHPLCKRCPQLCPSSLKVFPSNSSQEDLPLTFLAWLGSGFSRVKLLFLNPVSIAYHWEGGHWVQPTLKSWDDHPPPRGRGIYVNYVEFFCTGYLSSWHVPALSQGQRQRFYASVPENFSRILEIPGLQSQKGQVDEPMRGARGFWHLSLHLPRVSVSPQKGSISQRDAPVSHEGRQSTVD

SEQ ID NO: 926584 - protein, 138 aa, Homo sapiens
MQRHKNDTMDFRDSGEKDGKGEGLRLAGQTWPLQLSTPQRTQETHSQQHPGHLRLSPQSHRATQHRRVQCVQDPAGPRLGSAVAQGPQPQCKRGRGPKVQGLELSGLNPGCGESCRRPGWPRHCAPAGTVSSRGPSWA

SEQ ID NO: 926585 - protein, 136 aa, Homo sapiens
MVCEVTTVTHKPRNNSVKAGTLITKSFLSNAQSTNIFCCLWKLVCKQLDGDAAPGLIEELGSWCLEQGIGQNTQSKEGMKGFIENESTLHSAGAGSSIGAQGPGYRIFLGPNTPYRFPIGHLVVNSCKPSGGPKSV

SEQ ID NO: 926586 - protein, 148 aa, Homo sapiens
MLNKGLQIKVSASFYLRAFCKAPVCNCAYLMVIRKCQGINTFWDGPYQVALVDQYPNSFTSDGIMEWVFYAVSQSTREALDLQNAEKMAAASLPPPKSQGMSLVAQPMRTGNCIGKDMLGNAAAAHLRAHSLIHLLILRAPASSWPLR

SEQ ID NO: 926587 - protein, 154 aa, Homo sapiens
MGTSEERGPPPSTQLSPRTASPAGKWMDSWETSACCLQGVSWSAIQIHSWKEGQKRRLRSKWALDHQQDKARRNILPLGGGGAGTEQSWIAALKAQLEVPLHPLVTSSVYTGDGVSQHPNGPTDPPGYYSACGISDLVFSALCGIEAWLPLQDL

SEQ ID NO: 926588 - protein, 149 aa, Homo sapiens
MLSPRSQTHLFEGRHGLLVPFPLSWLLPFMPWLLLLCVNDGILQNVPGSLGAVSSIGSLPRRPCCLPPTPLPCPLGSSAHLPVSQALLIDVGYPKSQRGATLQDVTVARQLSAVEAGPEGLQLEAMAVGFLQVGPGGHICVYHPSLTQT

SEQ ID NO: 926589 - protein, 144 aa, Homo sapiens
MTRAGPLSNDAVNKLASGRIAMAANCLASHRPSPAVTHTPGPPTVLARKELQVLGPEARQAADLPCSPQEKLSRNPTLLSSRGFGGEGSLPGSRSTKQKGAEGHHTLAICREPFPTQGRHVPLWLPGSPQHPWEDGRSRGGDMA

SEQ ID NO: 926590 - protein, 134 aa, Homo sapiens
MHIAPCKLGCWHLLAVANQHRSFRQLRLQGLAGSELANVTLLLSAGSVLSGHAGMQPTRFPEASSATQNAKFPFPGGGQRGAPAWAVVRQENGFTKSWMVMAKMQGIPWAAQDFSQGQCKPGAAGATTGRTLAG

SEQ ID NO: 926591 - protein, 303 aa, Homo sapiens
MTIWVLMPLFEPLGAGLLETSGRRLLFSLGDVPGEASDPAISSIPTMPTTALAEAAPCGVLLRAQSPREAESGTKWPINGTAGFRELNLYFPLGLTYSYFLESGAPAAVQELAGRLSQYLLGHLHTELWSFNFGKGFDYRMPGSLSHVPRWWGERALLGLMDQPGRQGGRKHRTNSTLVACPQPSFQNVALPEAALAGWGRGGVGGVETPRQKSQRMAAAPGLRTAAPGSQDGQACVAADPLPAPEPVNPGYAQPSPEKRLQNSSAFSSLQFQDNGTHSTSQALACVAGTPPIHFDLHANCRT

SEQ ID NO: 926592 - protein, 167 aa, Homo sapiens
MGLGAVEQGVALVEEARAVQEPTEGVGGSGMAGCRSRALPHGKAAKARREIERSAGGLALLGDPVYPLQLLARVLSPSLPGAGGAGQPAAPSAGPAKPTPTRNSSRPASAARSPGSRSRLSLQAEGVGSGLGQPRKGLPQCSGGLKGSPSAAKVEAQAEEALRAREG

SEQ ID NO: 926593 - protein, 599 aa, Homo sapiens
MKWKDQNIEDQYRYPRKNLRCRMLERFVESKDGTQCGETSSQIQDSIVTKNTLPGVGPYESRMSGEVIMGHSSLNCYIRVGAGHKPYEYHECGEKPDTHKQRGKAFSYHNSLQTHERLHTGKKPYNCKECGKSFSSLGNLQRHMAVQRGDGPYKCKLCGKAFFWPSLLHMHERTHTGEKPYECKQCSKAFSFYSSYLRHERTHTGEKLYECKQCSKAFPDYSSCLRHERTHTGKKPYTCKQCGKAFSASTSLRRHETTHTDEKPYACQQCGKAFHHLGSFQRHMVMHTRDGPHKCKICGKGFDCPSSLKSHERTHTGEKLYECKQCGKALSHSSSFRRHMTMHTGDGPHKCKICGKAFVYPSVFQRHEKTHTAEKPYKCKQCGKAYRISSSLRRHETTHTGEKPYKCKCGKAFIDFYSFQNHKTTHAGEKPYECKECGKAFSCFQYLSQHRRTHTGEKPYECNTCKKAFSHFGNLKVHERIHSGEKPYECKECGKAFSWLTCFLRHERIHMREKPYECQQCGKAFTHSRFLQGHEKTHTGENPYECKECGKAFASLSSLHRHKKTHWKKTHTGENPYGCKECGKAFASLSSLHRHKKTH

SEQ ID NO: 926594 - protein, 119 aa, Homo sapiens
MTLQCTGTIKAFPTYLTFMRSISSVPYHVSLEASQMIKCFPTLLTFMGFLCTVSQRIEGLPTFLTIIWFVSCVRNFVGLKRVAITEGFPKLFTCITLLSIFLILMWFVPSINSDVAMKG

SEQ ID NO: 926595 - protein, 231 aa, Homo sapiens
MQFYYLQVWEALLTLVFFPVCVVFAWMADKRLLFYKYVYKRYRTDPRSGIIIGAEGDPPKSIELDGTFVGAEAPGELGGLGPGPAEARELDASRREVIQILKDLKQKHPDKDLEQLVGIANYYALLHQQKSRAFYRIQATRLMTGAGNVLRRHAADASRRAAPAEGAGEDEDDGASRIFFEPSLYHCLENCGSVLLSVTCQGGEGNSTFYVDYRTEDGSAKAGSDYEYSSS

SEQ ID NO: 926596 - protein, 143 aa, Homo sapiens
MRRVGRWGAQVGASASAYSIQYSCMLHVCSLGTIGYTIQPSCVLGYTIWVCTAYDVHATRKKSPEDTSLRQISVVKYFHRTLPYFLQISAQCNLTREAFTDLYKTIPSDPILFPLFFFKRYAVSTRATRYKVPWSPGNVAGLN

SEQ ID NO: 926597 - protein, 263 aa, Homo sapiens
MAIGSLTINEERSEIVDFSVPFVETGISVMVARSNGTVSPSAFLEPYSPAVWVMMFVMCLTVVAVTVFIFEYLSPVGYNRSLATGKRPGGSTFTIGKSIWLLWALVFNNSVPVENPRGTTSKIMVLVWAFFAVIFLASYTANLAAFMIQEEYVDTVSGLSDRKFQRPQEQYPPLKFGTVPNGSTEKNIRSNYPDMHSYMVRYNQPRVEEALTQLKAGSAQTRAGGGGWAAGDLRMLKDGKGSRFIHSVPEVSPGWVSLEGGGH

SEQ ID NO: 926598 - protein, 159 aa, Homo sapiens
MALLALVTENRCIPKLTSTHSYILSNPDPTSGPVCPAFPPNTLDGPSCCHLSWRARGLFKSLLFCLGWMDGWTDGWMDEWMAGWIDISSSFGSSLTSLFFPYPASNLLENRTGFTFKTDPESDHFCYHSSLKHHHLEPGLSSSLLTDLRRSVACCQPYP

SEQ ID NO: 926599 - protein, 146 aa, Homo sapiens [sequence omitted]

SEQ ID NO: 926600 - protein, 124 aa, Homo sapiens [sequence omitted]

SEQ ID NO: 926601 - protein, 140 aa, Homo sapiens
MAASNRTSFWRAHVDMGLPDPILGVTKAFKRDIDSKKVNLVIGANQDNNRKLYLLSNICKAEAQTATKNLDKEYLLIGVLAEFCKTSAGLALGKNSEVLKSDWFVTVQAISRTGALRIRTSFLAVEGNSNGVKKKNLYII

SEQ ID NO: 926602 - protein, 216 aa, Homo sapiens
MALPHSGYITSWITAAFQLGLAMAASNRTSFWRAHVDMGLPDPILGVTKAFKRDIDSKKVNLVIGANQDNNRKLYLLSNICKAEAQTATKNLDKEYLLIGVLAEFCKTSAGLALGFARGDGNKDAGAVYHFIKQGINICLCQSYAKTWAYGERVGDFTIICKDVAEMTKDGHISVAGVTSGNVGYLAYAIYQAMDELSVTVLQLKQENPTLDTGLK

SEQ ID NO: 926603 - protein, 205 aa, Homo sapiens
MMLSAEPELTLAELRQRLIHFSAKDVINEAWFPEDQRVLTPNLVAALPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGGGARKLPPSLWGISPFKQVELCSGAASCSQCADVRGQNDFY

SEQ ID NO: 926604 - protein, 144 aa, Homo sapiens
MTPILPSGSPCLPQWVQGRAEQSPSCLLIRAAPGLNTGKGAWLMCDTLLWCCLEPQHSLESGEIRPLKIKLPWRLPYVKFWFTAFIGLSIGANKVKTTSLYYCLMAKVPSYWIFVCVCIYMSLYCCEKWESSSSKIIKSHNFFL

SEQ ID NO: 926605 - protein, 128 aa, Homo sapiens
MLLGGRCSQSSQDGGGPLPRWWQASCSLTWGSWPHGFQEMESWAMRNNGKPSAQSGVVMDQKHSRHPAGFRGIEVSGGSVTAANSSGGVNNTFLLVINRTRSNVSERLTPVIGASFGELPEHNMLKGD

SEQ ID NO: 926606 - protein, 215 aa, Homo sapiens
MVCSVDASEVAHDSGDESLDSTHTSVPQALPPEGAIHHTFSCPILPCHWYPTPPCPQPGSQAELQRGGRAHTGCPLPSGSPMCAPGPSPYCVPPGPSPYCVPGIGIGMASLQTLTHLFDSHRQSVHYSSLVPFHPTGQVRDEEIEAQRGYTTCVRSHGSQGKQLDWQLLPGHTKSRALAWGGGWLHSLRKLRTCWVWQRSKSQWAQQFMESHPEV

SEQ ID NO: 926607 - protein, 135 aa, Homo sapiens
MCEGTEACPWNYAELYENRNGSGVQAKPQRFQRSSQPCRLSLDADLLQTKRGGCHYRLALGSPAKVVAEPQQKIAMGAKARMGSEWAGFIGDEKWGGAAWTVFKAALSAHTQPTHPGLLLLLRWPGWSGSWYQHS

SEQ ID NO: 926608 - protein, 138 aa, Homo sapiens
MLPCCVPGLVLGTQMEDALSKWGPWYLSARLQLDQVHRKQLPWRPLENTVAPRSLETPGTAGPQRGSHSPGLGSSQRSGYKHRPWNLAAWIHILSYRILEGLKAERAEGREKMQTLGSSSCGGPYLQSGPSWSRDIVA

SEQ ID NO: 926609 - protein, 234 aa, Homo sapiens
MVADVCPVVGQSCVLKDKELVQNCNTTTTTATTTITTTVTTTITTITTTITTTTTITITITTTTTITTTTTVTTTITTTTTTITTTVTTTTVTTTTTTTVTTTTTTVTTTVTTTTTTTVTTTTTTTTTTTITTVTTTTTTTVTTVTTTTVTTVTTTTTTTITTTTTTTITTTTTTVTTVTTTTTTTTITTTTTTTTTTTTTITTTTTTTITTTITTTTTTSITTTTTTITTTTY

SEQ ID NO: 926610 - protein, 143 aa, Homo sapiens
MRLKVGEAKGVGVCVHPWPWDAPCLNPVEGDGDSGVDQTGDHEIYKSSLVPPPSLSREMSMDSASSADQPPTPSPRPALPTDALKLTGIDTALSGSLANMDHSRSLQFCALAENALGLLCSLQTQGFWGWGCCRDCVYGETEA

SEQ ID NO: 926611 - protein, 263 aa, Homo sapiens
MSHHSYHRLRAYSTWASLLTLEHARVTLTSGNLHVWLPLPGLTTQDVLMAPSLRAVPNHSSSSASTAAFPTAAPPTAAPSQQQLPQQQLPHGSFPHRSSPHSSSPTTAPPQQLPRQQLPNSSFPHGSSRSSPYSSSMHSVSLRAAPLSSSLDWLQIRMHPGSWDLDAHALGSRAGPALIQGGWVGPEMLQSTKLPGMLLLLLARDPQQEAGKLTSLKEVTCLGLSGGRPMGMLPASGDFVVFYQKKALYWCLPEKVVDFVYEP

SEQ ID NO: 926612 - protein, 142 aa, Homo sapiens
MSRATGPKDHGGFLEQKTSELNRQMPGQSMSKGCISKDGDEDVSFAEPGASFYSCYHLSRAYSASCSRCANVGLRIGGLGGQLKGHPLWVAKKDHVTSCTEHKAWSMAGGLLQIPVQPFQSSVPQVTAGQWQISDGISVQAC

SEQ ID NO: 926613 - protein, 446 aa, Homo sapiens
MLGSEKFRGGIGQGEETEVRRVGSVSVGMWQGTDEMAQSSQAIFGECKKETKKAKAWAGHKEILEMVLFPGIRQQRAPLPPLEDEEPLDVADKGCHPEAQSRGDKGEARVGRDTPVQGEGIFFIIIIFSIIIVIILSVIITSIIILSIIIISIIMFIIILSFIIILSIIILFIIIFSTIIITIIPILVIILSITTIIIIILSIIIVIIILFIITILLIFSIIIIFPISILSIIIIIIVLSPKEALAALLPGVKAHTCKSQPLRTHLPYSPVHPSLLSPVHPSDRIPWPPPPKPSLTPQARSDPPIIMDSSKEETSEQGSEAAVTLKGTDDEGRCRTPGLTAAGSPSVPRSEEGQSEPARELHVELRREGLWPLGEECSQSGDTAGEVQGDERLFSHLLLVAPVAKPTLKPEGLPAQGLWDHRAGWQGPHQNGLHYTFSYSILVMTT

SEQ ID NO: 926614 - protein, 391 aa, Homo sapiens
MQSIDPGCQRIYSRKKNVKRVTVHWAKGNDQTFQGLLDTGSELTLIPGDPKHHCSPPVRVGAYGGQLVNGVLAQVRLRVGPVGPLTHLAVISPVSECIIGIDILSSWQNPHIGSLTGRVRAIMVGKAKWKPFELPLPRKIVNQKQYRIPGGNVDMSATIKDLKDAGVVIPTTSPFNSPIWPVQKTDGSWRKTVDYYKLNQVVTPIAAAVLDVDSLLEQINTTPGPCYATIDLVNAFFSIPVHKAHQKQFAFSWTSPKYNGEGTSSQWAELCLFPKPSLSSPNGPMNEVTTVAGIEVTNELSNMDFHSPRLAWLWPLPATWWQVDYIGPLASRKGQRFVLIGIDTYSRYGFASPAHNASAKTTIHVLTDYLIHRHGIPNSIVVEEGSHRYQL

SEQ ID NO: 926615 - protein, 128 aa, Homo sapiens
MPKGWENLACRPECFSGIVCSGRSQLSRPEAALWRDREGNFITHIKALKMPISFDLMRPEIYHKEIIRDEDKDLCVELNKNEMGAWDIDKIVHEATIEVLKFLNPEFSYMREKQIFLEAAVFQIPINS

SEQ ID NO: 926616 - protein, 139 aa, Homo sapiens
MGLGIPAGALGQGSQEEAREAGLGTLGWESGPGGKSSQEHRGGAWLLTWVGPGPAPPFSAPNLLVTGQALASPTLENPGDWRCPAKPALPLGTSCSYARQRVAEGGPALLAPFVSRNPALSPDREGPFVRLRQWEFSLN

SEQ ID NO: 926617 - protein, 156 aa, Homo sapiens
MDLSDRGLGLSHLCHLELCDLGHSAKSSINIDSTEFHPTQQPYKLTISLLDFSFTPEKPRGLEPKEPGRCSTSGLEQGELLLDGPALHLLSLDLGGLSPSPCFRPCRPGHRALAWVKLTPHCGQLVLTCHKFFNELLIDKNLAATTEPQSQGVKRI

SEQ ID NO: 926618 - protein, 202 aa, Homo sapiens
MRLSSDLPSPSRSGAGHRVLTAVTGACLQKKDVRMLRFIQEVNTTTRSCALWDLEEDTEYIVHVQAISIQGQSPASEPVLFKTPREAEKMASKNKGRPGSLLRGMGWDEVTMKEMGRNQQLRTGEVLIIVVVLFMWAGVIALFCRQYDIIKDNEPNNNKEKTKSASETSTPEHQGGGLLRSKCLPSAAKKTDSRECERISWF

SEQ ID NO: 926619 - protein, 166 aa, Homo sapiens
MAQSDKPRNAGILVGSGPTCCQTHPSVFVGPGAYVRVSAGFWQQVPEVAGKAGFTENGPEGLFLPTFPKRQKAMPGFEPGSVTPGNLYSHIEEPAKMQHFLYLLGSLTVDLAWNWVLLPRSQGSSWGPIGAISILQSSAASGALPAGSSSLDFCLEKDHLKQPQPS

SEQ ID NO: 926620 - protein, 153 aa, Homo sapiens
MFSSSFRYARKSQAQRTFSDGGYNKDTEEVRLLGKPSQQRPASPRRTGTGIDLCSGPMPSGHVPSIDVSHTRQSHTGIGLHHIQLVQGSKWLGPKSCVQSATVRLAGLASLDLRDLDHSDFMKPEGGNTGGAKLAESRGESEVWLKRTLEVEL

SEQ ID NO: 926621 - protein, 124 aa, Homo sapiens
MEQDQSVALLKMICLIGEELLNGMRAEHWGTQTLRIEQRCLRRSTTEVGKGRLQKDSNQHPALQEGRSTNKDLKCFINDLGESEEWAQKLDQNPFPQPPPIGRGARGEGVHGFALGGRAMRKSS

SEQ ID NO: 926622 - protein, 168 aa, Homo sapiens
MAAAVVSDCVQWLDPTLVHTPLAVPCLTPTQSRGVQAGGVSRAWPARPSEWNKLSGPEQHSGKGATSHRGFWPEKQHPKDPQDTFSPPALGHQTLRSSAFGPETCTNNLLEPPGGSQAFGLRLGPALLASLDLEPINENSDNKGLNNGAYFSHALKIWMYQLEAGAGS

SEQ ID NO: 926623 - protein, 135 aa, Homo sapiens
MAEGEERAERLFQLYPSFKFQCKHQSLQEPFQTPSPCTVPQGNVNVFTLTQTNENKNILYIQGVLTNQQERDKHNNRKTDHESGGPMNRISATTEEALEGSLAPSTMVRVQFHSYACGYPVFPAPLVEKNCPYLQ

SEQ ID NO: 926624 - protein, 148 aa, Homo sapiens
MKRECDSFIILVNFSVIAGIRQSPGPDLANATGEGNSWWSSAHLEWALLSTESSNPGSPTAFGGCVFFVPSNPGPFLHLFLSFMTITPLASTGDFENVQPFQMALGAKCQKRLLKVWCREKAGCVIDNTSFSKTTEISRDHTRGPIKR

SEQ ID NO: 926625 - protein, 144 aa, Homo sapiens
MQLVPNLPSFPPACPLSPNPKQVFRLFFIKYKNPAQFMACLAATLRRFTALDPKRSKGHKPQPHLQHTRTSKRLNCSSQVFLQNLLPQELATSDGNLATRPRNARSPGFLLSRVSSLRDSTENRTVQLTWQPLPEPLELWPKAL

SEQ ID NO: 926626 - protein, 134 aa, Homo sapiens
MRISCSNISLAQNVTGKGSQSGPQERVLGSHTRKNLSEDHQRSRSEDDQSSEDDQRSRSSSCNRRTVPSGRLGGTKEICSRCGRTRDHLTKIKSLCRSKLVGPRGQHQDVNPAVHRCRPRRQAIHNRTDRESEL

SEQ ID NO: 926627 - protein, 248 aa, Homo sapiens
MGAAFVASLRSNLSSATSRSEMNSSVGDLGVGGCSLWDDPARFIVVPAAYALALGLGLPANVAALAMFIRSGGRLGQALLLYLFNLALVDEFFTLTLQLWLTYYLGLARRPPATRPGPPTTCPPMRRVCRCGFVRGPGPRAAARLARCLRRPARAACAFAWLAGLAPPCLEHRWASSGLASATVAFAAAFLLVLAANVSLARALKAPSGPGPGPATAGAHRRAAKTMVLGFLLVFALSLAPNHLLLAP

SEQ ID NO: 926628 - protein, 169 aa, Homo sapiens
MALTVKPLTSPLAFGIWTLPAPILDELSWAVIALLHSSLDNRERPCLKKKKEEEEEGEGGGEGGGEGGGEGGGEGGGGGGEGGEEGEEGEGGEGEEGEEGEEEEEEEEEEEEEEEEEEEEEEEEEEEEEEEEEEEEEEEEEEEEEEEEMIVLKIIVAKQLFEYSSISGI

SEQ ID NO: 926629 - protein, 170 aa, Homo sapiens
MFSTSAKIVKPNGEKPDEFESRISQALLELEMNLDLKAQLRELNIMAAKEIEVGGGQKAIIIFVPVPQLKSFQKIQVRLPTWKSCTKYKQKHPRSHTLTAVHDAILEDLVFTSKIVGKRIRVKLDGSRLMKVHLDKAQQNNVEHKVETFSGVYKKLMGKDVNFEFPEFQL

SEQ ID NO: 926630 - protein, 146 aa, Homo sapiens
MPGLYGYPCNRPTGSLCPLPGHSRFIKTDELHRDRVIHTELAVWETGVLLLLISVSLSIRGLAVSRITWWVGGNQWPNVRTMTHDTAPGGPENMYPRWLVYSLIVPFKRTEVTGKHQSVHIRCTLARNGKGEVEETYQIWTVYFQV

SEQ ID NO: 926631 - protein, 186 aa, Homo sapiens
MRQQLQHCQKPREGRNICWLLLFEALPESTMMPVCEDAHKPYRDSASQLRPQVSILPLRMFSPPWLEPGLSFRTEDSLVQLQSRCGSSRLTRCIQGPHSPQNIIILPQCHCKSFPTILSHLSSPDVESLLYDQVEMRKKGPQYFQPSLIWGEPPFPEDWLDRGRSRGIDWEEAQEDFLVSRKYSIY

SEQ ID NO: 926632 - protein, 607 aa, Homo sapiens
MVKSKAECDNVGSVENGKTNSVVTCSGAGNGRNVSSLNEEVTELDMETNIFCPPPLYYTNLTQEKPPPAQAKITIEPQMNAPEEMDDASPEKKRVNPPAHRSCLKHPSSAAHEHPPMLVNPPHIQNIGATNQTCQTEQNRINTIRQLPLLNALLVELSLLYDQPVTSPAHIHPHLAWLYRTEDKKSPESSAKSTCRSEAKKDKRSVGGCEKSVSLQYKKNQIENYKEDKYSEKSSGALHKRVPKGRLLYGLTNTLRLRLKLTNPDMLVVHEKRELYRKRQSQMLGTKFRIPSSKVKLLSSAEQSQKPQLPEDKYLDSDASFTENSDTSRQISGVFDEPSTSKETKLKYATEKKTVDCSKNRINNVSLEEVVSPANSIIPERLTPTNILGGNVEMKIQSPCVFQQDAVVDRIVDKEIDIRQVKTTDNDILMADISDKRTGKNSCYENISELKYSDDLSSPCYSEDFCTSEDTSRSFKAHDSSSRTENPKHSQYTSKSSDTGVSKKKNSSDRSSILSPPFSAGSPVHSYRKFHISKTQDKSLEEASSISASDLSSTHWTEQKENQIDQNSMHNSEITKRAQDISVKTRSSWKSLEKSQSPQTSQVGIEQ

SEQ ID NO: 926633 - protein, 148 aa, Homo sapiens
MCLALHLVSYRLCLIFIATPGNYWHTHKETNETNLESLNNVFKVTQQESGLEVSGKRCLNYDKGDCEDEGSCYVDEDSRSSNGLVALMEIAYRHKFPPAKTAFGAISKDGKEIYFGDGYKRKKRKIRTVSKHVGKLEACCTTGGIIKQ

SEQ ID NO: 926634 - protein, 153 aa, Homo sapiens
MVCGLSEQNKGQAVVLKEPMPRSPGIQSPAVQPSGMPRPLLPSLGMSFPDVCWGESWDGHRMFYHTPQSRPIYPGPHRRARGPPPPSQPLSPGPAPPPPAVGISWGKSLCLSIKSTCLISSCPAQQNSWFPGAQDTEIQSFSLSFLQGNGSQP

SEQ ID NO: 926635 - protein, 145 aa, Homo sapiens
MEEVVNRTCLAAFLPWASKVGQPRTMANPSQEPSASGPQPPLGNAASKEPSHLSKVPRSSTLFRSTENWEAPSPCGFVDWHPVCKPGKASASQETGVLRPPARPRIRTGFWRAAQQELPPLLRVLLWPVQPTLGTSMGVAMSQEE

SEQ ID NO: 926636 - protein, 136 aa, Homo sapiens
MRRVAVWMLTRQKLLNGQDGCCLEEQLLPGEEEQLLLLPAPPALPWDTGDLEQSHEAGHFSLISLPYQPLGSLSSSLSCQQSLLDTIFLWLQSHGRCHIRGYKGFLSQVLALSLASSVSSSIEGKEIGHVHSQTPL

SEQ ID NO: 926637 - protein, 151 aa, Homo sapiens
MERNPRPKTMAGSILIAKSKRERRDAHISHSLLGATIVLWILSSKKTSTQHLLMSTLRNRMGTKSQTTDQGDDGAGPLEAGHQPQLANDLLTSRSALPQLHTKTSEMSGCHENCVNTLLTMKIPFLPEGVAQTGRENALASLAGSLFCGSW

SEQ ID NO: 926638 - protein, 153 aa, Homo sapiens
MLRCHNPLIQPHPHIHVTGKSLITLPTRGNLLWFGCLSLPNLMLKFDPECGNVGRWDLVGGVWVLGTDPLYISSRMQMSGPELSIHQNHEPNTSLFFINYLLSEWKDSMVVRALGFRPQWTWWVRCMVAAQLWRRHGHGWNSGKYCDMGEKLV

SEQ ID NO: 926639 - protein, 144 aa, Homo sapiens
MLAKIHAMPVLTKQLKYTKSPGGQSDDIRQQQSDAGVCVLSLLTHTVVSGAKVFDSWAAAMEKTGAFLTLTSPLHQKWSWLCLPEWSDVCCSVGTRKEADLVHLRLIRTDNENYQYSKEGEFELSHEGCGGICLDRKNEGKGSS

SEQ ID NO: 926640 - protein, 133 aa, Homo sapiens
MLCCVHASYLDPLDTIHFCLPLPKMLNLFLQLPQTVGCLSKFDVSTCCQNLPISPRQHQFGVCQNDLQPPAPVFHGLRTFSDCQSPETGSLGMRQGVLIPWQFQTLIFKHDKIPIIKTDDTGTQIGQQINAIE

SEQ ID NO: 926641 - protein, 518 aa, Homo sapiens
MLDAQDIAFAVWVPPTSASAMAARTVIIDHGSGFLKAGTAGWNEPQMVFPNIVNYLPCKENPGPSYARRRVSLGIDICHPDTFSYPIERGRILNWEGVQYLWSFVLENHRREQEVPPVIITETPLREPADRKKMLEILFELLHVPSVLLADQLQMSLYASGLLTGVVVDSGYGLTRVQPFHQGRPLPASGKTLEFAGQDLSAYLLKSLFKEDCDRRCLFQLETVAVTQMNKCYVPQNLGEALDFRERQQSALDESNTYQLPDGSRVELTPMQRVAPEMFFSPQVFEQPGPSIPRAIVESVESCEISLRPLLVSHVMACGGNTLYPGFTKRLFRELMGDHVSSTKATVWEGSNRNFSVWLGASVVAHLSTYQSEWMSREEYVPGKWLHVLSMFEENEATAAQRREVTSESSSGLSRQIRCLLHTSAHFSPPLPQHRISLQQHRLQPRSERCFCICVLCESRAALLLLPMLGLILRFHGATCQDGQPGSDGQVPFPFTGAGKDPGLAPAERPLKWLAPNL

SEQ ID NO: 926642 - protein, 150 aa, Homo sapiens
MPCPVLIPSLGGGLSLLSLCHLFAKGLLTWAEAAVSPSEGGISCPMRFLLQILSAQLWEGRLPLSHFKLLRGSLRLVWENLDSAAGKLGMKSWFLDLLRSIPVQEEPGRGGGIFQAPASRSLLRTHPPSEAVAGWIPLPLEEDIATACAC

SEQ ID NO: 926643 - protein, 118 aa, Homo sapiens
MAPCQIMYPCGQPPVKQASGNFHAHSTGPTGWHRLHAHSFNQQVTGPLSLHQCCFEHWGRGCPLGAHDLVRGDGQSARVQIITTISSTNMDCVLCRVSAVAVLATTASPSLRTVPGIH

SEQ ID NO: 926644 - protein, 285 aa, Homo sapiens
MWAKCLGQFKEGKKRKDPLGLATVEFPCDVPKGANSFRVSGSSGVEVFMVYNRTRVKEPIGKARWPLDTDADMVVSVGTASKELKDFKVRVSYFGEQEDQALGRSVLYLTGVDISLEVDTGRTGKVKRSQGDKKTWRWGPEGYGAILLVNCDRDNHRSAEPDLTHSWLMSLADLQDMSPMLLSCNGPDKLFDSHKLVLNVPFSDSKRSSRRRFNNNEFHFMERKTEAQMQEFTVAQPSGVEQAFQPRCLGCTKAPPFTIAPHPFPPLVNQRGLNCMPSTVQAGRA

SEQ ID NO: 926645 - protein, 157 aa, Homo sapiens
MSFPHQHNGTGTTVTAANLHMRQLSHREARWKGCWQEIAEKVELAVESGRKELGSSQVLLGAPAPGHWAQDIGFNPLGPPGSKFCEPNPVTAQALRLFYVAGLCGPHKGKAKDDLSLLSWCPAWDLMYSSYPGRPTGFNHDSATSPLGSPEKATPPS

SEQ ID NO: 926646 - protein, 127 aa, Homo sapiens
MFVRFIHLLHGDISLDCDLNCEGRQDRNFVDKWVWGPSGYGGILLVNCDRDDPSCDVQDNCDQHVHCLQDLEDMSVMVLRTQGPAALFDDHKLVLHTSSYDAKRAQVFHICGPAYTPGDALVGGGSQ

SEQ ID NO: 926647 - protein, 133 aa, Homo sapiens
MRSSQLTKRGWGECFSGGSSHVLYPGLSKSELGFTDLEEAAACLLRLLRMIVMGKNLGIPKPFGPQIKGTCCLEEKICCLLEPLGFKCTFINDFDCYLTETKMCSNRPQSPSLPTVFPCKGQWSFGAMLALLL

SEQ ID NO: 926648 - protein, 462 aa, Homo sapiens
MPPGASKEGLLQNCRVHREGCWGSNPEQEAEDPGQCLTRGSHGRSCSHLLAQDNSSTFELVLGPDQHAYTLALLGNHLKETFYVEAIAFPSAEFSGLISYSVSLVEESQDPSLRFAGGELQKASGAQLGAGLNGRNPGVPLEVYLCRELQLQGFVDTVTKLSEKSNSQVASVYEDPNRLGRWLQDEMAFCYTQAPHKTTSLILDTPQAADLDEFPMKYSLVWNLSPGIGYMIQDTEDHKVASMDSIGNLMVSPPVKVQGKEYPLGRVLIGSSFYPSAEGRAMSKTLRDFLYAQQVQAPVELYSDWLMTGHVDEFMCFIPTDDKNEGKKVCFGGFLLLLASPSACYKLFREKQKEGYGDALLFDELRADQLLSNGREAKTIDQLLADESLKKQNEYVEKCIHLNRDILKTELGLGEQDIIFFPQLFCLQKLTNIPSDQQPKSPLRGHTSLTWDAPPREQVYRA

SEQ ID NO: 926649 - protein, 220 aa, Homo sapiens
MLPHIAILTATINSSQLPSAAEGHRCLSNRPQTPLACSSAGTRCAPQKCQCFTIHGSGRVLIDVANTVISEKEDATIWWPLSDPTYATVKMTSPSPSVDADKVSVTYYGPNEDAPVGTAVLYLTGIEVSLEVDIYRNGQVEMSSDKQAKKKWIWGPSGWGAILLVNCNPADVGQQLEDKKTKKVIFSEANGFQTNFLHPTPDTLFPSPHAWADQTFCPEL

SEQ ID NO: 926650 - protein, 144 aa, Homo sapiens
MHAPLSHTVRLCLKKKKKKKKEKEEGQEEEEEEEEEEEEEEEEEEEQEEEEEEEEEEEEEEEEEEEEEEEEEEEEEDGGGGGERRRRRRKNFPLCCLSLLLTCEEDADFFFHHDCKFLETSTAMQNSAGMKKPSGVLEMFCILI

SEQ ID NO: 926651 - protein, 153 aa, Homo sapiens
MRAIISTVFIVPLIPTMILTIPNTIPTILPSISIIPTTIPNIPTIIPITIPTTISTIPTTVTITPTISIIIPTIPTILTINITIPTIPNTIPTIPTITITIPTNIPTTHHAHHHPHHQFAYLPPPDCEPLRHGCALAISDLSGMLRIRHVVGA

SEQ ID NO: 926652 - protein, 127 aa, Homo sapiens
MCLHPLRRHACFPFAFHQDEEDRKMRENLELPRDLLNCCDQSVDGVMDNEDHSEKVSGGNEELIGNWSKGHSCYALANNLAALCPCFRDLWNFELESDDLGYLVEEIPKHQCSGCDLAASKFLCAYV

SEQ ID NO: 926653 - protein, 127 aa, Homo sapiens
MELQERVPPDKRECTTPKYGALDIEYLKLKEFEKRRVQEGLSELSSEADHKTFSPDASFGVNQTRTRQVFSTAPGKQDSSWMGTSLPGAHFPSSWAEAQQLIQLVLHLPMDALIWCNQPGLWSQHAS

SEQ ID NO: 926654 - protein, 429 aa, Homo sapiens
MVEAGWSVAGFSLRQAHPSSKIESLRVTVDFLKVPLGLKKPVLKEVAVGPPKRPQPAALERYKARRSDAMDTESQYSGYSYKSGHSRSSRKHRDRRDRHRSKSRDGGRGDKSVTIQAPGEPLLDNESTRGDERDDNWGETTTVVTGTSEHSISHDDLTRIAKDMEDSVPLDCSRHLGVAAGATLALLSFLTPLAFLLLPPLLWREELEPCGTACEGLFISVAFKLLILLLGSWALFFRRPKASLPRVFVLRALLMVLVFLLVVSYWLFYGVRILDARERSYQGVVQFAVSLVDALLFVHYLAVVLLELRQLQPQFTLKVVRSTDGASRFYNVGHLSIQRVAVWILEKYYHDFPVYNPALLNLPKSVLAKKVSGFKVYSLGEENSTNNSTGQSRAVIAAAARRRDNSHNEYYYEEAEHERRVRKRRASWR

SEQ ID NO: 926655 - protein, 121 aa, Homo sapiens
MSLGHVRDLHSGTSHYSPRGPGGIRGFVGWAQDPHAVCSLGTWCPVSQPLQPWLKGANIGLMLWLQRVEAPSLGSFHVVLSLLVCRSQELRFGNLISDVSKCLDAQAKVCCTGGALMENLC

SEQ ID NO: 926656 - protein, 139 aa, Homo sapiens
MRVPEASEAPSQGSESSYDLRCSTFLIPEGPVLVSLTVERYWLRWAILSGPGAAFDVCSKAHQDLSRRVSLRPSEPDSTGYIVIGVGWHLCLLVRLTVAAVLPGVMYGLCFFITLFGSYVSRLRRVICASYYPSREQGC

SEQ ID NO: 926657 - protein, 135 aa, Homo sapiens
MLMQLQELPSHDVYPPENDLSSLGLVAAAVAAATFASYLAPWQLDPVPPPFDRTLYVGYDRKFISKWLQYKAKLLVQSLVFLVTSSNFGAIQEPSKSHLIITRSGSYHPGNPMGFRSSVPGTRDKDPKYISYYAT

SEQ ID NO: 926658 - protein, 142 aa, Homo sapiens
MRFQSLTSSDRNLRARAGRGSATGHLGSREGLAQGAVASTASRPCSSLTALPVGETSIQAHETLAAFFPARNPWLLRSGPSLGLLLRCLFCIWETGLDIQGLSGKKCGQKAYTYQLAFLVASRASKGQVMCPGSKCPNSQSG

SEQ ID NO: 926659 - protein, 133 aa, Homo sapiens
MEDVLQEVRKSSLPFGGPFVSHFWLHQAYCLGCGQPQDEGDMENTVSCSTPGCQGLYCLTCFRLLDNTCSVCASPLSYQGDLDLELDSSDEEGPQLWLAAAQRKDPEQAWLLQQQLQEVLGRSLSMESTSESR

SEQ ID NO: 926660 - protein, 175 aa, Homo sapiens
MRVPEASEAPSQGSESSYDLRCSTFLIPEGPVLVSLTVEGTGYAGNIYRDLVSAFDVLQQGNISILSRRCLLRPSEPDSTGYIVIGVGWHLCLLVRLTVAAVLPGVMYGLCFFITLFGSYVSRLRRVICASYYPSREQQPQPALLWLNSKANDLDCKPLDPRWGWEKWCLWGGAS

SEQ ID NO: 926661 - protein, 232 aa, Homo sapiens
MVIPQAYHLCYVLMPFKLALCGLASLVQVFCVIPKYIQPFLRQTIGTPVIQLLNRVRQEFEFNMTATHHFSVDLNASRSLSQVAMDLHEAVSMKLHRVREALALMGFTTPLLLVLLYLQALFYRYCYLNWDHYDNIYITSRFLRMEAVRSTAGLPTVLPLSAHEARRYIPPGSIFLSQWEKFFYILETFNLIRHLLLVLFLVFLDYAVFWVLDLARHQLQGEIVARTPSACF

SEQ ID NO: 926662 - protein, 206 aa, Homo sapiens [sequence omitted]

SEQ ID NO: 926663 - protein, 180 aa, Homo sapiens
MSAKSGCYGDSHGGVELCHARFQGVCLMVICLTNRDPVARFKLAGTVGLWQQGYLRAELPLTQRWSHATHCLGQGWGRAGVLNCILMGPQWLLVLNALQENAEANSRWQRLTQVMCTVPFCVRVTGECLQGSPVCPCVALLCGGGQRLNFPEQLCGPGAAKGSLEVWLPQPYPEGLACHW

SEQ ID NO: 926664 - protein, 159 aa, Homo sapiens
MAATRGVLGIIPESLPLHLAHDKVSGGTCVTSICQRELGSNPRGLTPHVKDEECAIWQVGHLWIIALASFQGIVKKQSFKSMTIKGQFFGIIAGEGNSGCNAPIGCITELMALKSVNILHLPDFFLITKTGEFQGENVGAMCPFLNCSVTNFSKASSFS

SEQ ID NO: 926665 - protein, 231 aa, Homo sapiens
MGINILIAPGQTLFSPWWKRQYLLKPEASKGLEALINNLKMRGFLKPSNSPCNTPILGVQKPNGEWRLVLDLCLINEAIVPIHPVVPNPYILLTQIPEGTKWFSVLDLKDAFFCIPLHPDSQYLFTFKDPSSQTAQLTWMVVPQGFRDSPHLFGQALSKDLSEFSHPQEINRLLSSVFLPQGVAAMHCKGHQKGTDEVAEGNMLAHQTAKSVARKPQGTTHLKPLEFGKAP

SEQ ID NO: 926666 - protein, 142 aa, Homo sapiens
MVSGARVKRLPLARDVKMDGLGQGSKAQEKVKEAPRTLLQRNQEAIRQSDGVWVTRNQVKTNEETETQKSKFLVIKPSDIAEGQESALNSAGSSWLHCCSGCVNRERKDLETHVHLPDAERTRVPFFYTQIADGLLWDLVIM

SEQ ID NO: 926667 - protein, 232 aa, Homo sapiens
MSLKGLNTSERLAADSGTQIVASRSSDPSSIVWLALAQCQAYVLTDQAQSYQAIADKTAVWVAWYKYKNRQAKVDRQKVQRRPRAIEWGRNGQMVWRDAVEDFTQQEITDILQTFRQKGGESVITWLVRINEQGANGIRVDSGNVLKFVTLSWVPKIQLALRNWATAPHPTNDEGNVLDEISLWQLAINVARQKYSTEDAWPDGGKPWHTLKEYAMRLKEEAMETAVSYNPQ

SEQ ID NO: 926668 - protein, 136 aa, Homo sapiens
MTRNVRKHIITAEGEGEASMSSHGCRRERESKVGGATRFQTTRSHENSIMRQDMGDGDKPLETTLMIRSPPPPGPTSDTGNYNSTQDLGGDTEPNHIKLCEKISNCHLRDIPKNNGKCLQPIANDSLTHRDPRFST

SEQ ID NO: 926669 - protein, 275 aa, Homo sapiens
MRGGEKEEVMGPVSPDLHKEEVIGPVSPDLHKEEVMGPVSPDLHKEEVMGPVSPDLHKEEVMGPVSLDLHKEEVMGPVSPDLHKEVMGPVSPDLHKEEVMGPVSPDLHEEVMGPVSPDLHKEEVMGPVSPDLHKEEVMGPVSPDLHKEEVMGPVSPDLHKEEVMGPVSPDLHKEEVMGPVSLDLHKEEVMGPVSPDLHKEVMGPVSPDLHKEEVMGPVSPDLHEEVMGPVSPDLHKEEVMGPVSPDLHKEEVMGPVSPDLHKEEVMGPVSPDLHK

SEQ ID NO: 926670 - protein, 149 aa, Homo sapiens
MFSPITITIEFHDPTNHGDENTWYPEKNPDKLTKIIQKLFVFAFTWAFGGALNREDEHRENIPFCPSLEPDSLAKVTYDFDKLVHELFGNSSQVGATKTYNASKAEDKAIKLSIQPTWGQVHQYHCLPPPYIVPLEVLQGNNTHRAVIS

SEQ ID NO: 926671 - protein, 444 aa, Homo sapiens
MSKHADGRGKEQKHRMGKTLTSCMSPSAGPKQYCCRSSEKPYCEFEIYKQAAESKHADGRGEERRSPIGPYCGSEIYEQAAASEDSGSSDDEQKRTTGNRLTPCVLCQPQAAQAQEVGRALPWVRSTSRQKQRMVQMAVERSKGTPKSASPNQADPRLRREHYCEAAFSKQPAGGIQADGRGEEWRRPMGHRLTSCMSRGSSSKQCQCRRSTEFYCGSEISEQAAESKHADGGREEQSCSMGNRLASCMSQSASPEWGWHRRLVGDYCKSEIKEQPAASKGTGSSREEQRCPMGNTLISCMSPSASPKQDRHRKSVEPYCEFQIHERCWYKRLAELYWGSEIYEEQEAMIKVEPYYEFEIYEHAALNKGTGSGGEEWRCPIGNMLNSCIFPNASPVWGCCTGLVEPDCRAEIYEQVAASKNAGSGREEWKLVWHRRSVEPYPQV

SEQ ID NO: 926672 - protein, 145 aa, Homo sapiens
MLGDALPREEESREAVCLQQLCRAAVGSAQFKLPCGFVYTVMGKLPTQASVMADAPPPTKLQHPRSTSDCCAGNENFKPVDLSLLGSVAGVGGSAELDHLAPWLQPPFQGSEQLCLAGIPAHIQVPVRYIHMMTEHYHSAISQGH

SEQ ID NO: 926673 - protein, 232 aa, Homo sapiens
MREIVAVRVTISVPRLVAGALRAQRGPAGWPEKMLAAAGAFWEVISDEHAIDSAGTCHGDRDLQLERINMYYNEASGGRYVPRPVLVDVEPGTIGSVCSAPFGRIFRPDDFIFGELRAFLHWYTGEGMDVMEFTEAKSNMNDLLSEYQQYQDATAEEEEASQGAWTSRPASLKLSNKMDVSWVLGSTPRTVLFYLALVELIHGLYDTLLVTHTLTQVDWEDEASIAWGWAYV

SEQ ID NO: 926674 - protein, 216 aa, Homo sapiens
MAPKRAAYLPAQRSSSAKDQTASLSAPLGRSFQRKEQSAIFAVLQPPLPRQTGPGVDLQQIPAYQQQRALTIRRKTNKQKGEHVHSETTFEGHQHQRPKVDKSMKMGRNQGKKAENSKNQNTPSHPKDQNSSPAREQNWTENEFDKLTEVGFRSWVITNSFELKEHVLTQCKEAKNLEKRLDKLLTRINSLEKNINDLMELKNTARELCEAYTSYQ

SEQ ID NO: 926675 - protein, 189 aa, Homo sapiens
MAPAFARMSLPNKGVGLSGIIRKACEKSKVTQSQLSDWEKYLVTACPRTPWIVTDLEDSCLGQESKTEKAVPVSRRQLTSRPSMVKHTWGSVRVMAWAGACPGNPHSCCWIIWLVASDSEDLHTLGCGGPSSDSLDIRGMDKGVAYFYSDNLFNMSLQTALEASPIRHSICPAFPFSRATKVHLPEGHD

SEQ ID NO: 926676 - protein, 420 aa, Homo sapiens
MWLPFYEGTLLGGHPCDLLAGDLRRNMPLQELVSFEDVAVGFTWEEWQDLDDAQRTLYRDMMLETYSSLVSLGLLEFAGGPLQTLFACVSPAEAAQQQRLLLAPSSGSFIPERHLPDASWNSPDHKIQIGLQCFEYSGRRNAFNVEAILTHKSASMGKTSCKSNKCGKACNESATIAQELTQVGRKTFERHVCGKIFSKKHKVTEHKKIHSGKKPYKYSEYEKAFISQSCVTKHQRTHTEEKPYPCAICEKSFCQKSNLSVYQRIHTEGKSYFAKNILAAGKKPYEHNECGKKFHHKSYLRVHQGFHIGKKPYECNECGKTYEKGILTSHQRNHTGEKPYECNQCGKPFGWKSSLRSHQSIHRGQKTYGCNVCSKSFHQKSDLTKHERIHTGENPYECNECGKSFGWKSRLSQHQRSHIG

SEQ ID NO: 926677 - protein, 169 aa, Homo sapiens
MSADGAVWGRMRSCLRAFPERLAACGAEYSSIPQIPAPTPAWNAHSAFITALNSTWFPKAMSPHTTSQGYNTLGFSDTVNTKQHELQDTQDSWRGADVSYLTAGPVLGSMPGFASVWRRERREAAGNGEHRVEPTFKEEGAGKRVKYCKAAQDTKVSKVLSTETAGDLW

SEQ ID NO: 926678 - protein, 163 aa, Homo sapiens
MSVGVCWRSTSDPVCLGITSGGYRTANIAEQQILLPDPSSGSFVPEGHLPELERCAVRSAALFRAGRQERLSLLKLRLQPPLLPGALSQGDGSFIYKLLTGAAASLSEMPCPERRNLERQSGYSSFAELWWVLPILNFPAALFTLKPYDRELWGPLGADSGPY

SEQ ID NO: 926679 - protein, 220 aa, Homo sapiens
MGCQYPSLSQLKQLHLIHILMWTTNLEPLGALLEKAAATIETLVLEDCRIQDSQLMVILPALSRCSQLTTFYFHGNETSMNALKVLLHHTGELSKLGLETYPAPLESLNNRGHVSWEILAPIQAELMRTLREVRQPKRIFLVLPPALPVAHGHLRNWSCIFASREGLKQDQSPQHKGYSDTVDTTYSSTPPSKVKSNCSPPFPSCPAWEKQDCNRTGSIK

SEQ ID NO: 926680 - protein, 139 aa, Homo sapiens
MAEERKRLLLLIDLGCCNGVEHELTLALVNGQRVSGNMRDKAKRQVLVNPGVPALHHFQTRKDLATLTRCCGWGPCGADLQDEDVPGARGGKWSRTSSLPHFLQPNQPALPQPIHQISQSLLPALSWLRSSSWVYPTPH

SEQ ID NO: 926681 - protein, 160 aa, Homo sapiens
MVWLCPYPHLILNCNSYNSHVSQEDPEAVLAQPLGGLPYHSQISITYWSDIKNNSKQYDTELNQPEVLLVQIGQYRDNYTYIWKSSSLSPSSWLLYAKIQAPLNYAYKTKVHGSGTTSREKSHDWTMVDRIGGKKKAFSPQKTTVPERSATFPLEASCLL

SEQ ID NO: 926682 - protein, 231 aa, Homo sapiens
MMCKAIQGHLENNPALEKLLPHIQGNVGFAFTKEDLTKFRDMLLNSKVPAATHAGAIAPCEVTVPGQNTGLEPKKTSFFQALSITTEILSDVQLIKTGDKVGASEATLLNMLNEHLSLLLWDDYPAAIGYPTVASVPHSTINGYKQVLALSVETDCTFPLAEKVKAFLADPSAFVAAAPGATATTAAPAAAPAKAEAKKSWRSWMRIWDLAYLTNHQKATNSASFICKTKK

SEQ ID NO: 926683 - protein, 292 aa, Homo sapiens
MVVEVVVVKVVDDGGGGDNGGGGGRGVGGGGDEVVVVKVVDDGGGGDNGGGGGRGVGGGGDVEVVEVLVVVVMVVEVVVVKVVDDGGGGDNCSGGGRGVGGGGDEVLVVVVMVVEVVVVKVVDDGGGGDNGGGGGRGVGGGGDGGRNGGGGGSGNAGEDSGGGGWWWVMVVEVGDGGGSGGDGGGGGGRGGGGYEGRGGGSGGGGGGGVAVAQHVDMAVMTMVVMVQKVVDVIVVVAMEMGEVVKVAATVGISEDQSGSPCDCDGDGDTGEGDEVGAAGGGGGGDGGLIPGY

SEQ ID NO: 926684 - protein, 152 aa, Homo sapiens
MGLEPESVGASLRPESTGADLALEWALNLNLQGLAKSEMGLVHGAGLDFESSGAWNHKDQPRAWGQPGTRASIEPGSVEADLEPRIVGNALVLRATGTGLEPGDLGVNLGPRYTGEVLKLGCVGVSPPLWSSGTCLYHGPSGTSLVVGSTGA

SEQ ID NO: 926685 - protein, 159 aa, Homo sapiens
MFRDSQLFCLGSFWVVLASCISGLVQQLGERDRETEREFCSIHKRLKLESWRKQWRSLQEDSLAKEDCRILTYSQGCFRYSWPQSETQDETLALSAENRFSVSQASTRWRHRAPTSPELRGGSTWLGRPCRFSPLFRLCVPLRAAVLQLFKKEIFTKSS

SEQ ID NO: 926686 - protein, 150 aa, Homo sapiens
MAATLGLNLTLALGILRGCQTQVLVPKRPGVQAFRAKREYFPGEGGGPPEAWAKSYLPNRARGGSDAASHEGGALTNGIVLLEERALSTLLSCEDTPDANSLQAERGTPPEPSHAGTLMAFSEPPERLQYSLSFGYHFVFSKALVLPLSH

SEQ ID NO: 926687 - protein, 142 aa, Homo sapiens
MGFEERVDSVGHKVFCSPELGYSPEGLETTIWSKCFLGIQLHFLPPGSLQRKPLKGRHKYSTGGHPCTHPLWAAPIRAASSLVQNSADASAGISWVPQLELQVQTCFPLQISCTGPQCDIGGHGIDGFFKKNVASVPSLNVE

SEQ ID NO: 926688 - protein, 842 aa, Homo sapiens
MTTILVLCWSQQVDAARRSWNLGVMENFLIMMAPQAKDQSSQGDEEKDPPKSHPYSVETPYGFHLDLDFLKYVDDIEKGNTIKRIPIHRRAKQAKFSTLPRNFSLPDSGARPPAAPPLQNWSPVVPREASLGTQEQNQSPPLGNAPQASTSRSEVSYHRKALLAEATRQLEAAEPEDAELTFGSGRPQLLRASSMPATLLHSRASEEPGLSLGPPAPPALPPLQGEGSVCDGTFEPAEGLAGFHSSSPRASTRIPELVQEGAEPPEGVVKVPNHLPLPGPPFSFQNVLVVLEDKEDEHNAREAEVLFTPGSPTPSPPPLPSPIPENELLLEEIELNISEIPPPPPVEVDMRSIGIRVTEESLGLARVDPGSISSLKQQVSALEGELSGRTEELAQVRTALQQQEEEIKAREQRIRELEFTVAQLEGQFHQENAKDTQGQTDVMVNTDPVHGLLTRESCDKGIEVNLLGSMESESWGHRGEENGLLWGPDGHKQGNQSPAERVLLPQLSLPQGPEQVLTSSVHSFLSTELRIEEAGTEQEGGPQGGTRGAGGFLWGSDRKTPPAGREETSSNLPGKEHPGRPPSSPTDATIGQYVKKIQELLQEQWNCLEHGYPELASAIKQPASKLSSIQSQLLSSLNLLLSAYSAQAHPPKEPPASSSSPPVEISPSTSLKSIMKKKDYGFRAGGNGTKKNLQFVGVNGGYETTSSEETSGEDSTPEDLSDSEAEKKCDGPDHKHVKDAHLTCEAGQGIPEGTCHAAQESGPGEEVPHSKAESQEWFRVSSRKSSSPAVVASYLHEVQPHSPHFLKLLVNLADHNGNTALHYSVSHSNFSIVKLLLETAPI

SEQ ID NO: 926689 - protein, 184 aa, Homo sapiens
MDTASRDKTGTVVEFTLFSFLQGSKSYAACYLMSKNVSYIIIEQMYHRVLYRDIQFPGKRQETVAFLYLNYKRLSSFTNPPQHRPFTSVGLGDGQIFLIPRGHISDYHMGRNLGQYPTFQGRGLCGFPQCIVPLARNEVSPGLGHILPNSLSSFQLSTVALQLIVSGTIQTNGEKHVHLAESSQ

SEQ ID NO: 926690 - protein, 184 aa, Homo sapiens
MKDVKFTRGAVVNLASVSSGAVRVNLDGCLSTDSAVNCRGNDSILVYQGKEQSVYEGGLQPFTEYLYRVIASHEGGSVYSDWSRGRTTGAAPQSVPTPSRVRSLNGYSIEVTWDEPVVRGVIEKYILKAYSEDSTRPPRMPSASAEFVNTSNLTALLTCKAAAQRDRTGVSPQTEDCSETDFII

SEQ ID NO: 926691 - protein, 134 aa, Homo sapiens
MKLKHKKEQSKYKERENRFQSEGAAPAKAQKCELVVLEEQNNGGQGIQTDENNEREKDLAVFTPHQFLLSACTHVGCTNSSWVLLYTAQLPPEHVDSPVLTVLDSRTIHIQRGEESKRGGFPKNAVVRVTLYFQ

SEQ ID NO: 926692 - protein, 165 aa, Homo sapiens
MHGQRLCSGPTAANGSSGYKIGSAVSPDVLATLNKGDLHYQPASCTDSSYVENRTLEAPPEGTVNVFVKTQGSRKAHVRWEAPFRPNGLLTHSVLFTGIFYVDPATDVGFFIFLKITYTDKLLPDGSQNVVPRAAATATSDERLEMYVVELLPQPSESETLEAKV

SEQ ID NO: 926693 - protein, 183 aa, Homo sapiens
MLFVHNSVGFTPSREVTVTTLAGLPERGANLTASVLNHTAIDVRWAKPTVQDLQGEVEYYTLFWSSATSNDSLKILPDVNSHVIGHLKPNTEYWIFISVFNGVHSINSAGLHATTCDGEPQGMLPPEVVIINSTAVEVCTIYACVKSNGTQITTVEDTPSDIPTPTIRGITSRKYYSFDGHEF

SEQ ID NO: 926694 - protein, 136 aa, Homo sapiens
MERAEKAVYALNQHPIYGTVSPLARIHNSRNQGVEVEVAPLTITSKDPLAKFLLPVPATLHSGGLEVLFPEGGSLPPGDTTMIPLNWKMRLSLRHFGLLPPLSQQDKKGVIVLAGVIDPDSQDEISLLLHNGGKER

SEQ ID NO: 926695 - protein, 171 aa, Homo sapiens
MAGYPSEMKLSEDRSGSNICCSAILNVLQPLLLIPRQTGSGVDLQQTPTELQLRVLTVRRKTNKQNDIHTKTPSDIGIGKDFMSKTPKAIATKAKIDKWDLIKLKSFCTAKETTIRVNRQPREWEKIFAIYSSDKRLISRIYKELRQIYKKKTNNPIKKVIKTRPVGEDND

SEQ ID NO: 926696 - protein, 163 aa, Homo sapiens
MGLELRYQQNFGRGLHCGVSEGDEELTGNWSKGHSCYAVAKRVVAFCPCSRDLLHFELERDDVGYLEEDIYKEKSIQEVAWLLLKPCDYLHKQRNDLKLELTYKREAEHGKMPPRHFRDLCSSPFYHRSEGLGGNNGFMGQAQGLVALCSLRTWGPASQPLHP

SEQ ID NO: 926697 - protein, 141 aa, Homo sapiens
MQWGDSQASGHEKALSKSFEIPMPSSFQMVITGRFFPVFRCSPAPCCFIKATSGGRPQTLGIQKEACPSQTQHTVQGAETKEQDKALPTRNLQCPQSDQTLFQLVGTWAVQIVGGLSEAHSQEPYGIVMGSTTAHVSPTPN

SEQ ID NO: 926698 - protein, 131 aa, Homo sapiens [sequence omitted]

SEQ ID NO: 926699 - protein, 172 aa, Homo sapiens
MCNKLFLNLQVDVLPKKYRLALFQEVNPDFISHFATGGGQMDALGIGHCAVGGWGISRTSTLGFGGKALEERALPALGFQSRGFAGESEVFQCQGALKATATCRGGPRRGSGQGPPTGLKCHSGPQLGPKPKPLSLPDHSAGTAPPSPGTSTCLPLWLFQQPLTINDTESCQ

SEQ ID NO: 926700 - protein, 152 aa, Homo sapiens
MGQLESAVTSGSGWSLFPARGRSMQEGSSSASSWALPGSADARCVAEPPAKPHWLLCSFSQVQCVPGHRVPKHKVYLSIGLLPAACFKGRPEAHPVSPHLLWSRTLPALTWKIRGQQSPETVEARDPVPVSESFMVPSHPLLLKPQLGCVLR

SEQ ID NO: 926701 - protein, 148 aa, Homo sapiens
MNNTGQRKYSAVCSYTGTTNPDLGTNEGFLEEAAWESVDLYKDQRNLAPGHTLAECSSVKWELHSQEHEGYIRGVHVPRSPRHPGGDDSDIGPGSSTLDLPAPNPHNTLKRQRPGEGRRAVPQKEMGEPAGGTNAANTLLLDFQPPEL

SEQ ID NO: 926702 - protein, 152 aa, Homo sapiens
MATACFQSPRPKKAGLTARFYAMFHFSSAHQLGLPTARSPRLFYGSAYPMLCFNTRYRLIRCLSGFLKLPPDPSPAPPTFLPAAGQDTAAGDLLVKHTSAHDFPLLETSCAFPSPSESSSRAMASVGDVVASNNRMYPLPVLEPRGPKSRCQ

SEQ ID NO: 926703 - protein, 138 aa, Homo sapiens
MSLTEELASLAGELVFYHLEKLGPLGELTDSNGALGQRHKTGSGLHQTLREYLGDEKSEQLLPSPYYRMTFPGTLVSATYCRMYSSISKVYDNIKDIARFRSSVPAYRYLLAHPGVQPRAPSQGSMKKVGWGTTLSGF

SEQ ID NO: 926704 - protein, 682 aa, Homo sapiens
MNFEAVLHYKHQNQARDEKKKLRHASGANITNATTAATTAATATTTASTEGSNSESEAESTENSPTPSPLQKKVTENAPGPLAGPEIRVFRASAPPPPSILFRKPLSAQDNNSYDTDLSKTLLMYTVPAVQGFFRSISLSRGNNLQDTLRVLTLWFDYGHWPDVNEALVEGVKAIQIDTWLQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVGHWALQTCALLEPPLAIGWPSHLFMCTQRLFFAVIGCRAHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVECL

SEQ ID NO: 926705 - protein, 258 aa, Homo sapiens
MEAQMWKAVSHPGKGFLATQTSLALATSRSPRPSHPTSSPQGLGFFALPTLAWSCLLPRPFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQEPESVWAFMPLAPALQCEATS

SEQ ID NO: 926706 - protein, 140 aa, Homo sapiens
MMDATYPMVSRMKPDTVSSIVPGARRNFQKHLHPIRLKMGWQEEDVLVGIILVDCVIVQPLSGIRKRLVCLAIARTVPIRDLLSEHLPEKAVISPGKARADCEAPAEKRSICAYPRHRRHGVPHQRLNIHQIVTEFLLCA

SEQ ID NO: 926707 - protein, 179 aa, Homo sapiens
MKLRNQQRSVYVEIAGNKSGNRAEGCRLEPGFPGSQHSGGAGHAGCLLEIHTRRNQEDAGLYQGKSQTATQANKALASPTGKRWSINGPSSCPVLDLMAGPLYPHCYQSLDVNHLGKGRPLAFCSILWLSSVEANPEEAVSWKPIAHSWGNKSSLEARSRRHISMSPPHGPRIAEFGDM

SEQ ID NO: 926708 - protein, 151 aa, Homo sapiens
MQAVSGSTLQGSGGQWPPSHSSTEQCPSGNCVRAPTSHFPLASSSISSHGPSCTWGPLSLGCSWSSWDVGSSVLRLSRATQPFNQSLRSSKFSLIFLSSSELPNSSNLCPLRNSKAASTSLVIFKAMPLFSFPVFCVSSFFQCSKVVPEAG

SEQ ID NO: 926709 - protein, 202 aa, Homo sapiens
MVALWVLGKSHHQLKEMGFINQRQPQGRACTLPWPRTSCHHLVHPYFSEDRAGEGPAQEGRRQSVWSQKPKDRLIHILWLQTGPGDNLEKGDRQVYSQGAWTPHVEPQTGGSVPPCMAVAAEPPLGNKRLQSKGPVLPQQRELKGYQGWECGEGQTHGTWLQVNAKQIPMNLEPGSLGAQVSDLQSHLADALACAGKGRVKA

SEQ ID NO: 926710 - protein, 162 aa, Homo sapiens
MPAGQFAPHPRLAALALAVHLPLGCSCSFVSITGLTSKPPAAAFRAPPTTSQGYFGQDPVKTWLDGEMLPGDAGWREGSSEPYLALPFQVVSPVSLQNGELTPGKECITEWWPNHFQILLESPLLAPLELHCRSALSFRQLSWTLTTQGLLSCLPSDPCARG

SEQ ID NO: 926711 - protein, 173 aa, Homo sapiens
MSWVHPGLLVSVLGRLVSESDDNNGDEDDNGDVSDDGDGSDGDYDDDKDGHYDKSIDGDGDDDDDDDGDDDNVMKIIVMMVMMVMVVMVVTIGMVMMMVSDDGDGDDDNVGMKIMMVMVMLVMIIYHYMRGSAKSSGSCPGCINGKYKPDHKDLKPSEKQENLMSTKSIAINA

SEQ ID NO: 926712 - protein, 134 aa, Homo sapiens
MRRSSSAAIVEIKIVIITVTIIILPMCQVLSYELGMSSLMEAFQCPTGWTGSMVPVSTSDEASGSLQSWQKVKGEKVYHGETRNKREKPEQQSNLFQKQKEEEERRRRRRRRRRRRRRRRRRKIYYMIYTEYYT

SEQ ID NO: 926713 - protein, 140 aa, Homo sapiens
MLCSVFSRIGKKEPCALKATEVMSSWVCRAFLRRQDFSKALDPFSKTNSKDSTVMSTAPWKLLGQHSPLECSRVMGTFYASIAQCGSYQPHVAMSTCSMASVAETLTFQWYLIRNPGFRALSVSALEVKSQEPNSEDTLL

SEQ ID NO: 926714 - protein, 172 aa, Homo sapiens
MGSGESKSLTGFASLFASLWPHTESLEKNLSYLQGLQTFAQILNLDEKRKRRAVSSVTHLQSHGERLLACSKRDLLGAGWNILVGSQFAASHGVPPHVFLMENSRGMCLHDIGMATQKQVTRNGSASESWCNWTRESVSPKCMGKSPSQEQIKKVFSDFCHGQNRPRRAREC

SEQ ID NO: 926715 - protein, 137 aa, Homo sapiens
MDSVSTFFTALWMQCQPPLLPHEYSVNLSHCPMDSANLLLLPRGHSANPLSLPHGHSATLLYCQGDTVSTFPTAPWTQSSRERSCLTTHRGAAGEKGVAWLGVLPRLAGGSKQGWTDCTCLPWLEEGKGRRLPFLVC

SEQ ID NO: 926716 - protein, 138 aa, Homo sapiens
MNFLSSEKGAYKGPVTVLAGRYLEVSDLCAPRGTWKPMLLPACCQALLMCGVDLVGLLEAGQVCSLAGRKGKEEAKGQQFPWEEGGEPAHIPSPHVPPATTQLPSAVEEAGTVATCPARTRGILRERGGRRSQWLHSH

SEQ ID NO: 926717 - protein, 167 aa, Homo sapiens
MLTFCISVIISILYRVLIKMFQVWLLIQQMASSGAAVTVLKDSDNPELGPAPAESEVPLRSLRDMRRGTGSSCPSVSGTAMTPLPGSCTWRLVPQFMFAHIKFKGQGHCFEFIKVKSNNFQIRTNSSCHYQGQDGEGPLQQADNFPGCAHTCKYVSVWAYASECVCL

SEQ ID NO: 926718 - protein, 233 aa, Homo sapiens
MCLGTQTEPWISGVDYESGLIKAHAYINHNNPGQWTMESTKTCEIAGNGFNMESPNHESIGETKAPSVVEIEVSPALSEVHLLLKKENVHEHQLMKDVLIRNHEPPELTDHARLTKIIHRTVHGCQLSAFSLNFHSIPDTVVWDQSLISPCSPICNRILGLPHVGINPVASNNRNSPSRSCRAGALKSRCLQGLILPMALTVVLPGLFQLPVVTSSPQHLACHQHDASLPFSG

SEQ ID NO: 926719 - protein, 164 aa, Homo sapiens
MTIDPLGQCSSLPLPILWERLSSGLSHPSQKVVRGPSSGANIGHVPSCAWIPGARATAMGNADQLKPGRPPGSSRENEVGVPKGDDRYTMTAALTTKVRIFSAEPGAPGHSWAARGPRNGQGPPATQILSQKSYREQTRRPCQPAPAPPPHPTPGCAGATQRLF

SEQ ID NO: 926720 - protein, 142 aa, Homo sapiens
MTLLYLLSKTTTYLMALNGRNLFSHSSGVLMTIDPLGQCSSLPLPILWERLSSGLSHPSQKVVRGPSSGANIGHVPSCAWIPGARATAMGNADQLKPGRPPGSSRENEVGDRYTMTAALTTKALVCDVPHPVSKCSPNEDNL

SEQ ID NO: 926721 - protein, 141 aa, Homo sapiens
MLRPWGCPAPRRLLTAGLECRYIQAALDLIETGKSGNFSGEVTLTGVLKDWGKLAKGHEYKEELSKMKCWPTQGPKDAKPGFEPKPPAGTCGLAMLLCCRCACDFRSYSPSEDGDHGRGLQRVSEAWTPEEKNLASYFQVV

SEQ ID NO: 926722 - protein, 243 aa, Homo sapiens
MHHHHHHHHHHHHHHCHHHHHHCAIIITTTVIITTTIITNTTAIVITTTVIITTTITNITTTIITTINTTTPIIIITTTIITSTTTTITTTTTITITTIINIITTTITNTTIIITTTTITNITTIIITTITKTIIITITTNITTITNTTITTTTTIITTTTIIITTTAIIIATTMTTTITTITTITTTIITIAITTITITTTITTTMTITTITTTITTITITATIITTTTTTITIKPSALLFF

SEQ ID NO: 926723 - protein, 373 aa, Homo sapiens
MTTWLLHLLHLICIPARTKDTERKKICGNRSVLSLRALPEVTSSNFCLHIIGQSCVTINSSFVSKEEEENEHWVVSGQHVTFLAISHVPSNKTKANIAHQRTVKACSRSFFKSKDSSSDRELLEEVAFLLNYPLPWCNGGGNGDGGDSDSDDGGCDGGDGCDGGGHGGGDDDGGGGDDDGGGGDDGGGGGDGGVGDGGDVGGDGDDDGLGDGGDDDGGDVGDGGGGDNDGGVGDGGSDDVDDSGDGDCGGGGDSGGGAGNDGSSDDDDGGGGVDGGDNGGGDVGDGGGDNDSGGDDDGSGVGDDGGGDNDSGGDDDGTVVVMMMAVVVVMMVVVMMVVMLVVMRRRVVMMEMMMMIFYWYIIFVHSLKVCVIF

SEQ ID NO: 926724 - protein, 133 aa, Homo sapiens
MKGNAKSQLGLNKDASFPPYELKDPLNSIQVPWESLDKENSRRKCFLTTEMGTSPAEVSRRSQSLKTTAAAPDVHAVESSSGHPANSGPFSPLGEVHSLEPWGTPAVSSPSPLPYFPNKGASRPLQEVLFEAL

SEQ ID NO: 926725 - protein, 148 aa, Homo sapiens
MVSFYSAPGIFHASWADGCGCPYEACISYAFSRVLRAEPKLDKCVHLGDKDSSGSLHWTGKRCGLTLAVAISSVDFMKTYCNAIIIELINPEEDLDTKGSAVGVFPLANSLAILVLFMDSEARLQPAQCQIPESQRFKDITCHSHGYV

SEQ ID NO: 926726 - protein, 144 aa, Homo sapiens
MGTQELVSVEDRVLDLGSLTLTLGGWHQNCMAVHPAGVEIEQTARMKEDIAADIKPAEGLCLSQGLRPFHVEICILQRRVPLCHLLASSADFVLQAADFISSLLGPLPEDSLKHGAGDSEERRMLWPKEKLGLRDFLQRAYHPL

SEQ ID NO: 926727 - protein, 135 aa, Homo sapiens
MGIIVLGISVLIVASGEWEDIAGLIAVIVDSWTINRPSKSTVLSDCKEQQVPHCYHNRQYPPKPYELLIAIPLELGLISFTAVINTGPWAGGSWSGTAEPIGVGWARSLVHPLDLIVLSCDGICLAGSTLCFPDP

SEQ ID NO: 926728 - protein, 205 aa, Homo sapiens
MNIYDTSTSYNLFFIVLCNMDHFLSNVALLERRVINTLKPNCLYYSQGESPFLVPLSGSPPPNINHSPSPPCPSSRSLVKGCVSSLSLRVKTRHCSVLVSGPAKVVFLSTQSYQMLALPRKQVHTGPLRVEPSLMTLKPVSVTATLLPAPRSCPLPYKHTQEFPKGRLDPSDSIQYNRNLMSTCSVLEMLLGTRATLRGEPVQNR

SEQ ID NO: 926729 - protein, 119 aa, Homo sapiens
MRSHSQALGVGTSTYLFWRDSSTMTVIWGGIGPIQLSDVTENRGHVTDGFGFFVTADTLAYLDRCTDFMYFPEEVYKEVPVLILETCECDLSWQKGLCGWDQAEDLDGEAIPADPGRTI

SEQ ID NO: 926730 - protein, 153 aa, Homo sapiens
MKECFASHRWACVLYCFFHTPLLTITLLEEGPPLASSNLTNPLARTQPRSLPMNPTTQKALAIGLPEGPTLKPVSGVVEIWNAKQKWQEMWLSRMWVGNQIINTFECQIKEFGLAPGDRGVQKKIKPLTHKLNHRDEELLISNCFKVQTSLFY

SEQ ID NO: 926731 - protein, 145 aa, Homo sapiens
MEHLGPNSEECRHLKTERGGKETYEEARKGKWGRRDSTGLCSWAEVGIVGATPGYRGTHMKMCCPDLPPEKHLLCSCGECSQQTTFSCQLLQSLPQLQRAALSEIIAFPLPPVSGDLDIERAGLFSPMLGTLPKETCSKAFCQVG

SEQ ID NO: 926732 - protein, 212 aa, Homo sapiens
MHSNNKPFPCSECGLTFNKPLSLLRHQRTHLGAKPFRCPACDREFAVASRMVEHQRVHSGERPFPCPTCGKCFTKSSNLSEHQTLHTGQRPFKCADCGVAFAQPSRLVRHQRIHTGERPFPCTQCGQAFARSSTLKRHQQIHSGEKGFLCAECGRAFRIASELAQHIRMHNGERPYQCEDCGQAFTRSNHLQRHRAKHGTCKKEPIPSSSDE

SEQ ID NO: 926733 - protein, 155 aa, Homo sapiens
MFTAASRSDQPPPKSLISRASFCGLVCGHGGRPTGALHQSGTVCQCRSYDVDPHSTQGCSASRYSQVVDLEEASRPRGAQVGLTQSDRQDCLAESRSDSSSKANVSYGSKLSLEGWLCLAMLCYKCSRNKPSGPHISWLVSPTSLSSFPCQLKCW

SEQ ID NO: 926734 - protein, 206 aa, Homo sapiens
MPSLHSSSSSPSPSPSPSPSPSPSPSPSSSSSSSSSSSSSSSSSSSSSSSSSSSSSSSSSSSSSSSSSSSSSSSSSTSSTSSSSSPLLLLLLLSSFSFSFFFFFFSSSSSLAQYWLILSPRPMYTWWQLLKFQTCYKTQQASLLALFILYLPCIGLNLYCLSCHIHFCGRTPESPLQTTGVSPRVQKLKNLEPDVRGQKAFSTGER

SEQ ID NO: 926735 - protein, 161 aa, Homo sapiens
MQPSQPNKGKATQGQTLWDEILGFPHQANKLLIDQIMLIKDREIESGWWMRQLTNVIWSLGPVLKCKSPVSWCVSTPELSQKIKEPAQPAHNHGLEMWRQLQLPGAVLNQWDQKPVNKCPSVPSFTWAIPRDPKESNPRYLLLQMVTLHPYTFPSSLSHSP

SEQ ID NO: 926736 - protein, 165 aa, Homo sapiens
MRDLLKTKAKDLVPCIPAAPVVAERGQHRTQAVASEGASPKSWQLPHSVEPVGAQKVKNGGLGTSIQISEDVWRCLDAGQEFAARGSAEGKCGIGVPTPSGAVRRGLPSSRPQNGRSTYSLHCVPGKAADTQCQPVKAAGKEAVPCKATGAELPRDHGNPPLVSA

SEQ ID NO: 926737 - protein, 195 aa, Homo sapiens
MSKTFHSHSSSHPVRGILLWYPQQIHTDPYHDLNPLLISVVESENMSIHIYGTWRGSHENNQYFQQNGKCLKSFTLAKREKEEVNFRSSPAEMIVQDPAKYLGSSNINNLLSSGENSFFTLWLQKNCWHREDMGEEDHGEEDGSTGFSPWILETPSKAPPLRTVRSLEDEGKDNTIDVKGQPVLKAASEDVVVLG

SEQ ID NO: 926738 - protein, 142 aa, Homo sapiens
MGYSRSDAMPVSGIAVYWPGSICLLLIGLFTFGVLSLRTQPLYFFFTATLRRVDIQCCNSSLILTPPICFSSPPNNQTAFIKVADDVHVSEFNGYFSVVKGLVNSVTVAQSNLFEELERMRGIRRRHVSKFCPNSKRNKNMD

SEQ ID NO: 926739 - protein, 591 aa, Homo sapiens
MIGSHRKECVISLRFTYNIFSDGFLEYSGLNRQFLFRRLDPFTLYTLTLEACTRAGCAHSAPQPLWTDEAPPDSQLAPTVHSVKSTSVELSWSEPVNPNGKIIRYEVIRRCFEGKAWGNQTIQADEKIVFTEYNTERNTFMYNDTGLQPWTQCEYKIYTWNSAGHTCSSWNVVRTLQAPPEGLSPPVISYVSMNPQKLLISWIPPEQSNGIIQSYRLQRNEMLYPFSFDPVTFNYTDEELLPFSTYSYALQACTSGGCSTSKPTSITTLEAAPSEVSPPDLWAVSATQMNVCWSPPTVQNGKITKYLVRYDNKESLAGQGLCLLVSHLQPYSQYNFSLVACTNGGCTASVSKSAWTMEALPENMDSPTLQVTGSESIEITWKPPRNPNGQIRSYELRRDGTIVYTGLETRYRDFTLTPGVEYSYTVTASNSQGGILSPLVKDRTSPSAPSGMEPPKLQARGPQEILVNWDPPVRTNGDIINYTLFILLQEPMQNGSLLLSNRPTLPPNKRMERRAVEETQKGILTVAASGSCLKTARGTVEAFPAPAPTIGYQIVGDELEVGGRKANIFYSFSHYFWIFEHINLFGPFLII

SEQ ID NO: 926740 - protein, 322 aa, Homo sapiens
MATQQTLHGLQAFTNYSIGVEACTCFNCCSKGPTAELRTHPAPPSGLSSPQIGTLASRTASFRWSPPMFPNGVIHSYELQFHVACPPDSALPCTPSQIETKYTGLGQKASLGGLQPYTTYKLRVVAHNEVGSTASEWISFTTQKELPQYRAPFSVDSNLSVVCVNWSDTFLLNGQLKEYVLTDGGRRVYSGLDTTLYIPRTADKTFFFQVICTTDEGSVKTPLIQYDTSTGLGLVLTTPGKKKGSRSKSTEFYSELWFIVLMAMLGLILLAIFLSLILQRKIHKEPYIRERPPLVPLQKRMSPLNVYPPGENHMFALRFYIS

SEQ ID NO: 926741 - protein, 146 aa, Homo sapiens
MSSPGTRPFLLPSIDKNLNLCPFKHTNWVTAEVFCTNLINEMVAIFSHFTLLRVKSHGAGDMFLSCTKNHHSKQMIRQRFGELIIYQFDPSRYISYEQDLELTNNQSWEKPWDFSPENEDCISGVLQALPKDSTCVTWIKKETQHC

SEQ ID NO: 926742 - protein, 134 aa, Homo sapiens
MLRKTWQGLSTSWKKVRPSSFGSEKFVITDRPSAAGLLEFAGGPLQTLFAWVSPAKAAEQQILQNSKCWCLILPLEASSQRGTELYEVSVGPYWEVPPSKALGFILESLIILHSISNPGAGLVSHILKVDPECD

SEQ ID NO: 926743 - protein, 137 aa, Homo sapiens
MWEETGVPGENPHKCGENVQTLHRQSPPPGIQFFSHQPYNQMTLNEVIQFEDMLYIYYLFVYSLTEEQFPQKPEDTVHREDDFNRSGKEGNLSYFLPDQLIITIYPLGAFYEPGGIFLLPYAHQSIPSFSISHLSSY

SEQ ID NO: 926744 - protein, 174 aa, Homo sapiens
MGLFYTIGVVGSIHFELPGGFVYTVRVKPPTQASAMAEAPPTTKLQHLRSISDSCCAGSKNFKPVDLSLPGSVRLALRGLHPLSNQSECDEPGWTSSIRWARPPYRGQNQNLLWEQVEPREMAIPGCAPLQMLLHQTLYHYRCSRTKPSRLHIILLTATTTSLSSCPCKLQCPW

SEQ ID NO: 926745 - protein, 149 aa, Homo sapiens
MDLTQKIGTREMGYFHGTLLKIPENVEATLELGNRQTDLLNGCDQNVDSDTDSEVAEEVSDEACEKSYGAVCCRVTGVGVPTALRTHSLHQCDLDDRSDIDEIPQLLSGIFSLSLTFGSLIIKSLESVFFGLKSWCCITFLYLSIDIFL

SEQ ID NO: 926746 - protein, 190 aa, Homo sapiens
MGRNQSRKAENSKNQSASSPPKDRSSSSAMEHSWTENDFDKLTEVGFRRSVITNLSELKEDVRAHHKEAKDLEKRLDEWLTRINSVEKSLNELMELKTMARELRDTCTSFSSRFDQVEEKIPVIEDQMNEMKQANAERFCLHQACLKRAPEGSTKHGKEQPVPATGKTCQIVKTIDARKKLNQLMSKITS

SEQ ID NO: 926747 - protein, 136 aa, Homo sapiens
MGCCSNLHSCVLRRKNLTEGHKAEGETEANFGTGKKEEGSGKGNNTEWSLSHSRNGDHPACLRKGPISVWQPRSCFLENRCCSLPFKAKSEEDIGKNTFFDGYGNLVAHFLLVYEGWQENQNFFEFPQNSNFECSV

SEQ ID NO: 926748 - protein, 173 aa, Homo sapiens
MAHVYLCNRPAHQPQNQTVCIILVQCLLTPGLLMSNIIIQVMTYLCPSVKFPGDIPEIREFHPNSTAPTTLRPPTGLSSGPLTLLSSLSLSSTPPPPSPLATGATSHSQKRLCSPRFDAIVPCSPFLPCLPGKRHLFQKVLWEAFANPPSPAHQVEMATPPLCSQLSFESQCL

SEQ ID NO: 926749 - protein, 236 aa, Homo sapiens
MLESTLSISALMKADSCPQVKAGEASGNLQSWRKGKQTLPSLGGSKEMCRAKPAKAPYKAIKSRENSLTTTRTAWSAASPVGSLSTGPQRWHSSSSRSWRTARLGSLPPDFSSWLSELLRFLTSPPALPFQLFFIYPVRSFLWILILRRWGLECGWGGLHGGLGFGWSIHSSQPGADSIFCPGRSSLFYCTMLKECLFFLTSNDVEKALSVALASGDTRLLEGTDKESNLEGNASR

SEQ ID NO: 926750 - protein, 211 aa, Homo sapiens
MCISWRISSVRPWCISSIHPWCISSIHPWCISSIHPRSISVVHPRCISSIHPLGHQLHQHLVHQRHPPLVHQLCPPLLNQLHPTLVHQLCLPLVHQLCLPLVHQLHPPLEHQLHPLLVHQLHPPLVHQLCPTLVHQLHPPPVHQLHPTLVHQLRPPLVHKLRPPLVHQLHPPLVRLLCPPLVHQLHPPLVHPFRPPLVHQLHPASLHRYGP

SEQ ID NO: 926751 - protein, 153 aa, Homo sapiens
MIIACVGIYLVPKRRDRLLTDWLTDQQGTDSRVSLQLIRSHSEPGQVSYTQWQPAVDTATQGPTGSLGPRPMERLPSTSRGQRATVLQPSGYSHSTFSNRAFLTTTPVPRLEVPEQQVFTTASLPPPPPPSNSLAMFSLFTSQNLGFFNSRGG

SEQ ID NO: 926752 - protein, 225 aa, Homo sapiens
MQTTKTAACDKGLGCSSVAWRGKRDWSLLAALGGEKTSGLRMSELEGALGNTATAGSPVLSAMVNPTVFIDGESLGHVSFKLSADKFPKTAENFRAMSTGEKGFGYKGSCFHRIIPGFMCRGGDFTHHNGTGGKSVHQEKFDDENFILKHTGPGILSTANAGPNTNCSWFFISIAKTESLDGQHVVFGNMKEGMNVVEAMEPFGFRNGKTSKKITIADCGQLQQI

SEQ ID NO: 926753 - protein, 139 aa, Homo sapiens
MTAILQSEKVRFSANASSKRENLFRASQRLVFAGNPGCSLARVSVMPSPSIVTWRPPFCFRGGPAKDKISAEYMNAGMNDSWQRRKLKFTEMTAIAQGTQKRENHLNGPPGRLAINVFIEGPSLDFGAQQLRPPYTPPR

SEQ ID NO: 926754 - protein, 143 aa, Homo sapiens
MPPPLGGPRTTCRLCSPRGVPWGQCSPQPCSPVRGPSVGVAWGSGRGVWRLVGQPCWWVELDQEVLLREDPLDFPQARSLASTPHWPLGNQGQDLFPGTFILHVSSRLLSARDYRRGWASARGCCLGPHVGCLKNISLKAEKV

SEQ ID NO: 926755 - protein, 136 aa, Homo sapiens
MSRAGRGCLGKRSGRQPQFHMPLSLSLPCKDTDFHSAQCRNPPGVRRRGKSTRPGSQKPDKFYSQGACTLDGEIVNTLTVNKLQSPPRAGSVTTPERPWTLLPSDNLEAISSLSCKLQNLGNLGSQRPLPTDCSQL

SEQ ID NO: 926756 - protein, 170 aa, Homo sapiens
MKSWGPLDTLIPHLTTCSGGQSGQEPVAVSAAGQLFCLTSVCPVFSPPLLMMQTVLSERAPSALLANVKCLQTEKNRPERLFRLEINVTEKCGSRAINAAFFATHYEETHQGLSPPRHGASHPWEKETVLINPGKVKMAVRESGVFDLLPWRRRWSLMPGSWALCHQGNG

SEQ ID NO: 926757 - protein, 250 aa, Homo sapiens
MANAGSSCGKKFCFLELVVSSPTSSKKLLSHCGAALPAPQGEPLLKQDSKQVQVDLQDLGYETCAKARMRLNRRKPPVPVRAQECEEHNSLKEMVLMEGLCSKQGCRGSTLASSSERKPLENQLGKQEEFWVYGKSENISVLRKDIKDLKAQLQNANKVIQNLKIRVWSLLVTSDYLSSLERPWKLGAVGTLEGSSPHSVTDEDEVWLSDGTGAFYSPGLQAKKDLESLIQRVSQLEVQLPKKSTRREAG

SEQ ID NO: 926758 - protein, 161 aa, Homo sapiens
MAVRGPLHSQQSRGEDGSACTQLSASPARQPRRPQQQRPEEPPQPRNGQVDASIYSLGKTFVNITPAKVGVLVGKDWSSFFVNRLTLRGQKCTVVLDSLLQDGELTVHLQTKSIGGAPTFNVTVTMIAKTLGLLMSKEAVHGSFINKKCYEMASHLQRSQY

SEQ ID NO: 926759 - protein, 153 aa, Homo sapiens
MQQYLLPSPPFLRETFLPVLDWTAGSLGLPDSGHPGNVPHPHAFPGAHGWGFLAGGFHGKEIGGKPAFSLETSPNDSNYRPFLCGQFFQRRVLQSPSCGRGLWLSLAGSLTPSINFNFILIFSLLPDFHASLCLESSSSGPLWFNFSRELLTS

SEQ ID NO: 926760 - protein, 156 aa, Homo sapiens [sequence omitted]

SEQ ID NO: 926761 - protein, 183 aa, Homo sapiens
MDPAPQRSYLLQHVCSLVEVGSGDPGLGRCLCRQHAECLWTSPLMPLGLFPVGPGSSTNLAPPQAGARGVASNPDGCVAAVTKYRKLGGLKQQKFILSQFWRPETQYQDVSRATFLSMALGENPLRASSSFSWLPHHSNLCLCLHLTFFSVCELCVSTQGQLTLDLEPTQIIQEDLLISRSLT

SEQ ID NO: 926762 - protein, 189 aa, Homo sapiens
MGPGLLSVVLKHHLPPVWLLPLNLHLWCLLYSLCQKFKSREGFYFLSSKINFKFGKHVLLALPSTPTLSGVVHGSNGHRGGGGGRSHNRLLVPLENVPHGGRGNSWGREVKRAGLDPKTGLEVKNQGPLDFASGDKEMDAIYQLSLAPPFYPCRWIGSPPPLSADSSPQPVHEVFIEPYLRHLEVALAP

SEQ ID NO: 926763 - protein, 147 aa, Homo sapiens
MTAHHCPLPAPTLSPQQAPPHLGLLLLKHPKFTVPRASPRGRTGKPAGILQAAPSCRTASFPCKPPAGEAPCPLKLVALSFPIKIQRLELEPGVILAQAAQAGRPENSEVGMQWDATFSTQVAHSLDQWLLEPFENFTKVPFSQKEQ

SEQ ID NO: 926764 - protein, 205 aa, Homo sapiens
MASLPCSKLFGNRIGKMLTTVEAGPLAVWPSASLPASPVASHPIAFHTRDPQETSTLLLSTRNRYNALEQLFVSISRIPAGTESPLSHGNSTLLDSKDRNGYVKARAQLVSDTNGGSDTKIQDTTRGSMTPEPVLLTTLKLPLKVPWGFLSSWLVTLRPPGWQPIISFRGPQTGRILEPEGTWGPKHPQGNPGALCKLVQPYPSI

SEQ ID NO: 926765 - protein, 138 aa, Homo sapiens
MPNIGVAIEGFQGIGKEVKCHSESKANASTCKTQDTRHTDEVPPPHTVSLFSRPAVGGPPYLSKHFRYLLPTYHPPNLGKVLSVLYATVTTGFKAYGAKGLEKIKDKLLEMGLAYSCGLTEHRGSGKSGFLHTLTVRK

SEQ ID NO: 926766 - protein, 142 aa, Homo sapiens
MKTGKKNDYRDQSPRLAVPVTNTCVQHDTLFRRNQCKSLLPLMNTDWSSQDSEGPRTGTGLLEVTLLLCLQQPHDHILEDGPCVLIALCEAYEMEEIGTVREKCRGTADFCSALRSRPETVVWRTAPPADSLGARPLLQELP

SEQ ID NO: 926767 - protein, 163 aa, Homo sapiens
MIIIIFALLLGACLSMSHPKCLRAGTFWILEYLHYMYSLIDHPKSKNLKSSMLQNLKLFECQHDAHRKCSLEHFGLWIFRFGMLNLYHTDEATFHRCLGKVVSKLWAMEPLEFVGIAQGPIGENGKRNGQASGIHHLDPRKFHFPLFRSVPSRESGTKQALNK

SEQ ID NO: 926768 - protein, 138 aa, Homo sapiens
MWFVKQMLEGSMLIGKEKGKRLRDLIQGSQLRNYIPNEEKEIKDFIPSEGSTDADKKTEKLQLSRPCQEKEAYKEQNLENNRQSKTAGPEQREARIRPLSEDAIICPEASSTGWRAELDGRQQGSLPELAPAWKARLT

SEQ ID NO: 926769 - protein, 176 aa, Homo sapiens
MAVGASVGQASLSLGYLLTWMNCPGCGGRGPRARALQMPPRLEKLHPAPPMPLLQFLLFLLPSHKRLQQSKMINQKSEKDDSLGKYGSGGALMQIQPKCCGSECVGTIGSDGDLQEKGSRKDVVEDGLDWEEETGSKDVHRLTKEHRLQRGSDGCGNKGNGKEVHVVHTPALTADA

SEQ ID NO: 926770 - protein, 174 aa, Homo sapiens
MVLPPAQQEEVSSAGRIEIQPTNTCWVAYCALSTLLAALFPGSPCGPHVCLAKQVSLLLLYCWGNTSSERRNNSSTVTRSISTATEPFCPPPAGWAQTAAVSLTNISAIIPKSLEATREGLEFVDSAQEHGSRATPRLPAEASYPPSESQSITFLICTMGIITVPPYGVAMGTK

SEQ ID NO: 926771 - protein, 280 aa, Homo sapiens
MSVKMSQFQTVHPLLQQRELDGGVLREQVHLEQAKEQQEELGSGKIKDVENLKLPSPTCLQMKAGPPTAGPLVALSGLCPWPREGFEEGSQVREDPWSAFHPPGAVGGRERIFLCLRAAVSVGSKCSCWHRGNISCICHLKSISEKCRGGKSVQNCQRVGISRPAHFLLQAALLRGSQRHKAFQEKHRPGTEQPLKGNPGKAMGKEWLLSRNDRLRTKGAGSLRNQSDQCPARAGACHQGPTALLAFQEPQRNSAVTTTPVCEVGTAMIPLLQLGKLRLE

SEQ ID NO: 926772 - protein, 141 aa, Homo sapiens
MSGAQALGFSLHPLSLGELIKDKAANPTGVTLKLYPKTNPFPTVTAPVPAPATVICLDGWHGFRLPHTSTRCPPPTAARGSLLKRPPCQSRAELPGRLEACSTGKEDQSSNQLSTTGDFSQCGMEQKNHSAEPCLNSSPTA

SEQ ID NO: 926773 - protein, 146 aa, Homo sapiens
MAYPGQEEERRSEEDPKHQGPALCVLTSTYLINAQTVGMEDCQMETEHLVLGVIKGLWVLLLLRPPWNISKGLKGGWCLTAVEGDEAVWPCAEGALGEGEKTEAASGLGFEPKVFELGHVSLKSSQGTVAFGGIWAAYHNIPYVAG

SEQ ID NO: 926774 - protein, 186 aa, Homo sapiens
MPVASWGQQRAAEQESRGAGKEGGWCCSCSERPWVERVATGSALPQISRPHFLDWPGLDSKDLIIKSPGFLFLNITQIHPGTGPILCQSSPLTFWKTAESGTQGKDRASIWGTLEDFVEEAYLLVGPGGGSGFQQAETEAFHARAQLGKVAPHFMVVEGVVIGESEQGQTLQIDKILPTETLNLMT

SEQ ID NO: 926775 - protein, 163 aa, Homo sapiens [sequence omitted]

SEQ ID NO: 926776 - protein, 219 aa, Homo sapiens
MVCGLLFLLSATARASPGAVVENLLGVELLEDGLQEVSLQAEIQESSLYLSSLWLLRILLEMQFPYAGPGLWDLTISLFPAAQPGPLLWPLGPGEGRLFRFQMASLPLIPRSHWKLFGRQEPSTTNHEASSLMTTSCSPPARDQQLPFTAVRCGPIGGDTELKGVCYQDLNRKGLYTLEIFFLAAASEDSSYGGFCSIDRRRSSYKLLNHLFTNMGKPH

SEQ ID NO: 926777 - protein, 140 aa, Homo sapiens
MGPSGAFREITDRIQTNPPWRGRGRGKASALNQPSEPRKPGNLERAGGSTRTVEPSAHGNWQICRLVHFLRTCWETLTGEAETNVLRLVFVASLRKEKAGYSLPPDSLTFESLELRPYDRDQLGAPNTHMLLLILSLPCS

SEQ ID NO: 926778 - protein, 179 aa, Homo sapiens
MGTVSNSLGLQMGCWGPGLLVRARWQCSSSLLSFQGSSQLPWEARDRFDIGWELTAPPDHKGEGTEDHLWSAGALGRKQWGLSFLNCGVGEKDGHLRVHCESPERWQTVDTQNTLALPCPQLYLVARDSDHITNSQAQLTCHLHLLQTDDRVDNPYFVVVLAEACLLGTSILDYPATQT

SEQ ID NO: 926779 - protein, 140 aa, Homo sapiens
MKSYCSIETSSGHIVHCPAECPMWLGIQALSPTVHKEMNAANNQKCLSIASESSEMLSTCTKLILSIYSVEKHNCQAAKRKACKGSQIKQLHSNKKAEALDDYLVHQLIDPYPMPVICIKPQDVNQQSQWKAGKLYVRTT

SEQ ID NO: 926780 - protein, 146 aa, Homo sapiens
MKEAWFPWVPQLLTAFLGWESLSAFWSIPFNKSLGSSKFSHIFLSSSELSKLFQPLPVTCFQSRFHIFGYLYSSALILKAYAIKDAIVVIEKALKAIKHTTRNSCWRKLCPDVVHDFTGFTTETIKETVKDTVDIAKENKYVDVDR

SEQ ID NO: 926781 - protein, 153 aa, Homo sapiens
MNNSRRTALRAVTLTAKHLETHIMNFCSKNRNIPGKPRESNDPLKELDPCCRLPEMLKNCELACFLSKEAHGLGQVLSPGHQLPGNRFSAVGWGTRGVRLAFRAVGYMGTGRSIIELIKESPGKGEVQLKEIKITIQDMKGKFFSEIDSINKK

SEQ ID NO: 926782 - protein, 146 aa, Homo sapiens [sequence omitted]

SEQ ID NO: 926783 - protein, 142 aa, Homo sapiens
MLGSARAAPWACSARPGKAGPPSGTPGPGPVRGSTLGNLEQSFPSSRGKEHESPGGLSHSAKMEVMTGSHCRHREDSILLTLRQPCLHPEVNTNTLTRCTHCKIHQHTGTAAETLTTGMDRFTYRYKTHRGTGKNKHAHRRR

SEQ ID NO: 926784 - protein, 147 aa, Homo sapiens
MHLHVQTAHGHRTSLASTLLQRLEISDCGSLHHLCFWEHGAVEGMWTLENYKGMDFSPSTFCMISFVKWKLLSGKKTFPVLFGGKLRALEIEVKWKKEVVPGGFLHLQIRPMLQYDVIFEIIKEKIDKFDYMKIKHLSTLKNIIRKF

SEQ ID NO: 926785 - protein, 141 aa, Homo sapiens
MGYCPHPWAFPGAGLAWRGGSAPSTQKLVELTQAAHGQTKPMARHPPASVGHLPSPLVITVPPEAIHASEEVESRMVKDRGSGTRHLGKNPVSTSYQFCDFRPTTYISVPPFPDEESGTQSDLSTAARFVNDRSWDKAHFF

SEQ ID NO: 926786 - protein, 353 aa, Homo sapiens
MVVMLVIVMVMVLVVMVMMLVVVMLVMVMLGMVMVMVIVMLVMVIVIVLEVMVLVLVVVLVVTVMVMVVVILMMVMVLVLVVMVLVVVMLVMVMVGMVMVLVVVVLVIVMVLVVMVLLLVVLLLVMVMVMVVVILMMVMVVMVMVLVVVMLVVVMVMVLVVIVMVMVLGGDGDGAGGGDAGDGDGTGCDSDGDGAGGNGDGAAAGDGDGGGDAGDSDGTAGDGDGGGDTDDGDGGNGNGAAGGDAGDGDGTGGYGDGDGGGDTDHGDGDCAAGGDAGDGDGTGGDGDGVELMVILLVHVLVIVLLVIVMMLVVMALLLILMVMVMVLVAVMLVIVMMTVMVMVMMMVMVMLWC

SEQ ID NO: 926787 - protein, 145 aa, Homo sapiens
MLVTSVNHGNDEYPLKQPQSLQIPSNLTFCDSEAAWTSHPDLMWLFVSQGLQLQLEVAPDPVAGLLWKFNSSHQDEKFLWEEDWEEEKRQKRSMGLQSGWVCTRLHYTAAVWPWTSRFTSLGAPASPSDKCGCNLPFMALSSGII

SEQ ID NO: 926788 - protein, 141 aa, Homo sapiens
MPWKDTHPILARQNVSSVFFEFVLQGFAEDGNRGGLLNIVTLLPAPRSTSGLAASLGHPKPGSLGPGSIWVSVRAFTIEEEDGYHLSQSRAPGNHSSYLLLHPPWLVSHQGLERSLQNSTWSDPICFPGWRAQWLSPECLQ

SEQ ID NO: 926789 - protein, 145 aa, Homo sapiens
MWQPMELDAGALSWDRGIGNGLKGGFARVVVRITWMVSVKHSTLPSTESALLVTWAAGSSVQSPNIPSPPPSGYMEDSFSGCLGVEWSHGLLPADELGSDPGIMLACGRLSRGFVPLCPNDWGSMGPGGGHRTDPRGSILVLLNK

SEQ ID NO: 926790 - protein, 157 aa, Homo sapiens
MLIGILLPKFPSGIFQTQFGFGNGREISRPKLSRFPYSSPGPVGDAKAAGVPGVGGISAIAADFGKKEILLLNTLSLQNDRGFESLKRRAVFECLVLIGDRDQHGKSSLSPQYGRQVSDRLPCCTEPDSTELGRRSGHNKKWKLLPRKVSEELTSDG

SEQ ID NO: 926791 - protein, 138 aa, Homo sapiens
MNPTVTCALIGNKRTGWTYGSVPLSSNSPFKVAFEADLDGNEDIFIALDDISFTPECVTGEEEEEKTHREYHVMKGAEIGVTHLQARECPTWSAKKKLRERSGAASPQSLQREQGSSNTLNSDFWPPQLWKHKCLNNH

SEQ ID NO: 926792 - protein, 343 aa, Homo sapiens
MAGAGAGNRNWGDSTLLHGSSKETGNGDSILLHGGAGKQELGAQHPTAWGQQGNRNWGHSILLHGGSKETGTGGTASYCMGAAGKHELGDSILLHGGSKETGNGYSILLHGGSREMGTGQTASYCMGAAGKQELGGTASYCMGAAGKRELGGQHPTAQKEENPRGCVGGGSFSENKQFSEGEELRYMLQELSGSSGKELRYVFQELSGGFLQTQSSPIPRSPGLLAGLKRGSKWETFGQVSITDPTKGLVGAALEVNPSAADGEWEDSGRLSASLLSYVHMAGVPYSLEAWTNGIQGLGKEWAEALPVTPTGCRACQAASIAGFGSQREWLLFYSTLVPGMET

SEQ ID NO: 926793 - protein, 142 aa, Homo sapiens
MIDVTNKQKIASYRNLEWFWEHPELSAGVRGSAAGAPEIKLRITQAAVLRTDYGGARVEARRPVTIPAMQARNDGGSRENSENWLDFRYTLKRNPQEEMGMVFERKKGVEADFKVLSKSLQSYVYRTLTAISIQANHISNAL

SEQ ID NO: 926794 - protein, 148 aa, Homo sapiens
MLLAHCIGSAEGVAPRKAASWVATVEPLPEVAYCRSWPRALPCQSQDMLNTLKSKAQSYTPYITQCPFVCTFCHPKFNSLFTYQGSQPNISGAEVFEVTHLKCKPPYYRGNVCLWISSFTDDNYQKILLSTGKPASWRKRLGYPGPFS

SEQ ID NO: 926795 - protein, 162 aa, Homo sapiens
MELPFKFILLLDNAPGHPEPHEFNTEDYGVETGLYGNKVKAEKPVEAVARATKVKTDKWDCNKLESSCTAKETINRVKRQLVEWEKIFANHTSNKGHQTPDATPGMKTGCYCCWNKVFPGFFLCITISSVNTLGGHVHLTKPRSHAFSLAARGAGAIQEGNF

SEQ ID NO: 926796 - protein, 138 aa, Homo sapiens
MGKFRHGGLQVRALLGRQLRPGEKSSTAPVASTAGGPSSPFAAAGPGAKLLSARGRRGGRPLRVQGPPSPRPPGTLAGLQALHAAPVPTRASPSTPPHKPREPAPASASPEKGSHEGTESERGLRGLASTLSPLTMIN

SEQ ID NO: 926797 - protein, 241 aa, Homo sapiens
MFWFISEIFVFVRHIIFMLPSQCLQFLVLDLPGPAVVGNLVLVLDLSGDAVCVRGVAVVHGQDHRCVQDLGLQLLDLLFIQLPDEIDLVNQPFHARLQLYILHVSFVRKLLDEDKCIVHLCTLIDLILMLILEVLQQPLHVAKLCLQLQLLLAQNVQLLLKVVDVALEHVVHVALCRLLLLLEATLALQHLVLLLQELYRVSDGGKLIVKSLDLLFLLGTHGLDLSIPNPKSDMLQNLKFF

SEQ ID NO: 926798 - protein, 157 aa, Homo sapiens
MAEEIYVEEVEHLETLKGANSGGANCKSQVMTCDSDVPGINLGSHNPPSQMMKRIQPCKEHSGREKNKHQGSGLGSMFMETQGNMSGSREVKRGNKGNFQYGSNTLLANEVPRSCWAGTDTEDSSLVCENTQEILPSRNAHLSFGVRSFYWGLIIKT

SEQ ID NO: 926799 - protein, 148 aa, Homo sapiens
MLLAHCIGSAEGVAPRKAASWVATVEPLPEVAYCRSWPRALPGGLTQARPIIPCPQFSNWDREESQPLSDYLHNQPAIVSVYNCVSLFPYGGSQEALMVHEEKRRKDKGYRKSVFPIVPWGQLHFCPSYDLVHQFFLDPSWLNSFCLL

SEQ ID NO: 926800 - protein, 149 aa, Homo sapiens
MKSASTLRYFLGSDYGVETGLYGNKVKAEKPVEAVARATKVKTDKWDCNKLESSCTAKETINRVKRQLVEWEKIFANHTSNKGHQTPDATPGMKTGCYCCWNKVFPGFFLCITISSVNTLGGHVHLTKPRSHAFSLAARGAGAIQEGNF

SEQ ID NO: 926801 - protein, 134 aa, Homo sapiens
MCVGMYVAMYVYVCVWCIATIFSGRGYDCQTTPLATQNPMNSTPKVSKWSTYSQAQDSAFRLGGHKDLQGSLTQFSMERIANAMEENPDGENIVQVWKDYTTEDAIVVIGKAVKAIMPETINSCYRKLIYYILA

SEQ ID NO: 926802 - protein, 149 aa, Homo sapiens
MPSVSQQKPLLTTSPGPEQEAQSEWAFNVRLLRHHQRHRWCSGSPRCSGGSPKGFLEKQGLHRGPEEGGGQLDRQRQKEGQEKAMQRLHLWISAPGSMQTRCLQISCLEAALGLTCGVPLKMMGWGPQLGEAPMGAAPGTLRSSFLNTR

SEQ ID NO: 926803 - protein, 142 aa, Homo sapiens
MASLLTAGGCVQQPAGTLHHSTLSAGLGPSTWQPALSGISSSSSQNPDPAASRAAAAGREGGGELIPSALAQHRGRAIPQNQILLREEPDSHLALLPITARLPCTMALPPHGRVTCPETCSKCGQRTCSINISWELAGNAEP

SEQ ID NO: 926804 - protein, 186 aa, Homo sapiens
MCISVAAWQHFYLLSLQSPFPGTEEPQKALGSTNEEVTGSSEGADMLSKLVVRLRASCPWSRSPCASAAAGNICPQETAPRRASGRRDPAWMAEGALTRPTGATDPTRFFFWCIFLGDVSFWEMLELGPEKSIRDHNPQDTAWWGTPHVCFKCHRYSKESLQDPSTSEVRKNPESGIGCQELEFWA

SEQ ID NO: 926805 - protein, 148 aa, Homo sapiens
MMRSQTKGTTDAYCGQKPARNQLTQDPGTVSLQESASQLPHTEKSWGMSLERLQEATVYTGSLSIRCHSPEGWTQGLALCSSAHLLTVQVSEWGQPWRLYTLWGLAHLALDLVFILVNQILEMEYSCYLSSWFQLVMCLCPAEPTAAL

SEQ ID NO: 926806 - protein, 248 aa, Homo sapiens
MNGMANVNPASRPHYASAIPVPRASSQTRIPTPGASPQLRPRQAGLALSPQRAASPRLGKAAGPSRNSSPRAFRGRGSPKFAGAVRESAEDGEGPFSSPWNSPRTTPKAALSSRAGSGRIGERQGTQGKKKKAQEGTPVCQTRGRSPSRTSFHGETQIPGAPEGRKPPSCPGKDQRDINYKSSGTPRSLEPDEGAASWASSPVCSPVQGKRPSPSPGAISFSSVHQQSQPVTATVAPFQYSSDCSIQL

SEQ ID NO: 926807 - protein, 337 aa, Homo sapiens
MGQGQLLFIILSLGPRVVPDVKQMFQLISTTRNLAQDLCYEKQGLPKTKPEDPSIKFSSLTQLFLLSLPDPESQRKRTVQNVLDLRQNLEETMSSLRGSQVTHSSLEMTCYDSDDANPRSVSSLSNRSSPLSWRYGQSSPRLQAGDAPSVGGSCRSEGTPAWYMHGERAHYSHTMPMRSPSKLSHISRLELVESLDSDEVDLKSGYMSDSDLMGKTMTEDDDITTGQRKDGSPAAPPAPSGAFALVSGSQPAACLPVSPVDTALPGSAPAALSQPASPSRGCRLQLRAEEGGKGKAGSKQEEGSECAHGEGGGGEIVCLFLAREGEGSWFQIGNDKQ

SEQ ID NO: 926808 - protein, 258 aa, Homo sapiens
MSISSLACLWQNAGYFLRGLSMQCVSVSSVAYMWQNVSISSMACLWQSAGYFLSGLSVAEYVYFLSGLSVAEYVYFLSGLSVAECWLFPPWPVRGRVLAVSSMACLWQCVSVSSVARLWQNVSISSVACLWQSAGYFLRGLSVAVCVSVSSLACPWQSAGYFLRGLSVAVCVSVSSVACPWQSAGLQESRNGADSFSKKEKLKPTKAERLAPGHRKKRGLESRGLCIQPCTSLPDTWGPGRFFRGQKLYRFQSWDKAQ

SEQ ID NO: 926809 - protein, 140 aa, Homo sapiens
MHPKGFSRPHWHRHQSMCVHRAVELERLLGASPPPSPKHHHHLYQHYRDTTSISTTIIKESITTSSLSSSPKHHHHHCHHQQKITIISTTITIISTTITITATITAAATVTTTSACSGHSSCSSIFPELKIYMNLMSSHA

SEQ ID NO: 926810 - protein, 147 aa, Homo sapiens
MIQRDLIPSLLSVNLDKSFILIILKALFYWTRACNKHSTFRVHVHIVQVSYICIHVPCWCAASTNSSSSIRYISQCYPSPLPPPHNTPQSVIFPFLCPCDLIVQFPPMSENMRCLVFCSGDSLLRMMISNFIHVPTKEVNSSFFMAA

SEQ ID NO: 926811 - protein, 138 aa, Homo sapiens; identical to SEQ ID NO: 773243

SEQ ID NO: 926812 - protein, 130 aa, Homo sapiens
MQSLRVVFTLTVSLMIPIFLAFCTEEHLFPDLNFVLAVTETPQMRLEWAYGASGQPLSPTCPRGFRWAGWWRKGLEAMVQDGFLPLLPLSLLKDTQCPSLCEAISAERMHPSSDEGRGAAGSPCAPIFFR

SEQ ID NO: 926813 - protein, 161 aa, Homo sapiens
MYRFVTKVCWSVLGVHSRPCLPVYHQQRLQNSKDCCLLLPLEASSQRGTHWMPARALLYEVSVYFFSELERCAGRSTALFRAIRQESLSLQKPRSQPPLPPGALTQGDGSFIYKPLTGDAAFLSEMPCPKRNLERQSGYSGFAVLQWAQPSQNFLAALFTL

SEQ ID NO: 926814 - protein, 140 aa, Homo sapiens
MTSKMEASFPTHKAKEGECDVPACLGSSWSSLKRCHYITWGRAELAYFFFLREEEAGEGTRMPENDGRLHQPQPLTSLPPFRAPSSPLRVSGRRGLEQRWVQICGNRLKLNRLKLNRSSQVQVPAENPLLQALVSTTPLS

SEQ ID NO: 926815 - protein, 168 aa, Homo sapiens
MYLSWKCRNHLPSASISLGAADWSCSYSAILAAMIELDNSYFSLLSAIASFSLKPGTFSSFCVGTDLKVPFATNHILYKSNFTMGSRHSASTLRGSCHSLDFVFASNGLDEAYYPHWGEKSALLSLPTQMLMSSRNTLIDTPRIMFIWASHGQVKLTQKLNINNEQGA

SEQ ID NO: 926816 - protein, 167 aa, Homo sapiens
MIALAGSQPGGLQPAGATRILRVLPGRHLPRWDTSPEQCVARPCGGSTQWLNTGKELALGVWISETCISGWQRQGKTSREKERKETERKRGKEREEETERQRRSQEKREAEREAEREEETEAKGKSKREREREKVKERKKKRKRNIQVVKKKTVYPIPLKAKRQLLC

SEQ ID NO: 926817 - protein, 144 aa, Homo sapiens
MVQGPKPLVLWGFQLGGDGVQRRRLGSLLASTSGEPRHQPLCGCTSKHASSAWQGFLPRLSQHNCRSEGGITGLCDLFIFLFGAFANSNLSFQPTPAHLLCITCETAHNTFLPYIRQTVGLQKTPDGCCPLRIYDQEAPHYAAK

SEQ ID NO: 926818 - protein, 174 aa, Homo sapiens
MAGCRSRALPRGKAAKAWREIEHSGGGPALLGDPVHPPQPLARVLSPSLPGAGRAGRLLRVRGRPAAPSAGPAKPTPTQNSSWPASSARSPGSCSRLSLHTSPQAEGVSSGLGQPRKGLPQCSGGLKGSSSAAKVGAQAEEAPRASEGCEDCQHAVTSQCELPLLRASTHISLL

SEQ ID NO: 926819 - protein, 135 aa, Homo sapiens
MAAATAIKRIQCLMESRDGEKGILTAENHNPKRAGRNQGVSSTEQRRKRFFTLVQGSVALRFMPLWWRQSPRLLITSDHKTIAPCSNSAVTKQSYHVTFTMFIHCKLYNKVYEATHTDPNAASLTILSSLIPTHN

SEQ ID NO: 926820 - protein, 157 aa, Homo sapiens
MCGLMCGLMYRLFHQPGIRPSDMIFILINFGPKFILPMWSRKTTRNIFSFKSPVLLEHLRYIVEANANSFWENPHSTKTLGDFKIPRNIRSLTTLLTQGHDPLTDSQQEQWMTVSEPQRLENLVKLLRKAEEKRGKGLVQEGSTELQQSCNFPLQNS

SEQ ID NO: 926821 - protein, 191 aa, Homo sapiens
MCITHRAHKVAKLVGILNPNSYEVLVLLLHNGGDEGICLELREAMEFIQTSRSGAVKLVLEGPGLLEFAGGPLQTLFAWVLPAEAAEQQRLLPGPYYGSFVPEGHLPDASWSSPRCAGRSTAVFRAGRQEHLRLLKLCPQLPHPPGALSQGDGSFIYKPLIGAAAFLSEMSSPVKRNLERQSGPRCFAMLQ

SEQ ID NO: 926822 - protein, 278 aa, Homo sapiens
MADSLPPTKLKCPRLTSDCCAGSENFKPVAPSLLCSVGVGSTEQDHLAPWLQPPFRRSEWFCLTGISGMTGVRKTNKQTKQNKTLLQLARCLPKQLPSFVLEAQGSGDIGTRDNSWSLGSKDHGKIIVSGLNSTVPHGTVPHGFPLLGYGVPQPLALSGDLHGSLYHQRPGGLGGKNDFMGWAQDLAALCSLRTWCPVSQQLQLQQWLNVVKIQLGPLLQRVQAPNLGGLHMVLGLQVCRRKGLSFESLCLILEDVWKCLEVQADVCYKGGALMETIY

SEQ ID NO: 926823 - protein, 157 aa, Homo sapiens
MGLLFSGQWIYVSREIMAASAASCKSPGKFPSEGACLGAEELHCKLWALTVLQVSLGACSGNPLPSKAILNQIISECLLKHRSVGFDPDQLIYNYLYKCAMNYCVPQLSECASSQEKPHQSLLGDWSEQCRSPRTTLIVPRGGSGHHESHLPCISPL

SEQ ID NO: 926824 - protein, 137 aa, Homo sapiens
MVVENAWCLVGSCYQLCCHLSMTVINNHSNDNDPKSFSENVMFELSREGFVEISEAKRSCIQHGKQLIKISTVVKVAFQKPEEIVLFLSSKCTRNRAFEVNSVGVQHFKAAKTAKRRTGGTFYPREVQSSNIVPHGY

SEQ ID NO: 926825 - protein, 140 aa, Homo sapiens
MGPRDTNPVGPGPAPRFLWCTGERELSDPSKFDVLLGAWAYSKSRTSVMNRRSAGVSWDYKNEKEMSLDKSKGKAQKKYFSKDLNEVMGKPCEYLGKSTPAHGKRSTKSLRQVWAGVSEPQKESSDGEKKSAAHESSAQS

SEQ ID NO: 926826 - protein, 183 aa, Homo sapiens
MPSIPSSSLRWVRTSSFSSEKFVIADLLKPTSVSSSKSFSVQLCSIAGGELRSFGGEESGPLAAGLLEFAGGPLQTLFAWVSPAEAAEQQILLPDPSSGSFIPEGYLPELCSWMNAGVEADSASLPVLLEPFVGSCVSSANAPEKSITRPEFESSCFFMWSWEVATLNFGTKDNLQLPLTLDC

SEQ ID NO: 926827 - protein, 124 aa, Homo sapiens
MEPFLPIQVSMVVEGSPPGGVPEAYGKNVLLLASSTHPCPQSHWGQGKSPGARLATKNVKKALFGVIVFHYGKLIQITWKLNLMKRELECHETQEEYVQVIFQQIFGGLRAIAPTPVNTGKNIY

SEQ ID NO: 926828 - protein, 207 aa, Homo sapiens
MITCYVTLERTIPTTYAAYGYILDISVNGVNKVLGSRNALSKNMQGEQGPIVIPSLFEAGNNGKSTVIPVWFLQVQEEEEYSEAITVVLLTLHPLMNTPAVAPETQPRKPGRKNRNSPITVFPVGVYVGDFCFTPCICDIWINNGNIKDLTEIFNIGFLRTHILNGGQCCRHGGESWLLGRLKKILNIKMFCGPSSYVNRYKAYMWY

SEQ ID NO: 926829 - protein, 183 aa, Homo sapiens
MCWQERAPQKPNDPKDGKSLSPRSTAWSWGRGDTSTPLATTAGVSRAPQVHWLQAQHSTRTCPRPFCRSNSFRTPGHFSRRSPGVLNKVVELAGTEIPTAAMEDFPLARASLAVPSKGTGQVLPCVVFRCDRAALNSYAKSHSHFTFPPPCIQILSPNTAGGLAKVVIAMQECLSYPLQCLFP

SEQ ID NO: 926830 - protein, 151 aa, Homo sapiens
MVKRCQCTVHAIASAGASPKFWWLTRGVGPPGAQKSTTGGQNPQENLCWHSVEGKCGAGVPRVLTGALPSGAVKRVPASSRPQNGRSTDNLYHVPGKAADAQCQPMKAATSGAIPAKAKGAELPQAVGAHLLHQHDLDLIFSSHGPRLWEY

SEQ ID NO: 926831 - protein, 145 aa, Homo sapiens
MQKSPIFCISHAGSCRLELAAAIRWGFTSSPIHLIHFHAWKCHSGRLESSKDGCLLLLRPLTSRSINLMSVGCSCVGCLTNRVGGSHPVWWHQEQNPFNKALCALVEMICFAEVKPTHLGFLDSSELPGGEAKSAGSQRLRPPLP

SEQ ID NO: 926832 - protein, 154 aa, Homo sapiens
MQGEGRLTVDLHYLRGVVKEVLIGRSQPSVQLLRSANKCSEEAEDVHYRAVYALKGNLKGEMHRYSGWASISCHSNTVTAGVSGWHTTVDAALRRCLVGHDLHVLECSLSSYPLLHCPSHEMPNTCGALGFSPPFVFLDEFKSWTQFERSWTAL

SEQ ID NO: 926833 - protein, 128 aa, Homo sapiens
MPKCCYGLLCVHKIAFSTSEMQLSLGGGLQQDDHSEPAPVDPNTYSFLWLITAASEKFHAKEDYNQCFRYTTRSNLGTGGPPQKTLESYIQFLLLIYDSSSPSPQNKSKAKIEEGKRRRKGNQGREMF

SEQ ID NO: 926834 - protein, 197 aa, Homo sapiens
MANRTCKIEGCHALAGCGMETPAQLKGRSRTAGVLGGTEALKAIFCFQLLYWASVPGDIDVYLQLRRALGSRACGEQHWLHVSNGTSQGLAELSLPRTETTPTAQEVLRVHECITEYGGEKNGPTLDSLRWRKMAISSPEWQNFGFPAHPDKSRIISPSQDPQLNDACNVSFAILGSFMDSGDWNASIVGCYSACHR

SEQ ID NO: 926835 - protein, 116 aa, Homo sapiens
MKTPMQIEINDCPKSDCIYARLEPIVLRGALSPLCGLLTETLQTCSPSPCYLPAGRVESTQPTSCTQSWTIVPWFISIRLCGNHVCNFELEFTPDIWTLQVPAGGNLDDVMKQRQV

SEQ ID NO: 926836 - protein, 131 aa, Homo sapiens
MILAVEKLLFLKPSDLTRPIHYHKNSKGKTHPYDSIISHWVPPTTYGNYGSINSKVRSPKSHLRQGKSLPPISLYNQKQVSYFLDTVGLQALGKYSHSKWEKLAKTKGLQAPCKSEIQQGSQILKLQNDLL

SEQ ID NO: 926837 - protein, 153 aa, Homo sapiens
MPMVSPASKIHLPSDCISILLGPSVFFANPESLLLIHTRCLQGSPGMVEMLANCVLSEEGLRQWPLLLHDLHEGLLEGAECVGKSKNAYGEGEVKLPFLSLSRALSHYFTGGERRIRNKGPWSANYSSMKPSLIPTPAPKEEEPCLLVVEDGV

SEQ ID NO: 926838 - protein, 160 aa, Homo sapiens
MESLPPICVLRGLAAATAPASDPVSPRQGFSQPDLPAATQQLSLGTQNLLAQTFIPNSRPGANAEASAGAANTEWGQGGEEKQQLRVCMTDGLMKKGNLDTKPCMQGEHQMKTRVTQPEGKEQPEDRREAWNRSFPSPFRGSMFLPTLHFELLASRTVKQ

SEQ ID NO: 926839 - protein, 140 aa, Homo sapiens
MRTPLVEDKDKDTKLCNVLTRQLLARLAVGLSGTVRKWAKKRRGKTKKERKIQHLNKIGKWAVKGGARQEGGNVRKGIHRGVKIQQLLGSPCTLGPECPLGLNAMLALPAGCTPIFSLKDISLPKLQQHKAAHLSSFTEA

SEQ ID NO: 926840 - protein, 146 aa, Homo sapiens
MPPSQAPELTVGEGWSPRKFPLIFWYSRRSIVIIGNDSCMCVIAAEDLPVGQDVEEEDSDIDDPNLCRPRPRIYSFSWQAAAQPKATFSRLLACGCDQFSSYSQREVNGSYKCQFWTKAFEKQSCFFYTLSPSAGLHAEKEQALGI

SEQ ID NO: 926841 - protein, 164 aa, Homo sapiens
MGVSMGLMEKVTSPKHLSGELVYRVGCSNPSHEQREERDVLLRIYSFSWQAAAQPKATFSRLLACGCDQFSSYSQREVNGSYKCQFWTKAFEKQSCFFYTLSPSAGLHAEKEQALGIPTTPQHSQRQRLNTDTQKSSLPAENSKQQKDSFCPLPRFTFLMSASN

SEQ ID NO: 926842 - protein, 134 aa, Homo sapiens
MPVLLVWVLHLTTIGLEYCFSDFQIMAHTENNFCMEYQSKWNPGLCQTAQGLREEISQHMAVYTSQTGWGGLAERDKRGKGQIPKCEWITRLSKQQKWILLSRTGTLFHLCTSSTNEEGLEDISDYIEFMVHLH

SEQ ID NO: 926843 - protein, 147 aa, Homo sapiens
MRVCPTSSEHVILPGEAESWSCPQLRRQVLLHPLNLPKGEHTSDSVERLVSAKRTHPHAEGQHLGLLCSHGDKLALSREQLLATCSPVQAKPFSEQECRSLIPRIQGWRYSKEGQAEGRSVALGKSETPVPEPEGTPKRGFIGPTTT

SEQ ID NO: 926844 - protein, 154 aa, Homo sapiens
MGEVNFLQKKGWMRMISFIRSFCKYRRFMLNPSKRQEFEDYLHQEMQNSKENFTTAHNTSGRSAPPSTNVRSADQENGEITLVKRRIFGHRIITVNFAINDLYFFSEMEKCLLIAHSLLNTGFDIGYTKNNYDVLSISKIPQTNEDGRKDTNKS

SEQ ID NO: 926845 - protein, 156 aa, Homo sapiens
MGEFPDPPSAEGATGVWLICSAAACSNPLWEEGHADRQVQEPGQVLLGSGPTVASTEILLDDGGGSQQNGCGAEKGMEWGDDLPLEFGYPMADLLSDCPQLNSSQCSDAPSLLSFSAMPLFCSSALLFVCPWSLGPRGGAFARELPSPTQYFSVYC

SEQ ID NO: 926846 - protein, 230 aa, Homo sapiens
MADVVLGIPVGYPVPEDLSSTMVVGKNQHLTKDGKKGAKKKVVDPFSKKDCYDVKAPAMFNIRNIGRTLVTRTQGTKIVSDGLKGHMKKFKMITEDVQGKNCLTNFHGMDLTHDTMCSMVKKWQTMIEAHVDVKTNDGYFFNLFCVGFTEKMQQSDMENHLCSTPTDSIGRDIEKSCQSTYPPHDVFVRGVKLLKKPEFELRRLMEFHGEGSSLGKATGDETVDKVKRAD

SEQ ID NO: 926847 - protein, 136 aa, Homo sapiens
MNGSLGQGFQEAGLVWGKRSCQHVRKEMCTKYKYFFLQQKKLFIWNMHYQYKLGDCKTYTVLVSLENTKVQLESKGTEACALTEAEKLKLSKPKQSRALQVYILNNKKRGGNIHYQMFIINTTKNETQVARNNGKC

SEQ ID NO: 926848 - protein, 155 aa, Homo sapiens
MDRWDGVLEETSGLEISISQSLAWSSQDICCFAKSASPGNLWGASPPVTQTLCSVLCVYYLIYPPGQHIKVIEEWNKAECITNFCGKAEGLTLAVFFFAFWRHSCMMKRGTSSFRATPNNCSSRPPAVHLTHPGPHSPAEPRSALSFTLTTSSKQ

SEQ ID NO: 926849 - protein, 149 aa, Homo sapiens
MRFYTLSGGNRHNFQPHTSARSYIELSRKSINEAQWKAGRLRQRFQGEIKFECYPSIPSVINEPLIAEEEDKKGNQRAAAEEEVKTPRKEKDLMHHHWLEELRLHNKNERVVGANKGHDEDPVLSPAEDHEMMMNTMMMKMLMVMLNIY

SEQ ID NO: 926850 - protein, 149 aa, Homo sapiens
MVYLRAWGEVLWRMKFSNLTICDIDMQIRSHSPSHALQWLLFALDALGIKTKHTICPTCCSLVLMTSHSSCIFNHTPPGSLNLNDAGLLSFPPMFQSLPHLGLTHHHYPSAPKSPPHTRCVSLINFCTLFRPLFKTYFLREPLPSPSQL

SEQ ID NO: 926851 - protein, 183 aa, Homo sapiens
MILTFKELMACWRERLIPKKKEEEEEEEEKNKKRKKKKKEKEKEEEKEEEKNKKRKKKKKEKEEEEEKNKKRKKKKKEKEKEEEEEKNKKRKKKKKEKEKEEEEEEKNKKRKKKKEKEKEEEEEKEKEKNKKKENEKEEKKEKMKSSRKRKRKTRGQAGIHFADIMDTKWDGLDILPAKKVLV

SEQ ID NO: 926852 - protein, 139 aa, Homo sapiens
MACNRVMLAGLLRNRVTLAQLYTAFINCQVQCPFWTQRLQLQEKSQVDSESNSFKDGRHTITLKPRGTESSIPRITICQEVRGERDVLHNESGKRGIWIFQIKTSYIPQKIRRKKDSQTPADVRNLLSGFGEKKSYTGS

SEQ ID NO: 926853 - protein, 191 aa, Homo sapiens
MCRRLRAYLGRAVSPKSVCEGCQRVILDRFLLRLNDSFWHEQCVQCASCKEPLETTCFYRDKKLYCKYDYEKPKRHAQRAELPFSAVVYIAPHGKVVGQRSARVRAAVARVPQKCAQWLSSTPWNPSSLVSLFYRGALRVASDPVSPCWFSPHVTQVSAPASRLCLAASRCLVVPGGSRCRGDSCLLFAHT

SEQ ID NO: 926854 - protein, 146 aa, Homo sapiens
MGFVPVSAWVQCGNALPNSDKFTGREFISQCNDKSLKDFKHGSNMIKFVIYKYRFGYFVANGMEVLAAETGKEAVHSGEQEPFLQLLSSSGPAQYLANGSSLNHIYRTYRKIQILNKKDHSTAPQHVELAQCLPPPAVVKIDDRSR

SEQ ID NO: 926855 - protein, 163 aa, Homo sapiens
MVIYNVHPFSPTRIRCMEELRCLGPGTTPISVGAKEASLSENSIEPASYKGKWFFSWSSGGTPVLPRAVLQVPRALVPPKEPGHGQVARAPVAACSGTFWADWRGPNGGISLELGRAPPLSCETEEKETRILMHKPMRISSPGTGFYLCLSGAPLTHCPAVMQ

SEQ ID NO: 926856 - protein, 154 aa, Homo sapiens
MPLMNATCSEEEREMQFECSMAHNQGCIIRPQEESKRVREKNLLYDNVMTLSLPVPKWGSYTCGWDCDTTITLGVAIAAHPCSPQPLSKWMHTFLSPVSRPGTRPQNTFGLGSVSYRAFNNTGLYSTHCLLWVSHICGFGCGLWRGGHGSFKDT

SEQ ID NO: 926857 - protein, 464 aa, Homo sapiens
MCGIISEGSSGPSAAGLLEFAGGPLQTLFAWVSPVEAAEQQVLQNGKCCCLILPPEALSQRGTRLFEVSSDPKSDSWIFALAVLLSSSFVYNSMGTINHQALEQLQYPSRNYVTELTELIRAKSCPRPDEVEDSSEFVSFFPDFIWTVRDFTLELKLDGHPITEDEYLENALKLISGKNPQIQNSNKPREWIRHFFPKQKCFVFDRPINDKKLLLHVEEVREDQLDSNFQMQSENFCSYIFTHAKTKTLREGILVTGNRLGMLVETYLDAINSGATPCLENAMAVLAQCENSAAVQRAANHYSQQMAQQVRFPTDTLQELLDVHAVCEREAIAVFMEYSFKDKSQEFQKKLVDTMEKKKEDFVLQNEEASAKYCQAELKRLSELLTESISRGTFFVPGGHNIYLEAKKKIEQDYTLVPRKGVKNLMILHKMDKLILIGYGVIVVIILVYIDRGDNDGDDEMNGS

SEQ ID NO: 926858 - protein, 179 aa, Homo sapiens
MVSRVGLHSHSPPPLAGAACLFIPDARTWIFQLKVLNSLAPFNSSPEKLEKVHAGLMCHLEEVADLVVLDTSNSRTKAILGALLILYVHCRDIVINLLLKNIFNAEDFEWTSFTYGYEYLGCTSRLVITPLTDRCWLTLMEALHLNLGGCPAGPAGTGKTETVKDLAKVFEESPHCLSQ

SEQ ID NO: 926859 - protein, 441 aa, Homo sapiens
MCFVKQMLEGSMLLKSHHHSLISSTQGHKNCGRPQGPLPRKARSSLGTSLPNPLHPAGFSPTDGEPRLAPSQRPPERRAFVGGFPLVPGSCRLCGARHRLGSSSTSSPCPPHEAWERVLPGCARVGVAQLAAFGMQSTGDPPPPLLLLQPLQLLLLAPSCCSSRSGNVFGVSSFRWVRGLTGSGVKLQTFALSQLIKAAWTQRVTNSRIYCKEQKNKPSTLWKWTRVGCHCSLGQPAFILLSGPTHILLIGRAQCGFTTGAAGGAACQSRAVRRHSSALGWWMGLGAVEQGAALVGEARAVQEPTEVGEAQAWRAAGPEPCPAGRQLRPGEKLSTAAAGPGAKPLTAQGRRGPRGRLAAPSAGPDEPTPTQNSRWPTSTARSPGSRPRLCLHTSPQAEGAGSGLGQPRRGLPQCSGGLKDSSSGAKVGAQAEEAPRASESE

SEQ ID NO: 926860 - protein, 304 aa, Homo sapiens
MHTSSSPRFVCRTSCPCCPSSFSWHLPQSSLWEPCSSSQRPCTHHQHPFHLQLKIREVPRRSCSHQSHGAACEAEAPPTGPPPNWHHCCPCPYSQPHVTLGQKQWWGSQGSVKSLSQVRCGQDPHRAGSQGRGRTNLGGEDVCIVGLEGGCGLVDRKKQWAWKSCMIRAGTGPGWIGGPWGLRIQQGAAGVKEEGMTGANTFPPKPLLPSGSSPELSPLSVGHPLLELEIGVGGAKAIISNDIITPSSSWMTCLTVYFPAVQAVYPAVGEGLGQAEPGSLTVCSRSAPQKLLLGIRALECLGCN

SEQ ID NO: 926861 - protein, 308 aa, Homo sapiens
MPYFKSRLRISEIENTLTEPTKDGELIFWTQLISPPPSEGFHDCLILGGSGDKVTIPCVNFSQSTSAFDFTHVLVEGQAEENMAAKVFASIGKFGLALAVAGGVVNSALYNVDAGHRAVIFDRFHGVQDIVVGEGTHCLIPWVQKPIIFDCRSRPRKVPVIAGSKDLQNVNITLRILFWAVASQFLASSPASERTMMSVCCCPSRPASSKAMEAKQVAQQEVERARFVVEKAEQQKKVAIISAEGDSKAAELIVNSLVTAGDGLIEQEAVEDIAYLLSRSWNITYLLAGQSVLLQLPQSVFQQEIYIP

SEQ ID NO: 926862 - protein, 138 aa, Homo sapiens
MESSLFESGYNASELSQVKGIWINPWYQFGTRRNPMSSSFLILGFLVTPGGSTSQDPTQCHASFLYQGIQETNQSFFPQTKLKYVWLYLDKVSLHGIGNLGNSVNSASPYLYLNLRTLFMSPLCVVLSVCLYPDSVFP

SEQ ID NO: 926863 - protein, 144 aa, Homo sapiens
MAHELRRGYNGEEGKKKKKIKQGKTWGGGIGGKEGAFSPRTRKELNLANNYLSMPGSRSSPDKPCDDYSLKVDESIVSQRTQLIQVQIPGPQKMPTNKWFFRPLNSGVICKHQDRHFVCYPQASEVNLAGLESPIPACLLLLLL

SEQ ID NO: 926864 - protein, 154 aa, Homo sapiens
MGSLLTQPTLQVSPAAMLADLGKMEHWAVHGLIGASGEELQKGPKEGQWPWNRGYGDAMYVKLIPSDGHEFIVKREHALISGMIKAMLNSPGQFAENETNEVNFREIPSYVLSKVCMYFTYKVRYTNSSTEIPEFPITPEIALELLVAVNFLDC

SEQ ID NO: 926865 - protein, 359 aa, Homo sapiens
MSGYPRRPGATPLSRARSLAIPDDDKFEDLEEANPFFFKEFLKTKNLRLSKEDPASRIYAKEASRHSLGLDHNSSPSQTGEYGLEYQQPFFEDPTGASDLLDKEEDEDTRWSGAYLPSAIKQTHPERVPAATLPCSTYLSFFSTPSELAGLQSLPPADFAAHGESLGDRHLRTLQISYEALKDENSKLRRKLNEVQSFSEAQTEMVRTLERKLEAKMIKEESDYHDLESVVQQVEQNLELMTKRAVKAENHVVKLKQEINLLQAQVSNFQRENDALQCGQGASLTVVKQNADVALQNLRVVMNSAQASIKQLVSGAETVTPVAPEGGPCGHGPSAQGPPRGCCCPPPGPTGTKVTHSVL

SEQ ID NO: 926866 - protein, 436 aa, Homo sapiens
MHGCFWLHQFAAAWGEEMFRFPMGLLLGSVLLVASAPATLEPPGCSNKEQQVTVSHTYKIDVPKSALVQVDADPQPLSDDGASLLALGEAREEQNIIFRHNIRLQTPQKDCELAGSVQDLLARVKKLEEEMVEMKEQCSAQRCCQGVTDLSRHCSGHGTFSLETCSCHCEEGREGPACERLACPGACSGHGRCVDGRCLCHEPYVGADCGYPACPENCSGHGECVRGVCQCHEDFMSEDCSEKRCPGDCSGHGFCDTGECYCEEGFTGLDCAQVVTPQGLQLLKNTEDSLLVSWEPSSQVDHYLLSYYPLGKELSGKQIQVPKEQHSYEILGLLPGTKYIVTLRNVKNEVSSSPQHLLATTDLAVLGTAWVTDETENSLDVEWENPSTEVDYYKLRYGPMTGQEVAEVTVPKSSDPKSRYDITVLEIAGYGGENKR

SEQ ID NO: 926867 - protein, 297 aa, Homo sapiens
MCSSVDRSFRMLQPSVKTDVPYPTLPTNVVTDRVTEDTATVSWDPVQAVIDKYVVRYTSADGDTKEMAVHKDESSTVLTGLKPGEAYKVYVWAERGNQGSKKADTNALTEIDSPANLVTDRVTENTATISWDPVQATIDKYVVRYTSADDQETREVLVGKEQSSTVLTGLRPGVEYTVHVWAQKGDRESKKADTNAPTDIDSPKNLVTDRVTENMATVSWDPVQAAIDKYVVRYTSAGGETREVPVGKEQSSTVLTGLRPGMEYMVHVWAQKGDQESKKADTKAQTDILAYVRHQPV

SEQ ID NO: 926868 - protein, 471 aa, Homo sapiens
MCSPGSRSRLSLHTSPQAEGVGSSLGQPRKGLPQCSGGLKGSSNAAKVGAQAEEVPRANIDSPQNLVTDRVTENMATVSWDPVRATIDRYVVRYTSAKDGETREVPVGKEQSSTVLTGLRPGVEYTVHVWAQKGAQESKKADTKAQTDIDSPQNLVTDWVTENTATVSWDPVQATIDRYVVHYTSANGETREVPVGKEQSSTVLTGLRPGMEYTVHVWAQKGNQESKKADTKAQTEIDGPKNLVTDWVTENMATVSWDPVQATIDKYMVRYTSADGETREVPVGKEHSSTVLTGLRPGMEYMVHVWAQKGAQESKKADTKAQTELDPPRNLRPSAVTQSGGILTWTPPSAQIHGYILTYQFPDGTVKEMQLGREDQRFALQGLEQGATYPVSLVAFKGGRRSRNVSTTLSTVGARFPHPSDCSQVQQNSNAASGLYTIYLHGDASRPLQVYCDMETDGGGWIPRMPVMDAP

SEQ ID NO: 926869 - protein, 138 aa, Homo sapiens
MPPLRFLQIARELILSSHLWPQFSALAEFLFSVLHNSAPSSPNLILSPKSNHFYKRCTLAEFLLMVLFQPAGNRCKEHSCTECPSRRTTGLPWAENFPAQQHRGMAFQGSELCKFVGPLGAATAPLSHQAVSPVFLTS

SEQ ID NO: 926870 - protein, 152 aa, Homo sapiens
MVLEKAVHALNQHPIYGTLSPIARIHRSRNQGVEVAPLTVTPSDPLAKFLLPVPMTLRSAGLEVLVPEEGTLPPGDMTMIPLNWKLRLPTGHFGLLLLLSQQAKKGVTVLAGVIDPDYQDEISLLLHNREASLEEEDLVRERAASVPLQSSG

SEQ ID NO: 926871 - protein, 124 aa, Homo sapiens [sequence omitted]

SEQ ID NO: 926872 - protein, 144 aa, Homo sapiens
MAPEQTPRTVGMGQEPPDSRRKLPQEAAAPTEFQHSLLAREKKGHATGNHWHWSQLSLTSHLKATLQDFSLKKMQCEDEEGLFSLSRLVTMGSYAVRAESSTVWVEISHAMTSRKTIFELVQIIQMSPLSEMPLTPHPVHQRTT

SEQ ID NO: 926873 - protein, 136 aa, Homo sapiens
MIILFFEWRNCGSTQLSNLRKPISLVKEEVAVTFLRESTVFPHSQFFFGLQRSVNIKNQVTFFFCLKIKAACCLLAPGALFSQGLFHLSGFPFYSSLLSTLASSAIQCFPQPFYLLVRHTVATLSPRSGMGKTELG

SEQ ID NO: 926874 - protein, 144 aa, Homo sapiens
MLPSLCPCVLIVHLPLMKVQPKNYLGSHISCHTFQNHWQAADSTVCQNLYFHFNQSTGLQGRSLNSHSHLEMAPAPLPVSCLNASSCCFESLLKGNICFSMGLVQFPLRQAEGQCDSFLYPKLLSSILEKLGHTWTRRMNARFY

SEQ ID NO: 926875 - protein, 185 aa, Homo sapiens
MIFTAVSNNGPMPFLAKKGNLAGKERPTLTQCQNNQKIPGKSRQKFAAVAVLSWKTSARAVQKENVGWKPPHRVPIGAPPSGAVRRWLPSCRPQNDRSTNSLHHVPGKAANTKHQPMKADRREAVPCKATGAELPKTMGTHLLHQCDPDVRHGDNRDHFGALRFDCPAGFWTGMGLSTFKMACKQ

SEQ ID NO: 926876 - protein, 196 aa, Homo sapiens
MGRNQSRKAENSKNQSTPSPPKDRISSPAKEQRRMENDFDEFTEVGFRKSEAKNLEKRLDKWLTRINSVEKTLNDLMELKTMAREICDACISFSSRFDQVEIRVSVIEDPINEMKREEKFREKRVKRNEQSLQEICDYVKRPNLRLIGVPESDGENGTKLENTLQDIIQENVPNLTRQANIQIQEIQRREHHKDTP

SEQ ID NO: 926877 - protein, 153 aa, Homo sapiens
MVWLCPHPNLILNCNSHNSHISWEEPEEDRKMWESLELPRDLLNGFDQNADNDVNNEIQAEVVSDGDEELFGNWSKSYSCYVLAKIWVAFCPCPRDLWNFELESDDLGFQNSRFNNSLRRVPGKATDTQCQPMKAARMGLSPAKPQGQSCPRP

SEQ ID NO: 926878 - protein, 154 aa, Homo sapiens
MILHYPTNRVVWTVKKYSLPGSGCQFTEQESSLASSQDSRRIRSHTDLKDGECGVLLGGGDGCQWDGWGSGQGMEWEDDLPPGFGCPTADSSTIHSQAPPDFQMLLLFAPSLPCGSAVRSLICSFPHLLLESGNHHRTFLVGGGEPSTALLMPV

SEQ ID NO: 926879 - protein, 193 aa, Homo sapiens [sequence omitted]

SEQ ID NO: 926880 - protein, 168 aa, Homo sapiens
MREVVEESKKRPLTRFEIVTSGHLGIYVQVTGDAMAWLGLRGLTILPSYINKKNKTVLKSWGGENFGGVIWRENGRCFSGLLQAGLGAAWEPRVGEIKLKEDFVGTDLPSTVRVTRSSASVMIYGAFEVIGQRQSSAAKPRRSQRALGQNSRGSGSACQNCGAFTTYH

SEQ ID NO: 926881 - protein, 148 aa, Homo sapiens
MNPGKFSLRHYADLEKEEGYTVRVRLFLLSVSCDFYSILWTTEQTQVYLQFWRFLPRAVTVTAKVCGFTPQVRETMNPPGGTNNSDAPPLRAVTLTESVCGFTPEVKARPQTHRKEETPDTSGHLKKQTLDTPSLRTNTHREGLWLHS

SEQ ID NO: 926882 - protein, 135 aa, Homo sapiens
MLSVQAVEMEEFKQAAEICQRMEEPNANSQDNGVKTLKALQRPLHQSLQSQVQWPRREEQFHGLGRGPHCPAQPWDTAPCIPAVPAPAVAKRAPDTSQATAAEGSSHKHWWLPCVVKPAGVKRARVEAWKPLPRA

SEQ ID NO: 926883 - protein, 138 aa, Homo sapiens
MADTTVTRTGSTNRLRSVITVRPEIALMMSRGRTQYPLTFPRNITLLCQQSSFLMSVKQKDWAGRNRNNKTASCQPAQHSTVKLHNLHCVLEEKKFLYLDRLTCSVNKSNVQLCVFGEQRNFSVNNVDIGLTNQCPLT

SEQ ID NO: 926884 - protein, 164 aa, Homo sapiens
MSTSGFFKPTESLLPFPKPPVALPGAILCQLKKTQTQLAERGEASGRQRLQLDIGEKRLDFRGTAGQCNLGEEFGQRRSDFKGKLPSLPSPLQFPFPLRATSISNKIYHIYHLSIRSGDFISPKSWTRAQVPGVRMKKAVTLTLCPHRQKAAISCEKAKGPLSY

SEQ ID NO: 926885 - protein, 156 aa, Homo sapiens
MASMIITSDSLDISQKVCKMKGISPLSYLEYPSYEKMITCPSFCHQYPTFSILLKYSGPGTQDLTKFVPGPGKQKALPSQSPPLIYQSSVKHPHKHPVINNSKWTMKIEKNIPGIAGPSTRSHYRHETEGPSTRSHYRCVTEGCGALKRKAVYGAY

SEQ ID NO: 926886 - protein, 178 aa, Homo sapiens
MIKHRLTREKHTHLFNKFDVTWNALHSKTIFEAAEMAPYNGLGVELGSLIAYTGIPVWTEQLVETHVINFCSKNYHENIPGKPRESTDPLKEVDCCSKLREAAEELWCAPESAISWLEANQHKTSTLNKNTTKGSYRVHFSSLLPLLEQVLVSTLRDLKTGYITGLLADSPQNHPGAW

SEQ ID NO: 926887 - protein, 167 aa, Homo sapiens
MGHTSGHGSLWDCVVHKPTKQAVTLDDCCRKICEEEVSRRRDDGVGMVIECPSAQLHDLLEPFRLLNRLHQWKVCCSHSCYSFHFEGCFPSHWLDHIKGTLKHGSSCCNICHNLTVDLSQEGSSILKHFHSKMQNKTKNLRAEVAVLDIQYLKNLCLLVQLSGGPEP

SEQ ID NO: 926888 - protein, 164 aa, Homo sapiens
MLLIYNLTPNPVLSETCAVSTQAKVGLDLQDSSSPPPSASQSAGITGMSHCTQPFFSSFGNVIHLIEIDVNIINANIAFTYLTGQRKFLVVHCGAVEFYFPKEVHRQTAGFGTGTLNSQAGFEFSRCPATHLFSQSLFSPARDVMIPLRAKLLPSNAGCLPQLP

SEQ ID NO: 926889 - protein, 184 aa, Homo sapiens
MDSSFTCRGQICWYQKPGMDLDAINDVILLEACIYHLLKIYCIYHLLKIYCREQPYYLNLTVLFLQSSYQTEIRQTLDLITAPQGNVDLGRFTEKRHKSIVKYKTAFYSFYLPVAAAMYMAGIDGKKEHANAKKILLGMGEFLQVQDDYLDLFGDPSVTGKVGTDIQDNKCSWLVVQCLQQATP

SEQ ID NO: 926890 - protein, 275 aa, Homo sapiens
MGGHHPIGCLTARPKQAEEGIPTCTERTPASLFPQLADGLSFRGLHLREKKKRKRKKRRRRKRKKKKKKEEEEEEEEEERRRGRRRRKKKRKKKEEERRRGRRKKKRKKKKKKEEEEEEEEEEEEEEEEKEKTVINKTLLPYNIVDLLSLMLLSATQTDCVHVIHLGMFNITLSMELEGKEDHVNMMFMLLAVPVRIPGNETAWLAKQKTKTTTTTTKTNQSVIDVCSCFPCSNFLKNKCLMLVGKNNHYELMNQGDTEYPLHCQHWVDAYLKSP

SEQ ID NO: 926891 - protein, 141 aa, Homo sapiens
MTKVLSNVNLFPGTAASTSSSSSSGTGAWNITVNKADKNLTFMEFTYLEGEDRLICTEPPEIHQLQFRFSYPGTGFHGGFCLCISAPDEVTISKLLPDMPDQKLKVLSLIFCAWVCSHPACSSAPTSHSLSLPCPLVRFLV

SEQ ID NO: 926892 - protein, 142 aa, Homo sapiens
MQTSLQYTDFLLLESDLCLVIVFDLKPIFPDVSVATPALFWLPLVCNIFLHLFTFHLCASLNLKDREQEQEEEEEAEEKEEEEEEEEEEEEGEGEGEGEGEGEEEEEEEEEEEEEEEEEEEILIMKQESVSVKVFLACESAD

SEQ ID NO: 926893 - protein, 159 aa, Homo sapiens
MLQLLPSQYDIGCGFVIDGSRYFEPFEVKNLLHWRGQGIPSPLVTTLQWVVVAKILHRGDGSGIHVHSHVPAAIAAWQSGAKVIVVFAIESNGKNRRYFSMNLCAMLRRHLTQQYCCLITSIVSAKFVVCITVHAKWISTYPKQHRGMSKKTGHFNKEC

SEQ ID NO: 926894 - protein, 150 aa, Homo sapiens
MKIKELAQSTEEIYHSQSFHNFIGKLEIKNFQHRILASLAGSPSTEHNTGLKMWNGVVLTHCLAEKTFRLTVLSACQGYHIRKVREPVPGMCAEVCSSWVGISLSTQTRAGKWSAPESYFSEKEQLSLRVLKVASSSLMSQSPKLSEIYI

SEQ ID NO: 926895 - protein, 146 aa, Homo sapiens
MPQVSAKDLLERCSPLWHFLASQEGNLTLEDMPTFFRVVIAIYHSKEANRTGTTLRKGKSAAVSQCGTRVCLHQHKPKHSHPKLPKQNALLMVDQVVIFLWNLTLLTQARNLEQSKESATLHDSDGKTLPRFDGQISEKSFHSHCS

SEQ ID NO: 926896 - protein, 168 aa, Homo sapiens
MVPAHTEDRSSPLSLLTHRLISFINTLTDVPEIMLYQFSKWSLTQTKHRERANLQGQGDKKSFTEWLEFQLDLEEKFVITNLRRPTSVNSSKSFSIQLCSFAGEELQSFVGEEEPQLQVCWSLLEVHSRPCCPGYHQQRLQNSNITEQQILLPDPSSGSFIPEGHLPV

SEQ ID NO: 926897 - protein, 136 aa, Homo sapiens
MEGVWFLKDHVAGHLQGGNIFNRFGIARNKLMVPSGCPHKVEGKWSLLDLICKGANLIHEGSTLPHLPKSQSPNTIILEVCEFGGYANIQITAGSLEGMPWVSISKGTKVKDHRTVAETSHLSPVGVSRNPTEQVS

SEQ ID NO: 926898 - protein, 195 aa, Homo sapiens
MIFCEENLELPGDLLNCCDQNADSDMDNEIQAEVVSDGDKELVKNWTTPAPAVAKRAPDTSQATAPEGVSPKPWWLPCGIWHKSTAGVEPSWRTSTREVQRGNVELELPHRVPTGALPIEAVRGRPLSYSTQNGRSTDSLHRAPRKATGTQCQPIKAVKGVVPCKATVAEMSKALGAHSLHQCSLNGVMQQVGPN

SEQ ID NO: 926899 - protein, 140 aa, Homo sapiens
MGRVCEASQDDARRRGRDGACAAGSKVLREDRLLANIWETGVTGGIETGVTGGIETERLEGWFLELWKTEAAIKNFSPYYSRQYSVAFCNHVRTEVEQQRDLTSQFLKTKGKTIDREKKQYTGPFSIWRSEKGEGSSKMD

SEQ ID NO: 926900 - protein, 142 aa, Homo sapiens
MRMKSQAEIQIEFQLFSASYQLGATCCSVTPIPQGPAFPKGGSWRYKTRHQCDVDTRNRNLGVINAEVKIQTTRMDELTKSHSLVRKLKGHGKAGFHIHFPYNKIELLLGKGSPAINYIFQLLWHLEVTICAFPILFFSWMQ

SEQ ID NO: 926901 - protein, 327 aa, Homo sapiens
MTGLGNLPTPFEWKRGLITHGNPDQFRYVDTWLQPDQFRYIDTWLQPDQFRYVDTWLQPDQFRYVDTWLQPDQFRYVDTWLQPDQFRYVDTWLQPDQFRYVDTWLQPDQFRYIDTWLQPDQFRYIDTWLQPDQFRYVDTWLQPDQFRYVDTWLQPDQFRYIDTWLQPDQFRYIDTWLQPDQFRYVDTWLQPDQFRYVDTWLQPDQFRYVDTWLQPDQFRYVDTWLQPDQFRYVDTWLQPDQFRYVDTWLQPDQFRYVDTWLQPDQFRYVDTWLQPDQFRAYPESTEAFLSKILNPVTRGWPKCIQSVAATVLLTTTTTTTTKHMYHP

SEQ ID NO: 926902 - protein, 132 aa, Homo sapiens
MFFLIHHKNRTSPSMQLHHQSPLQPLMAASLAGSLGFWVQDSSFSTPSHLFTLYFRFCLTLGLFFLCGSSTYMCLPANWMDTRTLVFLTPKIQFADGNEKLPVPLMTSTQQKKVIPLIPLLVELPGPRFTCC

SEQ ID NO: 926903 - protein, 140 aa, Homo sapiens
MSDRREEMTAVAFSDPVGKASTHPVKVSTQTKRYFSFLTEAWFINKPIVNRKEGNMGKWSECQVDQRDTVMGVRCGIRNNVGGRIEVWARNNGTVGDSTMKLGSFKRFRSLVVNTHNSYGDKGNRPLKSTIHNSQDMGST

SEQ ID NO: 926904 - protein, 270 aa, Homo sapiens
MASHIVLNNGTKMPILGLGTWNSPPGQVTEAVKVAINVGYCHIDCAHVYQNENDVGVAIREKLREQVVKSYHEKGLVKGACQKMLIDLKLDYLDLYLIRWPTSFKPGKEFFPLDEPGNGNVVPSNSNILDTWAGMEELVDEGLVKAIGISNFNHLQVERILNKPDLKYNSPDRPWAKPEDPSLLEDPRIKAITAKHNKTTAQVLIWFPMQRNLVVIPKSVTPECIAENFKVFNFELNSQDMTTLFSYNRTGGIQRADEQLHPFLVTFMGN

SEQ ID NO: 926905 - protein, 187 aa, Homo sapiens
MVVDNPNHILWLAFCISSQAVFSAGLWWNETTLLLSPLPLLPEDKAREEGDNLLPSDLSAREAWCVLSQDRDNRASHGGSSKGNIHRLPSEPTGSRLRKGRPEAQKPAAKGASSMVDSWGSPLGDTDTVACSSEEGRRLQDCSSGLDTTPACTQTSGEGGTEVPETEHGSHRHQPGTSHFFLFGLIL

SEQ ID NO: 926906 - protein, 165 aa, Homo sapiens
MRRAALAGTPHGQELASAYGRQETGCSALAFKDWNPAKGHTKERTLPGSPALLVGFGTPECGYGSVMAAELTEAVEFRLRSGGSKDCPAPCPAPTLDARKEEKRPELQRGQREGRKRTSMFAQGTQWRLPPRMEGRYSRERPPKRLEIFHGCWDEGCGGLLCAVH

SEQ ID NO: 926907 - protein, 160 aa, Homo sapiens
MKKREDNTLVYIVDVKANKRQIKQAARKLTNTSVVKVHTPIRLMERRRPSAGNAVSAGCQGHRPGPEVLRRPQRVDQMHQEAPGLVSVGSSWPNLWRGPGSRRAPREESFPWLVQHFSRALLYRNMVLTPDLGWFLEQRPTQCEDDEDEDLYEDSVLLNQ

SEQ ID NO: 926908 - protein, 149 aa, Homo sapiens
MKASDIRCVASQLHHSLMMGIEASELMDITVPVWRGSFRWCSCTDGTAIPILVDLLKVRMAPLMPDVNGTFLSASVKNLVTKKLHPFNLTISISYLKKAHFYVLPVHPPHALLQLFLLREMISPFKVQKVPKYSLIPSLTASLIINILH

SEQ ID NO: 926909 - protein, 148 aa, Homo sapiens
MVPKIKWLGIASAHQILNLCSLAGSCDKFWSVGYEQTGPMSLVDETGKTGWVPHELPSCLRSEGDLWPAHSIGEVAGVMRMPNVPQAARESLPYAVSGWGLTTMHNERAAAELQMMPAALESTLLSLFSRVKLEAELGTPGQSSRCRM

SEQ ID NO: 926910 - protein, 136 aa, Homo sapiens
MLTVGFTCSFPRSNWCSEVDLCGALYGVGIRYFLAGLCQLFGCPSFCPSQTWRPPENGHKSNTLTSFIHSLTVDDMPSTSPPLCSVMGTQQAMTVSVSVGPLPMETPPPTQDGREDKEGDVVRWLLIPLKTLNQDL

SEQ ID NO: 926911 - protein, 137 aa, Homo sapiens
MYKRHPRLNEENNPTGPTAPDNAPSLDNTGPGQNAEEDKILICSSVLYEGGRFEGDRTLSLHNVESLPVPGIASPNRHCRYTRAVCPRSRRRTAAGPCCKRSCSLAGTCFSASSHPGIVTSKKELQIPEEELGYGRI

SEQ ID NO: 926912 - protein, 148 aa, Homo sapiens
MTSRTNASRAPSGLSPLPALSSVCVLEKQQHCNEAKAVDIPHMDIEVLKKFNQNKKLVKKLAKKVSDQADPVSPRPGLHKAGTFPSLLIHNENEVDEVKSTIKFQMTKVLCLAVTVGHVNVTDNKLVYNIHLTVNFLVSLLKKNWQNV

SEQ ID NO: 926913 - protein, 158 aa, Homo sapiens
MEFSTLALLTFEAVLCVTELDSAGTSGNERELTELLTAVLILNFFLRGLESRPQAKSSPLQPVANQTIAEASSRCFTISCLLRPNYCTSPREPLSVVQDDKTYKGLLSPHSESNKWEGNPMSLICLTMYGAQSGVPAEMQCLVSSNKRTLSPYLRNRG

SEQ ID NO: 926914 - protein, 267 aa, Homo sapiens
MVAGFPEETATRVGCGVSVLHRTSEDVPPKLLRSSTPWDATEHPPASFFPSAHERRLRAAAASEESSAGKVAPVGPGASAPLAWQNLRGPPRGSGAVPRLRSWHRRSPVPRSQKHQAHLEAQAASRPSPTPPSTAAVSTAAQRRRSRDLKGHGRLYRTTGWSRLGAAGAEKTSNGGQSAVGTGKSLSSPSFSKHQPLTLQFADFPGHWKRPCQVKEAGDTPPLEPGATGRLGLQASPFRTAPKSDLQARAADPQASEGSPSSPERWP

SEQ ID NO: 926915 - protein, 138 aa, Homo sapiens
MLGLMPARGRTRRRPFRCPSSFRITQCTGFNRSRQAAPLRFSEALEPAQLFYKRRWLRLTLDGRLLCVVIPERESTVPVSQSGGVLASKSGGGWFELFDFNRRCVSLSSNIFFQLNERAFSFVLLPAQQFPYISLMYQ

SEQ ID NO: 926916 - protein, 203 aa, Homo sapiens
MGILLTFRSSALRASVSLLLPLSEPRDARRSPHPLFGVRGPRNRVLTVARTTGKSPNHPFGVKEPGGSPFRASLLAPSNRRPGLAPPGTQRPSKSSPPLRATLGLGESSYVSIAGPKSRCFTKLWNLTPGNFILSSQDLSRKERSARAGSAGSVPRPPRLNSRRTTGKRSLSSSEGPVSDGGAPPRPVRTLPQGEDALERYQS

SEQ ID NO: 926917 - protein, 138 aa, Homo sapiens
MKWSQNSQPLSWGRNFSLISRMFFSAFSLDQGLADNTMLTFVAEEVEPGTGEKKPKHMMGALRCNCPGFAETQAPWSHLRVTTNEDYSFSIHSQYSCTPVTMPQTHLFPNTSKHIPHCLSLVCTTSSRQTVSQQVIFS

SEQ ID NO: 926918 - protein, 150 aa, Homo sapiens
MVGSLLPVDFTLKGAVRTEVSGKGPEPWGLSLGDGDGRRGKAGKEGSGKGDYAELASKLSKPSQPFSTGFTTQITRPLMGQKSGLPFSPDKQLRISSQFQPCYRDCTQTDLVSSSSPFDIKSQFPPYFNAKIPSQCEDGVHVTYMFTLCT

SEQ ID NO: 926919 - protein, 187 aa, Homo sapiens
MTTTTWNADTDNRVKAQYQLIQHWVVSSSFPTKESRIPKQSPEKNNLSQIRPEGGLFGKHSSWGKNTFPWAVENDKGKGWHMHMWAGREGPRGAAQWGATHSLGEGTAGEEHGERGRGAVRALTITVVFLVHRLPEGSSETCVRKEKLSGLSSLLHDHSFSPTYHCLAWNGSWKEDSRETIETDNRK

SEQ ID NO: 926920 - protein, 241 aa, Homo sapiens
MHISLMTTTTWNADTDNRVKAQYQLIQHWVVSSSFPTKESRIPKQSPEKNNLSQIRPEGGLFGKHSSWGKNTFPWAVENDKGKGWHMHMWAGREGPRGAAQWGATHSLGEGTAGEEHGERGRGAVRALTITVVFLVHRLPEGSSETCVRKEKLSGLSSLLHDHSFSPTYHCLAWNGSWKEDSRETIETDNRKDAVISELSLEHFSPVCQGFREGFPNIQAGCQGFLKKPPFLDIVGKGQSI

SEQ ID NO: 926921 - protein, 176 aa, Homo sapiens
MAEVVSDGDEELVGNWSKGYSCYVLAKRLAAFFPHPRDLWNFELERDGLGYLAEEISKQQSIQEVTWVLFKAFSFKRKIEHKILENLQPHNMIEKKSSFSEEKFKQAAGICISNEELNVNHQDNGVNVSRACHRPWQQTLPSQAQRLGRIKWFCRQAPGSPCCVQPRDLVLCIQLL

SEQ ID NO: 926922 - protein, 189 aa, Homo sapiens
MGYLSLHNHVLCELESGHPQLDQQWEKPQEGPGEDGAVAGPATTSTNEVCVSYKTAVASLPSSKSPTRISLMGHLHGKYTQKGIPGQVVQLSQVDTLQGHHTYIEPTALAPVLSYCPFSFGQSLVPPHAEMQLLFAASFCVLALQEGGFDEFHTAGKEQLKSPVQHPEKLNLPPPYTWGKMSNVLCYNI

SEQ ID NO: 926923 - protein, 125 aa, Homo sapiens
MPQNMCIFDPIVLFMEFYPKIIIYNMPDNLDRRRVNVLFLIPKEWKQIHMPINRELFRNVTVIHTNENCWRHIEQLLTQRQDKSSKEARILILLCDFHHGMRILPHGCQHSTEMPFLGYAFMFYP

SEQ ID NO: 926924 - protein, 175 aa, Homo sapiens
MRPNCGVVKEGQLMKKYEGTENQEVKGFAQGHTAGKAEELDWEGREGGREIEERNEEREGQREGWREKDFTPDTTVGCFWLQNGFPHGTQMTTNSNGGMYSSVYIQMERVRESMDQGSCPSGRLVNSVHTRVPVPRLTQLVKHTARSPYVSPTREASRQYLPGEAHGTEAICSRW

SEQ ID NO: 926925 - protein, 157 aa, Homo sapiens
MAIAALPQTSTESPYAVLETVKKRRGKPRQTRSSYRHNPRFRSRKAQQDQRGVVISDKQMGRHGGLLMVGPGKSLRDWIWRMEFSRPGQAASQCVSPRRAFMRDQGWILAWGPKFIERVSMYVCLHMYEELYTIRNATLLSTLPEPQKNPQVRVPES

SEQ ID NO: 926926 - protein, 126 aa, Homo sapiens
MYQSHISKEENATFRTQRGLPGDMLSSYVGTAAVGHCVRPEFSYLTFTTTVVITPQTHKPRNQCGVLPKTKYIHSDDSLRLRKLPFGINVNTDLASNNPEHVRVSLFPNQMITSDPGYPSVNGFQV

SEQ ID NO: 926927 - protein, 161 aa, Homo sapiens
MPAITIAIVAIILTTSPSSAPPTGCFAVNTGMWRRVNELVGWERLSVKVREGNKTAHSPAALSTFSLPAKSFLASLEILTAPRVSHLLPCFCTATGIGTCNLNGSSRVLPSPGPTHACGLTACPAGVSASEILSSVNLLNTGTPVRLCRMMTNRVHINLVP

SEQ ID NO: 926928 - protein, 146 aa, Homo sapiens
MKSEEEATSGGAAVVLLATAGGSPLPEPPPLLFKNAMLVRSSFLRLDGKGSSGSLLRRKRRPLLLAAMKKAESGTVPSTEYIKLNAPKPIQFSQAGGDADLIPYHELIINPSAGSLLLIPYRQDFETVPSRFRGSFLALSSTFSTH

SEQ ID NO: 926929 - protein, 142 aa, Homo sapiens
MCLKHSRNAIIKLLKGYHMENDLYVRMYNMGFMGRRHQKGGAFEWVDGWGKWTMMEDGWVDKWMDGWIDGWMHGWQQNALGRGRERRGGGSRSEMLEEVEKKSQRERRDLGKRRLEKPDVRIQRPAATSATRRHFAEPRFPH

SEQ ID NO: 926930 - protein, 179 aa, Homo sapiens
MSVGSGGDRGTDVTGHWDPTCIQPLTSDKPPADLSLFFPKIIYVSACLHQSPKEKSPFFTPNLLSFWKARAQLTPCKASAMLTRALINAANTVCSVVISLPHQSAIHAHIHLLSLFEFQGLEEIWNKVVLGSWEVKLCAVSSYPPWLGGQVQCGIAWRPKMDWDRASQALTATSTTQGA

SEQ ID NO: 926931 - protein, 140 aa, Homo sapiens
MASSQLDYICTDLISKQEGFISPKSFHKPCLYPNPTPVFNLPQREVLDPRATCFQRPLSQCYTRFKPESMSTGDTVSKCNGCFYKEDPQNGEHSIELPVEDTHSPFSSRSGFVSHNQEKLDTQTSKKHLAVSIKTWWQIN

SEQ ID NO: 926932 - protein, 162 aa, Homo sapiens
MQTTAALFLDYSSRLHTGSTNIIIPEPGRVTQCSLTLRCCQTSTKQDLTLHNKGISTEGKWIEPSYGSGVALAESDRFPGCTKTNTIQRVEDKPYKDSETSHIHEFLGIQWSGACQDIFSSKIKNEYYILHLLPLRKKYNSWEAFSDSQVAYTQLENTTPAH

SEQ ID NO: 926933 - protein, 137 aa, Homo sapiens
MGKLQEGLAEAEYSIFLLKHGDTKKAEAPKLTEGPSTGVTVSAAYGWSHTPVLLEVGTAFAFGKNKMQKVGLGRQTDAVPSPAQKIIWGRSLIFGELGRGDSQAHISHCGPRHEDAAWCLLRAGCHGLLPLLGDENP

SEQ ID NO: 926934 - protein, 140 aa, Homo sapiens
MVAPCSVPSCLPLQPSFCVFPVPPVHSQCLPSEGLLGVRQSTQSLGGSSSTWLCLVGHLALSPYLFVCSFNKHLLNNVRQCNYTLPSKALAKAQESPRSGASGNEVEVKVEALVDGGAQSENKSHTLILHSSKSIDNAKN

SEQ ID NO: 926935 - protein, 139 aa, Homo sapiens
MISKILVRPSPEQCTLYPTCNLLSLTPTLSSESSKFIISFLCLYILTAKLPLMNLATQQSYWFPGWYWRLSAQFCDVNHLHSGLSAMDSSSCSSRGGRGVKWTLVSGKPPQGPLQDKVRNGFPKDRESPQGSSCCFLYP

SEQ ID NO: 926936 - protein, 134 aa, Homo sapiens
MCLRYSSPLLASCLPPPIFSLTPVHKDQSSNQISDSIKLSQHMCSKSDNQCTHRDGLWSNKQLKTPDPLPVDHGDIENILEVIEPHAVRDMQIKLMVSILQSQPMGDKNNTAWNLWSSLGMNKAFKQESYIEKV

SEQ ID NO: 926937 - protein, 541 aa, Homo sapiens
MRRQIRSSTTSMTLVTKSLKCLRPHYGKLKEMYENMAPGENEHFAADIISVLAMTMSGECECLKYRLVGSQKELASWSHEYIRHLAGEVAKEWQELDDAKKVQQEPLLTLVKEIVPYNMVHDAEHEACDLMEIEQVDMLEKDIDENAYTKVCLYLTSCVNYVSEPENSVLLRCALALRLALMRNDMELVEDIFTSCEDVVVQKQMAFMLGWHGVFLELSEDVKEYEHLTEIMSNVQLNSNFLALARELDIMEPKVPDDIYKTHLENNRFGGSGSQVDSARMNLASSFAGSGNVLKVQQLLHVCSEHFDSKEKEEDKGKKEKKDKDKKETPADMGAHQGVAVLGIALIAVGEIEVSYNSIFAMGMVGSGTNNARLAAMLRQLAQYHAKDPNDLFMVHLAQGLTHLGKGTLTLCPYHSDWQLMSPVAMAGLLTVPLSFLDVRNIILGKSHYVLYGLVAAMRPRMLVTFDEELRPLPVSVHVGQAVDVVGQAGKPKTITGFQTHTTPVSLAHGERAELATEEFLPVTPILESFVILRKNPNYDL

SEQ ID NO: 926938 - protein, 172 aa, Homo sapiens
MGIWGEIKEIRGMVWIEEIREMGPKSPLVPTMGLNGGTGKEMGKALGGDGKSSIGERVKMEWAKLLELLLGAGGLGDLEHIEAHRLAQGLALAHCDDVTDLDVPEAGGQLYGHVLVALLEAVVLADVVQSRQMTMILCIFVLVTTPERTHPRMETFPVKGHFLSMWAPSIAS

SEQ ID NO: 926939 - protein, 161 aa, Homo sapiens
MTGHDNDTCQESYDATQQFLSLLTRKEERNSRKQIKKENVGGGRMTYWYLLHPSCLLSLLRSPVRRLRCGRGCQQKPRESSLLFTVHLRRSGPPENLPLLRTTAKSLAPVYPSLPLCPDRPQSFPMWPCLACCSPCFQGSVSTNNIFPHDSRFHVCVPYHT

SEQ ID NO: 926940 - protein, 138 aa, Homo sapiens
MNKSESCRENRGVWSYFKMAPLLALPELGEDFFSDHHRKNLAELLEINLTEVILALYSSLWSFHSESQACGGDSLIEDRGILATFCVCSLGIRDSQVTKETYIVISSYISHESNRIYDTDKETKVLRGCKGHNLDLET

SEQ ID NO: 926941 - protein, 143 aa, Homo sapiens
MESAGTVNRLLPLQPGVLHVARHHPWWLVFPSKHLKRTRRKLQGFFWPGTKGHTTLEAASQCFPIDEEEEEEEEEEEKDNESPSLASLIKYKVADSLRADSPRAWRMSASVVKVDLGSAPQCPLEQKLKTEFFPKDQKTYGPA

SEQ ID NO: 926942 - protein, 149 aa, Homo sapiens
MYLNSTKGEGVKPFRRNCPHDWIIIFHQALPPTLEITIRHEIWAGTQIQNISDLKAVMETTNKRKAPEMCVQGVHKRAKRPMWLEDKAQSPFGNLRQQYVQGKMVTRTKMVTRTVWKGRVWRSESGLEFGAHYAFHVYYTSKWRFLVGN

SEQ ID NO: 926943 - protein, 145 aa, Homo sapiens
MYWVPQQCRPTGAVLYFSPGLSCLPAGQGSGPAARHASAFPDLRGLLCSPSLPEERRPLLHGAQSHHHPRAEECGRTPRDWQAAPPAAPVRDPLGEASWAPESAVTLTVKVRSFPPEPARPGTHQKEETQNTSQHQKEQTPDAPP

SEQ ID NO: 926944 - protein, 235 aa, Homo sapiens
MINEEQKHKETNNSNAPNPSKEGSEGPDEDILPLTLEKKENKGYLKSLFEILILMGKQNIPLDGQEADEIPEGLFTPDNLTSESYYKEILSVPTVEHIIQELKDIIAEQHLQARKCLSLVPSVMGQLKFNTSEEHHADMYRNDLPNPDMLSAELHCWRIKWKWGKTQSFCPPFMKPSICLTSSFFLMCMLNDLLPKVLCISPVMKVENEQYENGRKHLKAYLRNTLTDQRSSNLA

SEQ ID NO: 926945 - protein, 126 aa, Homo sapiens
MWENGVGPPGARRRTLPLASEVHSLPVLLSSEQKQGLVPAVTTVKRYSGSIRGQVSYTLEVSGVKFPAPWKKPAIKKNTARMQERQTRKLRKASNLVVEIYKADNNRIKYMLKSKTLFQVKNPVKV

SEQ ID NO: 926946 - protein, 269 aa, Homo sapiens
MADSGESHQCSKGMEAASCTHWSPCSVFLLRLSRNILKGQLLLIHASSDAYPTVESIRDEAFHGEFYSKQNVDHAFLMSFATKFSDYFLLIEDNVFFAPNFVTHIHSRVTTMKSNSWVLMEFSNMGFLGKLFHSRDLPLLAHFLLLFYKEKPLDSLISHFHTLLVQESPILCRPFLFYCRVSYTAFDHKQKATALQKKNADGPNNPPGAVFTDMQVSDVHFPWEAYTLDESFFWTHNISIGNHLTVILNHPANLSRVQVMTGSIVEWEL

SEQ ID NO: 926947 - protein, 237 aa, Homo sapiens
MLLLLPRIPPHQWRKEVAPEALSICPETCITTHTCLKESALPTWECELKKSSPRKPQLQQICSWGLHVTSSFPLDRAIEFGTAVSCQELLMKPQYLPGLGKMQGDTKEPSSKAHGIRELSGLGHQVEGTLSAAGRASGSSCGNCSANPGQKSPVACTHFLFQLCNSKGSPGSIYLGSLGSVTSESTRQLIQRNALTLKGILEAGGNRGSKKNFLEGNYCNISILRRYCRFRSRPLQQ

SEQ ID NO: 926948 - protein, 232 aa, Homo sapiens
MCKSAIFRSSISSANKEGLALKVVLSMPRAAFCCWASSRCFSSWSQSFGHNPRPSRCPGSPSANAGPRLPVGTVTLNESFCCLHKVTGEQRPLDSVGRDTRSNRTQLNDMQHFITLSGQSMLKPQSTPAGSGNGQSCCFQVLVGTFPHPKPKYVTWTVWICSEEVLDGDTSYWYLTPLNPLHQMHDIACYLVVELLAGDNGDLLAHALIRVEVIAQARVVLFCDDLGRLLHE

SEQ ID NO: 926949 - protein, 143 aa, Homo sapiens
MVFPSHCEELSVSLILPVSHLSSPHPLPPNNTNLPQNLGVQNLACLLEKRRENTESTIQMALFFFFWIIPQQSLLHGRGCSKPFTDEEVWSLQPLPLEYLTLNPHLTVGSQPSTSLGTVRIRIQVFGLNPWTDVYTTIPPSNA

SEQ ID NO: 926950 - protein, 149 aa, Homo sapiens
MMLAVGLSYMAFIVLRGQLPLCCPIRLPISQLPLHCPIRLPISQLRLHCPIRLPISQLPLHCPIRLPISQLRLHCPIRLPISQLPLHCPIRLPISQLRLHCPIRLPISQLPLHCPIRLPISQLRLHCPIRLPISQLRLHCPVQLPFLAP

SEQ ID NO: 926951 - protein, 151 aa, Homo sapiens
MGKVVEMGSAGPTPFSQARDPELCTITHAHGKADEALELASLYLGNCVILLGRTPGGSKAPTHQSPHPPSRPSSDAELKKDTADFPSKEGATHTKLAALERAIAKTETRRRFPEEGGVSGNFLNTRKLSLRCTYEEWVSGKGSIILGAWQT

SEQ ID NO: 926952 - protein, 462 aa, Homo sapiens
MELGELLYNKSEYIKTASGNKVSLQSVLCGSQNILLNRKTMPPFKKFSKGVEFFPLHIGDHVFIEEECVVNAAQIGSCIHVGKNCVIGCRCLLKDCCKILDNTALPPETVVPPFTVFSGCPGCFSGELVECTQELTIDVTKSYYQKFLPLTQNLLTDGPSGGVVFKCCAYTLSVTSHFVPLSVEHRIICSQRSSPLVLCMAGSHRKRACTAAAPSWCGGYVAGELLTAIHCPCRAPPTQEQSVTTNYFYNPREESLLVLRILPEEQPDGKDLDWDSFQWAWGRGNLMAHIAEKAGLDWALGCIPELQTGICLFGSQLCFPLSWLYSRAPWCGPTAPVIGKKSSHLLTELLDLVLIGPHEEGIQPQVITVAKRWNTLSGQAWHVYPQRLRVGADGMVVDEITRRRDKWVLGRKKHQLPSLGLSSFPGVFTFPPYPCCSLPSAQSLSTPGLGKVPSEDAPGTGT

SEQ ID NO: 926953 - protein, 165 aa, Homo sapiens
MGTCTSLTLFDPPKSLVRENSREVGDERMVSRHIAHSLPSSHSWSLFSLLAPLLFKAKCIVLFISPLQLEEQVLLLAHALESHNSTQAIYQSISSKQINIASSPKGISLNIFLHLIVPIFGIDTGTESKCTLEEFSVESDELNHVHSASCKFALLPSTSPFQVLA

SEQ ID NO: 926954 - protein, 162 aa, Homo sapiens
MCLGKAGPRASPGMEVEGVDNDVPSQSKWMQKELRETLSFLPMGKTSLPEAQASEEGCPRIVKIGDLGMKGNYWHFILQLVSAFEADSMTCACTTRIRKTALEKRWYVGQSAQEGCQDGLFKFSVLGKHGEMYYTCSYSWPSLWQTDEIGQPKYVDRLWGVY

SEQ ID NO: 926955 - protein, 147 aa, Homo sapiens
MFQQCEATQELENREKIETIKFSAAAIGSCMHCVDLHNCRCDTVQKLPGILLPPIIPLGVVAAKKDEAASKRLPKSKEPLLYHRCTSCISCTCSPVTRIPTHYGQNLRDGPQYKILRWEEGSAALRFSSFLGLLGTPVANQAPWEDS

SEQ ID NO: 926956 - protein, 143 aa, Homo sapiens
MENRRIVWKGYSWSCWLGIRFGILLSVSSLCVFVYVKGTSEEIAYGSPADLTQNPPLFIWSHLVIPKESSTGLSQGGYSLFTLTRDPNVNYHLEVIPSHLEWIKDNRDQQEKWLDPHSYGTASRVIKNCSILMEAAEKGNLKT

SEQ ID NO: 926957 - protein, 327 aa, Homo sapiens
MCHAGALHPLTRHLALGPSAAGLLEFAGGPLQTLFAWVSATVAAEQQILVNSKCCCLIVPLEVLSQRSTRPCEVSLAVCWENHCSLQSCQTGTFKSAEVTAVFLFVYALPPEVEPTEAGRPPGAVGRFQLIGDPHYQNCSLVIRDVQMEDTAVYFFRVKRGSFVRYNFMNTFFLELTALTQKPDVYIPKALEHGKPVTVIYVFNWAFEELLNLILRPQDHDTYHTCCIDFSRTGVSAWWTIQLFVAYTSRYLVISISYDNAPTELASSHISSKKSGPMEAVVLVAVREGAVKILLLCICFTFLSVSFYRRKVMRAAVGVEAANTVTG

SEQ ID NO: 926958 - protein, 432 aa, Homo sapiens
MKSSVQQTPHILQNFPLKWCTGGTLASQLFREHVRYVTTFDTWHWLLLGQKAPHPDIWKTNTFTSFKSRWQKTDDELCRHSMSFILHKAIRNDFFQSYLYLLEKIPLVKLYALTSQVINGEMQFYARAKLFYQEVPATEEGMMGNFIELSSPDIQASQKFLRKFVGDGSLYLKYQGAFLQGPGRAGTDCALDCGSGIGRVSKHVLLPVFNSVELVDMMESFLLEAQNYLQVKGDKVESYHCYSLQEFTPPFRRYDVIWIQWVSGHLTDKDLLAFLSRCRDGLKENGIIILKDNVAREGCILDLSDSSVTRDMDILRSLIRKSGLVVLGQEKQDGFPEQCIPVWMHQTGIRESSRKNEGLFKFHENYGLQDWSKQYNASGKNQEVHRNKKLGAHWDQASIWEKTVARLDPEETIRGYEQSEVHSFIRMMVFMF

SEQ ID NO: 926959 - protein, 140 aa, Homo sapiens
MSTLNIGPGLGLGVQCSDHALTLDLEGSEDRKMWKSLEHPRDLLNGFDKNADSDMDNEVQAEVVSHGDDELAGNYNPPHRVPTGALPSGAVRRRPPSSRPQNDGSTDSLHHASGKAAGAQCQPMKAARLRILSRKVEEND

SEQ ID NO: 926960 - protein, 161 aa, Homo sapiens
MAHVYISALFTSFVCLPSQQGSYSTPSILIYLRPLLSPTWLNDLFLASTLISMEVVPQSVSQLLIPFLSSFLKLVERFNPDIVLGFQIQHIKNKLMRFPSYLASSPNLPNSTNDTLLCLKCVIPELPLSLISPHASNPNVCHFHVLFSIPTNVLFPLIYAY

SEQ ID NO: 926961 - protein, 173 aa, Homo sapiens
MITATSQAGCAVLIVTAHIYITVDEFEAGISKNGQSHEHVLLASTLSVKELIVVNVTTEIKSVEMHHEALSEALPGDSMGFNIKNVSVKDVRCGNVVGDSKNDPPMEAAGFTAQVIILNHPGQIPVGSAPVLDCHTAHLTCKFAELKEKIDCHSGKKLENGPKFLKSGDAAIC

SEQ ID NO: 926962 - protein, 171 aa, Homo sapiens
MCNLNPSVMKTGRNPDPKRGFLDLAQERIWGKWKKTDQGSLAPTAPQLVNQDSRVAGSSSDSLNKLTKMTNEHRIQILMDLAPSIVPLYVHTEHTLCVSAFSALGTLCKCLGEEILHSNGDKVSLQPVFFFGVCVCVCVCVCVCFHPLVHAFTHVCIHIQVHAYIHLMDNF

SEQ ID NO: 926963 - protein, 153 aa, Homo sapiens
MSEARNQILLVCLALLTIFFPQTPTFTGCGPPRDRTKHLCNLFPSPAVDCDLHHQSSDSQNYTTSFPGSPACRQQIVEVSLHNCLTFEPALTSNTNEGLAAQQRMLCGNQTAVQDLRESRSLNIEHRFFNGLSAYPQSVLRPGEIPDLGYPTP

SEQ ID NO: 926964 - protein, 144 aa, Homo sapiens
MIREQKMLINFIANLFQEVRSSTEESDHITKKTASLEVFQGKPFPSNSECMNLEEDNCRKGAHAGEYQCLPALMVWNLLKLWSLTHSITLTCDSTHRPPPPYSKGDNVFLVIISKPKRDVPDVSFTEVYCMVEGKEPCFDIMHT

SEQ ID NO: 926965 - protein, 157 aa, Homo sapiens
MGQNRVSISSLAALGCAAFSQALPRDDSQGRESESQPSCERTAAQVKSVLSHREWQLSSVAMTALSLWSPLLAVLWPVPAQSIEHWPPNWAQGPVLETSEGEGEAFPWPIQLWCHEQDTKASLLEATVKGTSKEWSTERWTNYGMKALHQRAGLLIS

SEQ ID NO: 926966 - protein, 145 aa, Homo sapiens
MHMYCGRGLSVHNAVSRETWKIQAWFERARSCRAERGCGHPGGKRAARSAPAGGLSFGQHRERSLEEGARWTGQGWWEGICGCALHEVWRETLRRILGKLELASSNYCALGETLLSLSSELLQARKKGLENKGAILGPVTEKEAS

SEQ ID NO: 926967 - protein, 166 aa, Homo sapiens
MTHSAVAQQLLLRQRGAFSAGSVCKLRKREASKPGSQQCGLQLVVKAYEPRQATGAVPESKGRRTWSLDVHGQEESKQASSSGRQQSRRCSKQVDPPSSPALKDYLIPCNNLEEEKKSGPRPLLHLSLPKFTSLFSTSYCHVVPMCVFGARGGDGKRRSEDARTRA

SEQ ID NO: 926968 - protein, 162 aa, Homo sapiens
MGKLAASFPGFFAECYEILYIKVCLLPAVFVPALRMYGFPCQVESPGFFYVASSSGKTPAPGKARVLGHYLVNTDSYQAYSPVPFHLRAPHTAQQPHRHRIPRRTSVHNALRICHSLSQHLREGFLASEHHQFPPLPPSVTLPALPFPSQAKFPWYLFSLCC

SEQ ID NO: 926969 - protein, 142 aa, Homo sapiens
MGRLPGGGAPHFSDGAASQRRSSPPRRGGGGAETLLSSKTGSRPDRGALHISDGAAGQRRSPHPRRWAAGQRCSSLPRRDDGQEETLLTSQTGRPGRRAPHIPDDGRPGRDAPHFLDRVAPGQRLQSRHFGKPRQAAGRWRL

SEQ ID NO: 926970 - protein, 139 aa, Homo sapiens
MTVRNPLEEAVCPLAELKRGAGRSAALFGATSQGRLSLLKLCPQPPPPLTPHPTTAPTPPPPGALSQGDGNFIYKPLTRAAAFLSEMPCPVRRNLERQSGHSHFAVLQSVPPNFPAASLTLEVTPHPASAHPLWAAPTV

SEQ ID NO: 926971 - protein, 272 aa, Homo sapiens
MVGKAKWKPLELPLPRKIVNQKQYRMIGGIAEISATIKDLKDAGVVIPTKSLFNSPIWPVQKTNGSWRMTVDYHKLNQVVTPIAAAGPDEVSLLEQINTSPGTWYAAIDLANGFFSIPVHEAYQRQFVFSWQGQPYTFTVLPQRYINAQALCHNLIQKDLVCFLLPRDIILVHYINDIMLIGSKEQEVANTLDLLVKYLCTRRWEINPTKIQGSSTSVKFLGVQWCGACQDIPCKAVPMSSWGVPYDQLTEEEKTRAWFTDVSAQYVGTILK

SEQ ID NO: 926972 - protein, 151 aa, Homo sapiens
MEFLGDNIAMQGEFAATFYNSRAAGPRLCCCKIFGSISHCGDENTMSLHRAGCPWGGCEDERSARLHSPGGRPSSKQEEEEEVAQLLADFPLAAGAAPASPRLAIRQPVRSPPPGRVPPLPSPAAAMKLTHRMLLRSFCIANVFCENSGQD

SEQ ID NO: 926973 - protein, 261 aa, Homo sapiens
MGTHCPEEGGNRNISRLYKAALPYRSYAGLCVTTTLRVERVQIKVSFKPQLSSDPILSYNHQMVHSENNLPWMELRCINLALETLACLTIHFKLGLRGPAFGDEARDGHKKMSEFTAGCQVLSPPCFVGRQIFELLYEDLGHCRVFKFTASCPHVRVNYSYQALFAALAVEMVPNPQSRLSCEEFPFLYSSASEIWKAKLRQQPFLCSEGGYRYQVCSRDIVQWDGLRSSRHNSSRLEETADSCKSLRQVSAVKEEAHWRY

SEQ ID NO: 926974 - protein, 135 aa, Homo sapiens
MTMAVMLGEDSDHQGVRTQQEIQTPLMQRSLTLSFPTPEHRHKGRGTWSSMPLLTEYPQSVTGQLCRGLCGYLGTVKAYVFHLQVAELRGVGLGEAQSLLPFRMSHETPGEELLTPPEPHSPSMGLSCFVKLDSL

SEQ ID NO: 926975 - protein, 255 aa, Homo sapiens
MFSRATSLPDIAKTAVPTEASSPAQALPPQYQSIIVRQGIQNTVLSPASLAPLLPARDSDLVLSFADCSLGDTQHGEKLRRNCTIYRPWFSPYSYFVCADKESQLEAYDFPEVQQDEGKWDNCLSEDMAENICSSSSSPENTCPREATKKSRHGLDSITSQDILMASRWHPAQQNGYKCVACCRMYPTLDFLKSHIKRGFREGFSCKVYYRKLKALWSKEQKARLGDRLSSGSCQAFNSPAEHLRQIGGEAYLCL

SEQ ID NO: 926976 - protein, 126 aa, Homo sapiens
MLELSEKDFERAITTMLPRAATKTFKTNEKAECQQRKRNNQIEILELKNIIAKINSVDGLHTFINIANCVKLKVQKKEWTWDESKMLVMQDPIYSSRTKGSPFILQCCPSILQRNLTIVLLYRRCA

SEQ ID NO: 926977 - protein, 161 aa, Homo sapiens
MRAGSAAEAGTFTLCLFLGALSFPAALPALANRKFADFFSHPVDCLFTLLIVSFAVQKLFQLDVIPFVYFCFGCLCSWGITQEIFARSNVLEMFASPPQYVGSLDVPRPNSRVEIVAAMRRIRVSGQRWTVWSGESSALAAGPSSAIVESGMKHGKTFYKP

SEQ ID NO: 926978 - protein, 163 aa, Homo sapiens
MAWAYGLLGSHRAPSGRVLAVRVVKAILIQAQLLGVEVFGPRAERTWLQEDKSFVGTLIIFWPKDTKPRDRGLSSDRSWQAWLISLLILCGQAPGDYRGCLRPVNGTARLLREVENPEAPPALFQEKRSEWCGEGPAGDVKRFIKEITGPFKGVRQLLMMENC

SEQ ID NO: 926979 - protein, 150 aa, Homo sapiens
MQERRVFGESKMDALCDFGGSVDFVLTGLRNEEKEYKEKNFTAGPPGVTSHIGRFHDAHLSHKTSKFLLGILKGEGVYKQGVPVPICLPRQGSLNTDPLSDCAVSIWPHTAVASHYQSVLPFGSSCPWALQPLWDLSTKSQRISGRAGGQ

SEQ ID NO: 926980 - protein, 156 aa, Homo sapiens
MICAAAIVGIFLSCKRSANLDILDRLPGTVHGGLAAEVLEKAGLVPEGLSGIHCGGPVTGSMRVALVPWSVKADLEPGSMGANLKSETTSTNLALALKAGKSKIKMLAGSVSGEGSLVGSLHGRSGEDKKGPKLFNSSILIRDEWVMDKEKSQMTS

SEQ ID NO: 926981 - protein, 128 aa, Homo sapiens
MLSCLYCSASWSRLWAQGRGRAGQKGNTWVEKREASYDSHEDTGSKTLGFLAPEKFPIFKIRHGRNTNAEFNMTHTGWVNGYLNGNQFGLTTEGPLPNMLFWVEHPKSKKLQNPKFLDTDWTLKGNGH

SEQ ID NO: 926982 - protein, 374 aa, Homo sapiens
MEEELKCPVCGSLFREPIILPCSHNVCLPCARTIAVQTPDGEQHLPQPLLLSRGSGLQAGAAAAASLEHDAAAGPACGGAGGSAAGGLGGGAGGGGDHADKLSLYSETDSGYGSYTPSLKSPNGVRVLPMVPAPPGSSAAAARGAACSSLSSSSSSITCPQCHRSASLDHRGLRGFQRNRLLEAIVQRYQQGRGAVPGTSAAAAVAICQLCDRTPPEPAATLCEQCDVLYCSACQLKCHPSRGPFAKHRLVQPPPPPPPPAEAASGPTGTAQGAPSGGGGCKSPGGAGAGATGGSTARKFPTCPEHEMENYSMYCVSCRTPVCYLCLEEGRHAKHEVKPLGAMWKQHKQLMAGNVSLYLILREREEPSKSDEET

SEQ ID NO: 926983 - protein, 137 aa, Homo sapiens
MVMDIFVFSLQQFAKIIMDMFLRVDALIGFCSRIIPGLMWQGGDFTCHNDTGGEPICGEKFHDENFILKPTGPGIFFTANAGPNTNGSQFFICTAKTEWLDGKHVVSGKVKEETEYCGGHGALWVQERQDQQGGHYC

SEQ ID NO: 926984 - protein, 214 aa, Homo sapiens
MKTPAAGLNKTSVSFVLPHFILLKLIFNCKISQGYCRKISKTQHKEEEEKILFFSLPPGNNQYKHFDVHWRVTERIKLHRYTSVQTQGRTESTNTFLYFHEFFLRSNNTRQKSNITDILGRDLPYSHSSQITSTLTPALSHFPTDSAPTKVIDDLCLAEKPGPPPHERCGLLAQRLQMMENWVLLEGPGGGYTQKPDLTHLLTDPKFLSKAFLP

SEQ ID NO: 926985 - protein, 147 aa, Homo sapiens
MVNGVKVRGEDFKGRFRANDISELVLPQGKGAGLLYHPQNIYWLPWGRKEDIKGMRGKAALAPNVDSLKLQVRLVVAKLVEAGLWGLQPQTGPKGTWTEHKGDIVRISASVSHSEKKNDLNGCLWYPLWGKASLKAFTEKPTRWVRP

SEQ ID NO: 926986 - protein, 137 aa, Homo sapiens
MRNLLLQQASAWSSRCFHTSSELYEKVTKPQFLTCVYSQAQHHMEAAMVWGLHPLKPQPELYVGPFSHSWSSLDAGHQVCWSLLEVHSRPCFTWYHQQRLQNSKDCCLLLPLEASSQRVTHQMPASAPLYEVFVNPC

SEQ ID NO: 926987 - protein, 159 aa, Homo sapiens
MAALANDYTDPHLTLPSVNCSLASSTEAKGRMPLPYGNTAEKQHTLLTLHFSGEVNWIATPEHYSSAISYYIIAKRISELNFICISEIGSFGALNAELGTRFMKDKVIKARKECQERMTTVIVMTNVTGPIYTHTFYTEFLTYTLSQSITLRQERKKSL

SEQ ID NO: 926988 - protein, 163 aa, Homo sapiens
MSLYSVPFLIFLVFVSLGLAEAEESSLIGLEVMSLPEGTCQPFMQHEKLELRLGPIGICCGTEAGEPSLTGLEGVHLPGGTYQPFMQHEGLELKLGPFGIYCGKEYEVPNLQFKIMWVAKATPREWHLRNLEEVRVSATHIAGGKVFHVQKTAGIKALISEHT

SEQ ID NO: 926989 - protein, 137 aa, Homo sapiens
MMVAHKVNSLLDAYSGLLSNESMILAVNSSFVDPLLQFESQLKIIESSFGMLVVMPSLDKVKEMGSSYEYIEDMENVTQQVIIFRVLLFTLFSYNSQGTNLYHWTPCAKENAEHSIFMGTTVPKEGLTTIQNPIFHN

SEQ ID NO: 926990 - protein, 220 aa, Homo sapiens
MHITPMLAHGEVDPGTEEISGGKDLNQGLADPPIPPPTDPDLSLSGILAQSFSLRLGSSPDDIPKCVFQLVSILTVTFSQAPLQKVCWSLLEVHSRPSLPGYHQQRLQNSKDCCLLFPLEDSFQSGTCQMPVGALLYDVSLDPCWEQSSITVLFRAGRQEHLNLLKLCTQLPLPPGALSQGDESFIYKPLTGVSAFLSEMPCPERRNLERQSGYSGFAEL

SEQ ID NO: 926991 - protein, 218 aa, Homo sapiens
MVRKFLSICLSAPLLQVCWSLLEVHCRPCLPGYHQQRLQKSKDCCLFFCLEASFQRGTHQTPARALLYEVSVDPYWEMSPSQEARGAGRQECLSLLKLCPPPLLPPGALSQGDRSFIYKPLTAAFFSEMPCPERRNLERRSGYSWLCRAVVGSAQFELPGGFYTVRGKPPTQASVMVDIPPPTEFKCPRSTSDCCAGSENFKPVDISLLGSEGWHPLG

SEQ ID NO: 926992 - protein, 165 aa, Homo sapiens
MTLLDFTRATILKGYPLEHIPNEAKKEKEKEREGEGERRRRGKRRKKEEGERGEGKAEEGEEEEERKKKKKMISIFHMKGCPSVPAISLCYVNHQKTLAVPGLMDKQAYKELEICSENNENDKVVKNIHNSIWVNSLCGAPSQQPSSTPRTVKEALKGSEHTAVE

SEQ ID NO: 926993 - protein, 208 aa, Homo sapiens
MPAGALLYSVSVDPSWEVSPGEESRHSAFSRARALCWKICCSLQSWQAGMFKSAEAAPTAAPSPRCSDPGRWEFYLKAPDLGCCLSFRDALPSEEESREAVWLQQLCSTVVGLTQSELPGGFVYTVRGKPPTRASVMVDAPPHTKLEHPRLTSDCCAGSENFKPVDLSLLGSVRVGSAEQIHLAPWLQPFFQGSEEFYLTGVPGATGA

SEQ ID NO: 926994 - protein, 150 aa, Homo sapiens
MASMFSNKSLNVNKKLEVMINHCEEGMLKAKELMYLVTLSGSQFSFIIMKILEPLGIYSACALEMRHNKALMTVYLFTAWFTEYFKPTVESYCSEEKIPFKTLLLIAKAPGHPRILMKQCKLINMFIPINKASILQPMDEGVILLSTLII

SEQ ID NO: 926995 - protein, 264 aa, Homo sapiens
MQKEANLPIILTNVQEIMNLLRDFCTFEYFLLPLKSKRNGSSRTPINHSFSRSRNILEGSEVDRKIWESLELPRDLLNGFDQNADSDKNTEVQVEVFSDGDKELTGNRNFSGSMEINGCSGRSLLHGWSPHGGPLLGQCRGEMQLAHVLGNVAGTQHQPVKAAAGAVHCRPTVVELPKAMGAHYFHQCALNVRDEFCPGNFTFDQNCYKVQLEVSFFLCSFLNSTRSPPQGPCETKFKMASLWTESTHRAFPPASSTPIFCSHL

SEQ ID NO: 926996 - protein, 134 aa, Homo sapiens
MASEGASLKPWQLPLGVEPGSVEGKHGVGAPHRVPTGALPTEAVRRGPSSTSAQNGRSTSSLHCAPGKATDTQCQSMRAVGRRAVPCKATGVELPKTMGTYLLHQYDLDEVTNLLLTLQTLRGMSAPPIIGPEA

SEQ ID NO: 926997 - protein, 142 aa, Homo sapiens
MVCTQKFTESCTVTVLNVICAFPLVTLSIIHGALSDTVAPAGLFNMVSSWFRALSIHQDPYTIGCDQCPSLCSQFIPDVSALLVLPMIPMGQNQSGLPVKIPKPLRKSNVNHYFPHLILATVGPGNFSVSGIMPPWGRDHAV

SEQ ID NO: 926998 - protein, 145 aa, Homo sapiens
MPEPPTHSMGSCEDRASPMSTTPCSAVSTPIDHPRAEECERTAQDWQAVPPAALVRDPLGEASWAPESGGDLRDCKRTNQCPDKTGHSALPVSRMWVGPDKRIKAGCRASIGNLLGSPSTLWKLCSFTLCNKSCYCSLFGSTLLL

SEQ ID NO: 926999 - protein, 164 aa, Homo sapiens
MWQDEDVLSGLNVLIQILDPFSNPQSSHIKQQCVVRFHAADKDISETGKFTKERSLTGLTVPQGWGNITIMAEGKEEQVPSYVNGSRQKDLPLSTPHEREHVSQQVQELERVLLGTGRKKTPFTWLTVLNPLWEGTYRLWVWDPTDRFWAQVGANSMRACSSVQ

SEQ ID NO: 927000 - protein, 156 aa, Homo sapiens
MIYLLRVVELVPNIWGNYCSHSLIHTKVISFKNIRSEAANADAGDIASYPEDLAKVVDECGYTEQQIFSVDETAVFWEKFKQNKKTDGLEEVRGPFLKVLADKQGYDLRDRKAWLEDAVLMLAWDKAISSQQDKYWRKAFPKDILYLRKRFNDVTN

SEQ ID NO: 927001 - protein, 180 aa, Homo sapiens
MTEEAQKLNPNYFSNQSNKPNHNLFSNKSRDPNHNCGNKWPSSVRTWSATANFSLFAPTSNLGPASLQAGSGVYIIGPLALRPLNYTTGFSGLLEKTAAGEVTEQPRHFMIWGQDIERKGEGEDLGLLNKGEQVGRQASERQEFESSELAEDLELKERESESAGNKVMCGILTNQHITTN

SEQ ID NO: 927002 - protein, 188 aa, Homo sapiens
MYLWFMVLMVLYRAPQFSGRLVTEVEEEEEVGKEAGEAGLLVVQLKDWQLVFIFSLPGLRVSSFIDYGSPNHKLHSICTKILENITDIPICDVTPGGPAVKFLFELFLFISQTSQHLGKIERTYVEILGNGSPDNFVYSHGVNQGLWYCTKQDEKFYLEYAAHESHVIDWLTERLKHFLQSNIPNCYF

SEQ ID NO: 927003 - protein, 143 aa, Homo sapiens
MYCILNMSFHSLLAWKVSTEKSAARCISAPLKSLTPWPLLLQVYGTYYSTTTDVHLRPKGSSDILVNAARPESPPSGKWTPIWPRVGPEMPSRTQAWNWESQEPGWCSIPRGCAGAQAAEQSPLYSSLSFPQTECISPFGYHS

SEQ ID NO: 927004 - protein, 147 aa, Homo sapiens
MVTTLPQSPGDQGAADGHNQGILPETVKNKLLPAGVPGMMPGFPCNPSMEAVTLDPSKGAGVVKSLEGPCKVTALGGHPVSLLDSRTPRCPSQLHHHVCNSQMFTMIFGRNCLPQSQVLTTPGIYSPYLELLTHFFGNRPNGISYFS

SEQ ID NO: 927005 - protein, 372 aa, Homo sapiens
MDSQVLKKALTQAPVLSLLMGQDFSLYVTGKTEIALGVLTQVRGTSLQPMAYLSKETDVVAKEVSLTDPNLNLYTDGSSFVEKGLRKAGYAVVSDNGILESNLLTPGTSAQLAELIALTRALELGEGKRVNIYTDLPPMTIYTEQDLYNYVVPKPRNKRVPILPFVIGAGVLGGLGTRIGGITTPTQFYKLFQELNGDMEWVTDFLVTLQDQLNSLATVVLQNRRALDFRLIAKRGGTCLFLGEECCYYVNQSRIVTEKVKEIRDCIQHRAEELQNTGPWGLLSQWMPWILPFLGPLAAIILLLLFGPCIFNLLVKLVSSRIEAVKLQIILQMEPQRQSITKIYRGSLDQPASPCSDVDDIEGTPPEEISTA

SEQ ID NO: 927006 - protein, 193 aa, Homo sapiens
MRKKQNKIAENSKSQSASSPNDCNTSPAEMDELTEVGFRSKTGQHSNSGNPENSSKILHEKINPKTHYRQILQGRNKGKNVKGSQREKPGHLQGKPIRLTVDLSAETLHARRDWGPIFNILKEKNFQPRISYLSKLGFLSEGEIKSFSDKQILREFVTSRPALPKLLKEPLKMKRKNHYQPLKKRDTLKYTDQ

SEQ ID NO: 927007 - protein, 163 aa, Homo sapiens
MTAALAGILGKAFICLGQACGCEDVKNQNAWFGTRNAYFTPIFSSLNSYLSFEAHLLHATSSRKLSMTLKVDQAQLAPNGSWTLEDHILGEPAAMAAPHGKDHDMDLVTGYSGSIAEGRWKDVIDEMIKAPADLVSGEGCSLPPRWQHVAASSGGQEHRVLTW

SEQ ID NO: 927008 - protein, 144 aa, Homo sapiens
MMSAVGFSRMAFIMLRAKPHQGLILSVFGAPGGKCGQQCQWVQVGQSLDLQMPAVTAVGQEGGQMFGPLGNIYGVGDESTQKVAQWWTYLRTPRQHTLVVVAAAGWLFQDPGPQVAHPGSLLGSDKNLSRLGSGKIVSLKDRSY

SEQ ID NO: 927009 - protein, 152 aa, Homo sapiens
MGRIQSLESEEARILFGCQDQLLFLPFYASNPPPALLGHCQGWNTDLSWTHAAAIARQSTFNANRPRFAIYASCCQAFASRLSPRWVQIFPLIKTCCKCHLVSLWVWEVVLVANAQSRLGDAGEGCSCCPTEGEQMVNGVSSPPLPGEATGP

SEQ ID NO: 927010 - protein, 179 aa, Homo sapiens
MWLMTTILGSATLDCEVLEGLIQSCIILAPRIIPGMYQILSSGVLGRPLGGGDHRMSKVAQRSDATQQAGSSTDSKAQVHSIVRLRLSGGDSIGQNYGAANPSVVGSHTYFNTQRFDLTSYNLAPHSLAGSCLATREAFSRHPIYSSCPCLHMTLHLFLSSQNNVDAGKGTGPTSGPKA

SEQ ID NO: 927011 - protein, 452 aa, Homo sapiens
MFVLRTEKEKQDVYHHEHIEDLLDKQSRELQDMECCNNQKLLLEYEKYQELQLKSQRMQEEYEKQLRDNDETKSQALEELTEFYEAKLQEKTTLLEEEDVRQQLREFEETKKQIEEDEDREIQDIKTKYEKKLRDEKESNLRLKGETGIMRKKFSSLQKEIEERTNDIETLKGEQMKLQGVIKSLEKDIQGLKREIQERDETIQDKEKRIYDLKKKNQELGKFKFVLDYKIKELKKQIEPRENEIRVMKEQIQEMEAELENFHKQNTQLELNITELWQKLRATDQEMRRERQKERDLEALVKRFKTDLHNCVAYIQEPRLLKEKVRGLFEKYVQRADMVEIAGLNTDLQQEYTRQREHLERNLATLKKKVVKEGELHRTDYVRIMQENVSLIKEINELRRELKFTRSQVYDLEAALKLTKKVRPQEVSETGPIYTWPSGILSGAHTCSLRNP

SEQ ID NO: 927012 - protein, 115 aa, Homo sapiens
MDSACLHPGEINSHVAHTKPLWWSLHTDAHEIWCRDSDRGTSLRRSIPCPPVLCSVRKIHLQPQVLRPTSPRNISPISNPRQRRHVLSVDPKLQRRSRTGKAAFPWCLIIAGTPL

SEQ ID NO: 927013 - protein, 179 aa, Homo sapiens
MRDLGVRVMLAYPTKSKRQTAAVCFCHHKEGSPMPLRPLWVLEAHIPHLETPLQSFHWVTCKAPSSEWDLEQERALQQIRTARQTALTLGPYTPAELGVGNVSVETDGYSNPKDAIARNEGLGYIVRPAKRGPLGARGVHAVVPVDCGSHEIHYSDLPSVKNLPLSCGGPWRKMELLVL

SEQ ID NO: 927014 - protein, 148 aa, Homo sapiens
MLLCPSEARDDLITDLLNEAKQRLSKVVKDTTRYQVLLDGLVLQGLYQLLEHRMIVRCRKQDLPLVKAAVQKAIPMYKIATKNNVDVQIDQESYLPEDIAGGVEIYNGNHKIKVSKTPESQLDLIAQQMMLEVQGAFFGAKANRKFLD

SEQ ID NO: 927015 - protein, 163 aa, Homo sapiens
MSISKAYLACFSNHKLPLLLKDEETKGTEELSNLHKQTGLLKVGEYQEIIRMGLMETSENSEARPVDLEIAATVPKSWGFLTAVCVCIFWSQEQPLLRCSWKTLASEYTYAKLRRSALTNEGLDAIFLWKERCGGGPGLDEMTWESILNKAIPITEFLFSITP

SEQ ID NO: 927016 - protein, 136 aa, Homo sapiens
MTLEACCEEEGWTGTERNTSVPFLSAFPSRQYNAYGKRKQQQNLNQYLGQSYEDLDYGGREVGGSSLSQGNSGVTISARSQFNFEYPSLDASYKRVTGKEALELQREFRPADIESSIWPEFGKVIEAMDMAIFHRK

SEQ ID NO: 927017 - protein, 151 aa, Homo sapiens
MRMREGESQLNLLNGFAQNADSNMDNKVQAEVVSDGDEELVVNGFAQNADSDMNNKVQAEVVSDGHEELGNWSKGDSCYVLVKRLVAFFPCPRDLWNFELERNDLGYLAEEVSRQKSIQEATWVLFKAFSFMREAEHKEHKAEWKICSLTM

SEQ ID NO: 927018 - protein, 151 aa, Homo sapiens
MASEPANQVKSRCCYVRIAENARSAHGPMEMNDFRSPNLHKKAVTKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 927019 - protein, 742 aa, Homo sapiens
MEEGFRDRAAFIRGAKDIAKEVKKHAAKKVVKGLDRVQDEYSRRSYSRFEEEDDDDDFPAPSDGYYRGEGTHDEEEGGASSDATEGHDEDDEIYEGEYQGIPRAESGGKGERMADGAPLAGVRGGLSDGEGPPGGRGEAQRRKEREELAQQYEAILRECGHGRFQWTLYFVLGLALMADGVEVFVVGFVLPSAEKDMCLSDSNKGMLGLIVYLGMMVGAFLWGGLADRLGRRQCLLISLSVNSVFAFFSSFVQGYGTFLFCRLLSGVGIGGSIPIVFSYFSEFLAQEKRGEHLSWLCMFWMIGGVYAAAMAWAIIPHYGWSFQMGSAYQFHSWRVFVLVCAFPSVFAIGALTTQPESPRFFLENGKHDEAWMVLKQVHDTNMRAKGHPERVFSVTHIKTIHQEDELIEIQSDTGTWYQRWGVRALSLGGQVWGNFLSCFGPEYRRITLMMMGVWFTMSFSYYGLTVWFPDMIRHLQAVDYASRTKVFPGERVEHVTFNFTLENQIHRGGQYFNDKFIGLRLKSVSFEDSLFEECYFEDVTSSNTFFRNCTFINTVFYNTDLFEYKFVNSRLINSTFLHNKEGCPLDVTGTGEGAYMVYFVSFLGTLAVLPGNIVSALLMDKIGRLRMLAGSSVMSCVSCFFLSFGNSESAMIALLCLFGGVSIASWNALDVLTVELYPSDKRTTAFGFLNALCKLAAVLGISIFTSFVGITKAAPILFASAALALGSSLALKLPETRGQVLQ

SEQ ID NO: 927020 - protein, 456 aa, Homo sapiens
MLYPYRLLDIMVKSLSITPFSYYTGIMENIMNSGHNFTAADCLRLLGIGRNQYIDLMIQCRSSKKFFRRKTAGDLLPIKPVEIAIEAWWVVQAGYITEDDIKICTWPEKCATDKTKMLLSWGGGESRRPVQEASSATDTDTNSQEDPADTASVRSLSLSAGHTKHIAFLFDSTLTAFLKMGNLSPVQSTGEREAQRYFDHALTLRNTILFLRHNKDLVVQTAQPDQPNYGFPLDLLRCESLLGLDPATGSRVLNKNYTLLVSMAPLTNEIRPVSSCTPQHIGPAIPEVSSVWFKQYIYVYHITGQGPPSLLLSKGTRPRKLPDIFQSYDRLLITSWCHDPGVVPTSNVLTMLNDALTHSAVLIQRHGLHGIGETVHVPFPFDETELQGEFTRVNMGVHKALQILRNRVDLQHLCGYVTMLNASSQLANRKLSDASDERGKPDLASGSDVKWEYRVI

SEQ ID NO: 927021 - protein, 143 aa, Homo sapiens
MAGATVTGSARIGWCCAVRWKPILQVLPRGVGMLDVWSNSFSPQREYGNWRFFAYLLCAGLGVEPVVSAYMLVETTFFILNGPRHLQCASAQNQARQKPVPGEIPRKDGTPQAPVGQLHKLTHYLKKDCKDSEQFSLGKMSSE

SEQ ID NO: 927022 - protein, 195 aa, Homo sapiens
MLGAADRSCSYLAILEWSVLLGTRLRTRGPVTSTNQAASQLLQENHPLAPVVSNEDDQNGPGGDAGSQFSHVPTEGYFAMAQQLLRHVFMAEYFLLYVAFLEYIADQEYVPILLTRAGFQLQRGFPFLGFLALRLPLSTLPPALAFLASGFFSLVLLLPWNIGESPKSVLHPCSLISSLREEDCTAEAAADSGWG

SEQ ID NO: 927023 - protein, 155 aa, Homo sapiens
MIKVSVGSMYAHWTESLSSPLTVRCPQFIAILSSPAWQLASSSPVRKRKRKIKMEMNCVLDFPIELSTQQFLEISLTKLLMMLSKSIINYFPIAFDASAASNSGILLLGGRVGHEVHHFVAITKFIVIPENELEKVVTEGNDSPRIKGGRVGVNG

SEQ ID NO: 927024 - protein, 149 aa, Homo sapiens
MSFQVYLPFLPGVVLSGLVSLFPKSTLQSHPGGEKGPKSTFQVRLPCFSLQAFPPPYGASLRWLTDQASSPLSLITPHCLLEICPLPSFACENCPGGFSDPSAAGLLEFAGYPLQTLFGWVSIVEAAEQQVLPPDPSSGSFVPEGHPPV

SEQ ID NO: 927025 - protein, 140 aa, Homo sapiens
MKDISFTRTVEEPGKPEGQAGLTPKREAVTVEDCNFQGAVQSRDAHTFKAGPLSMRGAVGMQLTADSRSIPDWPDHQGGTVGREGLTQPWNQTQIKKQNLDSTPEAAFVPISTLDPSPRGGNHYPDSAQPKKPFMNKSAP

SEQ ID NO: 927026 - protein, 136 aa, Homo sapiens
MQQIPFLRLALALHHSCPRIPLCGTLEENESVLKKSSYGSPFPTAQLALLLESLDDDRQALPISPEASIPTCPYSPLLWFSFTNGLSFVSCSHPLNLLTFFLSSVPSVLGFQCVDSAQAPAGDTQSQVSAAGPGWH

SEQ ID NO: 927027 - protein, 141 aa, Homo sapiens
MKCLLIEWLKYRQMQLLSMKGILLAPCTVSSENSCFSVQLQHVSHHKEHKALASISTLKLSSPICVPSAACSGIEEGRAGLQSLLFFLGSVNGKGSCEGIQIDTLGSGHQRTLPCRHIEEGDGGRRLCTSRRSPRKVLAGS

SEQ ID NO: 927028 - protein, 158 aa, Homo sapiens
MQYTCHSAAGLLEFVGGSLQTLFAWLSPARLQNSKDCCLFLPLEASSQRGTCQMPPGALLYEVPVNPCWDVSPSQDARGASRQECLSLLKLHSCPLPQVLCPTEMGVLSIGPTGAAAFLSEMLRPERRNLEKQSGYSSFAKLRCTLPSLNFLAALFTL

SEQ ID NO: 927029 - protein, 183 aa, Homo sapiens
MSRTSHRNKRSLSDSASTEWSAGVTVLCNCLNFPRANGNARHIVGPQSVFVAEWIGIWWGRHIGSVVVSTARKQVSQTLWLKTTPIPYLMASVGQKPGYSSAGFSAQGTKGLMLVAIWKYTSKTKDKETIWEAIAVNGIDCNSSFRDVKVSHLQPLICISGHMGHPSPKADWPRGTVKSTVYP

SEQ ID NO: 927030 - protein, 153 aa, Homo sapiens
MWQEDTILHSVRSAQLMVTGSTPRSSKHWDRKCKNVPVQALKQLSCIQEMKLSRRKETELHSSPASEEPRGSPAESQANGALLGGTDSEDGALALSVEGGAWWEVIGSWRPMSYDRLSTKPLVMMTVSEFANILNNMPQKRCRIPVAVSDNGY

SEQ ID NO: 927031 - protein, 154 aa, Homo sapiens
MWFGSNTLKPLGPDEEQSLAGCVLRSIWIVKSIRQLEGCDGGEEGRHVVLLMGLLCPSSEEKVVNNIFLWPESLPCEAQVLTKETEVPISKVPEFHLSIVCLHCSHQGSWAGDTQLSTFRMGPGLDARAGALVLGLEVGAVDSGSHRKRKLKQP

SEQ ID NO: 927032 - protein, 155 aa, Homo sapiens
MGVSYANEQRGKPEVAFGATCWFLPVSVFILLGLGNKSRWSPTSLGVESDVDKFEIPHCVGDTSKVHEISKIDDENGQHKANQNSLTNVYYVNNLDYSLKDQKYNVSKPAEGNGGGVMKILSTLVEDRKGEKQEEEAGKKNEEKGEEKEEENEEE

SEQ ID NO: 927033 - protein, 167 aa, Homo sapiens
MGECMLIGPWEDLEKAPFDWLKDIEEVLTLTVDWQLGFQALNCLWFEVKTIQIWTHGTQDAVEYQPRAQERLLGLMGMQLSGQTHCELTMVEGNVQMLQTEPPWIVPWKPEKVSMKPRHKYEEAGHTQGLISGIIYGKEFSQVQGKENITPECQPFAKFNHKKKFRS

SEQ ID NO: 927034 - protein, 135 aa, Homo sapiens
MLHKEILFFNRNFITALRNSQQSSLPFFYTGGLRKLEKKQGEIRAWTLSVLEGKGPRGSVIRGFSYLTLTRLTSLILSFHIWMLRQYIPPRQMWRINLRNNRIILGEKSPFLVPWSPPLNCWPPQRQLLSSAPTC

SEQ ID NO: 927035 - protein, 146 aa, Homo sapiens
MGDILQLVGGLARQILLPLRNSNQLTYFKAEVKSIAGAKSSKQEGMSLKDVFEELSVKGEQSKRETDVDEAGNHHSQQTNTGTENQTLHVLTHKWELNNENVWTQGREHHALGPVEKKIDGHNDSYPSGQKREKATFKMSIEELNI

SEQ ID NO: 927036 - protein, 154 aa, Homo sapiens
MILWLKWAKVQLGPSLQRVQVPSFGSFHIVFSPWVHRSQELRAMQNGKVGLKPPHRVPPGALPGGAVRRGPPSSRPQNNRSTNSLHCASRKAADTQHQPMKTDESGAVPCKATGAELPKAMDQHDPDVRHGVKVYHFGALRFDCPTGFQTSSGP

SEQ ID NO: 927037 - protein, 124 aa, Homo sapiens
MFPASQKVALDSSGLRSGSLSGYLIQKCSKLSSAACFGGVTSDSAVGWWWGQGPLGPRLEAAHCTSGRTLGVTASQQANLVWCAEGQLQDRVCQGGGYLSPLTTGPAASTLTLPFSHELIQTTT

SEQ ID NO: 927038 - protein, 158 aa, Homo sapiens
MLTPNPTLNGAPQVPAKDLWAHMEGAGSGSLDDEVRGRWVTREGHDPELPGLMEDGLWLGLQEGTGTALTSGNGPPMARCCLRPPWPDGGQTQRGSRTCSSMLRPRLRCFFSSSETACSSDLNRSVGSASSSSGSPSSFSASCRKCSSSSTKKARSFL

SEQ ID NO: 927039 - protein, 144 aa, Homo sapiens
MQVSSMHLTEDMLLTTHTTSLRNPDWAWKGSRDEPGLGGWLPLPSRVSQQRPDTTAAQAAPVHAVLCGHSQGLRLWGIQHFTGQGTSTSPYCAWGHCDLLVLLESMSVQGCVQLSLKGLIISSPHCMVTLVKGQKCLWGRLGER

SEQ ID NO: 927040 - protein, 126 aa, Homo sapiens
MGDKPVWEPIGSSFNQHYYQLFDNDRTQLGAIYIDASCLTWEVRQFQGKAAAVEKLSSLPFQKIQNSLTAQDHQPTPDSCIIGVVVGQLKADEDPIKGFHQMFLLKNINDGFCANDMFRFALHNFG

SEQ ID NO: 927041 - protein, 171 aa, Homo sapiens
MPKTIKMPQRHFGDVHHSPYHHRPGDIGGKNDFVGAGPGPHCPVQPQDIAPWSQLLQLQLWLKGPQITSQSTAPEGGTHKSWQLPHGIKPVGAQRARVEAWELLPGFQRIYGNAWMSTQKPAAGAQPSWRTSARAVQRGNVGLEPPHRIHTGHCLVGLTTTGISQEIQEDP

SEQ ID NO: 927042 - protein, 137 aa, Homo sapiens [sequence omitted]

SEQ ID NO: 927043 - protein, 142 aa, Homo sapiens
MRGFNKTTVVTQFILVGFSSLGELQLLLFVIFLLLYLTILVANVTIMAVIRFSWTLHTPMYGFLFILSFSESCYTFVIIPQLLVHLLSDTKTISFMACATQLFFFLGFACTNCLLIAVMGYDRYVAICHPLSIDFWFHSNVA

SEQ ID NO: 927044 - protein, 165 aa, Homo sapiens
MAKEKTTWGPLKLILHQSLIFNPHQQQVSSFKEMEEMQLTYILGRCPTINRACEQNIPLPSLPLQPLKDGYVTIITHDCQQKGVRAAKEEEGKHLDGTAQERNGLLLGQQVNQHLGYNDEGVANLRAREDGKEEVHGDMKGPVQDNGGNDDCIGAQSEQKGFEMI

SEQ ID NO: 927045 - protein, 313 aa, Homo sapiens
MEQVNKTVVREFVVLGFSSLARLQQLLFVIFLLLYLFTLGTNAIIISTIVLDRALHTPMYFFLAILSCSEICYTFVIVPKMLVDLLSQKKTISFLGCAIQMFSFLFFGSSHSFLLAAMGYDRYMAICNPLRYSVLMGHGVCMGLMAAACACGFTVSLVTTSLVFHLPFHSSNQLHHFFCDISPVLKLASQHSGFSQLVIFMLGVFALVIPLLLILVSYIRIISAILKIPSSVGRYKTFSTCASHLIVVTVHYSCASFIYLRPKTNYTSSQDTLISVSYTILTPLFNPMIYSLRNKEFKSALRRTIGQTFYPLS

SEQ ID NO: 927046 - protein, 328 aa, Homo sapiens
MDSSKLDSGKGLHINLVPNKQNQTLTIVDTRIGMTKTDLINNLGTVTKSGTKAFMEALQADADISMIGHFGVGFYSAYLVAKKVTVISKHNNDEQYTWESSAGGSFTFIGYPITLFVEKEHDKEVRDDEAEEKEDKEEENEKEEKESEDKPEIEDVGSDEEEEEKKDGDKKNKKIKEKYIDQEKLNKTKPIWTRNPDDITNEDIYGWTANMERIMKAQVLRDNSTMGYMAAKKHLEINPDHSIIETLRQKAEADKYKSVQDLVVLLYKTALLSSGFGLEDPQTHANRIYRMIKLGVGIDENDPTADDTAEEMSPLEGDNDTSCMEETD

SEQ ID NO: 927047 - protein, 264 aa, Homo sapiens
MVPQTVNDGVEEWNNDSVENRYHFVGIVGIHEFGTGIGEKCHGIEENYDGQVGGTGGECLLAALSRRDPEDGGKDSSWITNGYIAVKGHDSKKDVLSADKGHKKVKLSHAAIEGNTLVMTEEVNKHLGADDCDIPHLQEGEVAQEEVHGLMQLPITAVDGWVEEWYNDSVEHRDNLVVVEGVHGPGPCIGEESGGVVDNNHCQMSGTSGKGFVASPGRRDPQDGCNDGSDNWEIKRSFIMELKKPLPQEAAARRVARLEGMRLG

SEQ ID NO: 927048 - protein, 257 aa, Homo sapiens
MHAGTCEDVPKGVHWEDLMDLVGPTERQCGNHHNLGKQDKETEEAGTCRELSTEPGGHDHLIAKRVADGNVSVNGHGAIDDRVEKGSKNCKHQCNSCVQNRWESGRETQVHEGYTAIEHQKDTKMGGTGRKGLLAAFNRGNPQDYSDDSDIRKGNNQDREYNGHSMDHILNQNHGRVCTGQAQHRFKITEDLVDLVGSTEGQCGNPCNLWEQHKKAKDAGPHRELNTEPGGHDGWVAERVTDGNVPINGHGGQQNPL

SEQ ID NO: 927049 - protein, 257 aa, Homo sapiens
MAYDRYLAICRPLHYPIIMTTTLCAKMAAACWTCGFLCPISEVILASQLPFCAYNEIQHIFCDFPPLLSLACKDTSANILVDFAINAFIILITFFFIMISYARIIGAVLKIKTASGRKKAFSTCASHLAVVLIFFGSIIFMYVRLKKSYSLTLDRTLAIVYSVLTPMVNPIIYRVGLDDIYVPSVSLSSPFQGQRRAKQRIMVKARFLVIGKDSCKLKHFKNGENCLMGQEASSAVNPGRGLMPICGDMDSFMSEKI

SEQ ID NO: 927050 - protein, 174 aa, Homo sapiens
MVSKYKNNVLLKGLEAINDYHFSIINSLLINDLKLNSTRRDEYDKIQIADLMEEKFPGDAAKGKTSSKKRKQRKVGPTTPLATTDKKFTAEEGEETPIAQKRKNPTKEKAGTKRSKISEEQTQPPCPAGAGMSTAMGIPHLPRPHHQLHPTLPQLRQSSRWEENPNNVPALTST

SEQ ID NO: 927051 - protein, 135 aa, Homo sapiens
MRIPRRATSREVLQQSSDSSPRGKGRVRTSLRGAMPGFKAWDEGECVYFEKAGFGNTWVVKGSFSGVTEVDISEFPSEVSHEPFTLEKQPLIFTKSMKSRYYSHIRNGKTKAQRILRGNAFNFSPFSIVLAVGLS

SEQ ID NO: 927052 - protein, 135 aa, Homo sapiens
MCNNMILKCLPILKVTSVEVCHQFPVPGLPCGPLCLCAHTCQADDCCCYSLWLSQEWMQIHLVFSPCSQKAIAFFHVDCEGLGTTVCAALRKLTRFWAQLQGDTSDSLERQKSAGDGKDLPKQDTTPRVDKGKDR

SEQ ID NO: 927053 - protein, 139 aa, Homo sapiens
MLIGMDILSKLHAFSLFDDRAKAHSYNLVRTLPFGCRSVPTNSGCWHRNRWCPSGLVKAHDLLLTCDEAGTQSSSQTAGSVAAFTADSITTPPQEEQVIKGSKNSSVACSTYYVAGCVLGAEDTKKNHKNAKKKSKSQT

SEQ ID NO: 927054 - protein, 170 aa, Homo sapiens
MESVMERHLPGILLLTTLSRGVTRKEQAAIFAVLQRLLVIPRQRGLEWTSSKLQQTDLQKRGLMVRRKTNKQSHSINININIKDPHTKTPSKNHHPQRSKVDKSMKMRKNQGKNTENSKNQNASTPPNDRKSSPGRAQNWMENEIDELTEVGFGRRVITNSSELKEHVLT

SEQ ID NO: 927055 - protein, 156 aa, Homo sapiens
MHQYSRAALAQELPVPAHYLKNEVQYFIQFTFKFWILLCLVEKKVGETRRGHKKKIQGNRTFMLSSPDTGSKTEIPISEFIGKCPWHQNLSPDTTYLDNKFLKLNCERPQYLINNLGFCQLFRCYREEQASFALIYVLPSDFSSREYTGTFRLEGS

SEQ ID NO: 927056 - protein, 144 aa, Homo sapiens
MSTGHGEGPGAGLWPGSLAAGSSRSCPVQSVGRAPGALYLQEHIPVMPAAYEKPVKPVEKDSLWPHDSLQDSEGTGRGSCLESQGDAKQAEGLKEGAEENDHAMEKHEEDLGKAGDLLLASCFHMKMPGCKTEKKEAHAEMASE

SEQ ID NO: 927057 - protein, 140 aa, Homo sapiens
MLCARQPPAGGAVESQKAGSLERNAALLPPSDLDGIIPAGEMGLMLPGIHQKYANCTISFSCLRLHSIEDSVVQVPNDPLLTWPWVPGQTLSSCPSTDFRASPCRATGPAGILSHNPSRAPQTWEGRAAPIFFPVMLPQD

SEQ ID NO: 927058 - protein, 237 aa, Homo sapiens
MVGWCVELLQAFFLVVDDITDSSLTHWGQICWYQKLGVGLDAVNDAMLLEACIYCLLKLCCWEQPYYLNLIELFLQSSYQTEIGQTLDPITAPPGQCGSSQIQGKELQIVKYKTVFYSFYLPIAAAMHMAGIDGEKAHTNAKKILLEMGEFFKIQDDHFDLFGDSTVTDKGQKEAKKVVQEKALYEELDLLAVFLQYEDDSYSHSHIMGLIEQYAMPLLPAIFLGLACKIYKRKNMY

SEQ ID NO: 927059 - protein, 147 aa, Homo sapiens
MPSSLCYIPKSGTLQVSPQGPSSFRPPTLSSLRVSHDREETAFLGDLKGCSELKNFQELINQSALVHPRVDVWWYCGGPLLGTLPNNWRGTCTLVQLTIPFTLAFHQPEGKKIRHHKVREASYGSFDSHIYLDTIGVSRGTADQFKA

SEQ ID NO: 927060 - protein, 149 aa, Homo sapiens
MKMANESAATHPSSLAHQANGLILPGLESCAPYENLMPDDLRWNSFILNHPPAGPRCLWKHCLPQNQSLGAKKDGDCWDSPFVSLEACSLGNFVGTGWDLVSFVHCYVHSTNKGTWHIGSLTQKAFVDERMNESFVYYWVYAHHFINSS

SEQ ID NO: 927061 - protein, 151 aa, Homo sapiens
MKLMFLKSFSSNSHDSIHVFWEASGSFYLQGKMKRRELLLTGQDEVGAGTSRGKNKRLLKMTLEERRKEYLRDYIPLNSILSWKEEMKGKGQNDGPTAAGQLEFLGGPLHTRFAWVSPAEAAEQQRLLPVPSSGSFVPEGHLPDASRSSPV

SEQ ID NO: 927062 - protein, 135 aa, Homo sapiens
MASSDPCLLVTTSLYNALPCCPCILHKQQNTVEVTKNHLRSTSILKMEKEATFSSTYELQEKRINSVENIHKDLGRSKPIISNQEFCFWCHQKFGALKYRRVNLYALTFPHDLTEIKVNKHRGKKKPKQTNKQNM

SEQ ID NO: 927063 - protein, 159 aa, Homo sapiens
MSSPSKLYFLRNCMADCMKIGWSFRDTQGQKAGSLSLGESKEHRQWKHLPFTECLLNAREMKQLDRDHPTRKVAEPGLTPKSFIPWSCSTNEARHESDCGQHSKAKHSAVGIFWGTLSWDTYPAAAGGPDLKTKRSWSEGARVILSLAGKGQAYGSHGQ

SEQ ID NO: 927064 - protein, 310 aa, Homo sapiens
MVVGESLRPWSSFLATLQPRNGSSCAGGPPPGECRGSVKTLAVTSAAPDSLVLVCLLTAAAPTCVLCTRMLLPVQLLAQARQRQYLEFSLPRRTHLWDQGLTPPVAVPGSYWCPLALSAKQPMLVETVALLRTTSCWQLHVRPHRSPWRWNFLSGRRGAFPLGQPALAIKMVIALTGSSAGQPSRASMVLLQSSGFPEILDANKQPAEAVSATEPVTFNPQKEESDCLQSNEMVLQFLAFSRVAQDCRGTSWPKTVYFTFQFYRFPPATTPRLQLVQLDEAGQPSSGALTHILVPVSRDGTFDAEVTFCF

SEQ ID NO: 927065 - protein, 234 aa, Homo sapiens
MLGKPSPCLAPCPYLCSRRDTCGCADVTVQVFNLMWAHDTARSGAGGPRPRFPFSKYFPGHVLGPVHRCPLLTPHHWESSTALTQKRNTVVLEVARQTCSGLNDQVPQKHGLVWVVPKPDPCLFSHTRFTLPPAEVESKGLTGYFSKMRWLVWNWVQPGTFYFGWLAVEKCWISYNSNKNIAEFKGCPKGLQTIFGELLLYRQPCICVQRHEQECSVLTTFTLIEIRKQFKVHQ

SEQ ID NO: 927066 - protein, 139 aa, Homo sapiens
MSQACKIALWATLSRYFPRPPSSYVPMVCYVGIRVPWWFAAPIDPSSKFPPLTLPSPPTGPVEGVCFAGGKPAHLGCLDSSELPAGKAKSAGLQRLWPPLPLGAQALGDQGFVPEPLAGVGGVPAGRPCPVRKDGSGSG

SEQ ID NO: 927067 - protein, 267 aa, Homo sapiens
MSISLTSDAPRLLLWLRTQIPKALGSHNNTCPNVLGTDVNSGAAGQRGECDTSPSSGGHSPVMCLGSSAKKHEAIILVSLYRSQAPNPESQMGHREPEEIMKGQKNKAQASWRLCGQDREIRAEYLPPEIKGDDQFKGFLQRSVVNGDGDSDDYGDDSDGYGSDDSDDGDGDGGVVNGDGDSDGDDDGDGDDGGVVNGDGDGDDGSGDDDGDGDDGVVNGDGDGDDGSGDDDGDGDDGGVVNDDGDDDGDDGSGDDDGDGDDSGGKW

SEQ ID NO: 927068 - protein, 140 aa, Homo sapiens
MNFCFFWWEGECGGAVAIPTNVPLAHFLPNVEQPSFDIHIWEGYSLSRRDATAASSMVYCLTGPEDISQRRDFSPEPFSFLLCGPVTLQANGESPLPPAWAFPSPLSCVGAVPSWRSCALSLLVWWSILSSSFLRHDTWK

SEQ ID NO: 927069 - protein, 168 aa, Homo sapiens
MFLPLDSEARNTMVALIAVALALLALTTGPCESISCYGSTEETSSSTALRASKVFLEERQNSATRRNKQTILCFVAGKEGLTFTTQWQRKCDLSSLLKASRFLFLADWKEEPKEAQNWLWAGNLRPFTYLAENLLEALEGPRDIQLSVGVCHSKDLLNRNLAFNKIYR

SEQ ID NO: 927070 - protein, 161 aa, Homo sapiens
MQLQQRSQLISQGALELGWPLRLGSQGLYVLSLISYWMWAALGCSLLCSTIQLFPCREELAMLICEEVEADPQDVSLGMFVELCNLVDAVNVSVLQPPRLQEVWQIHILNYMVPNRISDSDSLVNMATSELGSGDKSLFLSWPWNFDLENGDGELWMTKDF

SEQ ID NO: 927071 - protein, 140 aa, Homo sapiens
MVQQHLQNPEMVHRILKWTITWKHCCRGTSALRGDWSQLLPTPPFQNSKSQVLFLLEKPGAKFHGPCPQPEDRSLGQKGKPSPKPERPQDLIGEFVFHGLVSNWSVLFQIFMQNFLGIKNNNDDGGDDDDDDKNSPCLGL

SEQ ID NO: 927072 - protein, 145 aa, Homo sapiens
MEGRAWGPQMLCVVPAVAGPEGQVLWSPDSMCDVGGGSSSGRPTLRTPSSAHRHQQWWWQSGCAGPQSPGWYMWAGAGSSNVSVDRQVPLLLGGAYGHKQHVGWSCPYTARQHSHILVAAHRVGLYPNHCTVDAGPRTDFFMSTQ

SEQ ID NO: 927073 - protein, 141 aa, Homo sapiens
MTPRCLRQSRESVPPPKAPVGRSSVSLSYLRKTPTDNAGPLWTAVDRNNKLPADNRYLSGNSQGDPNQLPIFLNHVRMNDAAKINKNVPLIYVDSCMKLKGPGHRVCLENKKFSKLNNKITHNSIKNEAQDLNNHFTKEKI

SEQ ID NO: 927074 - protein, 175 aa, Homo sapiens
MDSIWARQPSPEDMQPLTYAVVIRFPPSIHGRYEVYIHAPLSAKGLHLGASEVPQRKNRPQKGRRPAFRLPVVPGAFLPPLHQETPQQKRAERDQCYPEKEPQSSTDMIPGFDKCHLLKEALSVDQERTLTPLTHYTSPWKHSSHGRSFSLSPLNLIASGAASVHSILIASSSSH

SEQ ID NO: 927075 - protein, 170 aa, Homo sapiens [sequence omitted]

SEQ ID NO: 927076 - protein, 205 aa, Homo sapiens
MSLTKVEMFGCSRLASAQRGALARTHLWDSQLEKCMNRCTPRPGSSPEGLHPSWCLLCYLATNLFRLPMWLQLLSDVIQIHGLPSLDGSCGNASYQPSPGTQAAWECGLPLPPTTWSARRDCWLFLRIPAPCFQSPDPWERLCRRGSCCISKAPPAGSLTSTPPPPPHALDGEMTFDDDVCVCGAGSVLEPDKQCISNSTAFESL

SEQ ID NO: 927077 - protein, 180 aa, Homo sapiens
MSRHRDSLLFKNGTWSNSNKRGAGKEDPVGKVHVEIGEKVLLNSAQEKINSMLKSVTQEFDIGSPVCAEEMGQMSAPNDKAQGLCVKYLDSQSIWLVSLVEEKKLNWLVNIVCSSDDIASFLYNFLFNYSVILQTFVGYLLCLGTMSRRWGYNSDKTDVALSPVELTVLCGRVLVSQLKH

SEQ ID NO: 927078 - protein, 124 aa, Homo sapiens
MVHCRTSQPVPQMGSMWPRNNDALIPWSSLGWPSMVAPPPCTPVCHDSVIFCVMTCKRLEHTTVPLVHRSRWALFSFQAKRGVEVGELSPSIPCQPTVSLGLHVHVPPSSRALWDVGEYALIPG

SEQ ID NO: 927079 - protein, 137 aa, Homo sapiens
MNGGEGGVLAAAWEAAQRELLEAAGVNKCRVAGEMDELINGWLLTNSHCMGMLHSLVAGSASSMEGLGICQVTRGSNLHFLNFSVELGRVKGAAGLAVHQAIGNHRMSINPDDRLQNCKGIALCQITNIYASLLDIA

SEQ ID NO: 927080 - protein, 264 aa, Homo sapiens
MLFAILPFVFSIAAEEKTSKAASFPQLPLDCRGGPRDGPSNLQGSPGPCLASLHLPLSPGLPDSMELAKNKSKKRRNRTTFSTFQLEELEKVFQKTHYPDVYAREQLALRTDLTEARVQVWFQNRRAKWRKRERYGKIQEGRNPFTAAYDISVLPRTDSHPQLQNSLWASPGSGSPGGPCLVSPEGIPSPCMSPYSHPHGSVAGFMGVPAPSAAHPGIYSIHGFPPTLGGHSFEPSSDGDYKSPSLVSLRVKPKEPPGLLNWTT

SEQ ID NO: 927081 - protein, 180 aa, Homo sapiens
MSTGPKVERSNKQERDSPWALHRIRRWQTESSPELRITVPDTLPGPPLTPIHLKNCPYVTYLGTRTILSVLTARNFLSASTLCFVTLSQFHHGKLLGTLDGTDQEIADFTLSSLRLMTHLNYYVPGPGTTAGHLALPTGDRQIMTIASGHFSKRTGIPGTMGAECGVQGSTLCSTSGLTF

SEQ ID NO: 927082 - protein, 176 aa, Homo sapiens
MAALSSTTTTTPTATTASTSSITITTITSSNTIITTTFSITIITTTFSITITTTFSITITTTTSSVIIIITILPNTSSPPTSYHHHQHYHFQHIAMITIPTINTAITITNIIIMITTIITIIIIPITSKGPPKEGNTLSDLSSQPPEGGTPLASPIPWQQRLPLVREEFWELKARP

SEQ ID NO: 927083 - protein, 146 aa, Homo sapiens
MANSTGKEEERKKANLKQGMNKILFAQSSSMSICLSFPPRTLPLQFGAFCEEGGILELPLEPKEAHRVLSTTTGGSDLIEEEKVMCEMRNEHDQLVKDGTEVKEFPSRRNGLLQRNLVHKGAQEVPEAEKRPAWLEQNAERKLTER

SEQ ID NO: 927084 - protein, 156 aa, Homo sapiens
MRICGLDYSKPCRKPNRNNPSFTGDAETPASGVHMLLVTHWIRLSGSGIQDYESLFCINISDILQNQCFWNVTVLIMAVSIYILTNGIQGFTFFHILTNTYYLLTFNNSHPNRNNKECAGEIASKEVKAPLCRPWMIVKEAIRGLSLLTAMKIIGP

SEQ ID NO: 927085 - protein, 154 aa, Homo sapiens
MRFCTPYPESNRGFETEETGIKVARVTFQIRPLQPCGIPGSLWRENLHGTSLAAVRGYLEGFRNTVWESFMEEVGHEQPFKEERDLGGEEGQISGRETELTKPKKQHYLGGVHRRSRSVGGCDQTRIEPFSSAPFSSSPPAPLPVIHGLSGVTG

SEQ ID NO: 927086 - protein, 149 aa, Homo sapiens
MTAKNAFSPPPLQVPGHNSEVSPSSLSSHPLLKVGLQLQTTNNPAPPPRRLAPSSPSVLSHLGEGKLASSLLRTACEVSRIPNTRAKHLDAWKEASGKPKSMNKQAIYLEVKKQEEEEERMEEKEKRMCLEKEEKEKEAEKCGQSSRYF

SEQ ID NO: 927087 - protein, 120 aa, Homo sapiens
MLPRKIIWIPIRPLHNWALFKILFQLCPGACSPRGSPYTFPSKPPCRSVGQQINLSSAIDPALPPGPQTQELGVVEFAPVSYDQGRAMDVGEKPSTYVNDMSVCGEVVDSPSGATRLLDV

SEQ ID NO: 927088 - protein, 143 aa, Homo sapiens
MQVCGSCVPLGTGSLRAGEMVPPRPCSGKPGLAIQQHCGAAAWEGIDIFARGVDGGGGERCPVKPTYEIILDYPVGSKSNNNHLHKRQKGRHRWEAVEHVKMDAEITVMLPQAKERLMPPEAGRSKEGSSPRAFAGSPDLLTP

SEQ ID NO: 927089 - protein, 146 aa, Homo sapiens
MVCTEGSDHGDIGATPGPGICDFSLLDLEERGLAAGTAGEQQAPLQQQQEPQGHPAGGPGMACVLWPPQMPGSAIPEQGGLQVHTVQRGSLSQREDLQTSAVALRRPLAPGPEALSGCSLEMAEANPLAARGRSTAGWNRKGPESV

SEQ ID NO: 927090 - protein, 329 aa, Homo sapiens
MTITVPISAAGHVVIAGITDYLLLPILYSLCLQQSPRQFNGIVVSPGGSVPPSGTKSSRPAELNVVGTGSKNFTIGSLGVMFLTTQRGPSTYLSSKFLCHRFSNYASSKSLTIQPNHWLQPVNPHIIAHLAISPSLQCAQPGALIEVLPTGIFPFTTVLQGCPRKRPYCYSCPLSGMEKKAFAKSMAVYQVPGNVYTWYSSCNWSHHLVKLTIIYCHSPRSICLLHKLNGRSLNLNRDGANVGVLPAAKYVYANYAFWHWGNDHRMNLGTHWTHSALPPCSSAPCEVEEAAAQLWLKVRKLPLGVQLRFSLENFQALRSLKRHKQGKGP

SEQ ID NO: 927091 - protein, 134 aa, Homo sapiens
MSEAYKKVCLPGVPDSRSWLEVAGSDSHLQEERKEKARIYSGKEKQLLRPQKQAAKNMEKTDRYAEVLKTHGLLMQNVRLQRQGASMPPSWISPHHRYIFTRPLRSSSPLSSTFRSDLCCLFIVLVLLCAGDER

SEQ ID NO: 927092 - protein, 292 aa, Homo sapiens
MAPKRQSPLPLQKKKPRPPPALGLEETSASAGLPKKGEKEQQEAIEHIDEVQNEIDRLNEQDSEEILKVEQKYNKLRQPFFQKRSELIAKIPNFGVTTFVNHPQVSSLLGEEDEEALHYLTKVEVTEFEDIKSGYRIDFYFDENPYFENKVFSKEFHLNESGDPSSKSTKIKWKSGKDVTKRSSQTQNKASRKRQHEEPESFFTWFTDHSDAGADELEEVIKDDIWPNPLQYYLVPDMDDEEGGEDDDDDDDDGDEGEEELEDIDEGDEDEGEEDEDDDEGEEGEEDEGEDD

SEQ ID NO: 927093 - protein, 147 aa, Homo sapiens [sequence omitted]

SEQ ID NO: 927094 - protein, 242 aa, Homo sapiens
MAGSLAAVGLGPHLLLFHPEPFGDKPTWFEPQLLLLLLLSSVTFGKLLNLSESQFTYLQNGGCPLVAAAPSHVALRPGTGIPDKGWSAQRQHWTLYLPPPPDCTEVCSVSQATLRVGGGPGRQPGVLAWRKCEGRLGPACPLARELALETSGWRKWAFGGTAGCQLPAPHPTGPCLASPGALLGCPLQAQVQAKAGCAGGAQHLSGDEQPRGALLARTLPRPHEGEEVAEIQTQSADSQTCV

SEQ ID NO: 927095 - protein, 344 aa, Homo sapiens
MEACLKEELPSPVELEESLRNGVLLAKLGHCFAPSVVPLKKIYDVEQLRYQATGLHFRHTDNINFWLSAIAHIGLPSTFFPETTDIYDKKNMPRVVYCIHALSLFLFRLGLAPQIHDLYGKVKFTAEELSNMASELAKYGLQLPAFSKIGGILANELSVDEAAVHAAVLAINEAVERGVVEDTLAALQNPSALLENLREPLAAVYQEMLAQAKMEKAANARNHDDRESQDIYDHYLTQAEIQGNINHVNVHGALEVVDDALERQSPEALLKALQDPALALRGVRRDFADWYLEQLNSDREQKAQELGLVELLEKEEVQAGVAAANTKGDQEQAMLRQNAVACGH

SEQ ID NO: 927096 - protein, 489 aa, Homo sapiens
MSSPNPEDVPRRPEPEPSSSNKKKKKRKWLRQEASIQALTRAGHGALQAGQNHEALNNFQRAFLLASKAPQTRDTPVLQACAFNLGAAYVETGDPARGLELLLRAHPEEKAQGRRHGDQCFNVALAYHALGELPQALAWYHRALGHYQPQGDQGEAWAKMGACYQALGQPELAAHCLQEASQAYAQERQLRAAALALGAAAGCMLKSGRHRVGEVVQVLEKSRRLAERSTERRLLGHLYNDLGLGYSQLQLFPLAVEAFLQALPLCWVPGEQATVLRNLGMAHNALGNYQEAREFHQKAADLHGSVGQRWEQGRSFGSLAFALSQLGDHKAARDNYLHALQAARDSGDMKGQWQACEGLGAAAARLGQYDQALKYYKEALAQCQKEPDSVRERLVAKLADTVRTRLAQVGLVQTHTLTSAPGRLQAPGGASQAEGTPAKAGSSTAGVQHRSSSGWEDEEFEEGHQKKKEERSANVPVRAGPGRPERELM

SEQ ID NO: 927097 - protein, 397 aa, Homo sapiens
MNKQIQGRTGACSQRDTATLIKTESSDVIHLIMQYLKENGLHRALATLQEETTVSLNAVDSIESFVADINSGHWDTVLQAIQSLKLPDKTLIDLYEQIVLELIELPVKDVEEEKFPTQLSRHIKFGQKSQVECARFSPDGHYLVTGSVDGLTEVWNFTTGKIRKDLKYQAQDNFMMMDDAVLCMCFSRDTEMLATGAQDGKIKVWKIQSRQYLRRYERAHSKGVTCLSFSKDSSQILSASFDQTIRIHGLKSGKTLKEFCSHSSFVNKATFTQDGHYIISASSDGTVKIWNMKTTECSDTFKSLGSTAGTDITVNSVILLPKNPEHFVVCNRSNTVVIMNMQGQIVRNFSSGKREATGKLERTLTVHEKDVIGIAHHPHQNLIATYSEDGLLKLWKP

SEQ ID NO: 927098 - protein, 462 aa, Homo sapiens
MELRQVYLTRAHSINSPPFSAENHKIPGSCPWFTNSTNIYKAPLSTMSCATMGSGEPAEENKTARVADLGADTLSGIQMFNKEDTIYNGDHFPKAQTQPISPEWTMHCSCLAEGIPANPGNWISGLAFPDWAYKAESSPGSRQIQLWHFILELLQKEEFRHVIAWQQGEYGEFVIKDPDEVARLWGRRKCKPQMNYDKLSRALRYYYNKRILHKTKGKRFTYKFNFSKLIVVNYPLWEVRAPPSPHLLLGAPALCRPALVPVGVQSELLHSMLFAHQAMVEQLTGQQTPRGPPETSGDKKGSSSSVYPNFMEEGSMAFTPPLSCWGPKLCTPGSAAEAMGVGCSRACWDSLGLDLALPQAPAGWAFAAIWGASKASCLVLPPSLLPSRPLCPPTGPVSRGPSCLLSRQSSSSQGLLSQTSCSQDLGASQGPGIFQGFLSWQGWDRVRDPGKWGGETLAFSAL

SEQ ID NO: 927099 - protein, 152 aa, Homo sapiens
MSLSDYGRYQTPVRPLLGIDFTEKEAFVAHSPVTFLAVVPPAETVQCSGNSVLSSKARRPKRLRIQPALKSNKPQDQNLYLIFDCPGFQPLQPPPGNSDCDNKIKLLHVRCLKWILHIAGIIVFSRRSGEEEAKDKVQVPGWGHCLRMGTQK

SEQ ID NO: 927100 - protein, 223 aa, Homo sapiens
MGKKQSRKTGNSKNQSASPPPKECSSSPAMEQSWMENDFDKLTEEGFRRSNNSKLKKEVRTNGKEVKNFEKKLDEWITRITNAEKSLKDLMELKTTARELHDECTSLSNQCNQLEERLSVMEDEMNEMKHEEKFREKRIKRNEQSLQEIWDYVKRQNLCLIGVPESDRENGNKLENTAGYYPGEFPQSSKAGQHSNSGNTENTTKILLEKSNSKTHDCQIYQS

SEQ ID NO: 927101 - protein, 149 aa, Homo sapiens
MGKERGAEKRMELRSREEPSLAHPVVVIKQACAPFPGPNQVTVHHTRLLKIYPRGQGSKSHRGPKCDLRESKGLPRELDQTGMPGPAYNPGTLAVSLPLSQCNASLTCVISNHEEQKTATSDLGGNVFNSKNCPARAGSSSGGTPFPED

SEQ ID NO: 927102 - protein, 144 aa, Homo sapiens
MAPRFCGCNKWSNRDDIYWDGKTVWEACLGSLKAKLEIPVIRPSGADSCDYTELTQITQDNSHLKTLKLDDVCKVPFAIRLYWHMVQELVQSHNLRKKMRVDNEDRSSGCKPEDIPEYRGNENQKHNELPVHTHSEGNNQRNGQ

SEQ ID NO: 927103 - protein, 151 aa, Homo sapiens
MDVHTESPSKGHQHQSPKIDKSMKMRKNQSKKAENSKNQNASSPPKDHNSLPTREHNWMENEFDKLTEVGFRRWVIINSSKLKEHVLSQCKEAKNMEKSSTGQHSNSGNTENNTKILPEKNNSKTHNRQITKVEMKEKMLRAAREKEESGG

SEQ ID NO: 927104 - protein, 135 aa, Homo sapiens
MYQHEHRQTYLPVGSWVARNTLCPQLGPLADCSGGRTKAKESYIQIYWGKVLFPGLYPGTCTVSLLPGCENTLSKQLSSVLGSPKVLLPLTWSPIRSQLYFGLWKALKFLLLWEDMSGTSPTLYSALKFYFTERH

SEQ ID NO: 927105 - protein, 182 aa, Homo sapiens
MPAAPPWRSHFFWLLGPGLCPALPLRPRSSAGWLGSPKPEHPSYLLQPKAIFCLPLEVHFLLNTEKILLGSLPYTEKQTELGVEPKNLEPRQMQGPAETTQIVAYTRTILQSLPIMARVVGGDDAAHAFPPVGTFPSWPVVVGGDDAAHAFPPVGTFPSWPMAVGSDGAAQSFLSPTPPPFP

SEQ ID NO: 927106 - protein, 214 aa, Homo sapiens
MRCPSGDVCPLGNWTSGFGAQDLWNGHPEAEDPENSQEMQQKRRSWMWDSLGKICSTLCNCSLKALVSVSTKYINIIIISIQGAHLKIRCSCFELIKISVTKVGVQPPTQPLLHLTGKKKKKKKKKKKKKKKKKKKEEEEEEEEEEEEEEEEEEEEGGGTAPLAGSNHSHELTVHHGGTRLVTSPTLALILTITLRGAGVPKPRATDWYQSLAC

SEQ ID NO: 927107 - protein, 118 aa, Homo sapiens
MPGTGNAVVNPFLHGASVEVGGSKEKIKTKYVHFCSYVGRVDEPGLAQYRMTAGLEHYAKQFPPASQNAQLSSVEAEYAGGLATMQVVKPEGSLSTKFKKAVLQDFPRSSSYRLALSP

SEQ ID NO: 927108 - protein, 587 aa, Homo sapiens
MAAAVAVAAASRRQSCYLCDLPRMPWAMIWDFTEPVCRGCVNYEGADRVEFVIETARQLKRAHGCFPEGRSPPGAAASAAAKPPPLSAKDILLQQQQQLGHGGPEAAPRAPQALERYPLAAAAERPPRLGSDFGSSRPAASLAQPPTPQPPPVNGILVPNGFSKLEEPPELNRQSPNPRRGHAVPPTLVPLMNGSATPLPTALGLGGRAAASLAAVSGTAAASLGSAQPTDLGAHKRPASVSSSAAVEHEQREAAAKEKQPPPPAHRGPADSLSTAAGAAELSAEGAGKSRGSGEQDWVNRPKTVRDTLLALHQHGHSGPFESKFKKEPALTAGRLLGFEANGANGSKAVARTARKRKPSPEPEGEVGPPKINGEAQPWLSTSTEGLKIPMTPTSSFVSPPPPTASPHSNRTTPPEAAQNGQSPMAALILVADNAGGSHASKDANQVHSTTRRNSNSPPSPSSMNQRRLGPREVGGQGAGNTGGLEPVHPASLPDSSLATSAPLCCTLCHERLEDTHFVQCPSVPSHKFCFPCSRQSIKQQGASGEVYCPSGEKCPLVGSNVPWAFMQGEIATILAGDVKVKKERDS

SEQ ID NO: 927109 - protein, 157 aa, Homo sapiens
MRGACGNPDSKSAGPGWGLRVCVFNKLLGHAGAAGLSTTLSVGSLGGGIMISLSAGLGLWALGQRQGGNLSCLAEMSESAESGGGGHAQRYWTHFCVLLNPWKSESEAAVCKPRCLLESALGSTSARGEGCRIGEKERLNHETGATEASPNPWGALD

SEQ ID NO: 927110 - protein, 143 aa, Homo sapiens
MRICFMLFGMENPHPLSPKKNICEAISLSFKGHGGKRYQRHLTLLDQIREGNEEFHYLVSRALWRLEPPDALVEAVRRSSALLLPGCRPPLPVQEAHRYARAVGLLKASQSPETCSSGAAFPTWLAVPDLHMKPALGGNGTSR

SEQ ID NO: 927111 - protein, 144 aa, Homo sapiens
MHSGTCQYHVDGIVPDSHSNPSIPPGIGGDVFSLTIVFTRIVGYKMEAQCFLLRVPVEQTCKRLLGLETLQTREGLLMCPQEGKGRRSTVVQGGVSHASLKKSFLKCKKAGERHISQGLGPVRGQTRGWRTCIAGSARHLVASG

SEQ ID NO: 927112 - protein, 140 aa, Homo sapiens
MNACKICAFKKHLFSGRMRLTLGVRQQSSTFLAPGTRFRGRQFFHGAGKVGVAADLIGGGAQVVRQSKAAADLIGGGAQVIMPTRLQLTFSCAAWFLTGHGGVAVHGPGVRDPWWNSWEEEHRWGVMMLGEGMKGMKLDL

SEQ ID NO: 927113 - protein, 189 aa, Homo sapiens
MWYAHVLTTVPSDGKDKDRIEEESTGCGEGSSMSLFLKSPQAAGEGSVFAWRYCPAYNLPSCKTVVHPLHSNSQISVHIEAKESGDANNLMRKNTSKEEYAYLSGFCVQVISSTKTSPDYVLSLEPMLVRSMTGASAACEWWQRFLTQSPGIHMDDLERASGLGHVNKGTCLFYLVFFKSIQAWNMFSL

SEQ ID NO: 927114 - protein, 130 aa, Homo sapiens
MHYKLCDSLLLLFITCIPEIHQKPGRDNQVLQDQELNRGGQSGAPSLGVKPKSTDLVSNGEQNSVHQRREDAAQRRRTFSSWCLQIGNLGFSFFPFDLLPTLPFYFFKNFFGSLAGKDLRGQCPSLLVPP

SEQ ID NO: 927115 - protein, 139 aa, Homo sapiens
MENCCRCPKQKAGGKISTRTSKRWYHSQIPRRLHSTKHLRTLPLFHSVLPRGVRKNPESTVSSGESGSQGGEVRRLGRGGGQNRGGTVWRCGARGKPCFPAFWLQIKASAGAGIKSKPKDTWVRPTGALCTGILGCPIV

SEQ ID NO: 927116 - protein, 450 aa, Homo sapiens
MSIQAPPRLLELAGQSLLRDQALSISAMEELPRVLYLPLFMEAFSRRHFQTLTVMVQAWPFTCLPLGSLMKTLHLETLKALLEGLHMLLTQKDRPRRWKLQVLDLRDVDENFWARWPGAWALSCFPETTSKRQTAEDCPRMGEHQPLKVFIDICLKEIPQDECLRYLFQWVYQRRGLVHLCCSKLVNYLTPIKYLRKSLKIIYLNSIQELEIRNMSWSRLIRKLRCYLKEMKNLRKLVFSRCHHYTSDNELEGRLVAKFSSVFLRLEHLQLLKIKLITFFSGHLEQLIRCLQNPLENLELTYGYLLEEDMKCLSQYPSLGYLKHLNLSYVLLFRISLEPLGALLEKIAASLKTLILEGCQIHYSQLSAILPGLSRCSQLTTFYFGSNCMSIDALKDLLRHTSGLSKLSLETYPAPEESLNSLVRVNWEIFTPLRAELMYQRWSLDAPWYE

SEQ ID NO: 927117 - protein, 319 aa, Homo sapiens
MSIVGTENVGCVGPQDILVPIVLGWMSLQAPPRLLELAEQSLLRDRALAIPTLEELPRELFPPLFMEAFTRRCCETLTTMVQAWPFTCLPLGSLMKSCNLEIFRAVLEGLDALLAQKVRPRRWKLQVLDLRNVDENFWGIWSGASALSPEALSKRRTAGNCPRPGGQQPLMVILDLCFKNGTLDECLTHFLEWGKQRKGLLHVCCKELQIFGIAIHRIIEVLNTVELDCIQEVQVCCPWELSILIRFAPYLGQMRNLRKLVLFNIHVSACIPLDRKEQFVIQFTSQFLKLDYFQKLYMHSVSFLEGHLDQLLRPPWRQS

SEQ ID NO: 927118 - protein, 163 aa, Homo sapiens
MEERRKFTRDTDKTPQSIYRKEYIPFPDHRPDQISRWYGKRKVEGLPYKHLITHHQEPPHRYLISTYDDHYNRHGYNPGLPPLRTWNGQKLLWLPEKSDFPLLAPPTNYGLYEQLKQRQLTPKAGLKQSTYTSSYPRPPLCAMSWREHAVPVPPHRLHPFPHF

SEQ ID NO: 927119 - protein, 525 aa, Homo sapiens
MHKEIPALTAQSAGGKQKLRNILETLSKCLGELWYSGGDSVELRNLIRFIKMSIRAPPRLLELARQRLLRDQALAISTMEELPRELFPTLFMEAFSRRRCETLKTMVQAWPFTRLPLGSLMKSPHLESLKSVLEGVDVLLTQEVRPRQSKLQVLDLRNVDENFCDIFSGATASFPEALSQKQTADNCPGTGRQQPFMVFIDLCLKNRTLDECLTHLLEWGKQRKGLLHVCCQELQVFGMPIHSIIEVLNMVELDCIQEVEVCCPWELSTLVKFAPYLGQMRNLRKLVLFNIRASACIPPDNKGQFIARFTSQFLKLDYFQNLSMHSVSFLEGHLDQLLRCLQASLEMVVMTDCLLSESDLKHLSWCPSIRQLKELDLRGVTLTHFSPEPLTGLLEQVVATLQTLDLEDCGIMDSQLSAILPVLSRCSQLSTFSFCGNLISMAALENLLRHTVGLSKLSLELYPAPLESYDTQGALCWGRFAELGAELMKTLRDLRQPKIIVFCTVPCPRCGIRASYDLEPSHCLC

SEQ ID NO: 927120 - protein, 896 aa, Homo sapiens
MVGAPPPALLPPCSLISGCCASNEQGSVGTGPSKPVQTVTMQPGVSGRMSLQAPSRLLELAGQSLLRNQFLTIFTLDELPREVFPLMFMEAFSMRRFEALKLMVQAWPFLRLPLGSLMKTPHLETLQAVLRGLDTLVAQKVRPRRWKLQVLDLRDVDENFWTIWSGARVLSCSPEAMSKRQTVEDCPRMGERQPLKVFIDLCLKESTLDECLSYLFGWIHYRRGLVHLCCSKVQNYSMPTSSFRNLLERIYPDSIQELEVWKKCSLNKTGKFAPYLSQMSNLRELFLAFGYERELYVSVQYLKNPLGAFIFSDAYLTDRDMECLSQYPSLSQLKELRLIHILMWTTNLEPLGVLLEKVAATLKTLVLKDCRIQDPQLRVLLPALSHCSQLTTFNFHGNETSMNALKDLLRHTRGLSKFMKMSIRTPPRLLELAGRSLLRDQALAMSTLEELPTELFPPLFMEAFSRRRCEALKLMVQAWPFRRLPLRPLIKMPCLEAFQAVLDGLDALLTQGVRPRRWKLQVLDLQDVCENFWMVWSEAMAHGCFLNAKRNKKPVQDCPRMRGRQPLTVFVELWLKNRTLDEYLTYLLLWVKQRKDLLHLCCKKLKILGMPFRNIRSILKMVNLDCIQEVEVNCKWVLPILTQFTPYLGHMRNLQKLVLSHMDVSRYVSPEQKKEIVTQFTTQFLKLRCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNTFSFCGNPICMATLENLLSHTIILKNLCVELYPAPRESYGADGTLCWSRFAQIRAELMNRVRDLRHPKRILFCTDYCPDCGNRSFYDLEADQYCC

SEQ ID NO: 927121 - protein, 122 aa, Homo sapiens
MGKKTTLHDALMVDTCHYPFVKIHRIYKTSNDPSCELWTLGDNDVSLWLIGCDECSVLVWVLILWGCCVLKGEEDGTRDIRIGNFDLIMNESSPEMPTLPPAGSWGSALWGNHDKIVAESRS

SEQ ID NO: 927122 - protein, 129 aa, Homo sapiens
MLNRSDLMLTLVEGLGFENCWDWNPGSHLTPTYTSRIYSPWEASGNIYRARIPYAKRPTKKESPKKQEGTPPARDLTLTDLRDIHGLRGTKESVLGADPHLERSKTVPQGLEDVSCFLCAVLWGRPSPF

SEQ ID NO: 927123 - protein, 115 aa, Homo sapiens
MPIQEESWGPCLIKVTLDSTAGGDLDESLGHLSGVTSAQREITKYDVQKPLGPDPSCSPGRLLGNSLAIIKFPLTTKSAMKKTEDNNTLVFSVDVKANKYQIAGMSHCAWLNILK

SEQ ID NO: 927124 - protein, 329 aa, Homo sapiens
MSLQSPSRLLELAGQSLLRNQFLTIFILDELPREVFPLMFMEASSMRHFEALKLMVQAWPFLRLPLGSLMKTPHLETLQAVLKGLDTLLAQKLRPRRWKLQVLDLRDVDGNFWTIWSGARALSCSPEAMSKRQTVEDYPRTGEHQPLKVFIDLCQKETFGYDDELYVSGQQQFVPDLDCPFLCLYYPQMLYIRKISNIKEHLEHLLRCLKNPLGTFIFCHAYLADQDMECLSQYPSLSQLKELHLIHILMWTTNLEPLGALLEKVAATLEILTLKDCQIQDSQLRVLLPALSRCSQLTTFYFRGNETSTNALKDLLCHTDSEMEPEVLE

SEQ ID NO: 927125 - protein, 719 aa, Homo sapiens
MSIRTPPRLLELAGRSLLRDEALAISTLEELPTELFPPLFMEAFSRRHCEALKLMVQAWPFLRLPLGSLMKRPCPETFQAVLDGLDALLTHRVRLRRWKLQVLDLQDVSENFWMVWSEAMARRCLPNAMMNRKPVQDCPRMRGQQPLTVFIDLCLKNRTLDEYFTCLFLWVKQREGLVHLCCKKLKMLGMLFHNIRNILKTVNLDCIQEVEVNCNWTLPVLAEFTPYLGQMRNLRKLVLSDIDSRYISPEQKKEFVTQFTTQFLKLRCLQKLYMNSVSFLEGHLDQMLSCLKTSLNILAITNCVLLESDLKHLSKYPSIGQLKTLDLSGTRLANFSLVPLQVLLEKVAATLEYLDLDDCGIVDSQVNAILPALSRCFELTTFSFRGNPISTATLENLLCHTIRLNNLCLELYPAPRESYDVRGIVCRSRFAQLGAELMGRVRALREPERILFCTDYCPQCGNRSLYDLESRYVTYFDVATDRRSNLLEHSKPSFVPGGKNGSHTGAAGGAACQSRTLRLHSSALGRSMGLGAVEQGAALIGEAQAVQEPMVGGAQAWQAAGPKPCPAGRQLRPGEKLSAAPVGLHCWGTQCTLRSYGPGAKPLTARGQRGRPGRLASPSAGPEPTPTRDSRWPTSTARSPGSHPHLSLHTSPQAEGAGSCLGQPRDGLPQCSGGLKGPSSAARVGTEPEEALRVSEGCQHAVTSELYLHSLLPQPPGFK

SEQ ID NO: 927126 - protein, 219 aa, Homo sapiens
MRPRAPACAAAALGLCSLLLLLAPGHACPAGCACTDPHTVDCRDRGLPSVPDPFPLDVRKLLVAGNRIQRIPEDFFIFYGDLVYLDFRNNSLRSLEEGTFSGSAKLVFLDLSYNNLTQLGAGAFRSAGRLVKLSLANNNLVGVHEDAFETLESLQVLELNDNNLRSLSVAALAALPALRSLRLDGNPWLCDCDFAHLFSWIQENASKLPKGIISLGFGS

SEQ ID NO: 927127 - protein, 267 aa, Homo sapiens
MVWGLSFQGQTLLDSLKCVSLIPLLPAPASKPSSKISPNRTIVPPPSKDKTKIAMVKVKDLKQTLAIETGYQDVNAWLEWIKYSVHALNKSNCYACAHGRPEAQIVPFQLRSFNSHVHLDTIKVPWGIPDRFKVQNQIAAGFKSICWWVTINKNVHWINYIYYNQQRFINYTRDAVKGIAEQLGATSQMGWENRIALDMILAESGGVCIIIKTQCYTFIQNNTAPNKSITKGLQGLTALSNELASNSGVNDLFTGWLKKGTSVNGKE

SEQ ID NO: 927128 - protein, 181 aa, Homo sapiens
MGPGVSLSKFKSWIWIYHFTAGGVVVTSWALCWFLLKRRENKQQQAGAGSSGNCYKPPIAFRTPYKVNLCAHRRMTLKGPPGQITRKAPHVARPLASRSSNTSSISWTTIPKLPDDQQNGLPWSIEKPVVRGIQVEATEQAVVGTTERPPNSIDNWPGRIRASAVLPGTILSLLSPLTCWR

SEQ ID NO: 927129 - protein, 142 aa, Homo sapiens
MGIRRLQVLITTQNYVTIFMGPSCDNQKCPWKGEEGDLSLVKNHRSRIDCVTQRGNSASWSLSFVPGLCPTVVGRILSLKDVHLLISRNCEYATLHGRRAPQNVVKVMASLHMWASYVYSVLSAWSMVLIWPTIKEEDACNA

SEQ ID NO: 927130 - protein, 202 aa, Homo sapiens
MELSQQEETLAAQGVTSRYWWKFQTTPGLIYYLHSHVIFTSFLDFKIISANYPFLRFAIKCRLAYQVTPYKVGKTSMSQSSSHRQKTNNSKNQGTFCLWALHWLFPASGMFFAQIFLFHNPLKHPSIRIQSQLYLDQVPLGPVKEDGHLPSTDVKLNLESFWAELMSPDKSLRMGRKGSLPLQQGKICLLPYRPMGCLVFSS

SEQ ID NO: 927131 - protein, 150 aa, Homo sapiens
MGRNQSRKAENFKTQSASSPPKNLSSWPAMEQSWTENDFDKLTEVGFTRSVITNFSKLKEDVQTHRKEIENLEKRLDKWLTRTNSVEKTLNDLMELKIMAQELHEARTSFNSQFDQVGERKLYKPEKSGGQYSTFLKKRIFNPEFHIQPN

SEQ ID NO: 927132 - protein, 143 aa, Homo sapiens
MCPELVPFCEFLVSLTSRMKPRTLVVSVTVLKDGVSGVCSFRCSDVSGVSSFWWVHGLADFRIEATDLRTWKGTQVGCCCWLRWPAFIPLFGPTHILLIGPFYRELIGPFYREPIGPFLQSADWCTYKPLARHRALTGAFTIL

SEQ ID NO: 927133 - protein, 136 aa, Homo sapiens
MRELTNEENRDLCSSPSYHRPRGLGGEDGFVVQAHDPGYPAWPQDTGPCIVATPASAIAQRAQDSVEGKRGVGAPPNRVPTGTLPTGAVRRVPSSSRPQNGGSTDSLHHAPGKAAGIQHSYLNTPATSVALYHFQD

SEQ ID NO: 927134 - protein, 233 aa, Homo sapiens
MVNSLLFGEMALAFGCPPGGGGGGCPGGGGGGGGAGPGPSPVTAALRDDLGSNIHLLKGLNVRFRCFLAKVHELERRNRLLEKQLEQQQSERERRLRYKTFSREQAVQTGPELLRPPAPGGGHGLSSGAAAGANANAVALGGLPPGGGSHPQHYGRLPGTIWSYTQVRRTGGGGVETVQGPGVSWVHPDGVGVQIDTITPEIRALYNVLAKVKRERDEYKRSFWRWPGMRRCC

SEQ ID NO: 927135 - protein, 122 aa, Homo sapiens
MRTAQVKGSVPQNCLTSDTGPRRSPRLLTNWLQIESSPDPASGSIFHLHDSQILGKHFIYVCWLVTKGTTPEQPDGRRCLHCCDFCFSRNKMMKLQGTCPDSLGGFSLTRERVICKPAVRVN

SEQ ID NO: 927136 - protein, 188 aa, Homo sapiens
MARAEGRQVTFASSNPGSQQPGMDVAPSEAKSDSGIYWVTSVALLSLFLAWTPCQEGKEQILPKLPPALHSKSSVRPGNKAAMGSLLAVPELVPVNLKQSNKTKGTGRGLWGPPGGTLHGSIKVLGFASLSRSCLGILQTTRSPHSNPAKPDYDAIFPDRNKTETNLSSDPGFLSTKTSVFQAAGCDP

SEQ ID NO: 927137 - protein, 156 aa, Homo sapiens
MFKNEGQRIQNADVRSQENLDVPAKEERENSPFLCLLFYSGPQGIERCLFTLFLKVVDPDICSIQPPSVDYIHIGQLDKGYLTDPHTLHGLHKYAAVTTTQSWCGSTGLIPSIQGVLPSAFRDRFKKELRLGITMAADADCIFVPYLAYPRDSPVS

SEQ ID NO: 927138 - protein, 209 aa, Homo sapiens
MKCYSSHLFLLPAARPQLARSSPAARQTRVCGAQWTFCLSNVKVTGETASSDQETAEEFPSDIKKIIEKKRYVYEQVFNADERPLKLITHDTLWKGSSMLWKRTPIENNIMKVWKNYSIEYAIVVIENVMKAINPKTINFCPDVVHDIGFKTEPIKEIMKKIVDMAKKIKDDNMMEVSASKSVPNDEEEDAEETVPENKFTSSNLAEEF

SEQ ID NO: 927139 - protein, 169 aa, Homo sapiens
MSKTVSEVMREVLILESRQVSIIFQKVQYSAYSGYTDEIYLVAKEDRFLAPEAYEQPIANMCIPEIPGCMRGSSWVLWSEKVSENESAQRRISPMYHIHDVSFPLMPSIYLTQVILDKGGCDRDLACKDCVIWEDCGDAIWVSRRQTINRRNNSQHRGLLSWLSLDNSN

SEQ ID NO: 927140 - protein, 152 aa, Homo sapiens
MEIDLRLSSHLLSCSGQLKPSSLAILVVSVIGFLRSKSHNLDRSPGVLVKVRSNVTLSISPGHPGETELCVAALHRSGETERPHAASLLLTDRQQGTAEALHALQAGLSRLRKASWGRWSLSGEPSTYTAAEEPRKAAQLGFTSWMPHGAPD

SEQ ID NO: 927141 - protein, 139 aa, Homo sapiens
MSSISKISSIKKVSKLKKNSFLFTHKMLIDYLLYRGHTLVNGNKAMNKTAVVSVVFQSIRSVGWRCLFVLLVGRSLSWVPNQEPEGMMAIQETLVSCIGWKYVRASARQADAFQGSAGIISKQLFDQCCMGLFPESCLL

SEQ ID NO: 927142 - protein, 168 aa, Homo sapiens
MRNIKRPDLLDIAAHQRRPHDSVSSGIPGTPEAPEGVCYSVLLAWLSTDSLSVKYLSGPSAFLHEVVALCQQGQRDFIANESGSQWEGSWKRDGTGRRSSPGVQPSPARLLSKAKRSSCPSEVKLLLSDVKPQSPTSSCFSSSPLLCSLLVEPGVFTETVEYQYEKKI

SEQ ID NO: 927143 - protein, 144 aa, Homo sapiens
MGLHLAVGVSTSLDPVEASLQGVKSMDHGEIANTVFEVSCVKTQPKTGSSHFPAVPCDSEVEVLDTHGLEVLTRAGGPAPGEGCMCCKLEENRDTHGLDVLTSAGGSALQEGRMCCKLEENHKKFWTLMYSLINTNERLLARGQ

SEQ ID NO: 927144 - protein, 210 aa, Homo sapiens
MNVDAKILNKILAKQIQQHIKKVPLLAGTQRIYGKAYMIRQKPAAAAEPSQRPSTRAVPRGNVGLELPHRVLTGALPTGTVGRRPPFPRPQNGRSVSRLHHASEKGAGTQLQAMRAATGPAPCKATGEKLPKALGAHSLHWCTLDGYEFITSIFEFLTFNSKMLPELLDYGEIKTTDGSLKFSTLVFSKRPFCSKAVSGFEGHAYKLQWS

SEQ ID NO: 927145 - protein, 144 aa, Homo sapiens
MLPFPKPSMACPTPHLVPIKIPELSWQRREVTGHQTLRTQGPRMWMQKALTLTLCSRWWKAAASHEKAEGPLSCCQLSCPWMAKLKEHCNTSSGASGGAGTSQMLLQGCYRVGSSRHPKALAPGPAPAHLCLPSHEGWNTAGVS

SEQ ID NO: 927146 - protein, 298 aa, Homo sapiens [sequence omitted]

SEQ ID NO: 927147 - protein, 220 aa, Homo sapiens
MPVGEPNIPRVARPFGGNLRMPPNGLPVSASTGIPIMSHTGNPPVPYPGLSTVPSDETLLGPTVPSTEAQAVLPSMAQMLPPQDAHDLGMPPAESQSLLVLGSQDSLVSQPDSQEGPFLPEQPGPAPQTVEKNSRPQEGTGRRGSSEARPYCCNYENCGKAYTKRSHLVSHQRKHTDQCSREFMRSDHLKQHQKTHRPGPSDPQANNNNGEQDSPPAAGP

SEQ ID NO: 927148 - protein, 969 aa, Homo sapiens
MMTSACTNIPGTVLTQDLTMHPLKALEDLSETYSMGQKVTSFDQVKHTAGSQMTDVTVTPKSSPTDCQKTTITASNMTISNESSQLNTPSSDQTLNESQIPALLGDQMKTLSDNQTLCGDQVTFSSDQTLTDGHTVTSGSDETLSGGQMTTSLDLYGGQMMTSIDNQTLCGEQMTTSSGNQAFYGRQMTTSTGNQTLCGEQMTTSTGNQALYGGQMTTSASNQTLCGEQMTTSTSNQTLCGEQVMTSTGNQALCGGQMTTSTGNQNLYGGQMMTSTGNQTLYWGQMMTSTGNQNLCGEQVMTSTGNQALCGGQMTTSTGNQNLYGGQMMTSTGNQTLYWGQMMTSTGNQNLCGEQVMTSTGNQALCGGQMTTSTGNQNLCGEQVMTSTSNQTLCGEQTTTSTSNQTLCGEQVTTSTGNQALYGGQMMTSTGNQTLYWGQMMTSTGNQNLCGEQMTTSTGNQALYGGQMTTSTSNQTLCGEQMTTPTSNQTLCGEQVTTSTGNQALYGGQITTSTSNQTLCGEQMTTSTSNQTLCGEQVTTSTGNQALYGGQMMTSTGNQALYGGQMTTSASNQTLCGEQMTTSTSNQTLCEEQVMTSTGNQALCGEQMTTSTGNQALYGGQMTTSTSNQTLCGEQTTTSTSNQTLCGEQVTTSTGNQALYGGQMMTSTGNQTLYWGQMMTSTGNQNLCGEQMTTSTGNQALYGGQMTTSTSNQTLCGEQMTTPTSNQTLCGEQVTTSTGNQALYRGQITTSTSNQTLCGEQMTTSTSNQTLCGEQVTTSTGNQALYGGQMMTSTGNQNLYGGQNMTSTDNQALYGGQMATYSGNQTLYGDQMLTLQVGNMTTLTDDHSLYGGYMMSHQFSSLPYPGFLCFSSSHLIQGQLPKQKTQSCQFWKNPEVSRPYVCTYEDCKMSYSKACHLRTHMRKHTGEKPYVCDVEGCTWKFARSDELNRHKKRHTGERPYLVTAFISML

SEQ ID NO: 927149 - protein, 149 aa, Homo sapiens
MNFLLLYEIGNLAKGFSVFLRGTGFLFSVTSIFHEMAWCRTLRGLECRQCSNTAGVSMLQPSEDGSSHSPSIYFWPRAARQAEVGLKSDCYPQSTSSQCHRLQKRDFSVGPDGLTLAAGVGECSRTGVALGQDNFPSFMVLQIPFLLLP

SEQ ID NO: 927150 - protein, 137 aa, Homo sapiens
MGESNACILVSALGLGAPKDGRTSQHPQHSQGSSLTLCPHCSQSLKGFGVQKGSPTFWPVIDIRSSWFGNSEPACSLMISSDRLFQGYEIRTCARSSSGNGNNLPKRGSKWQGPGCGVPGVPSLAHGGQPGCLPHAC

SEQ ID NO: 927151 - protein, 144 aa, Homo sapiens
MALTSSAGFGEELLPGWGMGSSEIINSTRELCDSPRVVVGLRLSKPPGKAVKMNFLESQTKLTASEYLEDYGLELDFSQASQVIFINTQTLTVNDLRSTCINTAALTSKPSSSMKSTPLVQGCIHQWYNFPSKVQTPGRGLCRS

SEQ ID NO: 927152 - protein, 191 aa, Homo sapiens
MAAATPDRPLLQIGLYYIASERQKSKLPVKSYGYNRKYRTDLAVHGWLGLHGGAQFLCRWPRSIPSAHLPGFLSTVTLNVVTTRLNVYLAPTGVRNTEDELVAKGHTEFLNAEFKFKPLGLHWFMLVSNLERVPNRSEESCNQGIGSGLSQGYTEDGCDQQPSQIYFKPQDGRRREQDFILLLKRLPGSLT

SEQ ID NO: 927153 - protein, 129 aa, Homo sapiens
MANDVNHAFICLFSFYILFGEVSKSLPPHTSFLFLRQDLTLITQMKFHCGFDFPASCTRFFPTADSEFQRAAREQTPMHKNLPRPLFTSCLLMSHGPKTGKKNVGDSHLIYGRLSTLLIRMLFRKLTCQ

SEQ ID NO: 927154 - protein, 162 aa, Homo sapiens
MSLITQMKYNVTYKNAHSFSHCKLNTLLRGHFSNHQWPCNSLKIFSISQKERSHKTSQYEKKDFDHVNMSNCLLTLPKETELYNFQKCSLNSASGLILHMLPLDTSSAKPYLITKRNLNRCYSSRCTGCKAASTEDSLPRKTGKRAVLTDIQNGKNELQRSN

SEQ ID NO: 927155 - protein, 165 aa, Homo sapiens
MISTLGVLAAKPLKLIKICAHELINTVWLLCGFGIFNISSASTIDLSRNQIGVRLQRIQRGPGLPRCSEWCKCENGREVYNRCCLPNRNKTVFDWLSSDSCECEKYKELVINVECKQIGKEALSNEFFLQETLGGKVPCKISRSTNNTVKKNFCEEELAEDMEVL

SEQ ID NO: 927156 - protein, 447 aa, Homo sapiens
MRAIVQAREYGDPEAWQFPVILQPPVPATPTVQNHPQPVVDPAQQAADPAAQQDQEADNQAPQPETQAAQGNNQPPQLPAPGAQPIPGIPAVQAVVQPDPIHPGLAEDKRLVPYDWEILAKSVLSKSQYLQFRTWWVDAVQERIHLNQGSNPPVNVTADQLLGMGQWAAIRHQTILNDEVVEQLQKCCLDAWDKIQDDGKVCPSFTAVRQGQHEPYPDFIARLPDAAEKAIPDSHGQRLVVELMVYEQANPDCQAAIRPVKGKIPLGGDILTSYVKACEGVGGTLHTAMIMAQAMASILMPGQFSGQCFLCGQKGLAKRNCPRRAGRSPLHHQQQQQKTFQQQDAPPSTVCPRCQKGFHWASQCHSRFDIDGNPLQPFKNQGNGMRGRPQAPLNNGAFLNSQPLASSQTGAFPVQSIQPPPQFPLQRCRDQPHKVDGSLPVCRDERV

SEQ ID NO: 927157 - protein, 159 aa, Homo sapiens
MCNQKEGRAGPAEFGPGEQASLQGARARLETEVLQLQLRPPLFLHWAESRDGASAGVHGGGRLLSGPGPEAWQDAGQLEAKLEKFQREILFHEEMAQEVWMATGSTKRVLQELREEYDFKRQKPAHWEAKFQPFWTVLWLLGLQPQSAGPGSTRGTVSH

SEQ ID NO: 927158 - protein, 139 aa, Homo sapiens
MAKIKARDLHGKKKEELRKQLDDLKVELSQLRVAKVTGGAASKLSKIRVVHKSIAHFLTVINQTQKENLRKFYKGKKYKPLDLRPKKTRATRHRLNKREEHLKTKKQQWKERLCLLRKKSDKGLYAADVPASSSSNTVY

SEQ ID NO: 927159 - protein, 172 aa, Homo sapiens
MDQYLAPRTPHYQLTEGCQILSLGNIRSFQKNLALRCKVILPMPISGIILQVFMPGFRTITRVEICMEQRPSSMWKRISPAEGQQQDRRPGRRFCSDISSKCHFLEFCFWKWFSHSEQLESLVKYNYIHLEASERYPISEENRCERERRPRDDPGVRDHFSPEADANSESGS

SEQ ID NO: 927160 - protein, 152 aa, Homo sapiens
MSGSQPKISRHAKRQKNMTHNERVINRNCPRTDTDVSVISVTFRIMFRCYQNCISCVQEVKVEIWDVFLKYPNQSSIEEMTNYEKTNTLDGIKGRLNIAEKRYNTKSGIHKIITSKENLDFIKIKTSALQKTLLKEQKDKPQAGEVFCKAST

SEQ ID NO: 927161 - protein, 255 aa, Homo sapiens
MLECRDDLVSLVSQAGYFPRNSHVEALTRSTQNVTVFGERAFSPNRRRVDVYAEQHLLTPTRPLLLMMVTVAQVLTKSLGLPPVGFPGTLAVVESRRIQTKIQPSQQVRVKMSLLEQHLLEQNRTGCSLALGLAALAAGGPESRAWLHIEGHQPERAAGGTAVRKVISSRGHYYGRGIGCCHPSSLTGDCAGCCCNLVVGCHQTAIEDRPEAWLWRLSKQKAGNIPMAQNVLRQHITAFNVSLTFIPFALPWGHR

SEQ ID NO: 927162 - protein, 601 aa, Homo sapiens
MAPYSPLVTRLQKALGVRQYHVASVLCQRAKMAMSHFEPNEYIHYDLLEKNINIVCKRLNWPLTLLEKIVYGHLDDPASQEIEQGKTPFISSGLPKVAMPSTIHCDHLKEAQLGGEKDLRQAKDINQEVYNFLATAGAKYGDEEVPKQDGRTDIANLADEFQDHLVPDPGCHYDQLIEINLSELKPHINGPFTPDQAHPVAEVGKVAEKEGWPLDIRVAAVAKQALAHDFKCKSHFTITPGSEQIHATIERDSYAQILRNVGGIVLANACGPCIGRWDTKDIKKGKKYTIVTSYNRNFTGCNDANPETHVFVTSPEIVTALAIVGILKFNPETNYLMGKDRKKFKLEALDADDLPQEEFDPGQDPYQHPPQDSSGQHVDVSPTSQRLQLLEAFDKWDSKDLEDPQILIKVKGKCTTDHISAAGPWLKFCGHLDNISNNLLTGAINIENSQANSVCSANIENTQEFGPVPDTARYYKKHGIRWVVIGDENSSREHAVLEPPHLWGQAIITKSFARIHKTNPKKQGLLPLTFADPGDYNKVHPVDKLTIQGLKDFAPDKPLKCIIKHPNGTQETILLNHTFNEMRIKWFCAGSALNRMKELQQ

SEQ ID NO: 927163 - protein, 178 aa, Homo sapiens
MPCFSASSGNFVTCNRQKLPLPSVGDAGHTGRLSSCCVLPAVAPCLEQPRFVPLGDKSETPSQKKKKKDSYKLYVHSLKSQFKASGWSRAQTGSLFPELPHQEQGWKAPEKVKETYSGGSRSCCKQPPDLLRDSSALQWDWKVHGVPIASLSGATTGPGADPELTRLKRCHRVELHNM

SEQ ID NO: 927164 - protein, 167 aa, Homo sapiens
MSTSQTFKRIRNSGGGAQQPVIPQTLQGVTLLGSQLNACVFSELFPFGGLELRCIRIPCELRELFSLQLPVHSLLRPMELCVMHIQLSIQPEPPLDPQALPSILTKLKSENETPVHYHQSSEVLPRACTELAFSEHCGKGVQGTTVLCAARYPQHLVQCLAPGKGSI

SEQ ID NO: 927165 - protein, 153 aa, Homo sapiens
MLLIGHMGSLALWLPGNTSLIVAYLAPSWALQGAVEGARAVARPNWVRTWICIFISLNLTGEWTKAKHQAQTSEGMVLLKIVNPAIFIQEFLIVTFQGLLQLLLPAWKMAWAHTPVLVTLWGRSRGNGFCSGQPLALTSSSARGAPAESPDRM

SEQ ID NO: 927166 - protein, 139 aa, Homo sapiens
MASKIQTRKGAALQRQAWLTTNQPFGKTCFTTVTNQRPDAFPQFCDGPPGRTTEQALEDRRDWSEWGGIEGKMEIEPERAPNARTCSSPRIRSSRRTRPKTSRWGTPKSLEEQHPHDPLCSFRQKDLLPLFVQLFVFVK

SEQ ID NO: 927167 - protein, 145 aa, Homo sapiens
MKSWPSTYVGFTQQTHKKCSSSLVIREMHIKTTMRYHHMPVRMMIIKKSGNNRYWRGCGEIGMLLHCWWEHKLVQPLWKAVWRFLKDLELEIPFDPAIPLLGVYPKDYTSCYYKDVYMHTYVNCGAIHNSKDLEPTQMSINDRLD

SEQ ID NO: 927168 - protein, 240 aa, Homo sapiens
MGLVVKIKHKSNSLELSTVSNGDLLAGLAIPVPKVLRGFHNIHTFFHLAKRHMLAIQPLSLGSADEKLGTICVGSSICHGQDARTCMLSDEVLIIKFLPIDGLVTGAIRACEVTTLTHKPWNNSVKAGTLITKSFLSSAQSTKVFCCLWNLVCKQFDGDAAQGLAIPGDFKKDDGVSPMNIYSFVIQQVLLREGCRTGYYGNIYKAFNVPVESGDQRKMMSGNYAKCFESAKDKQMQTII

SEQ ID NO: 927169 - protein, 184 aa, Homo sapiens
MGVTESIPKPCGQLTGAEFAGIIIEWNRMESTSNGIKWNHHRMESNGIIIERILRESSNGIERNYAIESNGIIIKWTPMELSSNGMESPSNGNEWNLRMELNEIIERNQIESSLNRIKLDHHRIESNEINIERNLVELSSNGIEWNQQGMESNGEIEWNPLESSSYGTECSHHTMELNGINEGT

SEQ ID NO: 927170 - protein, 137 aa, Homo sapiens
MTLCLHPWNPWKVQERQSSATGSSPNRTGLGMASSLGARPKSSPLVSNGGQNSVHLQREDLAQKRPFSDPSCAGPKRAVPLPTGPSLPGVFGALAHPERYCPPVTARGPKRTKEGSGCGGNHRVTAHLRLAGSSQIE

SEQ ID NO: 927171 - protein, 317 aa, Homo sapiens
MLAPVVVSDPEHSQEMESLREALLSSRSHLQELEEELEHQKVERQQLLEDLREKQQEVLHFREERLSLQENDSRLKHKLVLLQQQCEEKQQLFESLQSELQIYEALYGNSKKGLKVLTFYLGGPYTLAYRTKNFPASADPGNKQLLLQGLGLDTSPVMKAPPKLEGDATDGSFANKHGRHVIGHIDDYSALRQQIVEGKLLVLGSKGIHELWSSTSALHHALEESASLLTMFWRVALPSTHIPVLPGKVRESTERELLELRTKVSKQEWLLQSTAEHLKIANQQKESMEQFIVSQRRFPEREWGKKRAVFPMPHLCC

SEQ ID NO: 927172 - protein, 243 aa, Homo sapiens
MFISAFSLDKGPADTTMLTLGFWVIRAYGHLTWAELLDKVLCQSTPLSQLFLEVLPLGLLSFLRVNQDFILPKEQEPVHQEADFTLTKQSRGEEDSTCIELSASPTRQPRRPQQQRPEEPLQQRKGQVDTSIYSLDTAIVGNKDPPSICATVPGKTFLNITPAEVGVLVGKDWSSFVMNGLTLGGQKYTVVLDSLLQDGELTTDLCMKSIGGAPTFNVIVTMTAKTLGLLMGKEGIHGNFINK

SEQ ID NO: 927173 - protein, 208 aa, Homo sapiens
MSSPCHPRALRGGIHRTGTWSLHRLQPFAQSQPSTYANAVYHCHKLYSQVSHIWGNCRGQQIRSAMDKTRSGKTTFVTRVSLLPALTHSWDSQVRPAVLNPLPRHGNSFVAKQHVAKQQPLRWLIYIEVALSVMSPTVPFPVPVCLSAAQPTNPLPEPARGSDVCLSLFSLLLPSSVLFQRSWSLACIAEQAFGDQLDPGHPSSNNGF

SEQ ID NO: 927174 - protein, 137 aa, Homo sapiens
MQVIFRNEVTNEFLYYNVSFRVIPSGIIKTIEMVTPVRQVASASIKLENPLPYSVTFSTECQMPDIALPSQFVVPANSEQQRCCWIVRKTTALEALEFCVCICAYVSQALNSNNLESEDTLQAHVSLHGNEVEVFVK

SEQ ID NO: 927175 - protein, 137 aa, Homo sapiens
MTPNLPVVNFTCQVRSKHTQTILLSNRTNQTWNLHPIFEGEHWEGPEFITLEAHQQNKPYEITYRPRTMNLENRKHQGTLFFPLPDGTGWLYALHGTSELPKAVANIYREVPCKTPYTELLPITNWLNKPQRTSRGC

SEQ ID NO: 927176 - protein, 232 aa, Homo sapiens
MRLCLIPQNTGTPQRVLPPVVWSPPSRKKPMLSACNSMMFGHLSPVRIPHLRGKFNLQLPSLDEQVIPARLPKMEVRAEEPKEATEVKDQVETQGQEDNKRGPCSNGEAASTSSLLETQGNLTSSWYNPRPLEGNVHLKSLIEKNQTDKAQVHAVSFYSKDHEVASSHSPAGGILSFGKPDPLPTVLPAPVPGCSLWPEKAALKVLELPATVPTKENCRSHRCSCNRPLPCN

SEQ ID NO: 927177 - protein, 904 aa, Homo sapiens
MPQLLRNVLCVIETFHKYASEDSNGATLTGRELKQLIQGEFGDFFQPCVLHAVEKNSNLLNIDSNGIISFDEFVLAIFNLLNLCYLDIKSLLSSELRQVTKPEKEKLDDVDVQATTGDGQWTVGTSPTQEKRMLPSGMASSSQLIPEESGAVGNNRVDPWREAKTHNFPGEASEHNDPKNKHLEGDEQSQEVAQDIQTTEDNEGQLKTNKPMAGSKKTSSPTERKGQDKEISQEGDEPAREQSVSKIRDQFGEQEGNLATQSSPPKEATQRPCEDQEVRTEKEKHSNIQEPPLQREDEPSSQHADLPEQAAARSPSQTQKSTDSKDVCRMFDTQEPGKDADQTPAKTKNLGEPEDYGRTSETQEKECETKDLPVQYGSRNGSETSDMRDERKERRGPEAHGTAGQKERDRKTRPLVLETQTQDGKYQELQGLSKSKDAEKGSETQYLSSEGGDQTHPELEGTAVSGEEAEHTKEGTAEAFVNSKNAPAAERTLGARERTQDLAPLEKQSVGENTRVTKTHDQPVEEEDGYQGEDPESPFTQSDEGSSETPNSLASEEGNSSSETGELPVQGDSQSQGDQHGESVQGGHNNNPDTQRQGTPGEKNRALEAVVPAVRGEDVQLTEDQEQPARGEHKNQGPGTKGPGAAVEPNGHPEAQESTAGDENRKSLEIEITGALDEDFTDQLSLMQLPGKGDSRNELKVQGPSSKEEKGRATEAQNTLLESLDEDNSASLKIQLETKEPVTSEEEDESPQELAGEGGDQKSPAKKEHNSSVPWSSLEKQMQRDQEPCSVERGAVYSSPLYQYLQEKILQQTNVTQEEHQKQVQIAQASGPELCSVSLTSEISDCSVFFNYSQASQPYTRGLPLDESPAGAQETPAPQALEDKQGHPQRERLVLQREASTTKQ

SEQ ID NO: 927178 - protein, 158 aa, Homo sapiens
MGLAQVVLPAVAHMSLAWVTLLSLVNMSLAQDIPLLTVSMVVAQGTSVAKDSMVLHQDSHQPLTRRDLAQASLPAMATVALAPVSLLAMADMGLDLASLLATADTGLVQGSLPATANMGLAQDSPLVIVSMEVAQGKMGILIAKEEKVKALKAKMQQR

SEQ ID NO: 927179 - protein, 152 aa, Homo sapiens [sequence omitted]

SEQ ID NO: 927180 - protein, 146 aa, Homo sapiens
MEPLPVPGAACPARCSSQHVWLCTVAGPHTRSSTHPSLLHACLALCRCGIWAGRATQFTLQVPMSQLRHWPPEPEQVNHKASGWNSLEGSQGDRKMRESLELPRDLLNGFNQNADSDMDNEVQSDVVSDEEEEHIGNCSKGTLVML

SEQ ID NO: 927181 - protein, 156 aa, Homo sapiens
MCPAFLPSSGFMVLLTSGVKLQTFANKLHKDRWRHREPDQKPFLQRPKERALPSPVNSHNTTQDYFQTVYVSMDRFLCMHFIPKFCFAIFNKYLIYLRSHGLRNSTAFVSSTLKLLQKEDGTVTDKGSYGDVVSKCHVVPWMASWNRKGALENKYS

SEQ ID NO: 927182 - protein, 137 aa, Homo sapiens
MGQGGNVATIGDGKAIFSGKMFIRVYKSSFIRFLPNVPILSFGVPSFSNQCPHFNSRHLVRLCMHLSFQAFIIYRVLLTPLSPGKQAGSRALEKIGASEAALMRNNCDFLSQSKSILVSASAFLSVAVGILRITEIH

SEQ ID NO: 927183 - protein, 142 aa, Homo sapiens
MTECQISSQKLGLQHNLLETEDVGIGSYRYIPYSHGVCCQMKKQEKRLNNCISTGELWLQYQCVYIHLLNPTVLPKWLQNFYKKGGRSWGAKWSSSADPTPTEPSKLRSTGLKFSLSAEQSEVHPGHSSLVRRGILLLLRLE

SEQ ID NO: 927184 - protein, 156 aa, Homo sapiens
MAEAIAAAAATRTANKMLLLLLLALAVMARILVVDIWKPIAHFEQRSYVIDFQFNQLHYFLLSTERVELGRQNKLDVAMKRCSQWSVKGSDVDHFWSWPAKSPKRSSTLSPSFTKCIENIKRLPTMLDSRGHPACISWLLSSLLPITPPMLLSSHL

SEQ ID NO: 927185 - protein, 147 aa, Homo sapiens
MGYSHINTKPGASWSTRHLALLRSLSSGGIGVAVSCGEISTQSRLLITLQLKRSWQREPLRCKFPFHTLELQPSFLQMKSRTLMALACQAGRPDWERDQVETSDLVTGAFGGAVPVRLRQGDGEPWLDAAAAQQPSQVPLLWRSCCL

SEQ ID NO: 927186 - protein, 157 aa, Homo sapiens
MWTIAILIIVANQCPGLWTREFGRWKVNNLAVERRNFLGSPLPLAPEFFRNIRLLGRRPTLQQITENLIKKYGTHFLLSATLGGEESLTIFVDKRKLSKRAEGSDSTTNSSSVTLETLHQLAASYFIDRDSTLRRLHHIQIASTAIKEESVPSLIII

SEQ ID NO: 927187 - protein, 131 aa, Homo sapiens
MKAQRSQVLFQCQRSKRSIPLQSYQGAGNNALGLFLGDNIQETDNAEHKYSVCVYNDLPFCDHRRKLTFINVLSNCAYIRALRWLESNAYPVEISTILACAVEQWQQGATPSQPNDHKVSNQYATVDCVVR

SEQ ID NO: 927188 - protein, 312 aa, Homo sapiens
MENYNQTSTDFILLGLFPPSKIGLFLFILFVLIFLMALIGNLSMILLIFLDTHLHTPMYFLLSQLSLIDLNYISTIVPKMASDFLYGNKSISFIGCGIQSFFFMTFAGAEALLLTSMAYDRYVAICFPLHYPIRMSKRMYVLMITGSWMIGSINSCAHTVYAFRIPYCKSRAINHFFCDVPAMLTLACTDTWVYEYTVFLSSTIFLVFPFTGIACSYGWVLLAVYRMHSAEGRKKAYSTCSTHLTVVTFYYAPFAYTYLCPRSLRSLTEDKVLAVFYTILTPMLNPIIYSLRNKEVMGALTRVIQNIFSVKM

SEQ ID NO: 927189 - protein, 288 aa, Homo sapiens
MAVSFLSQSKTIRFLGCEIQTYVFLALGGTEALLLGFMSYDRYVAICHPLHYPMLMSKKICCLMVACAWASGSINAFIHTLYVFQLPFCRSRLINHFFCEVPALLSLVCQDTSQYEYTVLLSGLIILLLPFLAILASYARVLIVVFQMSSGKGQAKAVSTCSSHLIVASLFYATTLFTYTRPHSLRSPSRDKAVAVFYTIVTPLLNPFIYSLRNKEVTGAKSRLSVTESRKEKEEQTFVCKKHICGAFYSSHKSLKLRALFRCLAFCTSSKSTDEIYMVIQGARAMEY

SEQ ID NO: 927190 - protein, 135 aa, Homo sapiens
MKDMGRPKVKIFLEMLVLAYSSPQTSLEILQGSPRDLLEFAGGPLEILFAWLSPAEAAEQQRLLPVRSSGSVVPEKHPPDAAGALLYEVAADSSVLLAFQAPLVYGKRLLQLAQCLPKRPSSFVPETQGTGGIGT

SEQ ID NO: 927191 - protein, 147 aa, Homo sapiens
MPSIPMLCDFLLCFRGERKWQSLDLMSPSPGSPCMAVDRFTASRWLCWRIPIVLLDVEPEIVWNAWCFFQFLDANLREQLGEHMTNQPEHLRQLEESVSYGHHSPLCQTGADGWSGQSTVLSSWFWEGLRCLLSPHKLMRTCTPVLS

SEQ ID NO: 927192 - protein, 226 aa, Homo sapiens
MKTIAYGGCLVHLYNSHALGSTECVLPAVMSCDRYVAVCRPLHYTVLMHIHLCMALASMAWLSGIATTLVQSTLTLQLPFCGHRQVDHFICEVPVLIKLACVGTTFNEAELFVASILFLIVPVSFILVSSGYIAHAVLRIKSATRRQKAFGTCFSHLTVVTIFYGTIIFMYLQPAKSRSRDQGKFVSLFYTVVTRMLNPLIYTLRIKEVKGALKKVLAKALGVNIL

SEQ ID NO: 927193 - protein, 309 aa, Homo sapiens
MGLGNESSLMDFILLGFSDHPRLEAVLFVFVLFFYLLTLVGNFTIIIISYLDPPLHTPMYFFLSNLSLLDICFTTSLAPQTLVNLQRPKKTITYGGCVAQLYISLALGSTECILLADMALDRYIAVCKPLHYVVIMNPRLCQQLASISWLSGLASSLIHATFTLQLPLCGNHRLDHFICEVPALLKLACVDTTVNELVLFVVSVLFVVIPPALISISYGFITQAVLRIKSVEARHKAFSTCSSHLTVVIIFYGTIIYVYLQPSDSYAQDQGKFISLFYTMVTPTLNPIIYTLRNKDMKEALRKLLSGKL

SEQ ID NO: 927194 - protein, 271 aa, Homo sapiens; identical to SEQ ID NO: 793172

SEQ ID NO: 927195 - protein, 201 aa, Homo sapiens
MTNQTQMMEFLLVRFTENWVLLRLHALLFSLIYLTAVLMNLVIILLMILDHRLHMAMYFFLRHLSFLDLCLISATVPKSILNSVASTDSISFLGCVLQLFLVVLLAGSEIGILTAMSYDRYAAICCPLHCEAVMSRGLCVQLMALSWLNRGALGLLYTAGTFSLNFYGSDELHQFFCDVPALLKLTCSKEHAIISVSVAIG

SEQ ID NO: 927196 - protein, 338 aa, Homo sapiens
MVAMPTLPLIVDCTTWPLPPRDPTIPTEFTFCSRVAVVPTVRADIQRRASTRLFKDAGAALTNLFCKALVRDKYGKADGSVDWGGDVATTGDGKAVSSGKEDSSEFASSGSSALSGSSHTSPFQVAGSQYVPVNALTLTVDTWPLAFAIGCPLDAPAILVMVGPQKLWGFWHLEWGPSVADTWGTPGFQHLVLAAPCFLQGTRKPRLRDPLLAAPTRRPMPSLEPPQVPSSEGGPASPLMKNSIPRSSDTPPLYPANPSIYPLMTEKVSPTSTTRSGTPYQPLKSKLSPLQECPLEHIETKDIEGDDNEATSEDQVLPYQLMLSVTKRHIQRKGLCLR

SEQ ID NO: 927197 - protein, 326 aa, Homo sapiens
MLPPRSNGTAYPGQLALYQQLAQGNAVGGSAGAPPLGPVQVVTACLLTLLIIWTLLGNVLVSAAIVRSRHLRAKMTNVFIVSLPVSDLFVALLVMSWKAVAEVAGYWPFEAFCDVWVAFDIMCSTASILNLCVSRSSALNRTYAISSSLISFYIPMAIMIVTYTRIYRIAQVQIRRISSLERAAEHVQSCRSSAGCAPDTSLRFSIKKETEVLKTLSVIMGVFVHYAFNADFRKVFAQLLGCSHVCSRTPVETVNISNELISYNQDTVFHKEIAAAYIHMMPNAVPPGDREVDNDEEKESPFDRMSQIYQTSPDGDPVAEQMRSVH

SEQ ID NO: 927198 - protein, 142 aa, Homo sapiens
MVGEPVEFRCIPEAQNVPDRYFAVSWAFNSSLIATMGPNAVPVLNSEFAHREARGQLNVAKESDSVFVLKIYHLRQEDSGKYNCRVTEREKTVTGEFIDKESKHPKNIPIIVLPLAQLGGKRGIPESCLLLCGNQVPEEVGR

SEQ ID NO: 927199 - protein, 146 aa, Homo sapiens
MVTLPAVAGRMFSLSLVGVTYSVHTFVDTLNATHRSHLNERERQRVLVDLRKSHILDERHIEEKGVDRKTRDVWEGKELSECLCGPLALVTWEWLMHPLAVPGVWALPVTVGKENGLAVLQLGLRWVQEADETSKLLHRREDKHLL

SEQ ID NO: 927200 - protein, 252 aa, Homo sapiens
MEATHSTLPSFQGPVSLASITVVGIDGQASKPLKTPQLWCQLRKHSFMHSFLVIPTCPVPLLGQDILTKLSASLTIPGLQLHLIAALLPNPKPPLHLPLVSPNLNPQVWDISTPSLATDHMPITIPLKPNHPYPTQCQYPIPQHALKGLKPVITFLLQHGLLKPIYSSYHSPILPVLKPDKAYRLVQNLRLINQIVLPIHPLVPNPYTLLSSIPASTTHYSVLVLKHAFFTIPLHPSSQPLFAFTYTDPGTH

SEQ ID NO: 927201 - protein, 162 aa, Homo sapiens
MLSVLGWTATVVQSEAALWLDPSVYHASSGMWGHPSLNGEGSGSRGASGTMALSCIRTTVPKISCNSAAKGLISSVFRCSNAVKNAHPTLAAKAYSFLVLSASSCSRAFSMLTGDPSTATPVSTGAHPSSRAATRGAFCHDCKFPEASSATWNCKKIEAQQD

SEQ ID NO: 927202 - protein, 164 aa, Homo sapiens
MSSSPDPPHQRSADTTDQMEGFDLEGSCVTSRLNMGTPFANLLVAACVPLLVTSVSIFKAYRSDLCFPHSPLIYYYTHYRDRQNEKIQTSRVRSRPDSASNCAFAETILVILKGSRRPDVHSLRGPLTTLDICTKPEVIPTLPVTKSYTWLSAPLAALLHLASE

SEQ ID NO: 927203 - protein, 177 aa, Homo sapiens
MKRWDIECQTYFFFFLIKEKPQDCEPSLHSGPEEDRKMWESLELPRDLEGSEDRKVWENLELPRDLLNGFDQNADSDMDNKVQAEVVSDEDEELVGNWSKGHSCYAKRLAAFCPGPREDAEHKSLENLQPDDVIEKKTPFSGEKVKLAEEICISNKEPNVIHQDNGENVSRACQRPS

SEQ ID NO: 927204 - protein, 137 aa, Homo sapiens
MWLQSSHRTGLLSSEGLPGDGDSTSKMAHFYGCRQWVSVPRHLLTKTLAYHHEFQEICGHILNGHSLAKPSFSLNGYFLGRCNPAYWWLAGIPSQWVLSCEVPWKWGLQTVAAQPPGFSIFPREPYFWLLVFDSYIA

SEQ ID NO: 927205 - protein, 176 aa, Homo sapiens
MSSTPTSPLSLASSQSPRTDFHWTRLGHMPLPEPITTSSLARPGFHEAPSGSGWGHPLQKDMGKTRKWQEGCFLLKNRDAITTRGIRYRAGTNKSYPRHHHVGVQQVHHEATWLLRKTESQLIQSMRNIPLFGFPPFTPGLAHPKFAWSKASKLPAFYAAQKAENIILLLWLKNFL

SEQ ID NO: 927206 - protein, 124 aa, Homo sapiens
MTTQNSEGKEEWNMEDKKGRSSEGRRKPTQLLMFLIPSHYEDMKRKFQDLLSEENESTALSQVLAQGPLESSRERSIARLGVEFVETGWLAADIFMRTAGTLVHNNRPGYILILALIKIQVYSL

SEQ ID NO: 927207 - protein, 149 aa, Homo sapiens
MAFLGPLSPNGPIYCTNYQSFLRTLYRMGPMPGKTHTSCQWWAVCMHTGLLACGSPTTLTSLLSRRAISASDLLSTDPRSFPPLQVTFHGYSSNGNGPCPKLNHFCKANERPLGYGEERSLSSAKAQAQVTVSHYSRGYKICNSSNYFS

SEQ ID NO: 927208 - protein, 145 aa, Homo sapiens
MCSRSSYTHMEAGQDEDPITDSVFIPVAIFLEKPDECKNYFILIPDIFKQNCINRKYALTNNVNIRCTCGRNKDIKGDTDEGSERKEEDSSASYYCFREHIYRYHNVSRNMNTKGALVGSQLKMRNMLSETERKTVHAMKWQILG

SEQ ID NO: 927209 - protein, 140 aa, Homo sapiens
MTKGLGTASGVPLEHSISYLGITMSLLTTANTLMNNSPPRGLKVGPGSPSFSPIVPKHTVQRHEAQSNPPVAPEFSWGLRSGPLNLLLPPLLATTCINYFRSGHQPVQPVATTTHTHMHRFGPRHCPTTATVITHATFNS

SEQ ID NO: 927210 - protein, 184 aa, Homo sapiens
MGPRIRDWAGDRAVTTGPSSPAGAHVFRFMQVQTGQTNTARPRREEGNPDSDTERRRRRLRRQSRQWGDAATSQGCLEPPVVEDAGRVLLQNLQRQRGPARTSIWDVGLQTAREWTPVVEALCGHPYHGSPGIPQLCPVTSHPAAGEARFAPGSRDCEMWMFCCDVHCYSHAGVLLSLSGFRHR

SEQ ID NO: 927211 - protein, 178 aa, Homo sapiens
MGMIVSPIPQFQAAQHMERDCLGENKGREQESLPHFKRIQKSCFEEETSDLICTVDQMDLIDIYRTFHPVAAEYTFFSTAHGSSSRIYHILSYKTSLKTFKKIEISIFSDHNGIKLQINSKKRFGNYINTVKLNNVLLNDQWVYEEIKEIKILRAASENGNTIYPNLWNTVKAVIKKF

SEQ ID NO: 927212 - protein, 208 aa, Homo sapiens
MGGLTLTSSLCDFFHLCFPRQPLLWDLHSSCAVLWETPPGPWCQQARVANSNHRYSGCPSLQELGPSLAVSSLLPLASWNSKPMGFDAKLLGFHACPSEPASIPPRLHTALCFRPKAMVAELTGGPPNLQVAKIRGESMVSQAVTQSLTASLGCEWGLPSSVPHLDGPSPHLLFLTPCGPSGPSQSQCKNLDTSTQGAEVTCSFHCSP

SEQ ID NO: 927213 - protein, 142 aa, Homo sapiens
MDFRHRACFVLSKPDFSTRWPGADAQRPPVLVVVALDSSLPFTEHHNFTECYQLDSKVSKLKRRISASYQKYCNLTTKDKQGNMEVAAIPEAAPLSMGTEPQKWSQSPLHISSGSALSLSQWVEAGPCEGKGIRCFLASAVW

SEQ ID NO: 927214 - protein, 166 aa, Homo sapiens
MGLIPHGLRSEVHLSVHKCIVGGGTWWEVIRLRGRIPHEWFSTIPLVKQRGPMIDSLQAGNPGMLTQSKSESLRIKEADDVLITLNPMQPLLNWTMPAHSEGGSSLSPQTLTPISSGNTLTDTSGSNASPALQSSLEKRPFENMARKWLSASQGERPYQKPILLAP

SEQ ID NO: 927215 - protein, 142 aa, Homo sapiens
MVAIVKPPEPIPLKWLTDKPIWIESWLLSKEKLDALEKLVTEQLENGHIAPTFSPWNSPVFIIKKKSAELDCEPFAFTIPAVNNLQPAKRFHCFTDGSSNGKASYSGSKACPKARCYQQLNSIYRNQLQRQKQNNWFGGEIQ

SEQ ID NO: 927216 - protein, 136 aa, Homo sapiens
MLSNSVGSGHSCLVPDLRRKAFRLSLFRMILAVGKSHTEEGQVLGIAQEGIQKQACGGRKQLYRGTGGVTALLLLLQDREPSKWAVTSSCFHGKGWGLPVLPWHWQTVMALVGASSGDLRPEVLSLSLPVSCVPLT

SEQ ID NO: 927217 - protein, 288 aa, Homo sapiens
MDAAVTDDFQQILPIEQLRSTHASNDYVERPPAPCKQALSSPSLIVQTHKSDWSLATMPTSLPRSLSQCHQLQPLPQHLSQSSIASSMSHSTTASDQRLLASITPSPSGQSIIRTQPGAGVHPKADGALKGEAEQSAGHPSEHLFICEECGRCKCVPCTAARPLPSCWLCNQRCLCSAESLLDYGTCLCCVKGLFYHCSTDDEDNCADEPCSCGPSSCFVRWAAMSLISLFLPCLCCYLPTRGCLHLCQQGYDSLRRPGCRCKRHTNTVCRKISSGSAPFPKAQEKSV

SEQ ID NO: 927218 - protein, 141 aa, Homo sapiens [sequence omitted]

SEQ ID NO: 927219 - protein, 138 aa, Homo sapiens [sequence omitted]

SEQ ID NO: 927220 - protein, 184 aa, Homo sapiens
MALAQCLTQIIVPILIRIADVQIKKRLSLMYSITKGYIKSQEDAKLLIKQIAVCESIYQKLCEILETNKQDAVKELVLMEHEGRDVVIALKTKQAIRNVIAKALKNLTFLCSRGIIDKHEVIEINKVLLKKLKALNNFPKAIPPPTPDIYLHNIIWLEGKDVLIDFFKREYQPFDVMRIRKTST

SEQ ID NO: 927221 - protein, 140 aa, Homo sapiens
MTLGTFSYTCLPSSAGDESCQDWVLPFKTAVSLLTQGVSRNVVQELEPELGASKLCPVPYSAVVELVSKMQDKVLFTLLSSSRRKKVQTERQRKDDKMATDFTAAWEQQVGTNLGPTLMRWGIGVALRAVYTAFCVRVTI

SEQ ID NO: 927222 - protein, 150 aa, Homo sapiens
MGAAHQHDTCIHMKGSSSLTFIENDLYNDELFSKQKQQAASHQRILGPSPVNPYVADADRICWLAQEALLHMAPIFKPLLVSMCGEHGLLLMDSESLHKEPNSEIHASSLKMKNCLVFLENTAPYTLLWVSVNNQSHPKTNDTQMEFILW

SEQ ID NO: 927223 - protein, 146 aa, Homo sapiens
MTFASAVQKGNVGSKPPFRVPTGAPPSGALRRGPPSSRPQNGRSTNRLHCVPGKAAGTQCQPMKVAWREAVPCKATGVELPKTMGSHLLYQCDLDVCQSSISIVMLPYHSLKETGVCLRPMISQGPSSAIATLLIWQHKENGASIR

SEQ ID NO: 927224 - protein, 166 aa, Homo sapiens
MALGLAQGLWWPLPSYCLYSLKAQWSTISSWQIQPGMRPSSSLSLWPPLPRPTASPPGYCWYSLEAQGLYNQPVVNTAQHGFLPSGQWALLWSRPGPEMLSRSQGLESGTLGSCLVCYTTVAELVPKLQDKVPFTLPSPFVKQKVSLPLVPTAGECSGSPLKPAWL

SEQ ID NO: 927225 - protein, 136 aa, Homo sapiens
MAQIHSICSDNCFANRRKYEAILLKKKKKKDSTLTTKNSLNPAGFLAGDLNLNYYTKGGNLVFLGDLKGCSELKNFQELINQSALVHPRVDVWWYCGGSLLDTLPNNWSGTCALVQLAIPFTLAFYQPEEGKIKHR

SEQ ID NO: 927226 - protein, 133 aa, Homo sapiens
MLSPTSNNSCFGICYWHQKKKESSEVILKPFLLCIFKQRTSPKELLLQNQGRKSNSSHLRVNYPGNFVRRWEMSVRGEDCGEEVGLAFKIPWKEEAKCWKALLPDVHQLITVIGIVKIFSVTPLLEFIYQVFQ

SEQ ID NO: 927227 - protein, 172 aa, Homo sapiens
MPLSQILSSEEAIIEVAADPYGFVAGEWVLQMPRDLLGCGAERVPLLKDLHTGQGSSKSCLVAAGGLRRKPCCSTRGPSEVAGGSRLLVVLESYGGFRRVQGFIRTHLEPASGCHGRERSCRVGFAFSGNALCPGASPQPIRQSDPCLPETHYHGGNRSPDRGRCRRPAGAN

SEQ ID NO: 927228 - protein, 198 aa, Homo sapiens
MESDNVQMCPEFLPSGGFVVSLTSGVKLQTFTAVDGTWCYRAGGVLLIQEARAAREPTTGWEGSGMAGCRSRALPHGEVGEARPRIRVLHGWAGSAGGPGAPSAAAGPGAKPLTAWGWRHWLAAPSAGPAKPVPTLNVRWPASSAGSRLRPRPAQTGDPTMQGWAEALLKHSQSGHGGAESEQKLLARCHLSVRLDSD

SEQ ID NO: 927229 - protein, 159 aa, Homo sapiens
MDYTCTLQGLLTLLGVHSGFVGYSIGPLSPSDSSMVANNWLVLGKSNPKRTYMVSQISGSVTGSPNPPFGLQEKWLTYYGGLLKEIVTRLLTNERRLNKAVTIAPDYGVYNTAVRESEINQIECQNRNSNIPNSFQAFWISPQDTEHVAVMSRSNCRRT

SEQ ID NO: 927230 - protein, 139 aa, Homo sapiens
MFLSTLFTLQLFAYLNLPGCREPSHSPCPDADADACSRCLMQYILSSHNLQKPHAVHLVQPQPCIEPTPVLAPGAGLPCCSSDMPGCMQWPDPVLAWPHTSCHTVPSSTLAGMESGTPSIITKAPFEQSFYYNLDHYYS

SEQ ID NO: 927231 - protein, 124 aa, Homo sapiens
MEDVNVSYTCGLRWGYTRGRREGGFGLGIRVAMRCGCSPGMVREADNLVKMSQPNKETAQEGITKKECIKECCPSWHQSGGVLIGLEAWPSIPTNSYGAYYPQLVFEIINLKANTYQGVNKPRN

SEQ ID NO: 927232 - protein, 157 aa, Homo sapiens
MAAVATNGLPLPSTGSPRSKCWQRLLQHTHGFTTTLLLQHRQLLQHQASDVHPADSNVPNIPSSGWFCNRMPPLRHLSMNSFSQHPKGQFSSNFREQVSSKRCEKRAGERRNERQEGGVEQILLPFRNQGVEISCQKPGAWLTTSYPSSPTLFSSPT

SEQ ID NO: 927233 - protein, 388 aa, Homo sapiens
MQQPCNTPILGAQKPSGQWRLVQDLRIINEAVVPLYPAVPNPYTLLSQIPEEAEWFTVLDLKDAFFCIPVHPDSQFLFAFEDPLNPMSQLTWTVLPQGFRDSPHLFGQALAQDLSQLSYLDTLVLQYVDDLLLAACSETLCHQATQALLNFLATCGYKVSKEKAQLCSQQVKYLGLKLSKGTKALSEECIQPILAYPHLKTLKQLREFLGITGFCRIWIPRLYYLKGQCCNCALVQLLTQSHFFQTMKIEYNCQQIISQTYATRGDLLEVPLTDPDLNLYTDGSSFVEKGPQKAGYAVGTPITHQEAIRRLLLAVQKPKEVEVLHCWGHQKGKKREIEGNCQADIEAKRAARQDPPLEMLIEGTLLWGNALRETKPQYSEEEIEWGTS

SEQ ID NO: 927234 - protein, 453 aa, Homo sapiens
MSIRTPPRLLELAGRSLLRDQALVMSTLEELPTELFPPLFMEAFSRRRCEALKLMVQAWPFRRLPLRPLIKMPCLEAFQAVLDGLDALLTQGVCPRRWKLQVLDLQDVCENFWMVWSEAMARGSFLNAKRNKTPVQDCPRMRGQQPLTVFVELWLKNRTLDEYLTYLLLWVKQRKDLLHLCCKKLKILGMPFRNIRSILKMVNLDCIQEVEVNCKWVLPILTQFTPYLGHMRNLQKLVLSHMDVSRYVSPEQKKEIVTKFTTQFLKLHCLQKLYMNSVSFLEGHLDQLLSCLKTSLKVLTITNCVLLESDLKHLSQCPSISQLKTLDLSGIRLTNYSLVPLQILLEKVAATLEYLDLDDCGIIDSQVNAILPALSRCFELNAFSFCGNPISMATLENLLSHTIILKNLCVEVYPAPRESYGADAPPQDQHPHQHRAFITTNEPQGHIIITQCP

SEQ ID NO: 927235 - protein, 153 aa, Homo sapiens
MKSKSKPVVEESSSTEALAVLQPCVPSGRAGSPPAKRNPWASGDPGGPDQCSPVVGADAWAHHRRARPDVPVRAADSGRCWEDTLGVPAVKRVPEAQEHVAEAGGPGPGVCRPRSCPAAEGPGYQPACHSVCPSVPVLTHSSRETFPISRVVV

SEQ ID NO: 927236 - protein, 2746 aa, Homo sapiens
MSMRVASHGLAVLFPSWDTCNDYNDSRSLQESYVRDKHSEASWSVLESYVRDKHSEPSSSVLESYVRDKLSDPRSRVLESYVRGKHLDPRSTVLEYYQCSGVLCDEQTFRPQQESSGILCEGQTFRPQQYCSGILCEDKHSDPRGSVLESHVRDKYSDHNRSALESYVRGKHSEPCSSVLESYVRERHLDPRSSVLVSHVRDKHSDPPSCVLEFYVRERHSNSSSSFLESDLRGRHSDPSSSVLECYMGDKHSDPSSRLLESYVGDKHSDNGSSVLESYVRDKHSEPRSSALESYVRDKHSEPHSSVLESYVRNKQSDHSKVFWNPFNVLESYVRDKLSDHNRSVLESYFSGMLRDGQTFPPQQECSGILCEGKHSDHSRGVLECYVRDKYSDTSIRLLESYMRDKYSDNDSSVLESYVGDKHSEPRSVVESYVRDRHLGHSSSVLESHVRDKHSDPNRSVLESYVRDKHLDRLSSVLESYVRDKHSYPRSIVMESYGHSDTSHSVLESYVTEKHSDHSSSVLESYQCSGILCEGHSEFHSSVLESYVTDKHSDHSRSVLESYVRDKNSDPSMNLLESYVRDKHSDSHSSVLEYCVGDKHSDHSRSVLESYVRDKHSDPRGSVLESYVRDKHSDPHNSFPESYGKHSDHSRSVLECYVRDKHSDTRSRLVESYVRDKYSDNGSSVLESYVGDKHSEPRSVVGSYVRGRHLDHSSSVLESHVRDKHSDPNRSVLESYVRDKYSDPLSSVLESYVRDKHSYPRSSVMESYVRDKHSDLRSSVLESYCSGIVCEGHTFRPSQQCSGILDEGKTFRHQQKASGILCEGQSFRQRQQCSGFLCQGHSEPRSSVLESYVKNKQSDHSRTVLESFGHSDHCRNVLESYVRDKLSDPRSSVLESNVGYKHTDPSSSVLKPYVRNQQSDPHSSVLEFYVRDKHSDSNVVLECYVRNKHSDHSRSVLECYGHSYHSLSVLESYVTDSHSDHSRSVLECYVRDQHSDPCSRVLESYVRDQHSDPRSSVLEFYVRDKHSDPSSSVLESYVRDIQTTDTVFWNSVTDKHSDHSRNVLESYVRDKHSEHSRKPSSSVLEAYVREKGSESSNTVLQSYGRDKHSHQSRSVLESHERGKHSDSSSSVLECYVRDKHSDHSRSVLESYVREKHSEHSRRLLETIVKDKHTDLCSSVLEFYVRKKHSEHSRSVLKSYVRDKHSNHSRSVLESYVSVKYSDNSRSVLESYVRDKHSDPRSSVLESYVRENHSYPRSSVLESYVRVKISESRSSVLESYVRDKHSVHSSSVLESYVRDKHSDHSRSVLESYVRDKHSDPGSSVLESYVRENHSYPRSSVLESYVRVKNSESRSSALESYVRDKHSVHSSSVLESYVRDKHSDHSRSVLESYVRDKHSDPHSSVLESYVRENHSYPRSSVLESYVRVKISESKSSVLESYVRDKHSVHSSSVLESYVRDKHSDHSRSVMEFYVRDKHSDHSGSVLECYLKNKIQNPAAVFWNPMSVLKSYVMNKHSDHSKSVLECYARYKHSDHSRSVLESHVRYIHSDPRSSVLECYVRDKNSHHSRSVLESYVMDKHSEHSRSVLKSYVRDKYSDHRSVLESFVKDKRSDPCSSVQESYVQTFRHQQKCAGILCEGEHSDPRSSVVESYVKDKHSYPHSSILESYVWDKHSNPHNSVLESYVREKLSDHGSSVLECYMREKHPDPPSSVLQSYVRDRHLDPRSCVLESYGRDKHSDPRSSVLESFGHTYPSHSVLESYVTDKHTNNSRSVLESYVRNKHSDPSSSVLESYVREKHSYPRRGVLESYVREKKLRIQEHCSGILYPSSSVLESYVMYQHSDACSSVLESYVRDKHSEPTNSVLQSYVRDKYSDPRRGVLESFLRDKCSESSSCVLESYVRDKHSDQCRIVLESYVRDKHSDSNSSVLECYVRDKLSDHSRSVLESYSYVRDKHSEAHSSVMESYVRDKHADLSSSVLGSYVRDKHSDPRSSVLGCHVRDKSSDHSRNVLESYMKDKHSDSCSSFLESYVRDKPSDLSSSVLGSYVRDKHSDPRSSVLGCHVRDKSSDHSRNVLQSYVKDKHSDSCSSFLESYVREKHSDPSSSVVKSYVRDKHSDPPSSVLESYVRDKHSDPPSSVLESYVRDKHSDPHSSVLESYVRNKHSDNCRIVLESYVREKRSDPRNSVLESYVRDKHSDQSRSVLESHVTKKLSEHSRSVLESYVMDKHSEPSSSVLEYYVRGKSSDSSSSVLECYLRDKHSDHSWSVLESYVRDKHSDHSRSVLKSYVRDKHSDHSRSLLESLVKDKHSDTCGSVLESYVRDKHAEHCRSVLKSYVRNKHSDHTRSVMENHSYPRSSVLESYLREKNSESRSNVLESFVREKHSVRSSSLLECYVRDKHSDRSRIVLESYVRDKQSDHSSSVMESYSYVSVKHSDNSRGVLESYVRNKHSGHSRSVLESYVRDKDSDPHNNVLDSYVRDKHSDPSSSFLESSCSGILCEAHSDPSSSVFECYVRDKHSEPSNSVLECYVRDKHSEHSSSVLESYVRDRHSHNSRNVLESLVKEKHSDPCSSVLESYASDRHSEHSRSVLESYVRVKHSDPRNSVLESYVKDKHSDSSSSFLESYFRIKYSDPRSSVLESYVRDKHSEPSSSVLESYVREKHSDNSRSVVELCVRNKHSDHSRSVQESCVRDKHSDPHNSVIESHMRDRQPSSSVLESYVRVKHSDHSRSVLETCVRTNIQTTAGVFSNPI

SEQ ID NO: 927237 - protein, 174 aa, Homo sapiens
MEHRCFGVARGSGEGENHCLPTYLGERARASTFPEDCVSHVYTLRQSQTCASGARVHLEEEQPQLLQVIKMRRPVHEDDSGQEFTLGQLELLGLQWVGVGEGSAGGREKASPNFSIMVGAEHRAAQVRAPTSSNRSQKLLQEQQKAHQRVAQQDRFFPETSVYTIRLPSSDHHD

SEQ ID NO: 927238 - protein, 120 aa, Homo sapiens
MKDSETLLVEVEPEKPIAGSNQLVRGSPDLCPSEQCGLISFRYAVFAGVSMLRGESGGDENSLEEDFFLSIVLISLHCYKEISDTKEFIKKRGLLGLWFCRLYAKHSASIHSCFFICQMG

SEQ ID NO: 927239 - protein, 142 aa, Homo sapiens
MESQGQMIKRPHHRQYTEVYLEYKLGASTHSATDCSSHAAWGGTNTVGSLILDSKPPEPCDKTFLLLKPLGLWVCGTSEATFSLNVTQAYPRASGDCELLSNTFAWEKRVHLAVGQPRWGGTVGIILASGPASSSWALLSDL

SEQ ID NO: 927240 - protein, 119 aa, Homo sapiens
MHETALIGCSFQQSLVIPGGLVLLGSFVLVSSGRNRRLASHFQFSIRVTSFCQQAGNANSFRQQAHHRDFPRSSKSGDSIEDVASPSARTVGPDLCLQGWDEAELALGAAQAVAKGELT

SEQ ID NO: 927241 - protein, 302 aa, Homo sapiens
MCATLVSTCLLWTTGYISEENGLTKQVPLERKTTDETHKMVKKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHNAEFRMVEKHSAEFRMGVRGQQGLPFYIRCLEKSSQKRGRSSKVVNEAGRRVCGELTF

SEQ ID NO: 927242 - protein, 153 aa, Homo sapiens
MKRASFPFTFRHDCKLGVDTEMHHPGSILGGLCCRAAGSVLADRPRLKLLQRQAQQPNCPAPGLIFPGQPHPGTEQGRGTEATRCWATCSRAPGLALITKYSIDSFACQGMERLPRVLKDAVRALALPMEPVCGLSHRSYEAPSFGPKHLTGI

SEQ ID NO: 927243 - protein, 460 aa, Homo sapiens
MARDYRVTRGNEASRGVSMFVWRNVEGHSVAVFPWYSIPFLTPPCSHMRPSNLPVTQWPPTRENNLPSWQLLLISVHQMMSGPVPQCLRKEQDSSSEKDGRSPNKWDKDHIRWPMSAGHDLQQAAPGPGRAHQGHPNHYNRTISQMLSERWYTLGPNETQKYHDLAFQVKVAHLQQGPKEVQLRGQAHKPGASRIAAQTLQSSDTKEQLLWGRTAAHSQETWLSLAQAFSHSGVHSLDGREIDRQALRELTQVVSGTASYSGPKPSTQHGAPGHFAAPEGNKGFGGKVFAPVIPSSFTPAAPCWILSPQGPPIHLQLLAKSMVPPCPPPTHTRMLPPQPWHPPPSYWAQEPSKPRSLVKAAERAPYDPYPWGWGPRDAFQGDLFPPNGSCHLLVEKPRTGSGNRRPRRRCPLHCTRPGPVPALIMQLFQAHCFFLSTRPQLPSRPTMHTSSPPRFVLPLP

SEQ ID NO: 927244 - protein, 143 aa, Homo sapiens
MVQGFKVNKFMLNSCEEKQRKGWGEGAHGGKGGGCTRRISWERIEKYARDFKESLLQYENVTFGYQQRPHYSKRLCMPDGYIPEAIKSSKKKLSYQNSDGPVADCTFPEFHIIHSQKGGENFWSRLVEEMVSREMGARSQVEG

SEQ ID NO: 927245 - protein, 461 aa, Homo sapiens
MQWSPTPGASACLGWASSLACSTAPTLLGRAGRGPLMAAKWFKEFPLNLKTVSERAKPGGGGGKLRKNSEAGGAGPGPGKGRKNSAAELGSGRAGVGPKDSRLSRDSLQGLIQAAAGKGRKNSRATEEEPHRGATKSSGCSTYINRLIKVDTQEKNGKSNYPSSSSSSSSSSSSASSSPSSLGPELDKGKIIKQQETVIILEDYADPYDAKRTKGQRDAERVGENDGYMEPYDAQQMITEIRRRGSKDPLVKALQLLDSPCEPADGGLKSETLAKRRSSKDLLGKPPQLYDTPYEPAEGGPRAEGKARPPDSRLPENDERPAAEYEQPWEWKKEQIVRALSVQFEGAERPSFREETVRQHHRQKSWTQKILKPALSDHSEGEKVDPGLPLEKQPWYHGAISRAEAESRLQPCKEAGYLVRNSESGNSRYSIALKITYGSPQAMPLYVRSDSHGSASSPSSH

SEQ ID NO: 927246 - protein, 127 aa, Homo sapiens
MRNSSMRNCIKTSKYNILTFLPVNLFEQFQEVANTYFLFLLILQLIPQISSLSWFTTIVPLVLVLTITAVKDATDDYFRHKSDNQVNNRQSQVLINGILQQEQWMNVCVGDIIKLENNQFVALISSE

SEQ ID NO: 927247 - protein, 162 aa, Homo sapiens
MEARKSCFADELPSCHTGRSARSLDVGGGGGGLPCCAKLAQIQVRLAGFVQFYILFRPPLLFQLSPPKDHLRLPPHFIALLFHWEAHRGPGWALGTGPLEVPQEVHQPPGSVLSSWGAPWPCPCTPSGSWSLGPDSRTSTGSHTVKAKQGQACVWVYVNPCK

SEQ ID NO: 927248 - protein, 327 aa, Homo sapiens
MSVSSAPETLPGPGNCICAMGHYHHEHRHHHDHDLYHCHHYYRHHHHHHHQTMITTLMTTTIIITIDSLIPHNRRYHYHHHNYHHDHHHHYHQYHQHHHTCTTMSSIATTTMITNITITTMITTTTTIATITTAIITITTTTAITITITMTTITIITTVTTTTTIATITTAIITITTTIAITIIITMTIITIITTVTTTTIITMALITIITIPTITSLSTGTSTPTMIITITTTITTLINTIITTTITTIITTTITTITRMTVTIIITAIITTIIITIYHYHYCYHHHYHHCHPYHITTTTMTTTVTTKITTTTILINIHITICYHC

SEQ ID NO: 927249 - protein, 133 aa, Homo sapiens
MATGPEFKCVCKKDTRGAPETGCKPPPASVQHTSALLADSVPNVGTFEMPTLGVVKNQLLLGWHSEDCALEELLCEPHAPGFNKQREAAQAVLKGFPLLAVLGSTLDPIIPVPIASSSAGLRFRNPREQGSST

SEQ ID NO: 927250 - protein, 170 aa, Homo sapiens
MIPTHNSLARASLMATSNFNVARCTILLCTQQRTGPHYPLGRATIILDCHSSLRDSTFALYGKSPLSSQRDLVPREFGRPGRSPNSPVGGMLLEQLHWTDEQIEACRKREGSGSPYYILSVGLGGYPGTQDCRLPTPCPSSALSLPGNSFCPEDGGPTGLRLWAVPSGSQ

SEQ ID NO: 927251 - protein, 144 aa, Homo sapiens
MSLLPAGRWPAQAWKLALAVILTCSTSCPALAPGRASPALHHVWRLLALGLPICLLLQLPGLAAADQGQNEASACSSGPRGTGKQRPWGVPGSGVHTGVEAETSLPGNVHHQSSNVGKSVGFRAADLGLNPGFTTLLCDFGQIA

SEQ ID NO: 927252 - protein, 182 aa, Homo sapiens
MALCEVLMFVGSPNSPVGGMLLEQLHWTDEQIEACRKREDEKTPAAPPGPKGTLFIFTHGGLLHPQGLLTKIWDPGAMPEAPLLPEGSPRPSATLPGWYHILPQPCILGPGTKWVPRAESLGHRFLLNPPAPMLAMMLRIDVCVLAGAAPKLGIATACGGLCAPGTTLLCPVHIHQDPQSPV

SEQ ID NO: 927253 - protein, 170 aa, Homo sapiens
MSTQKLVGWLLLFATENTDCSGNGAVGGYGDGTSAGGEVGGNSRPCSHTHSHVHRLTSARSPRVTIHRWLPRKDNTRPLRICPGSALIPETAWALLPGYAEGPGPPVFLCSECVCTQAPTGPPVPMSPSLNGVAAPKRAVLKGGHTSLTCPCKPHRGQRVLDTRLTDNTT

SEQ ID NO: 927254 - protein, 391 aa, Homo sapiens
MHCKGHQQATTSVALGNSQADSEAYKAASTQYRASVTAALLPQAPDLVPAYSKEERDFFQAEGEQAIKEGRIQLPDGRVAVPQLLGAAAVLAVHETTYLGQESLEKLLGWYFYISRLSALAKTVTEQGVTCRQHNVRQGPTVPPGIQAYGSALFEDLQVDFTEMPKCGGNKYLLGLVCTYSGWVEAYPTRTEKAREVTRVLLQDFIPRFGLPLQIGSHNRLVFVADSVQKTQKIRCTPSKRTGYSPCDRVWIKDWNVAPLQPRWKGPQSVILTTPTAMKVEGIPAWIHHSRLKPAAPEAWELGYTGYVDTEPMPSYLINGQAVFVIGTIKTSFFPAAGKNSIPQQPYRKRPNCYISAHSYISLLVGFSIPGPPATHHQRYQASSSSGPWGN

SEQ ID NO: 927255 - protein, 157 aa, Homo sapiens
MGSCAAQASPTSTTPCSPAPSPIDYPRAEECERMARDWQAPPPAAPAWDPLGEASWAPESAVALTAKICSFTPEPSETTSPPGGTNNSRLAALRAVTLTAKVCSELTRRKKLRTHLNIRRDRLQTRHLKSCNTHRKDCKLHEANYPICVVHHSKANT

SEQ ID NO: 927256 - protein, 214 aa, Homo sapiens
MTQVLLNGFSFKRETKHKSLEILQPDSVIEKKIPFSEEKFKPAAEICISNEEQNVNHQDGEENVSRAYQRPLQQPLPSQVWRPRRNWPEPGSLCCVQSRNLVRCIPAAPGVNKKGKALLKGNVGWVPTHKVPTGVLPSGTLRRGPLSFRPQNGRSTDSLHCVPGKATDTQCQPMKAAGRKAVPHKATGTELPNTMGTHLLHQHDPDINNILIIV

SEQ ID NO: 927257 - protein, 157 aa, Homo sapiens
MHFLPSEAHKTPNTGDWRDSMTTCQQRGATHSRVSSLLKAEHSSRHLGGAKELSSPSQGCDTLFGALWFLVSPTCHAPLCSPVPAVEDAYGAPGPAATLQGASVHAGTWSCLSCCSQCAWVCTVAGSHAHLLTYPSPLCLPLAGRGPGQRNSFKEQP

SEQ ID NO: 927258 - protein, 138 aa, Homo sapiens
MIVTFYHEFVGFCEISTATLPFHHLHLGQSAAINIDARPSASKKIMSLKLSDFSGLSWTYTCYFYPAVSQLLVFFWLSVGVTVIASEDLNGSCSCSFLQAVSQTCSLRSHSWASKSPEPRCGAAPGASLTHQRVPLAT

SEQ ID NO: 927259 - protein, 140 aa, Homo sapiens
MQSCLTPDTRHLTPASNCLTRKLHHFTFHLLENKGGSARDSGNGEIAGATTDTEDRTHSQQQEIDRRKSRQMANLHQGRVSSEQQVCWQRRQIQHQEPGWQQTESISEKSDNSSFGGPHFHSYRANTDTTLPFMHTQGDQ

SEQ ID NO: 927260 - protein, 152 aa, Homo sapiens
MFLVQSAELIVLKQRPEKRQGHEHQNAMPFLDVQKRFGLNTDGWLTIQSAEQPYKIPARHHPFEKEWRECAHGIGGIWGEKECRIEYDYFIECILWQKMMRCNGISQKGAAPNLKHNPDFNLSPGKKRLNKATAVDYGCQYVTCLLHQMKIP

SEQ ID NO: 927261 - protein, 176 aa, Homo sapiens
MLGEPPLSSELSGMFKFADISAAFCSAMPCLQSWRLQSQQVLMSCSGLHPVRASLGLLCLPTQASVMANAPPPARLLPRRLISDCCASSKQGSVGLGSAEPCAGYNLLVCHLLRQLEKHGIWAGVSIFPGAISHGFPCLGKGNPPTPCASRKEYELNMVNNVIWSGEVKRMETEKG

SEQ ID NO: 927262 - protein, 139 aa, Homo sapiens
MDQSAGCGQRQENKSWPPEPAAATRSGPLPCCGSFVLLLFTVNLAAAHSLGVTDTPSLRAVSLTTKVRSFILEVSETKNPPEGTNSGHTTRRKSSLRTHRKDAHEGDTRLASQISPTNPGNQWGNRCHSQSDVTSCIFY

SEQ ID NO: 927263 - protein, 145 aa, Homo sapiens
MLGRKDEPYPCVNLCSRDTFSRDADAENSTGKAVSKCMYNSPQLCGRDPVVHQEPTDPLWLPESEQILGYVYGVFGDAAIQGLRIPGPDARWPVRERKRETERKKEDLTVAPGNPKEIPEGARDCKLLKKELCNSTLTWNLHMTI

SEQ ID NO: 927264 - protein, 157 aa, Homo sapiens
MVLTAANVKYNCAHQIKGGSAFHTPLTQMLISFGNSHTKTYPGFILYIPQSNQVDTQYFTIATSMVKPPAFSRVNQPIQLDLLVVTWLNVPTVAADIWLSWWPPRYFFSHVLRRCEENVLLWRHRKSYPPLLLHNPCNSQQNEKDMTKGKKSSKYEK

SEQ ID NO: 927265 - protein, 164 aa, Homo sapiens
MISCGWGGCAVNPSCGTLPGEDQDGWGSHGEDSLASSPYERHRRAANGKVQPGVGLLEQGVRGSQERETGLLSVWWLQCAGGASKASRFFVPQPKGSKDGTTAAAMAEKVCGLSLGIPLQRKAELPPTEVINLTAVGMGPAAAQQRLQSCWLPLGAPTQRNAEL

SEQ ID NO: 927266 - protein, 166 aa, Homo sapiens
MGRKAGETTCNINNAFGPGTANERTSLAGPRRSSKALPKAKLAPEKGHGHCLRSAAGLIRYSFLNPEETVTSEKYAQQIDEMHQKLQHLQLALGKCFHNQQDAENAFQDPVPQIPTGQPQPEARGLGSYSVVCSDQPPGGSVEQRMENGAEVANRSQPNSVKLNQT

SEQ ID NO: 927267 - protein, 168 aa, Homo sapiens
MGVGRSFGIAVEGRRCKSQTLWKGRGHSQRTVCSSHPAAFKWVWPACATPSKEVYEHLPGISFCEINPATLLNLATPDLPPLTLSTLTSTEPLCPDDPFGHTSLVSPLLDLTPVISPFPDRHLTPRPSKGKGAMATCRPSRHTAAYGVKREQCEATQKGAESQRKNKF

SEQ ID NO: 927268 - protein, 167 aa, Homo sapiens
MEQGAALIWEAGAAQEPTESPALPRGKAAKARREIERSGCGPALLGDPAHPPQPLARVLSSSLPRAAGPAAAPSAGLAKPTPTRKSSWPASAPCSPGCRSRLSLHTSLQAEGAGSGLGQPRKGLPQCSGGLRGSSSAAKVGAQAEEAPRASEGCEDCQHAVTFHYLH

SEQ ID NO: 927269 - protein, 140 aa, Homo sapiens
MGHVSNSGPAKPSEGILEEGIVIIGDDSSMPVFAPEDLPVGQEMEVKDSDLDDPDPGDMDEAGNHHSQQTITRTKNQTPHVLTHRWELNNANTWTQQEEHHTLGPVIGLAGWGGIALGDIPNVNDELIGAAHQHGTCIPM

SEQ ID NO: 927270 - protein, 143 aa, Homo sapiens
MALPQEESPGDVSFGSGLVCPSSPQSVLRATKGKAICSRPCLRLPVKTSTCEQLDKFTPREPFVGCTAQATCSFLGESQLTLHLSPPAAGYNSTHFEPLSRGADGGSGIRISHHNGSAGKQKTNVSGPLQVSTKKEVKKYDTG

SEQ ID NO: 927271 - protein, 169 aa, Homo sapiens
MVLMGSELICEVHSGLSSLLSSGVGRGVQDLCVGTVGQLRLLIQASRCPKCLEICLSVEQIGPHRTKISGQQAKILEPKRLPSSTCRHTSGCSVTAEGILPQHPAGTHADRFQVTKLALAASLVSREKLGPAKRNKHSQAIRTAVPVSNNSHGSDEPVTAAALAEKAVK

SEQ ID NO: 927272 - protein, 139 aa, Homo sapiens
MVVKVVGNGSCDRDSDRSRDGSGGGGVRGGGGGGGGEKTEVEVEVLKVVLEVEEVMMAVEDSFRKFDDIENPKEKGKTITQNCSEVTTTYLYHEPIEEKMEWLYMLMFGVGERNSQRDSQIFKILRHTHSYSDLPVCSS

SEQ ID NO: 927273 - protein, 135 aa, Homo sapiens
MRRRTNRFLCYWGSLLPELPRWWRATSKMAASFVFSDLGFLASWIPMNGIFGHVDEPRHLAVQEQWQAFSPIGSGSRCLSGSGAQRTPCRIRRNGSQRWVCDGGKQQWWTVSESSAQAVTNTDQKSAAARFNRVK

SEQ ID NO: 927274 - protein, 142 aa, Homo sapiens
MACWYLLVPVGVLFSSSTCPAAHLEKRSRPFKGEENSNSTNAMMIGEDAPGAGKTLIYSMARGISPKVKWELHFLFRGCQGAQRALQSLLDSWSRDLVLLKCLHLPVLWLPHLQAIYFTLEPRCLLPLADSKDTISPKGFEE

SEQ ID NO: 927275 - protein, 147 aa, Homo sapiens
MNHCCLDADFGGLLMVVLAETAVKFGLHGVFEKSKFGTFGKDWRLGHCWADATGIEWVAKLVRFLKVDQEFNVEYFCSPFTISQELHKQLCNAQNTRSRSASCQQTYLYTPVIFPFHLACKFSIEICCIFFLHPTHSYTPVSCTAPF

SEQ ID NO: 927276 - protein, 147 aa, Homo sapiens
MLGGSLQSLVTSDFPGPGGITSEGCKTAETAACPSLWDLGPREGGPMLLPWLAGIPSKWILSCEAPWKWGLQTVAAQPPGFSLFPEICYGDLTSCFARVAATFARKPEEHEYLKLPGICACLSSCSAETPWDSMCQTEGPGGMGFLT

SEQ ID NO: 927277 - protein, 179 aa, Homo sapiens
MRAGDDKLLNGFSGSSGAHSLGTRRLPNPIHYYWYFLPNPIHHYWYFSWETEVGLNYQAATITAGNYLADHLDPEDHPATDTANFQTTPSAQGHKNPSTRLTPCCYYWHLSKPPGGPRISLPGPTNIGASTHHSGTQGPTCLAHHCHHWSLKTSSPAILVPSKTSPHPPLSHQENYRYH

SEQ ID NO: 927278 - protein, 143 aa, Homo sapiens
MSNGKKLSASDLTNGVDEILATSSNLSTMAPGWRPRCEGGISRRASCTRQKMDKMIFRGASHAAIQCAGAELIGNPFQDLRNRLILFRLISIILDRGSSSCLDLGAFGHVNNKAERLQGYAGAVRTPECPLRLSRVSERLRTM

SEQ ID NO: 927279 - protein, 161 aa, Homo sapiens
MINLIDIPHPYPHTDTGVWNVKHEENVYSVKKKMYLLEKEEGAVWFTTGSPQCIGFMKLRNAVLGLKAGTCCSVTHFGFTPSFIHSISNRYLRNACAWCKGHNRHVVPADLELSVLIVTMSAHPSVGRSSVQSRNCHSGVQSRDPGEDSRDFERLGKGRIS

SEQ ID NO: 927280 - protein, 249 aa, Homo sapiens
MGDMPTLAEIHVFTVQLAQLGSATQQSSNVEFQTAASIKAHFQDIDVESGALVVVYQEVYLISFQSTPNGEHRCCQELMKLDSHLAPSDQTLLDNFACLETGGSYATSLGLVYGCSGKGCVWSVDLFPAARFKKFATENEAWAFVRKSASPEGSEGQKNKHVQESQMKASKGLCEPLNGDGDESAESCAKPVKQIIEPAPRVMNKKDFVALEKLSQGMDIQWILVPGHPGCIGNEEADRLARGAKHSED

SEQ ID NO: 927281 - protein, 141 aa, Homo sapiens
MGYSHCTDDLPDSGMGTFMAGEFQEVLGPVALIQDKAMGPEAPLDLEPSPFREVHPLIHNEAWHTDGSSQGATAAWTALAVQPNTDTIWFETRRGQSSQWAEPRAMCMVITKEAIPIKWLVTSPCGAKSCGKTYKREDDLL

SEQ ID NO: 927282 - protein, 160 aa, Homo sapiens
MFEFESRNKCLSQLKSSQAGGIPSYSGDVVLSFQTEPMFILRMLINVSCLPRMYESKLCSDHLGHMSSERLETVSRARILNAGKINSKLTETCLEICLSVKQTGPPAPRSLNRKGWWVRLPIWSPGLGKIKVLSFSLSCLDPQWKGPSAAGLLDFAGDPL

SEQ ID NO: 927283 - protein, 221 aa, Homo sapiens
MGVNLSGMAWAIPLVITSRSRKLPQSPAATALKTESSTEDKEQEEKSGEDGEKDTKDDQTEQEPNMLLESEDELLVDEEAAAAALLESGSSVGDETDLANLGDMASDGEKEPSGTVKNDASASAAAKKKLKKRRFPGSMEGFLTLDEVGDEKDLELQELRKSGMAFKSGDRNDDGLVEIKVDKMEEFNQENEAALENGIKNVENTEPDVILHFCILKTFWP

SEQ ID NO: 927284 - protein, 169 aa, Homo sapiens
MKQGAALSLFPILPPLLIGAQSLEGAETAGVWHVSATLSMCTLDQVMMAPGLGYSFASHWSRLLEPGEAREQEGALPSLWGAGQASWAPDSAGKLGCSATNGQLQLCLGAWGSCLSDLVGGRTPMGSMGHAALDTPPLLQPTSLQPRPLMGCRCHHLYLIFSNISGFLC

SEQ ID NO: 927285 - protein, 141 aa, Homo sapiens
MISLIIGIRGDTEIRSVPITLHLHAMFKTHYPISKSNSSQYLINALLRIPHLVGIGLPIISKMSRLNRLMEDSQGLGKVTRIQIPSRARTNITLFLESKWEEIYISHENDPSLRRVWLQSRKIQLHGHKNYYNILQSQNYV

SEQ ID NO: 927286 - protein, 145 aa, Homo sapiens
MAKRGQGTVGAMASEGSSPKPWQIPQGVESAGAQKSRIEGISWSLGCKNCEKSIGKSIVSGPDSTVPHSTVPHGFPWLGEGIPQPLALPGNGLVYPENKKNTRMSPLATPIQHSTGNPSKSNQTTERDKKHTNKKKKSNYLSLMI

SEQ ID NO: 927287 - protein, 183 aa, Homo sapiens
MFLIASEELPLKFNIGIGIGSASLNLGNFYGIYCLQVDQAQPTERASQPFQFGHLYLLLQKLDCLLVIVCVLYSHEKLEFGKVIFFCNTVWPRYCLEFWSLLLNGKDRWSCIYPGFCAAVLSRVRPAYYAMFSFGVVRPLCSFESGEVWPLKIKLETALPKILVHSLNWITYWGKQSKTENCH

SEQ ID NO: 927288 - protein, 140 aa, Homo sapiens
MAFWMTFLDLPWARGESSTLRGASQSWQHSPQAELRVLRPYGNISGSPAVLLMAGSGDVHRAVPQCGLHVQAPTPQLPSVLALYEGCVPVTGLSLDIQAFSYILLNLGRGSEASTLSLCPPTGVKPHGSLEGLQPPEEEP

SEQ ID NO: 927289 - protein, 138 aa, Homo sapiens
MSLIILECVRKFETAEGSVQDRKMQESLELLRDFLNGFDQNADSDMENEVQAAVFSEGDEELGGNWSKGHSCYALAKRLETFCSCPRDLWNFEIQRGAVWYQAEEVSKQQSVQDITWVLLKAFRFIYSQRRFEIGTYV

SEQ ID NO: 927290 - protein, 141 aa, Homo sapiens
MCVNANLPQCGMCKLCDDQVGETKINVHRSGDQREELHKKNSRDLQKVPSSIQISSDQCTGVRDMDEAGNHYSQQTNTGTENQTVNVLTHKWELNSQNTWTQGGEHHTPGPVGGKPSIGEDVEKREPLHTVGGRVNGNKLL

SEQ ID NO: 927291 - protein, 147 aa, Homo sapiens
MARLKLDFPAQPSLHSLLLCVLPTSLRTLWYEIIIRKYFVSFRYSSLRASVDEKNWSCFLCYGFSMEAFPVVSNLLIHCQEETNETKGKIRVLLKHRMNEFGAGEIVNKWVPSCREEETHQAIFGSFIRHTWYPVWLEHTSNPSLYE

SEQ ID NO: 927292 - protein, 161 aa, Homo sapiens
MLQGSRAAPNPARSSPEKHRQLSLHTIPQNFRHPNALPLFPFIFHINIRRQECQASKPKLSHHIPCDLHLHIQMADADSTLGEVEISGHRCCVRNYHWATESLEEPASASKTGSYPVSNLYTTLGPGGKELPEIITSNSKIRANSPRKANVKKEMNGLKNI

SEQ ID NO: 927293 - protein, 131 aa, Homo sapiens
MWTAKTQNPRPAFLPSGCGAGLSLEWGSYDLQSNKVDQNSYVEAPTLNVTVFEDMTFMELTYVSRSFQYRKYDLRIIVHAKCYTVTKMMKRIMFLGSHVTGKLHSAASASVKQPVIAQLIRSAFPSLTNPS

SEQ ID NO: 927294 - protein, 136 aa, Homo sapiens
MEPGQEKELEEEEELEKEEEEEEKEKVIEEEEVVKEEEKEEVVVEEVEEEENEENVSGEKLDHWKVTDILQIPVGKPTTAQPPPGNRVIILVISKWYGIVTFSQKCATEITYKAFLKMQVSGLTSDQLNQNLQENS

SEQ ID NO: 927295 - protein, 143 aa, Homo sapiens
MRWALKEDLAMCDDADMTRAKGTFTLDLGWDSGQGVLAPSGRRAAGSVSYIERTKIRLEAHFHIPIEDDLLLLLASLEFRECCPSRLLALLFWKEGSKRGPPWEPWPCSAGEGQTRALSRARNALLLRDRLLLSGGFHPAAIL

SEQ ID NO: 927296 - protein, 132 aa, Homo sapiens
MTLVPLSKASWAYSCGAASTTRAEVPKLMENTGFLGFDIQCYRKANPALSTIASIVKGGRRTGFLSFSVDQHWKLGMSLIYSSLVFHLQHGNHENTYGLGVGSVETVHAKYLTVEIMNKAAGNIPVQVSVWT

SEQ ID NO: 927297 - protein, 119 aa, Homo sapiens
MEIIEKFYYLPTTLIPVPLWPGLSPAPRDWGTWLFPVALKPVDGFQISVAIVSMATAAFSSPTSVVLSDNGFQKNSQELDLRYVGISNLCRRDLLPSCDTHSIPGTLSIIKLFFMLSPI

SEQ ID NO: 927298 - protein, 152 aa, Homo sapiens
MEYPGSSLLKLDENIGAFLGWILLPKMRFAWRLKEMVFIRKTNNCNSGTLDQGSSEEGPNSQCRRVFLIGDICKKLFSEAVIGQAEILNDKPVLIGQLVRREVIASQVLPPAPCLYPLGLRCFGCRRELLTICSAPSGWQKLEACHVTQSPQ

SEQ ID NO: 927299 - protein, 148 aa, Homo sapiens
MGNELNECMVPLKDKELSFCGIQRTQHETWAMAFRVSLRTATPPVHRLCCIREAAVTNYPKPGGGKQLWRTDISIQSEGVKVKVLAGLGPSGGSRGDSVPGFFQLLVAPGVSWPDATSLHHSGLCLCGHIDLSASVSNIPLSASYKDT

SEQ ID NO: 927300 - protein, 147 aa, Homo sapiens
MLKGKSMQAPSWLPRAGFPKAPQAPHTCLHIRIPSGIPEVKGEVPRGQGQTSVLGRSSWFLLLTQAPCCGGRVPTTCITSWVLDSGDVGVPGPMYLPWALLSTWALGAPCHRCRSLRHREGHVPQGGPIPMANSWRGRPAQFPHLEL

SEQ ID NO: 927301 - protein, 180 aa, Homo sapiens
MEPDTAELIRPQGLISASRDGGGVNARRTVLHAGRRGETGNKRLEPTSLQPSLGGSTEADLEHSQPDNVIEKKNPFSEEKFKPAAETCKSNEEPDVNRGTQCKSQQRHWGKCLQGILHRASGKAADTQCQPVKAARRGAVPCKATGMELPKAMGAHFLYQHDLDARPGVKGDHFGALRYD

SEQ ID NO: 927302 - protein, 210 aa, Homo sapiens
MLVQIHPMADAPILDLVGTRGAHTHYPLWFFSNTPSHGAKSPRLNLGESDRPTSSTFLVHYQILGQEDRAWNLSPLAQDVEVNMSPRSWKEAWPTGLTPADPRSRPHDAGCFALRGFHMQRLLVTQNLPQSQTQGDEITPLARAAPEEECLLQLLAEWRAQGLGTLVLVGSRGWAGSAVATGEPRRGFLGAFLSCCQKLLYVTGRECGAV

SEQ ID NO: 927303 - protein, 135 aa, Homo sapiens
MGSVAQTPTLGVQVHLILGDMSIEEAEKPLPQGGQVHQRPAMCGTESVLLHQDFCTGREGQLRLLILEKKMASETLLPLQTCDGRQPNSSAYCWDAFHICHSILAVGSCPTPEDDYGNFACLHDDNNPFETNKRF

SEQ ID NO: 927304 - protein, 169 aa, Homo sapiens
MFCNFLFASSVLLASCFPTDKRNAELPLTEVIRRGKAAVLQAQLEGRRCGGPQQWQKLQACQLPLGAPFQRNAELRLAKVLRQDSGGYSGVLGQWALPDEEICNSQKEVKILTLRGIWKRLIPTLMDDLEVFKTLVKERTAYVVKIARELEIEVEPEDVTKLLQSHDRT

SEQ ID NO: 927305 - protein, 147 aa, Homo sapiens
MAKAAEQQRLQHSLPSGTSIPERFETAAGWKTQAGVAVDLDQKVAPVKRNGIWDLLEKAVWLLLYRASALAAALKAIIAKAMKQQRWQPTPPSGSFMSGRCNTATCGWLDSQASGSYPMRYHGSGTCRPSLLSPLVSAPFLGVYMGL

SEQ ID NO: 927306 - protein, 139 aa, Homo sapiens
MIYRKQALFFRASRQEHLSLLKLCPQQPLLSRSLSHGDGLFIYKSLTEAAAFLSEMLCPERRDLERQSGFSGFAELWWALPSSDFRAALFTLPTELTFPVSTGTGLENALVLSPVHKDLLNSCYVPESEPSLGNTKMTM

SEQ ID NO: 927307 - protein, 127 aa, Homo sapiens
MSMSTMQSHSQYPSFKLLLSRYRKGWTLRLLEDFGDGGAFPEIHVAQYPLDMGRKKKISSALAIQVDSEGKIKYDGITRQGQSKDKVIYSKYTVLVPKDVTNANDPDLQRPDEEAIKEITEKTRVAL

SEQ ID NO: 927308 - protein, 137 aa, Homo sapiens
MRKPHDLQKVMILSFSFLMCVMICEQVSKRRCARMEATVRCHLILEVGSHRLSHRGGDHQGTSTTVGIAVFLSRGIERPGDSAEVIQEMVEELGDNQGSLAAEAALIATMLHCAAPQLECQGMHFLNLEDQRAQAQS

SEQ ID NO: 927309 - protein, 149 aa, Homo sapiens
MAVFQCTARGFAMRKPHDLQKVMILSFSFLMCVMICEQVSKRRCARMEATVRCHLILEVGSHRLSHRGGDHQGTSTTVGIAVFLSRGIERPGDSAEVIQEMVEELGDNQGSLAAEAALIATMLHCAAPQLECQGMHFLNLEDQRAQAQS

SEQ ID NO: 927310 - protein, 133 aa, Homo sapiens
MHTTSVNTVHAALPGAGRPLCMQTAHAKGRIRGEGMQPPSEACQHKKPKSKEIKEARIEVAPDPCGFAAADILWCCDLDMFPSGYPKDSPSGNCHWCGKPGHWKANCPNEINGKKPGTACPFATSSATGKELL

SEQ ID NO: 927311 - protein, 196 aa, Homo sapiens
MNKQKGIASTSTKRTKKDIHTKTPSDCSPSPATEQSWMENDLEELTEIGFRRSVITNFSELKEDVRIHHKKAKNLGKRLDEWLTRINSVEKTLNDLMELKTMARELHDSCTSFNSRSNQAEEKMPDTVQYSYPQVLRAQSEESSTLAWDIDFTEDALVRLIHYHENSMGKTSPCDSIASHQDPPMTRGNDEIYNSS

SEQ ID NO: 927312 - protein, 225 aa, Homo sapiens
MKIKSLEEICLFSLPIKESEIIDFLLGASLKEEVLKIMPAQKQTRAGQRIRFKAFVAIGDYNGHVGLGVKCSKEVATAIRGAIILTKLSIVLVRRGYWGNKIGKPHTVPCKVTGCCSSVLACLIPPPRGTGIVSVPVPKKLLMMAGIDDCYTSARGCTATLGNFTKATFDAISKTYSYLTPDLWKETVFTKSPDQEFNDHLVKTHARVSMPRTQAPAVATTKVFI

SEQ ID NO: 927313 - protein, 140 aa, Homo sapiens
MSQRFLREGFSDHPAWRRCSSSFHLSIPFTSRPGFHWSEAEKPRPYGLSYSSLRLDIFSLYCLSHLHPPSLLTNPLIPFTKCLQQSVPAGRPPWILSFSGLLITSNLCPALLNTRRENKGRKQEEKQVCGGGLRCVSNIT

SEQ ID NO: 927314 - protein, 140 aa, Homo sapiens
MSRMLASDLVTQGEQSEKNKIKNKTLRSTDIVEVKEESKNYKGEMRDQNCKGKLNSGNQKPVRKKFENGVLNVNLLDKFTRNLFCLIHYVKHKGVNKTKPFGAYCLVGKTLLYITKKAIFLITIPCFFLKRHVAYPKKSV

SEQ ID NO: 927315 - protein, 3004 aa, Homo sapiens
MEGNAMEWNGINPSAGEWNGMECNGMESSGMEWNGMECNQPDAMEWNGMEWNGNIPNGMECNGVAMEWIRMEWNGMEWIQQEWNGKEWNQPECNGMEWNGMEWDGMEWNAMEWNQPECNGMERNGMEWNGNYPNGMECNGVGMEWNGMECNGMESTREQSNGTEWNGMQWNGFNLNGMERMESTRVEWHGLEWNGKESTRVQGNGMEWNAMEWNHPKGMDGIEWNGMESTRVQGNGMEWNAMEWNLPEWNGMEWNGMEWNKPECNGMEWNGMEWNGTTRMEWNNQSEWNGMEWNGMELNGMEWNAMEWNQPECNGMERNGMEWNGNYPNGMECNGVAIEWNRIEWNAMEWIQLEWNGKNGINTSGRHGLECNGMETTRNGMEWNGTERNGMEWNGMERNGMEWNGMEWNGKEWILPEWNGMECNGFNSIAMEWNRMEWNGMEWNGINPNKMEWNAMERNGTERNGMEWNGMEWNGMVWNGMEWYGIEWNGKNWNAMDSNGMEWNGMESTRVQGNVMERNVMEWNHPEWNEIEWNGMEWNGMEWNQLDCDGMEWNGMEWNGMELTRIQWNGMEWNGMEWNGMESTRVQGNGMEWNAMEWNHPEWNGMQSNGINSIAMEWNGIDWDTFESTRNQSECNGMEWNGMEWNGMEWNGMECNGMESTRVQSNGIEWNGMQWNGFKLNGMERMESTRVEGHALECNGMESTRVQGNEMEWNAMEWNHPMEWNGMERNGMEWNGMEWNGMERNGTERNGMEWNGMEWNGMESTRNGMEWNGMGITRIEWNGMECNGMERNGMEWNGMEWNGMVWNGMEWYGIEWNGTNCNGMELNGIEWNGMESTRVQGNVMERNAMEWNHPEWNGMEWNGMESTRNQSECNGMEWNGMEWNGMEWNGMQWNGINPSAIEWNRIEWNAMEWIQLECNGKNGINTSGRTWIGMQWNGNNPSTGEWNGMECNGMESSNGMEWNGTERNGMEWNGMEWNGTEWNGMEWNGMERNGFFRNGIEWNAMDSTRLQWNRIEWNGMEWNGINPNKMEWNGMERNGTERNGLECNGMEWYGMEWNGECNGTEWNGMESSGMEWNRMEWNGMEWNGTNSIVMEWNGMEWNGINPNTMEWNGMERNGVEWNGINPSAGEWNGMESNGMESSGMEWNAKQWNQLDCNGMEWNGKEYIGINPSGMEWKGLKWKWNQHEWNGMDWNGMEWNEPEYRGMEWNGMQWNGIIRNGMERNGMEWNRMEWNQIDCNQMEWNGINLNRMEWNGMEWNGAERKGMAWNGTEWNGTERNGMEWNGMEWNGMNASAGEWNGMECNGMESSGMEWNGMEWNGMEWNKPECNGMERNGMEWNGTTRMEWNVMEKSIRMYWNGMERNGMEWNAMEWNGMQWNGINPSAIEWNRMEWNAMEWIQLEWNGKNGINSSGMAWIGMQWNGINPSTGEWNGMECNGMEPSNGMEWNGTERNGMEWNGMEWNGTEWNGMEWNGMDWNQRECRGMECSGMQWNGIFRNGMEWNGMESTRVQWNGVEWNGMEWNGITPNRMEWNGTEWNGMEWNGMEWNGMEWNGMNGMEWNGINASAGECNGTECNGMESSGMEWNGMEWNGMEWNQPDSNGMEWNGMEWNGTTRMEWNLNRINPNVMEWNATEWNGMEWNGMEWNGMQRNGINPTGMAWNGMQWNGMEWNQLEWKGMEWNGKEWNEVNSSGMEWNGIDWNGLQWNGMQWNGMESIIPSGMEGNNGMEWNGTEWNGMEGNGINTRAGEWNGMECNGMESSGMEWNGMESTPLQWNGMEWNGIEWNGINPNRRECNRMECNGTEWSGMEWNGINRSTGEWNGMECNGLESSVMEWKGMEWNGMEWNGMEWNGINSMAVEWNGMESTRIEWNGMEWNGTEWNGMEWNGTERNGMEWNGMEWNGTEWNGMEWNGINAKWNGMELNGMEWNGMERNGMEWNGRMEWNGMESTRLQGNGMEWNAMEWIQLEWNGKNGINTSGMAWIGMEWNGINPSTWEWNGMECNGMESSVMEWKGMEWNGMEWNGMEWKGMESTRMQMEWNGMERNGTERNGMAWNGMEWNGMEWNGKEWNGMEWNGMEWNERVCRGMEWNGMQWNGIFWNGMEWNGMEWNQRECRGMEWNGMQWNGIFRNGMEWNGINSIAMEWNGMECNGIEWNGINPNRMECNRMECNGTEWSGMEWNGINPSTGEWRGMEWNGMETTRMEWNEWNGMEWNGINSIAIEWNGMELTRIEWNGMEWNGTERNGMEWNGMEWNGTERNGMEWNGMEWNGMEWNGINASAGEWNVMECNGMESSGMEWNGMEWNGKEWNRMEWNGMERNGTERNGMEWNGMAWNQRELQGNVMERNAMEWNHPEWNGMEWNGINPSAMEWSGMEWNGMEQPEWNGMEWRVRELNRINPNVMEWNATEWNGMEWNGMQWNGINPSTMEWNGMEWNGMEWNGMDWNALKPNGMERNGINTSGMEWNGKEWNGMEWNGMEWNGMEWNGMESTRLKGNGMEWNAMEWTQLEWNGKNGINKSGMAWIAMEWNGINPSTGEWNGMECNGMESSNGMEWNGTEWNGMEWNGMEWNGTERNGMEWNGMEWNGKEWNGMEWNGMEWNGINASAGEWNGMECNGMESCGMELNGMESTRVQWNGVEWNGMEWNNPNRMESIEWNGTELTQIEWNGMEWNGTEWNGMEWNGMERNGTERNGMERNGMEWNGINASVGEWNGMECNGMESSGMEWNGMEWNGMEWNRMQWNGINPSTMEWNGMEWNGTDWNGMEWNGMELNGMERNGINPKWNGIEWNGINPNGMEWNGMERNGTERNGMERNGMEWNGMVWNGMEWYGIEWNGTNCNGMELNGMEWNGMEWNQLECRGIAMEWSGMEWNGVEQPEWNGMEWRVRELNRINPNNGMERNGMEWNGMEWNGINPSAIKWNRMEWNAMEWIQLEWNGKNGINTSGLAWIGMDWNGINPITWDWNGMECNGMDSPVMEWKGMEWNGMDWNELDWKGLESPRMQSIGMEWIYPE

SEQ ID NO: 927316 - protein, 2219 aa, Homo sapiens
MQSNGINSIAMEWNGMERSTLESTQVEWNGKDWNGVEWNGMQWNGMEWNQLDWNGMEWNGMEWNGMESTRLQGNGMEWNAMEWIQLEWNGKNGINTSGMAWIGMEWNGINPSTGEWNGMEYNGMESSNGTEWNGTERNGMEWNGKERKGREWNGIEWNGMESTRVQGNGMERNAMEWNLPEWNGMEWNGMEWNGMEYTRVQWNGVEWNGMEWNNPNGMEYNGEINPNVMEWNGTEWNGMEWNGMEWNAMEWNQPECNRMESNGMEWKGMQWNGMEWNGINTIAIEWNGMELTRIEWNGMEWNGTEWNGMEWNGMERNGTERNGMEWNGMESTRVQGNGMEWNAMEWNLPEWNGIEWNGMEWYGINPSAMEWSGMEWNGMEQPEWNGMNGMERNGMEWNGMVWNGMEWYGIEWNGTNCNGMELNGMEWNGMEWNGINLSAGECNGTECNGMESSGMEWNGMESTRVQWNGVEWNGMEWNNLNGMEWNGDAIKWNRMEWNAMEWIQLEWNGKNGINTSGMTWIGMEWNGINPSTGEWNGMECNGMESSNGMEWNGTERNGTERNGMEWNGMEWKGTERKGMEWNRMEWNGINASAGEWNGTEWNAMEWNLPEWNGMEWNGMESTRNQSECNGMEWNGMELNGMEWNAMEWNQPECNGMERNGINASAGEWDGMECNGMESSGMEWNGMEWNGMESTLVQWNGVEWNGMEWNNPNGMECNGEINPNVMEWNGTEWNGMEWNGMECNGMESTRVQSNGIEWNGMQWNGFNLNGMERMESTRVEWHGLEWNGMESTRVQGNGMEWNAMEWNHPMEWNGMERNGTEWNGMEWNGMVWNGMEWYGIEWNGTKCNGMELNGMEWNGMESTRVQGNVMERNAMEWNHPEWNGMEWNGMESTRVQWNGVEWNGMEWNNPNGMECNGEMEWNEMEWNGMEWNGMEWNGMEWNRSEWNRRECIRVEWKGMESTRVECGMEWKGLEWNGMEWNQLDCNGMEWNGMEWNGINPNTMEWNRMEWSGMEWNQPECRGMEWNGMQWNGIIRNGMEWNGMQNNGIISITMEWNGIEWNGINTNRMEWNGIEWNRKEWNGMEWNQPKCRGMEWNGIQWNGEWNGMEWNGINSIAIEWNGMELTRIEWNGMEWNGTEWNGMECNGTERNGMEWNGMEWNGINAKWNGMEWNGMERKGTEWNGMEWNGMVWNGMECAGKCNGTECNGMESSGMEWNGMEWNGMECNGMESTRVQSNGIELNGMQWNGFNLNGMERMESTLVEGHGLECNGMETTRVQGNGMEWNAMEWNHPMEWNGMERNGMEWNGMEWNGTERNGMEWNGMKWNQCEGREWNGMECNGMETSGMEWNRMEWNGMEWNQSEYRGMEWKEWNGMEWNGIEWNGMEWKGMEGKEMECNQPECRGMEWNGMRWNGIIQNGMEWNGMEWNGMEWNGINASAGECNGMECNGMESSGMEWNGMEWNGINPSAMEWSGMEWNGMKWNGMQWNGINPSAIEWNRMEWNAMEWIQLEWNGKNGINTSGMTWIGMEWNGINASAGECNGTECNGMESSGMEWNGMEWNKPECNGMEELNRINSNVMEWNATEWNGMEWNGMEWNGMEWNAKEWNQPEWNGMEWNAMDWNGMESTRWNARQWNGMERNGMESTRLQWNGMEWNGMHWNGMQLTGIEWNGMEWNGMEWNGREWNQHECRGMEWNGMQWNGIIRNGMEWNGINSIAMEWNGMEWNGIEWNGINPNRMECNRMECNGTEWSGMEWNGINPSTEEWNGMECNGMEMEWNGMERNGMEWNGMEWNGTEQNGMEWNGMESTRVQGNGMEWNAMEWNLPEWNGMEWNGMKGNGLNSIAMEWNRMEWNGMEWNGMEWNGMPSNRMEWKGMESTRVERNGMERNGMEWNEWNGMEWKGMEGKEMECNQPECRGMEWNGMRWNGIIRNGMEWNGMEWNGMVSTRVQGNVMERNAMEWNHPEWNGMEWNGMESTRVQWNGVEWNGMEWNNQNGMECNGEINPNVMEWNATEWNGMECNGMEWNGMQRNGINPSGMAWNGMQWIGMEWNQLEWKGMEWNGMERNGMKSTRVEWSGKMECNRMECNGTEWSGMEWNIINPSTGEWNGMECNGMESSVMEWKEWNGMEWNGMEWNGINSMAIEWNAMELTRIEWNGMEWNGTEWNGMEWNGTEWNGMEWNGMESTRVQRNGMEWNVMEWNLPEWNAMEWNGMKGNGLNPIAMEW

SEQ ID NO: 927317 - protein, 164 aa, Homo sapiens
MLSLITWNCFTEGSLQFFHPCDKSLPRPLGFQQYSLNMALALCKPAESVDASKTYGLYLFEWWFHHSVQQVYEGCLVPIPEKKFALLGLWAFNGGGRLKYLKCLYGLAFIVLRNSTWLPSVYAKPFGKWLLNYTLGFLSQMCFFTLYGSCEYGCSITYNRVVSQ

SEQ ID NO: 927318 - protein, 157 aa, Homo sapiens
MTKIPTLQRETSCLCSSRPGLTNTSQTQEVERREDPSGMEAIQEGFHRHRDTQSGMLLKRYPKMWKQLWNWVTGRGWNSLESSEEDRKMWKSLEHLLNGFAQNADIDMYNKNQGVHGQVCSKDTLCNAAVWSTNKSITQIIHDYYEFTACNSLFSYR

SEQ ID NO: 927319 - protein, 191 aa, Homo sapiens
MAVYFTWVQLLVCSRRPESLWQNPGPRGQPIGWCPPTPWVGLPDDGSSSLSPLTQMLNLFWQHPDTPRTITLHSSVIKLTFNINHHTFYGARCKLLVDLPFWGLEHSGPLLTAPLGGAPAETLHGHSDSIFPFHTTLAEVLHESLAPAENFWLSIQAFPYIFRNPGRGSQTSILDFCASAGLMPCGSCQGH

SEQ ID NO: 927320 - protein, 240 aa, Homo sapiens
MEWNGMERNVTEWNGMEWNGMEWNGMEWNGMVRNRMEWNEWKWNGIEWNGMEWNGMESTRVQGNVMERNSMEWNHLEWNGMEWNGMEWNGINPSAMEWSGMEWNGMECNGMEWNGMQRNGINPSGMAWNGMQWIGMEWNQLEWKGMEWNGKEWNEVNSSGMEWNGMDWNGLKWNEMEWNGMESIIPSGMEGNVMEWKKGNGINPSGMQGNGMEWKGMEWNQLDCNGMEWNGMEWNGMEWH

SEQ ID NO: 927321 - protein, 641 aa, Homo sapiens
MEWNGMELNGMEWNAMEWNQPECNGMERNGMEWNGNYPNGMECNGVAIEWNRMEWNEMEWNQLEWNGKNEINTSGMAWIGMEWNGINPSTGEWNRMECNGMESSVMEWKGMEWNGMEWNGINPNTMEWNGMEWNGGEWNGINRSAGEWNGMECNGMESSGMEWNGMECKAMESTRLQWNGMEWKGIHWNQPEWNGMQRTGMEWNVMECNGMEWNGMERNGMECNGMERNGMEWNGMEWNQREMEWNGMERNGTEWNGMEWNGMVWNGMEWYGIEWNGTNCNGMELNGMEWNGMESTRVQGNVMERNAMEWNHPEWNGMEWNGMEWNQPECNGMEWNGMEWNGTTRMEWNEGKYSSGMERNGINQSGMEGNGMEWKLIEWNQPEWNGMERTGMEWNGMESTRFAGEWNGMECNGMESSEMESNGMECKAMESTRLQWNGMEWKGVHWNQPEWNGMERTGMEWNGMECNGMEWNGINLIGMEWNGMEWNGMESTRLQGNGMEWNAMEWIQLEWNGKNGINTSGMAWIGMEWNGINPSTGERNGMECNGMESSNGMEWNGTERNGMEWNGMERNGTERNGMEWNGMESTRVQGNGMEWNAMEWNLPEWNGMEWNGMESTRVQWNGVEWNGMEWNNPNGMECNGE

SEQ ID NO: 927322 - protein, 135 aa, Homo sapiens
MLISVLKPNNSLNIFSSSDSAKPVEPFLMLLFESFLTSGPSVWPENSTFRIYPEFDHYHHLEASLLDHCKNSLSDLPTSALPIRPPPQHPTYHSPTGEGFCWRAKRELAAHMVKAGPIERMGWGRCHTLLNDQIS

SEQ ID NO: 927323 - protein, 285 aa, Homo sapiens
MHGSAAPPASSKPHGTGYTLVCPYGLNHVHAGIQAGTHWHSAWEALSTQDVGFEAEESVNRGNQQMGISEQLNAAGEKGEAKPENGRQPHHPLGLRMLDLLWCCHCGRRQIPGTFIPGGLCQPASLLLLQGLCWPLQSLGLSNHRLWKDFMARSTQEAADRDVIHVRICSVSPWESLLFGEGRMTIELLRLGGLAGAVSKQVNSFRTGAFNPLSCSQAFGERGPRERLERVQCAQGMKWLVEGCPEMVGPVQISSASVHNPTHTRHQPELTCRPERKKGPESLVP

SEQ ID NO: 927324 - protein, 166 aa, Homo sapiens
MGGTAPMIQLSPPGPALDTWGLLQFKKCTFLCLCQQYPRESIRTSCLQGSKPWVRDSVPVKNVHKLSISNIQNSGRVNGAAPQRNREEGETYFLKFEKQGYKENIKDQDTGRFFWEERLSTSGITQSGELGCWSTACGILGGCAFRVPVETWNRTSLEIETTVVFL

SEQ ID NO: 927325 - protein, 149 aa, Homo sapiens
MPIWHTYSEKEIPGSCSGIFPPETALPVSTYCLHHSCDNNPLTLPSASRFEKGIDSYVLDDAEASPSSWSLHPYHSSPASSPPLRPFQPHLTLSHGSQDAGVWDPILGPRLSFEEGLQRIAGLAAGVSGEVKRSYWERRDLSIIRKICG

SEQ ID NO: 927326 - protein, 137 aa, Homo sapiens
MAMKATSGHPHCSLHANYNTLAYFPSNSQTTLLQVCWSFLEVHSRPCLPGYHQQRLQNSKDCCLFLPLEASSQRGTRQVPARALLYEVSVGPYWEVSPSQETQGSGTHLRRQSVPYQSLNAVLLDLLLSSELSGRDI

SEQ ID NO: 927327 - protein, 185 aa, Homo sapiens
MATLGRLMSLLSPFDVVIWMTDGWPLYESRLKGKLHVISKRYTQRIERHNLNLRQHLARLGRKSLSFSKSVELHDKSRTWPPEAEEVWWWQLLQLLLPVAGASTGRSWEKGQRPTETRGCAASACVGAPVDLHPAPSTAFDAQTMLKKASEMNESTHWRWRQHGIWFEAACLQARRLDRRALCLS

SEQ ID NO: 927328 - protein, 141 aa, Homo sapiens
MVTVQNPQVAREKEQKRKKKEKKKEKGKGKGKKEGKGKGKKEGKGKGKKEGKGKGEEKGEEEEEEKKDEEEEEDEEEEEEEEKEEEGEEEKEEEEEEEEEKKEEEEEKKKEEGEEEEEEEKKKEEGEEEEEEEKKKEEEGY

SEQ ID NO: 927329 - protein, 157 aa, Homo sapiens; identical to SEQ ID NO: 916613

SEQ ID NO: 927330 - protein, 140 aa, Homo sapiens
MVTVQNPQVAREKEQKRKKKEKKKEKGKGKGKKEGKGKGKKEGKGKGKKEGKGKGEEKGEEEEEEKKDEEEEEDEEEEEEEEKEEEGEEEKEEEEEEEEEKKEEEEEKKKEEGEEEEEEEKKKEEGEEEEEEEKKKEEEG

SEQ ID NO: 927331 - protein, 168 aa, Homo sapiens
MQIHTGRRQSTCLEKCLKLSLEGYTGVGPAKWVVRIKSTYTEKKTHFQKWKCGVGPCLEDASVSVRYARGQILKLSGLPLTFMGKPKVFCLHRARCSSNPITSPSCTAHQEAGLCWGQREAEEADCPQPRFLLQIKPGIDCADSPPGCCHNSSCSLLALKSFSPNYSH

SEQ ID NO: 927332 - protein, 209 aa, Homo sapiens
MFFKERKNEATKERKQGFIENESTIHSVAAHPSSWARAQIQNLLGSKCPLEMLLLRLIGGYTLRTTDLEEGAIIMAEGPGSCSHFQVNTSCGLFWGQPGEPVGPKDHLSMSIMRLLCTQCPWRGPGDGTQDETPGDQTEEGKGVGNRGIDWIELCKRMRRLKVTRRLCPAKFLLLPNSVDTILMGTGHLQNSLSNKRLLQGQNPLPAED

SEQ ID NO: 927333 - protein, 146 aa, Homo sapiens
MDPRLLFIFAAHLVVFCRENWELTLSFAKIWGSANLGLLYVDICLGSFEAIHRVGIQTPDLNECGEDVLDAVEIPSSHILSTVAASASGTFHGAPGSLHSAFSLCQSPNANECLTARCHPSSFCPVIFLLLTDFETSVLYLPVKDF

SEQ ID NO: 927334 - protein, 163 aa, Homo sapiens
MDLKISLSCYQEDFPPGACIIGPSHSKMQKDYENPAAGLAAMHHLWAFICQWRKIQSKRHELSLEEWMQWILQAHKLPTFQAEAAVGARAWRGVRRAAWQRNASLCINFVYSQGWSKGTDGKKIGFKERKDVLASGSSVNLLASGVRTRVTSSYPSSRVPVCC

SEQ ID NO: 927335 - protein, 182 aa, Homo sapiens
MCQNVTPGIMALGMSAVYFQVSGTKEQPVPGHPMQSILLELWGFQVHHCVPGNPRPDFMEHSKDLTLSLLDHSCHWHGRSHSSKEYLELHRENFLLILRFLVAGSAEGAAGAMSGHEGGKKKPPKQPKKQAKEMDEEDKAFKQKQKEEQKKLEELKAKAAGKGPLATGGIKKSGEKQAVPCA

SEQ ID NO: 927336 - protein, 158 aa, Homo sapiens
MPKCESCAAEPLSCRSVGVCWRSVHSRPCLPGYHQRRLQNSKYCCLILPLEASSQRGTCLFEVSVSPCWEMFPSQATRGSGTRLRRQPVRSQSSNAVLREPRSLQSCQTGMFKSAETVCCLLFYYALPPEVESIEAVGLAELQWAPLSLCFLASLLTL

SEQ ID NO: 927337 - protein, 127 aa, Homo sapiens
MPVSRPGARSQGLESGTLGMYLGLCSTAAQIVDMLQSIVNPAVLNKLNQSADIIVVTQYCGNIIVVTQYCDNSIVVTQYCDNIIVVENLTKSVWKVTEVSYREECEQVKEKFLQETAFRTFNVPIRP

SEQ ID NO: 927338 - protein, 155 aa, Homo sapiens
MGPQRLSLTHHFPAVEKPPLAPCHSQGARKLINEGPERTNNGRTSSNLKRGYLWVRSATKLPTGLLIQKDLSIKSLLNKYPQGQLVEAVAATLYSTFLGVFEGPGPLAQLTGRISVSVSVIHPSLGQGLQDGPLQLVPCVRNAAKGVQRTSQKRR

SEQ ID NO: 927339 - protein, 139 aa, Homo sapiens
MCALTLGGFGPGPQLCYMPPQDEVPAALTGPQHSQSTGNNSPMGDTNKSASLEHLLRGPCLRTCAPAAAGVQCGIESRVESAAMVMATEKHPRWACKAALQEGMAWRGPQERPVDRRASNHIGISHGQDSPSLCRSDNQ

SEQ ID NO: 927340 - protein, 185 aa, Homo sapiens
MQWELDYAVPFDNMISQSASCADAENFRQIQGGAGYRYFTGLEAGKRLVNVQDQKRDKSKTKALILLHNCPIRKQRIQGAEPIEKFILKSMQNGYKEEKQTTPKWNYPKTIKLRGPEYNPASCRYYRSVTLVLSHSGTQPVSGHGKTADKSKMRNHLLKREGYIVHKVNITVRRNAVKKFQNKGH

SEQ ID NO: 927341 - protein, 179 aa, Homo sapiens
MDNATHHREYIQYATFSLTCGCPWTILPTTESIFNMLPSPSLEDACGQYYPPQRVYSICCLLPHLWMPMDNILPTTGNIFNVLPSPSLVDARGQYYPPQRVYSICYLLPHLRMPVDNTTHHREYIQYAAFSLTCGCPWTIYYPPQGTYSMCYLLPHLWMPVDNTTHHREYIQYATFSLT

SEQ ID NO: 927342 - protein, 213 aa, Homo sapiens
MQRGEELPRQRRYHDVRCQVGRPLVEEWLTLLEYELWKEAEQAPTPSVTEAWTTSGRGGGKGVWQSVEPGTSKSLPSPAKLQEQRSFQGPHFLSVGAATPAAAGQKRGVQAQRFVGNRRSGRSSLDFSGDLAIMGPGKGRLQPPRERPRAAPSAGEAVVRKLPPRLLQGTSDSASLAVSNVSPNRKNKAQSGPSCLYLSGLVDYSVHFSVERA

SEQ ID NO: 927343 - protein, 182 aa, Homo sapiens
MWHKGAIWEQKLDPHQTPDLPEFKSIRGHGHHYTIVHITEMQFLIATTMTVLTTVGITINFTIIIKENLETDTYTGKIPTEHEDDRLQAKEKRHGMDPSLIALRRNQLCQHLDFGFLASKTAAILLYAAWTRSCLTCTVQIIFAPDPLSSSKRDVGGMVEDGMVKRKLCYISDNRWKLIYVA

SEQ ID NO: 927344 - protein, 151 aa, Homo sapiens
MEKSAGPYDKGEYLTSVQKTLCDIQVLSLSRVPAAFLWLCLPPLGEESVGPQQHTLQRPMHSPEFPVQIALRLLRERGQISSRDLSSRGRIMLLVFTLRPESRQRGRCLQEIEDMEISLPNIHYFNIDMSKMGLINKEEPWQNVKPLSVSD

SEQ ID NO: 927345 - protein, 143 aa, Homo sapiens
MTRSIHLLPGGRGIGKNRGEVVLGLYTRTRPCGLDCEKGNSRRGCSDEQIGVMDMSPDGKMVGLACLRSYWAEEWTEVGCKSDFLDIGKQLACSMYQSLLGHQTLLHLTEVCRPESSGDWLNPYLHMVMALSVKPKLIKNYTS

SEQ ID NO: 927346 - protein, 605 aa, Homo sapiens
MNMFDADTTTNLVTISFILPIGVHVFGLCSTALITDIIQLSTGYQAPYFLTVCKPNYTSLNVSCKENSYIVEDICSGSDLTVINSGRKSFPSQHATLAAFAAVYVSMYFNSTLTDSSKLLKPLLVFTFIICGIICGLTRITQYKNHPVDVYCGFLIGGGIALYLGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 927347 - protein, 140 aa, Homo sapiens
MMWVPCIQRGRCVNAQNLNIFNGNPVSVHSNEKWHPLKKQPSDILRDRVLHSTNNLEKICLKMHLTLLFKVSDFSEFAAAPQCTKYSQEGAPLLENPLDNQLQHMLLPKSTGHTPRCGLLKVLGEWRDPTVLLTGGGEKA

SEQ ID NO: 927348 - protein, 156 aa, Homo sapiens
MGRNQRKKAENSKNQNASFPPKDHNSSQATEQNWTENEFDELTEVAFRRWDSQRERSEYSQKEAIRLTVDLSSETLQARREWGPIFNILKEKNFQRRMPYPAKLSFLSEREIKSFTDKQMLRDFVITRCALQELLKEALNMERNNWYQPLQKHTKL

SEQ ID NO: 927349 - protein, 184 aa, Homo sapiens
MGAGQRRSLSSYKDHHYSLPPCQPLPKPIPGRSCGVVYTVQPLLPNLGVLQGPHLSTFLEAWVYFGSSSATGAGPQGTGDGATGWSQCHRAVVLLRSAQPRFTAGAHVGEDPPTLRTLREDSLLQVCCSLLEVNSRPYLPEYHQGSLQNSKDCCLLLPLEASSQKGTGFMPARALLYEVSVNPC

SEQ ID NO: 927350 - protein, 142 aa, Homo sapiens
MCRAVGETAVFCLQLATRDFENQEKTILTGDCCYINPLVRRTVRFLGIYTFGLFATDIFVNAGQVVTGNLAPHFLALCKPNYTALGCQQYTQFISGEEACTGNPDLIMRARKTFPSKEAALSVYAAMYLTSHHRNSHVFNNH

SEQ ID NO: 927351 - protein, 128 aa, Homo sapiens [sequence omitted]

SEQ ID NO: 927352 - protein, 140 aa, Homo sapiens
MSMCIHCLAPTCLNNYPSKVHIQVLSNPHGRHNTSSPLKMRFFKNARESLPNGTEVISGATFIYLRTDGKYREAYFACGKAHIRLPLGTATYVWQMRQPECRHRLTSWLSLKNSGKVSRCSGRVKCSLTTGLNLQEGRGE

SEQ ID NO: 927353 - protein, 209 aa, Homo sapiens
MYLPSGLNFCEIELGEEAPLKSFLLEVGLCFGGPGPISQGLLFPVLDRAMKGSLSYLHNGNLGWFLEPTANIILNGQKRDAFHLKTSTRQGCPLLPLLFNIVLEVMAKAIRQEKEIKGIQIGREESKQSLFADDMILYLENPIVSAQKILELINNFKKVSRYKISVQKSLAFLCTNNSQAKSQIRNEIPFTIATKRMKCMGIQLTKTLQ

SEQ ID NO: 927354 - protein, 148 aa, Homo sapiens
MQPFLLPELALSMGIKSMCRGRMHNETEHSGETYRSFNVAKSQSLKRGMEQGIAEVEVKFRSCYARHFHPYPECFEIRGLQHTRLASRSFTVGSGSVAVWGGRARKAMLPRIHGSDKTQAKNDSPTGLSKTIMEVKLLAQRSKQAAGI

SEQ ID NO: 927355 - protein, 141 aa, Homo sapiens
MPIHIFSTFKGNYHVSSTCYEAGTVCSGCKGGHPIRSLEVQDGMADAMSGRRAAGRKVIKKGFPEGLLGQTLGKGELGRGEGAGGMEFQAVGTCAEAQKHEKSRTEAVKRERGRGGLEPCAVTDQVSLRILCEVTSSVWTQ

SEQ ID NO: 927356 - protein, 124 aa, Homo sapiens
MLLLLIILFYMCIFIELIFHFDNYILNNKGLLDIAFSVSCVKAKCLIYLFYYTLSSRVHVHKVQVCYICIHVPCWCAAPINSSFTLDYHIFLYINLSDLASSSAGSINLKDKVKSIYKDSKRCS

SEQ ID NO: 927357 - protein, 154 aa, Homo sapiens
MISSCIQQDGNCGNHNQSSIVTKCTRSSVATRKQISIDGWWSMSKIGKHSHRKQQQGKKCSEDLPERSITYLQEAEVFGSVHWFGVVSRMKTILYKMGVLACATPPQTSDSTARGSKRDLLLLLEEKKGKSNKDFVLHLGYKFSYSKIGYQSEL

SEQ ID NO: 927358 - protein, 283 aa, Homo sapiens
MPTVTVTSLLPFLSDNSDVFLYASLEIVCRRPQIPKAIFVSGFGPLYTYKDSIMVNCEEGYILRGSSLIYCETNNEWYPSVPSCISICSYPPSIAHGHYKEVILITPYPEATYECDEGYVLAGFATIYCKSFHWQLAPPQCKALCLKPEIVNGRLSVDKDQYVESENVTIECDSGYGVVGLKSITCSEKRTWYPEVPRCEWEAPEGCEQVLTGRKLMQCLPSPEDVKVALEVYKLSLEIKQLEKERDKLMNTHQKFSEKEEMKDLFFPSNQHTESSLIHPTLP

SEQ ID NO: 927359 - protein, 152 aa, Homo sapiens
MDTLHLQALSHQSLLSGKVICLTLQKSSQVPPGNGTSILDSLICAIRLCHAGFIHLANVHLGNSVVSCPECIHHVILTAPVTGTIVGSRLCCYNQHREDHSFPCPYTIMGDLPGHEVERAPLQQDLCTGRVGQLRLLIQPRKISKFKIQSTD

SEQ ID NO: 927360 - protein, 139 aa, Homo sapiens
MFSTLLTMFSGLQAWTESYMVSCSVSQAFRLRLSYSAGFPHFTACKMAYSGTSQPLNVFKLHQHFTTSYLNLEAPTGRLLSVDGCKILVVVGGYKWVTFYSAILLMSFLLYRDHILTEVQSGPEEGSRLLWSLETPYAE

SEQ ID NO: 927361 - protein, 143 aa, Homo sapiens
MHLMKNGFAICSCQEAVDLGVQLNEYTNVQLDHSPFQKDLKGYESSDGKKEQLFTVCFCACYSSAGLPDILSRLTIVFFKSVIIAALSALEGVHKSRWGSFSTVPGEAGPRLDPLRICRGMAAGKPISLAQSRSLHRGNISNP

SEQ ID NO: 927362 - protein, 146 aa, Homo sapiens
MSSHEKYTEAFWETFLTCKWILEPFVAYGVKGNILTLKLHRNILRSFFVTCLETVFLKNLQTDICEHSEAYAGKEVSSQKTIKKVSEKLFCDVCIHLSEKQFWDVGIHLTEKLQRDICEHFEAYGEKLDRSILRNCFVMCAFTTQS

SEQ ID NO: 927363 - protein, 167 aa, Homo sapiens
MVSGLSAPHSFRSSPTAPGSRLGLRSALWRRTKLANRNAPTAPEKGHPPLSRIPRGAEWEGSFQGSCRLQVAPPISDRIRYSTKWRPNRDFKDMKKKVCWSRGTEIDKVNGDPRVSLPVADIRLREAVKRQIPHTAAAEMLILTLAFENANTDYKHALAPSLSGRGN

SEQ ID NO: 927364 - protein, 186 aa, Homo sapiens
MDRGSGQLCPFPGLGLAPSPSYSVKHISCPLLILHAEDDPVVPFQLGRKLYSIAAPARSFRDFKVQFVPFHSDLGYRHKYIYKSPELPRILSQQPGILKPRGAGTCNAQEPSSHLESTSDPRERGVQVLSAPSQHMQNDSSGSIVPSCPVYLLAFLSCPTSPGLAHSPTVEVPGICTSSPFTYLYT

SEQ ID NO: 927365 - protein, 2698 aa, Homo sapiens
MLIGATQTQAFEFEMLNQFVIRFELILTWCKVFAGGYCSFATSSGSVSDSSALVISTISAVTSSTEVLNSSVSSVKHSDTCNDSSGSSSVQESYVRDKHAEPSRSVLESYVREKLSDPLSRVLESYNKHSDHSRSVLEYYVRNKHSDPRSSVLESYVRDKHSDHSRSVLESYVRDKHSDPRNSVLQSFVREKHSDPRSRVPETYVRGKHSDHSSILESYMNIQTLVAVFCNPMSRTFRPQPQCSGILTNKHSDHSSSVLESYVRDKLSHHSRSVLESCVRDKHSDHSNSVLESCVRDKYSDPCSSVLESYVRDKHSDPSNSVLESYARDKHSDPPSCVLESYVRDKYSDTSCNVLESYVTDQHSDHSSSVLESYGKNCDPSINVVESYVSDKHSDHSSCVLESYVRDKHSDPIRSILESYVRDKHSDPRSSVQESYVRDKLSDHSSCVLESCERNKHSDHIRSVLESSVRGKHSDSSRSVLEFYVRNKHSDHSRSVLESYVRNKHSHHSRTDLGFYVRDYHSDPCSSVLESYVRDKHSDPSRTTLDSNVRDKHFNRRSTVQESYVRDKYSDQSSSVLESFVRDKHSDPCSSVLESFVKEKHSDPRSSVQESYGKQSDPSINVLESYVRDIHSDHSNSVLECYVRYKHSHHSRTVLGSYCSGILWEGQTFRPQQQCSGILFDGQTSDPRSSGLESYLRDKYSDPLSSVLESCERDKYSDHSSSVLESYVRDKQTTQECSGILLVEQTFKPQEKHSNHNRSVLESCVRDELSEHSRSVLKCYVRNKHSENCRSVLGTYDRDTYSDPRSSALESFVKNKHSHHNRSVLESYMRDEHSDHSRRFLESHVRDKHSERGSSVLESYVRDRYLDPRRSVLESYVKGKPSDPRSSVLHGILCEGQHSDHSSGVLESFVRDNHSDLRSSVLESCERDRHSDHSGSVLESYVRDKPSDNSRSVMESCVRNKHSNHSRNVLESFVRNKISKPRGSVLESCVRNKHSDHSRSVLESYVRDKHSEPGSSVLESYVREKHSNPHSRVLESYLRGKHSDPRSSVLESCERDKHSDHSRNVLESSVRHKLSDSSRSVLESYVRNKHSDHSSSVLESYVRDKHSDSSRSVLGSYVRNKNSDHSNSVLESYEQTARHSRSVLESYVREKHLDHSESVLECYVWNKHSHHCRIVLASYVRDKHSDPRSSVLESYVRDKHSDYSSSVVESYVRDKQSDHSGRVLEFSVRNKHSNHSRIVPESCVRVKISESHSSVLDKHSDARSSVLKSYVNGKESDPIINVLESCMRDIHSDHSNSVLECYVRNKHSHHSRTVLGFYVSDKHSDHSRSVLESYVRDKHVNPRRSVLEFYVRDKHSDHSRSVLESYVRDKHSDPHSSVQESYLRDKHSDHSSSVLESFVRDNHSDPRSSVLESYRRNKHSDTCSSFLEFCGRDKHSDHSRSFLDSYVREKMADNSRSVLESCESYVRDKYSDQSSSVLESYVRNKHSDPCSSVLESYVKEKHSQHSSSVLKSYVRGKHSDPSRSVLESYGRDKHSDPSRSILESHLRDKHSDQSNSVLESYVSMDKHSDPGNSVLESYLRDKHSDQRSSVLESCERDTHSDHSGSVVEPYVRDKQSDHNNSVQECYVRNKHSHHSRTVLGSYVSDKHSDHSSSVLESYVRDKHSDPRSSVQESYVRDKQSDHSSSVLESFVRDKHSDPRRNVPETYVRDKHSDPRSSVLESCERDKHSDHSWRVLESYVRDKHSDPSRSVLESYVRKKHSQHCRSVLDSYVRGEHSDHSSSVLQYRSVLESCVKNKHSHNSRNVLESCVRDKHSHNSKNVLESCVRDKHSDPSSSVLESFVRDKDSDPSSSVLESYERGVLESCVTVKHSDHSSSVLESYVKNKLSAHCRSVLESNVRDKHSDARNSVLESCERDKHSDHSWSVLESYVRDKHSDTSSSVLESYCTQCYVRNKHSHHSSTVLGSYVSDKLSDHSSCLLESYVRDNHSDHSSSVLECYVRNKHSHHSSTVLGSYVRDKHSEHNSSVLEYCVRDKHSDPNRSILESYVRNKHSYPRRSIQESYVRDKHSDYSRSVLEFFVRNKHSDRRSSVLESYLRDKHSEPRGSFLKSYVKGKHSDPSINVLESYVRDLHSNHSASVLECYVKNKHSHHSRTVLGSSVWDKHSNNVRGVLESCFRDKNSERRSSVLESYVRSKHSEYSRSAVESYGRDKHSDTCSSVLESCVRDKHSDRSRSVLESYVRDKHLDPGSSVLTTSSSVLESYVRDKHSDPSRSVLECYVRDKYSDLRSSVQESYVRDKHSDHSRSVLESFVMDKHSDPRTSVLESYVRDKHSDTCSSALESYGRDKHSEPTRSVLESYGYSEPTRSVLEFYVTDILSDHSSSVLESYVRDKLSDHSSSVLEYYVRDKFSDHSSSVLKSHVRDRHSEPRSSDLESNVMDKHSDPSSSVLESDVRGRHAHPIHSVLESYVIDKHSEHNNSDLKSNGYSDPRCSVLESYVTDKDSDDSSSVLESYVRDKLSDQSRSVLESYVRDKVSDHSRSVLESYVRDKVSDHSSSVLESYVRDRHSESRSNDLESYVRDKHSEPPDSVLESYVRDQYSYPRSRVVECYVTNIQTLIAMFSNPMSEIFRPQPQCSRILWDRQTFRPQQQCSGILCEGHSDHGSSVLESCVRDKHSDHHGSSFLESYVTDIQTLVAVLWNPM

SEQ ID NO: 927366 - protein, 540 aa, Homo sapiens
MRIHGSSVQIIDDLIERSHESHDRFFWQINVLFPIKPCETQSGEKPHVPDITRKSHRYQEHLTQHHKIQTLLQAFQCNKQEKTFNTEVIFFIHKRAHIGQTFGKYNEYEKVCNNSAVIVQGITQVGQPTCCRKSDFTKHQQTHTGEKPCECIECEKPSISKSDLMIQHNLTIHQRIHTGEKPYGCNECGKTFHRKSFLTLHQRTHTGDKPYKCIECGKTFHLNVEKPLARSHTSQYIIELTPGKIPMHVTIEKKHLSISQDLLPIREHTQGKNPMNVMSVENPLSISRTSGYIRELTQGKNPMNAMNVGKPFTVGCSSLSIKGLTWEKPYECNECEKTFPYKSFLTVQQRTHTGEKPYACNECGKTYSHKSYLTVHHRTHTGEKPYECNECGKSFYCNSFLTIHQRTHAGKKPYECNECEKTFINKLNLGIHKRTHTGERPYECNECGKPFIRSQISAPIRELTQGRNLMYVMNVEKPFIASHSSPYTRELTREKPYECNESGKTFCQKSYLIIHQRTQTGEKPYESNECGKSFHQKANL

SEQ ID NO: 927367 - protein, 141 aa, Homo sapiens
MQSLSGSLLLHMKEKISLPEHEVQSQSRSHPGNRVHNAVRACVGQKRNHFLLFPVGSPSGCFASAPGTASDTDRACKRGRRVSSGLEQTVGGGPQGGGCEESESSITLWHAESLSSRFLGISLIGSTLPCKAGRTRDYGGH

SEQ ID NO: 927368 - protein, 196 aa, Homo sapiens
MGVKGRSRETRGSGGRSCEKGSDSGYILKVDLTGFADVFGVDHVACPVLIQQDTSPAWDFTDRGADVVNTDKCHSLAQHAGGHLQPSWAKIEPENRSQSSFCRHAPSIAGNATFAAAILPPQPGVDAPLTLHIEAPDALLRVCFPSRSLHVTYLSPCQLVLLETFPGPSHVPAHSAAKGVHLIPLVMDKAHIQNPS

SEQ ID NO: 927369 - protein, 144 aa, Homo sapiens
MVLTHCSLGFLLTCDHLLNFSIPEVQFGSFLKWLFQLLYHFIGFIGLGFNFLLSTTEFLCHPGSEFCICQFSHISIWVGFIAGEPVQPFGEQNGEPWRMDTYGHILLQLSPMQNLLGLAQEYEPGTIAESWPIPVAIFQPLIDC

SEQ ID NO: 927370 - protein, 147 aa, Homo sapiens
MQVVKQPCYENELTSKSKHEDNEIEDWNEPPELPDSGLALGSVCKESRDVIHLQVFQPWIPAPALVEVAGVGSGLYSPWAGLAMTAVGDGGVVPRPMGLCSQGDYGCLCFIIQVIKEVGESWQSQASHCSHAAHCPKARSHSRCAPQ

SEQ ID NO: 927371 - protein, 143 aa, Homo sapiens
MHQHCPHYQLPSARTSTAVTLDSCWPSAATARAAEDMPDKDRGCGLAGEVGSSCLQRAQPACALPQWSLEWSPAGKGLPLEGGSGPIRHVQQGRVKNLSGRLWTPYPPGPPGSCEGQDVNEKQSWVWYKLVGPKVSDFRGSKV

SEQ ID NO: 927372 - protein, 607 aa, Homo sapiens
MEPYYEPDSEFREPLTDVDAFLDSARYNEAGDLDLLKAYLEKNPSDVDARDEQGRTAVHMAAANGHMPILEMLFQFNPQPNVPNDEGNTALHFAALNNRVAAAEALLAHGWRAAEQNIMGKTALQLIYEKQYNEMETLLMSRDETLDTYVPPTQASVMVDLSAKEGDEDEDNEREEKPTVEAKVAAERKTPPAPMAPAKKIVPSASEAPAPVEMSIGERFFEALFSFAEGDYVATRRFLFQNCTLEAVRANKSSGHNRVASQFNLLEFSSSEISPEHGVRHYAHYPTQGPACASAWMAGTVYRNYLLHPDFFGGTHAAPFMENADVADRGQRTNRQLNMLDDLVEYLTRARNSGDATSAADAANSTACSAPALLREHFFTICNGYFVQKRQMASLPARLYRIAAVEGISMADVEEESVSRLHIGLVEVATVTLLLHDPPVSRVREQRQLTDQAERKVVRRSDVDVAAEVEVHEVTQTYNSALSLPPKDYCTPLEWSGIATLSRIILRGTYEATLLAGVQHTLRDLERQASLADASSPATPPFSLPPIFLANVGGGVFNNDKEWIASGIASAVHRVAALSVPLNVRLVHFCQMDEYYMKYFPSWPVLD

SEQ ID NO: 927373 - protein, 1294 aa, Homo sapiens
MNNYVLNDEIGQGAFSTIYKGRYRTTTEFYAIASIDKKRRERVVNCVQLLRSMHHSNVIEFHNWYETNNHLWIITEYCTGGDMSTILRSNINLTTQAVQAFGRDVAMGLMYIHSKGVVYNDLQTRNLLMDSAAMLRFHDFSLACLFQDAATRPLVGTPLYMAPELFMADRPLYSMASDLWSFGCVLHELATGKPPFAASDLETLLGDILTSPTPAVPGAPESFQTLLCGLLEKDPLKRYAWVDVVRSEFWDEPLPLPSNGFPSQVAWEDYKRSRSGRGASQYNWTDSDVRVAVAHAVGAAKSNASTHNVEERERAAATLNVAKELDFTASAAMLLERLPERTQERAAHATGHVATAHGSLVHGCPSTASAASNTFNANGSSSSAVASSRRSRLSESKNNGGDPQRHRVSKGRGATSIRTSGSAAIAYEGGCTAYATNTGAKEDRPTEASLHLFASEALRHLTISDLLPHHTDQHIRPLSNNSRIEYTPEPSYDISTLGFTALTAAEINSLTGKEHTAFFRSLYLALSTLSSGYDNVLNTMNYVISLCGDAEVARASVNSSVMRLCVKHAGRKDAPAGFRTAAALIMGLLVRTTAFITPEVASSSILPDIMQLFEDETDVPVKRKLIACISEFLFYIAVQQKRQRAMWNVQPATVKRIYASALDSDDDVLKHYAAKMIENMASTPQKEMTLELFADPVFVEKLLAVFALPSAEGRSEDMRSDAVCAALKLAMVKDELILAVMQCKWLPVTSYATVMQRSTLTHTMQILLTFLNYALVKGSGGSGSGRRGCALTSSLSVEDAEEVVGNALFVSEDLLARLSEAIEQASVAVYGKTLLFVMLIGCVGGSTICQILNSRIVAFLDRLVRDADLYVKRCGAALSAFLGWFVSEKLASIARRVSSTSTATHLAAIQQLLSNSAVRSGIDFQKDVFQSLSTCIDKAMHNTIYGTYRDEFNTIADRFVESPEEVLRYEENICLYLATSYAEMLRRKEASGRFTAIRFLTSVMVPISAEVTATRKESSGATSAARQVLNAVAPNVTSLLQETSPIPTNTIRLLVTCGEMAQSKLSGLVSEQLLGHIMDYVNESGDGDGIYYPLSFIHLCLLVSQRVDIFNYVVRQGLCALALETLASAAKSRNEPLVEMCCNLLAVVVRRVAGDPSSRVKAQCASCVQEDSIGSVLLPICADTASSIALMESAASVIEDFVRLSSAARDDLTSASAIATWAGALSNALLSSARRAVAASLLAALSTSCESASRDVLQELKCDSRLMSVLANAADCTHMRLVASEANRILKKLS

SEQ ID NO: 927374 - protein, 135 aa, Homo sapiens
MLGANTNDSGNLLSHCVSMKALKGPLWNRRSINPELRSIFLFFSFVLWCIMFVVKSLGLSTRFSHLQDEGMEDDSSFLQFEKSQAEPHSHALTVKQKIFLPLLNELNTMFTHHIRKKKGKKPLTPTLVHLGVCHY

SEQ ID NO: 927375 - protein, 229 aa, Homo sapiens
MLPSHTSLLAAPPMRQASLATRPLILHFSLPGILLPRQLHGFTHHTLQSLFKRLLNREDFLGHLKVVNEFLHFTSKNLQSAKLKAEGIDLSSSKNAARAASKESEKAQWRKKKLKDGKENENRKEGVTSSRAFWKAQSFPETDLWINGSPGGLNMFLKEAREIKIDEGATKLGKIFVSGKNLPGPFRKLKGEGGLSQSHCLSAYASHGVVTGVENGISKPTQQEGQGKV

SEQ ID NO: 927376 - protein, 139 aa, Homo sapiens
MCRPWASESLSKNQLVYENYCADVDEKVRRAKWYWDTNASVRSGHSLAEWLASTLWPPGSPIQICVSANYLMTGTFWITHWGFLSFMHIQSANANAGLSVAQMKSPEFATVSLCCSSKFLFLSPHGLSVLDTTKMGKLQ

SEQ ID NO: 927377 - protein, 186 aa, Homo sapiens
MSKSWIIFPAQKLMTNKIETDAQIEVKELEASQGKGRERSSEKEGINSSDTMEAELARLGGQLQKRVREKGVTRSPRPLDILVEAGFTTVTLGRAVLFGIKGTEARLQTFAEGMGNEGLKLRHTETKLVQSHQQRGVLLEDHSCPDRTLPFMTWQDTDFERMVVQGGAQALYRLIADDVQGKSLQG

SEQ ID NO: 927378 - protein, 139 aa, Homo sapiens
MCPELVPSSGFFVSLTSRMKLWTLTVSVTVLKVGVKPQTFAVSVTTLKGGASGVVYSSWWVRGFTDFRNEAADPRVKRMSVETIIGPADVVESGPSKAIPCLYIHRNGKSAKKLCNFILPFAFLIELGSSRLNELSVEL

SEQ ID NO: 927379 - protein, 137 aa, Homo sapiens [sequence omitted]

SEQ ID NO: 927380 - protein, 146 aa, Homo sapiens
MAVRIPRTWVGPEVLTEEPQSLAISTPDHEEYCQTTSYCSLKAQALLSQLVMNATWPQTYYSGPKALQLAGDECCQDWLLSFKTACFYHAQDMSRNVIWEIRPGTGASRPCPVPYPAVAEQPDEVRVEEEVTLDSLLKISEPQFPQ

SEQ ID NO: 927381 - protein, 140 aa, Homo sapiens
MFGVRAHRYPFYQRVSNPHTKPNFSALCGSTLFPNGEPGDPQNVDSDFSERLSVATAAHHLSKAPTCSPTSPCHDVTSPFTRFLRPRSLKIPLSIIRAVSKPFRLHISNPAPLLAGLLRQHPYWFHFFQPYPSSLHLPFK

SEQ ID NO: 927382 - protein, 140 aa, Homo sapiens
MGLGEDVAITGDEKLFLLAKKVHQNLQAQCPQLQQGHPTHPHSKFQAPILFQPILSLCNSRHLVRLCMHLSLQVSHSHGKRLCSFSQNFSSFSTGDKTLTQGTLMFLGFPPRVKGIMYRVIKLIASHERWIRSVLCLYFA

SEQ ID NO: 927383 - protein, 124 aa, Homo sapiens
MSISDRLDEENLVHIHHHVLCRDMDGAGGDHPWQTKAGRENQRSHALTYKWELNDENTWTHRREQHTLGPTGEVQDQGVSKFGYLVRAAFLQYPLEVRKTVSSHGRRWNGKLTKSYNDAAFQGP

SEQ ID NO: 927384 - protein, 165 aa, Homo sapiens
MRTNSFSIFASSVLQAPLSLQHLVLLLLVDEGGKLVVEGLDLLLLLGAHGLDVGVHLQVKRAQQALVDGDSGDASHTTGPAIASAQATREAAADHSGEARGADAGTGLTLVGAAAEGPGAGGGHLVGLLGHPHGHGGGRSGGRQAEPGIDSRRRGEAASCSLSFF

SEQ ID NO: 927385 - protein, 161 aa, Homo sapiens
MQPSQFSESVGSSPFQVPSTDPILALLSCRPQSWGARTCWLLLLLNACGWVPGTVWDLKRSQAARIHSGETKHLGWAAEATLGMHSYGVARQGPWEGLVNRQVCRTDVPQSCEEAGPAFSLVVSWGQDLSVGGRQGALVDEMAALAGTLIESRDMLSQRKS

SEQ ID NO: 927386 - protein, 143 aa, Homo sapiens
MEYYFAAAVLTVTLTTKICGFVLKSARPRTHQKEETLDASEHLKEQTPDAPSLRTVTLTVMVHGFILEVSETKNPPEGTNSRHNMTRNPLIIYQSQSKLGFKVPISAKLLYQEDTTIINNYKSHSGELRYMKQTLVDPKGELE

SEQ ID NO: 927387 - protein, 137 aa, Homo sapiens
MFPILCPCALIVQFQPMKEDRKMWESLELPRDLLNGFDQKPDSNMDNKVQTEMVSDGHEELVGNWSKGCSVKAQINEYFVVLNSIELLGHLFYKKEISSFYSYHTRSEDLIFTRSVDDSGALSVIGNKWSNKTANDV

SEQ ID NO: 927388 - protein, 464 aa, Homo sapiens
MKVTSILIALIMKPSWRPPVRTSGALVVTASNKAHFHPYADFKDPSSRLMESLEVPRDLEDYEDRKMWESLELPRHLLNGFHQNSNTSDMDNKVQAEVVSDGDEELVGNYSKGDSCYTLAKRLAAFCPCPRDLWNFELERDDLGHLVEEISKQQSIQYVTWVLAEQKGNVGSEPQHRAPTGALPVGAVRRGPLSSRCQNGRYTDSLHGASGKATGTQCQPMKAAGKGGVCCKASRVSLPKAMGAYLLYQHDLDVRHGVKGDHFRALRLGCSIEFQTCIGPYLIEHTLRNADLGFDIQTDSSHMAFSTTSILLERVTSILKGGAVQAADPGEWVLHMSGDLPGHEVEMASPYHDLCPEMVVWVRLLNKASGCSKCLENLPRHEAERPPCTGSLHRNGVGILAAGPCTVVSGKPAGAQRSDTRRPVPSYQAGPGCNSHHIGDTVAVAALLLPQANDRGNYNSSSCC

SEQ ID NO: 927389 - protein, 135 aa, Homo sapiens
MGKGDPKKPRGKMLSYAFLVKTCQKEHKKLQSTSQSFLRSAQREARWKTISAKQKGKSEDMAKANKARYEREMKIYIPPKGETKKKFKSNAPKWPPAASKKGVIKAEKSKKKKEGEEDEEDQEEEEDEGEENDDE

SEQ ID NO: 927390 - protein, 170 aa, Homo sapiens
MRQLPKQIRKLLFHHQNIFCKAVLSSDTKTNLDKILRASALSTIQHQALVSVPPVTWESCTGRCPCDVEPTLALVDVLTLATQKLALNSWGSGKREYLTKDIKAKTWSETDLTFTYNPNQEFPGNKITNLGGILLMDILGDSKTLVIGNSDSKLECFFSMHALSSCGQES

SEQ ID NO: 927391 - protein, 151 aa, Homo sapiens
MRATKDVHIQTLALRKVSNASCVCNRLVEVLLSVGSLECGEGAQRDFLVSSSEEGASAKAIAEAKGSSFPQHAQPEEESQKLHERGPDPDPKRGFLDLTQERIQDHIGYLPDVAMAFANCHGAGGSAAVRTTRGHSRRHFGFGGFWPARLL

SEQ ID NO: 927392 - protein, 161 aa, Homo sapiens
MGISQPLQEALRTTSMMTQARVSFLIVHRYNTAQPLPQQTRGAGRPCQDSNLLTRLPKQQSSALQQRQQCGQRHGFQGWPDLDLNPSTAADELCNLGKVLHSLESQVLPQQNEGIAHLTLHSHSNEPFKSLDTSGKQPVELLQHRVGLSYKRERQLQKKLF

SEQ ID NO: 927393 - protein, 154 aa, Homo sapiens
MRKGWHWQFKMLSYPLQKEGSSSHPTSSILQSGPAQNRDKLFSEGKAQQRELPGVHMAALLPEESMLCSALHGLLLCCAMLDPEPWLEEVLLGRAGPVLPLRSRGRVTATTQPPRPEQLRYAPESQTLALWQSAPTYASESEHVSKFPGATVEW

SEQ ID NO: 927394 - protein, 136 aa, Homo sapiens
MPQTAAASNQPSCHFSLNKLSLYCCKPLLNFQCSEKFDSDHFCQCSHCLYRDDFPRSSLMLFTDTPPQILSMAFIFSLTSTLIFPNTEKSKAPNSLYVLCFQEVSFLRCISGNTVPVAAAQKYYKKTTLNIATTKI

SEQ ID NO: 927395 - protein, 186 aa, Homo sapiens
MDDAPLTIPLKPNHPYPSQRQYPIPQHALKGLKPVITPLLQHGLLKPINSPYNSPFYLSKNRTSLTGLVQDLHLINQIVLPIHLMVTNPYTLLSSIPPSTAHSSVLDLKHAFFIIPLHPSSQPLFAFTWTDPDTHQAQQITWAVLLQGFTDSPHYFSQAQISSSSVTYLSIILIKTHVLSLLIVSD

SEQ ID NO: 927396 - protein, 156 aa, Homo sapiens
MKNSLGAMGGGKRFSDDDNFELFYHTLRVYGIYKSLTACSFHSSIPGTGMVICIAQLLLLCCLTYSFCPGQTRTMMDYIYETSSLEARASDYHENCSKILKYSLAPSIWKAHLSKSHANKLALCVFREFLSFFFHSFNHFTFLNFLDADFTDTQCS

SEQ ID NO: 927397 - protein, 156 aa, Homo sapiens
MGRNQSRKAENSKNQSVSSPPKDCSSSPATEQSWMENDFDKLTEEGFRSQFDQVEKRVSVIEDEINEIKKEEKFREKRVKRNEQILKEIWVYVKRPNLHLIGIPESDGENGTKLENTLQDIIQENFPNLARQANIQIRKYREHHKNTPQEEQPQDT

SEQ ID NO: 927398 - protein, 1157 aa, Homo sapiens
MLVYDLVREDIIGHYLDHFASCVEDGFEGDKTGGSSPEALHRPYGCDVEPQALNEAIRWSSKENLLGATESDPNLFVALYDFVASGDNTLSITKECETLNYYLHAESLAPKGEKLRVLGYNQNGEWSEVRSKNGQGWVPSNYITPVNSLEKHSWYHGPVSRSAAEYLLSSLINGSFLVRESESSPGQLSISLRYEGRVYHYRINTTADGKVYVTAESRFSTLAELVHHHSTVADGLVTTLHYPAPKCNKPTVYGVSPIHDKWEMERTDITMKHKLGGGQYGEVYVGVWKKYSLTVAVKTLKCQAHQQIEMINPSAIADNAEEDTMEVEEFLKEAAVMKEIKHPNLVQLLGVCTLEPPFYIVTEYMPYGNLLDYLRECNREEVTAVVLLYMATQISSAMEYLEKKNFIHRDLAARNCLVGENHVVKVADFGLSRLMTGDTYTAHAGAKFPIKWTAPESLAYNTFSIKSDVWAFGVLLWEIATYGMSPYPGIDLSQVYDLLEKGYRMEQPEGCPPKVYELMRASEELGRAASSSSVVPYLPRLPILPSKTRTLKKQVENKENIEGAQDATENSASSLAPGMGPLAGFIRGAQASSGSPALPRKQRDKSPSSLLEDAKETCFTRDRKGGFFSSFMKKRNAPTPPKRSSSFREMENQPHKKYELTGNFSSVASLQHADGFSFTPAQQEANLVPPKCYGGSFAQRNLCNDDGGGGGGSGTAGGGWSGITGFFTPRLIKKTLGLRAGKPTASDDTSKPFPRSNSTSSMSSGLPEQDRMAMTLPRNCQRSKLQLERTVSTSSQPEENVDRANDMLPKKSEESAAPSRERPKAKLLPRGATALPLRTPSGDLAITEKDPPGVGVAGVAAAPKGKEKNGGARLGMAGVPEDGEQPGWPSPAKAAPVLPTTHNHKVPVLISPTLKHTPADVQLIGTDSQGNKFKLLSEHQVTSSGDKDRPRRVKPKCAPPPPPVMRLLQHPSICSDPTEEPTALTAGQSTSETQEGGKKAALGAVPISGKAGRPVMPPPQVPLPTSSISPAKMANGTAGTKVALRKTKQAAEKISADKISKEALLECADLLSSALTEPVPNSQLVDTGHQLLDYCSGYVDCIPQTRNKFAFREAVSKLELSLQELQVSSAAAGVPGTNPVLNNLLSCVQEISDVVQR

SEQ ID NO: 927399 - protein, 156 aa, Homo sapiens
MVISQDLKKFLSKHNGGQMATVRNCCQNGGELVSLALIYQKHLCPLAFLPLTIPGMVLLNCAEQYLRFTVDDTKAIDTDDMYHNSAPNMVWSEDSAVPGLSPSTRQLLPQSEQGFATLLRSKVVGKPELYPNDIDILTVKSWRRFRSSHILLRIPD

SEQ ID NO: 927400 - protein, 190 aa, Homo sapiens
MVDRSKLLPTSLQNEFIPKEVLLSLTYAANAGPCPENLLPPKKIKTPKPKTLTDTLIPEEFHIVSSTGVSGLECYDEKPNKRVEVAQLNDVMDTMLERAGVENQEYTGPTKIARQMIDFYKDLVTQRVMDQRILEELYNFKHVIEELTRELCLVRAHDVKLTKETEKAHKDLAQALLNAEKNAKKPVFKF

SEQ ID NO: 927401 - protein, 202 aa, Homo sapiens
MRVDVIVTLVSLLSVFALRLSWLMARTGGTGPMILNEKKEEFTGDVLLSKYDTLKIIKHLQENWADIGLGIFNRHKSLEGEMPSERQYMEEIIKNIQKLYKEYEIRINGDNGGESVFKSVNVELAAKDGDTSELPGDLLNGFEQDANNDMDNEIQAKVVSDGDEELLGNWSKGDSCYILAKGLAAFCPILEICGTLNLREMI

SEQ ID NO: 927402 - protein, 153 aa, Homo sapiens
MDGRGTYTAIASGCQIWRILHPNNISYRNRCPTPGQDQTSLKPHFLWIRAYLGLENWLGLSRVYTITTPGWWAQRGEDSHVSLGENAHVINIPADADECTSDGNMCLYHDEMQIRGPGANPRKSAQNCFISVSFNLIERKHALMQREKYECLI

SEQ ID NO: 927403 - protein, 135 aa, Homo sapiens
MLWASVLLVLSSLVSLAGYVYLDWILFFVLYDFCLVCITTYAINVGLMWLSFQKVQEPQGKAKSIIHLLLHAEYTGEEGREGGETVSGRAETGLHCGQIKALFSLHDLLLPALLEALCEDYTKDYMESIWQSVLY

SEQ ID NO: 927404 - protein, 148 aa, Homo sapiens
MDLLESSHGIFSFFWSLLILQTLKEKHQLRKNEELPVLSYSPSVVIRAPGRPGYTSRLQAGMNMAFNILFIIQKLVFRAWILKSDRPGLKTNSTTYYICDLEDLKAGLFLNTPHIELSPLWEAGQVVGFEGFKGSLALQKMAVVDIWF

SEQ ID NO: 927405 - protein, 161 aa, Homo sapiens
MMGRNSFLPKMDFAGDLIRETEEEVEALGLTNGTPERRGESLPGGGRQSQFPQSIVLSFLQQDARSPTEKGLICLPSQHNNLLLAFLLGLAQSNRIQSLPGEKEGRKEGGEGNDRSSGSPVPSLGPGETQHCEARTQTRAVQVQSAWYEEQFRFTENLNQM

SEQ ID NO: 927406 - protein, 182 aa, Homo sapiens
MRKNQHKKAENSKNKNASSPPKDHNSLPAREQNLTENGFDELAEVGFRRRAITNSSKLKKHVLTQCKEAKNLKKRLEKLLTRITSSEKNINDLMELKNTARELHEAYTTISSRIDQVEERLSEMNDQLNEIKCEDKIREKRMKRNEQSLQEIWDYVKRPSLPLVGVPESDGESGTKFRAEFY

SEQ ID NO: 927407 - protein, 164 aa, Homo sapiens
MSVGAQNYAPSQLSFNGLHCIQRAYNLWESSCPDLEVSVLKLPWSKIHRLWTCWGKQHWGKISQAGCQEETDGMLRLANVGAVAFQLEGCANSWCASSPSDSAESPLSYQCSPYMPALEAQKRARRVEGGCEGAVEDGELKSKPSRASELFNYTKMNHRGSTLN

SEQ ID NO: 927408 - protein, 330 aa, Homo sapiens
MEYYATIKRNEIMSLGGTWMELEAIILSKLIQEQKTKHHMFSLQHENRLIQYIGTRSGVLLKRYLKMWKRLWNWVTGRGWNSLEGSEENRKMWDSLELPRDLLNGFDQNADNDMDHEIQAEVVSDGDEGLVGNWSKVTLAVIKRCQGVARAVASEVQAPSLGSFHVVLSLWVYRSQEFRFGNLCLDVRGCMKTPGCSGRSLLQGPQNGRPIDSLHRVPGKAADTQCQPVKAARRKAVLCKATGVELPNTMGTHLLHQHDLDVRHGVKGDHFEALRFDCPIGFWTCMGPQATQINDQCTEKQGPLRCLPKTTYVSNRLIRCEGNDYLHKVK

SEQ ID NO: 927409 - protein, 140 aa, Homo sapiens
MAVAPVAQDLSEPPSTLNGHVRKRRPNRVRIGSTEQWPGAVPGAEEERKWRGPDYQQGEPIPLSLEAQAPVWVSRLPRPHYHLFSKSTLPSVETSSAFGIPYTKGRGLESLKFLELSAVKSLCFQTSQAVGCTDLQILLF

SEQ ID NO: 927410 - protein, 342 aa, Homo sapiens
MIVRPPQPRGTASPLNGGGSDGDGDGDGGDGDGHVGGSDGGGSDGGDGDGGGHVGSDGVGDGGNGGGHVGGSGGGGSDGDGDGGGGGGSGDGGGDGDGGGSDNSDGDGGGACGYRSSCNGDGDGDDGGGCGGGSGGGGSDGGGGDNGDGGDGGGGGGGRSGGGGSDGGGGDNGDGGDGGGGGGRSGGGGSDGGGGDNGDGGDGGGGGGRSGGGGSDGGGGDNGDGGDGGGGVVSGGGVGSDGDGGGSGDSGSCVGDGGGGGGGNGGGGDGDEGGDGGGSYYGDIDGGGHDGGGGSDGDGDGGDGGGRVGGSGGGDGGFRSRPKLVSPASWQFCKPTKYVRTC

SEQ ID NO: 927411 - protein, 159 aa, Homo sapiens
MKVPQVFSWTAQLCHEQRKDGNGLREPTESQGPHCPAVRGQNCRGPQVGSQDEVGSSSSEALSSLEILGWKGDLLCRVGHLFQAWLSQEKWQLPAGSARGSRSVVFGEWIHESGGESPFALTLLLAYPYKFTSPEENRMGDPGQRSFLHSFILSFTQQT

SEQ ID NO: 927412 - protein, 309 aa, Homo sapiens
MANHTGRLDFILMGLFRQSKHPALLSVVIFVVFLKALSGNAVLILLIHCDAHLHSPMYFFISQLSLMDMAYISVTVPKMLLDQVMGVNKVSAPECGMQMFLYLTLAGSEFFLLATMAYDRYVAICHPLRYPVLMNHRVCLFLASGCWFLGSVDGFMLTPITMSFPFCRSWEIHHFFCEVPAVTILSCSDTSLYETLMYLCCVLMLLIPVTIISSSYLLILLTVHRMNSAEGRKKAFATCSSHLTVVILFYGAAVYTYMLPSSYHTPEKDMMVSVFYTILTPVLNPLIYSLRNKDVMGALKKMLTVRFVL

SEQ ID NO: 927413 - protein, 305 aa, Homo sapiens [sequence omitted]

SEQ ID NO: 927414 - protein, 312 aa, Homo sapiens
MAWENQTFNSDFLLLGIFNHSPTHTFLFFLVLAIFSVAFMGNSIMVLLIYLDTQLHTPMYFLLSQLSLMDLMLICTTVPKMAFNYLSGSKSISMAGCATQIFFYISLLGSECFLLAVMSYDRYTAICHPLRYTNLMRPKICGLMTAFSWILGSTDGIIDAVATFSFSYCGSREIAHFCCDFPSLLILSCNDTSIFEEVIFICCIVMLVFPVAIIITSYARVILAVIHMGSGEGRRKAFTTCSSHLMVVGMYYGAGLFMCIQPTSHHSPMQDKMVSVFYTIVTPMLNPLIYSLRNKEVTRALMKILGKGKSGD

SEQ ID NO: 927415 - protein, 153 aa, Homo sapiens
MYICCVLMLLVPFSLILSSYGLILAAVLLMRSTEARKKAFATCSSHVAVVGLFYGAGIFTYMRPKSHRSTNHDKVVSAFYTMFTPLLNPLIYSVRNSEVKEALKRWLGTCVNLKHQQNEAHRMGENYTSTCSRGNFITHTRFMHHQRNYFRTR

SEQ ID NO: 927416 - protein, 312 aa, Homo sapiens
MARENSTFNSDFILLGIFNHSPTHTFLFFLVLAIFSVAFMGNSVMVLLIYLDTQLHTPMYLLLSQLSLMDLMLICTTVPKMAFNYLSGSKSISMAGCATQIFFYTSLLGSECFLLAVMAYDRYTAICHPLRYTNLMSPKICGLMTAFSWILGSTDGIIDVVATFSFSYCGSREIAHFFCDFPSLLILSCSDTSIFEKILFICCIVMIVFPVAIIIASYARVILAVIHMGSGEGRRKAFTTCSSHLLVVGMYYGAALFMYIRPTSDRSPTQDKMVSVFYTILTPMLNPLIYSLRNKEVTRAFMKILGKGKSGE

SEQ ID NO: 927417 - protein, 280 aa, Homo sapiens
MRRDQENNSGNVTKQDSLIPPEDHSSSPQMDPNQDKISELPEKNQNEIDSINNVITSGNQGNTERNAKCTEIEDKVFKSTQSIQGKEKIILSNEQSLQEVWDYVKYPNIRIIGVPVEEEKSKSLENIFKGIIEEDFPGLARALDIQMQAAQTSPRKFIAKRSLHIANMLTEVKMNEKIVKAVRQKHQVTYEEKPTRLTADFSAETLQARRDWGPVFSLFKQNNYQQIILYSVKRSLTNEGKASSFLGKEKLREFTTTKPALQELLKGVLNLETNSWNTPK

SEQ ID NO: 927418 - protein, 347 aa, Homo sapiens
MAWENQTFNSDFILLGIFNHSPPHTFLFFLVLGIFLVAFMGNSVMVLLIYLDTQLHTPMYFLLSQLSLMDLMLICTTVPKMAFNYLSGSKSISMAGCVTQIFFYISLSGSECFLLAVMAYDRYIAICHPLRYTNLMNPKICGLMATFSWILGSTDGIIDAVATFSFSFCGSREIAHFFCEFPSLLILSCNDTSIFEEVIFICCIVMLVFPVAIIIASYARVILAVIHMGSGEGRCKAFTTCSSHLMVVGMYYGAALFMYIRPTSDHSPTQDKMVSVFYTILTPMLNPLIYSLRNKEVTRAFMKILGKGKSESELPHKLYVLLFAKFFFLISIFFYDVKILALIMYIA

SEQ ID NO: 927419 - protein, 403 aa, Homo sapiens
MAWENQTFNSDFILLGIFNHSPTHTFLFFLVLAIFSVAFMGNSVMVLLIYLDTQLHTPMYFLLSQLFLMDLMLICSTVPKMAFNYLSGSKSISMAGCATQIFFYVSLLGSECFLLAVMSYDRYIAICHPLRYTNLMRPKICGLMTAFSWILGSMDAIIDAVATFSFSYCGSREIAHFFCDFPSLLILSCNDTSIFEKVLFICCIVMIVFPVAIIIASYARVILAVIHMGSGEGRRKAFTTCSSHLMVVGMYYGAGLFMYIRPTSDRSPMQDKLVSVFYTILTPMLNPLIYSLRNKEVTRALRKVLGKGKCGEQLVTRADNLPQTMGLSFEKANRLTSSERLREPASVIQFLQRVSGFSQLSWYVPVVVLGANIHNVSFHTLLCPSEWELKASPPSYPSSKSRC

SEQ ID NO: 927420 - protein, 158 aa, Homo sapiens
MAHVYISRPHFWRSAIVCWGPIPGPVGLGITSGGHKTAKVAACCFLKASSQRSTSLLPARALLYEVSVDPYWEVSPSQEASGALSQDDDSSVCKPLNGASGFPAEMPCPVPLESEKFPATQHQLQQPPRFVFETQGPGSVGSQGNILFCGLQKSTERA

SEQ ID NO: 927421 - protein, 317 aa, Homo sapiens
MEQSNYSVYADFILLGLFSNARFPWLLFALILLVFLTSIASNVVKIILIHIDSRLHTPMYFLLSQLSLRDILYISTIVPKMLVDQVMSQRAISFAGCTAQHFLYLTLAGAEFFLLGLMSYDRYVAICNPLHYPVLMSRKICWLIVAAAWLGGSIDGFLLTPVTMQFPFCASREINHFFCEVPALLKLSCTDTSAYETAMYVCCIMMLLIPFSVISGSYTRILITVYRMSEAEGRGKAVATCSSHMVVVSLFYGAAMYTYVLPHSYHTPEQDKAVSAFYTILTPMLNPLIYSLRNKDVTGALQKVVGRCVSSGKVTTF

SEQ ID NO: 927422 - protein, 151 aa, Homo sapiens
MVSEEGRPLDAGFTVKLKDSKADAHNVDLTHHNGLFFKGNESQIVSLAAMENKCYPQNGSILKALDCNDALLTALFKSRPVVAGTSKNTVFDLSQDPVLEEERESQKLLVKKIPLFNQILVTVAIHACHCSWHSDTCTQCFHLFPGVAAKA

SEQ ID NO: 927423 - protein, 171 aa, Homo sapiens
MCVVSILLFVMELVIAYVGNSLSLASDAFAVLSHFVSMIIGFFGVRASNIKQHKKSTYGFLRADVVGAFGNTIFAVALMFSILVEAIKRYINPQKTEEPILVLSAGIIGLFFNVLNYVIFLDCCYCAAPKPQGDMEAGNEKVSSGTQRGSKGTNRSHRESDWKDGGCGSLL

SEQ ID NO: 927424 - protein, 135 aa, Homo sapiens
MDIQFSQHHLLKRLSSPIYVLGIIVENEFSLDLRGKAFSFSPFNIISAMGLPFTAFIMLRHTVAITPRIALALTGSQHNTGSFQRPDVGEFPQALGGSRDAVWQPGIRVKNLRNLPGHMLPHSIGSKSSIAPGLA

SEQ ID NO: 927425 - protein, 137 aa, Homo sapiens
MKKPPKKHFQLPVLAAAPPTRISKGLDSRQPQPVLVASPPGELAGVFKVSNVASSNSSPTVTYPLTRTRKGSQFLSTSVIVATWKHPGNFCILHRFSFTLKCVHGKEIKSTSKHDPKKPSYLPSLFLEKIKIILVPF

SEQ ID NO: 927426 - protein, 155 aa, Homo sapiens
MLSGNQDLDSETLGIYLALYSTVAELASKTQDKVLPTLPSPTPQAEESPCVHHYHLPTGSTARALPISLQIQGLFSQLRCCPRAMARIRDLTSPPDALSLFGQADTQAQDKVPFISPLAFLKEKGPLPVAMMAVNEASMSHTITQDPQPVPPVIQ

SEQ ID NO: 927427 - protein, 245 aa, Homo sapiens
MTFHQNPRNACSLFEDDENTEGGVVHLLGLGKEVVQMCMIMDGLDEDGFAVRVAAYEVDGSAGCISCNEADLMVSMFGVHSPPEAERPTEEKATVIHSAMHAKSGTVSFGPVLNFCPACVMLLPGLHRDAGSACGYHSHSKCGALQAVSAMAHSSLGAGLSPPSLSLGSGSAAAPRTVAAARAPALLTTAPVTGVGPLAPASVVAPVVVQEAAALGARATAPRAWGTARGSWRQTLYWVLWGTLG

SEQ ID NO: 927428 - protein, 185 aa, Homo sapiens
MGCALEWHCGGPFEGIGIAGGFLERKSQGCRSPLGWLDPQQDMEEKLLRVEGVIMEHFHKVRESCGSELMFPQRTRIQKMQGTGSCPGMGPLEPSLGPIKDTSSFSTSSALTPQGRVCAPACDQGEWQPGIPEGYEQGRGMGRMEVGWRKSCVLVFCHTEEEWDSVCLESVEAVRPTGGRIGGES

SEQ ID NO: 927429 - protein, 145 aa, Homo sapiens
MEMESNSGSRTVKRGVYRNSTKMSCQQNQQQCQPPPKCPIPKYPPKCPSKCASSCPPPISSCCGSSSGGCGCCSSEGGGCCLSHHRHHRSHCHRPKSSNCYGSGSGQQSGGSGCCSGGGCLRLINFRPWICIILALCQYLYFSDY

SEQ ID NO: 927430 - protein, 141 aa, Homo sapiens
MWCGCDETLSVQIYLPIARSGIPAFLHCLTPGVHEWCPDPLGTLSAWSCLVPACGGILVFLQCWSRSVHGRTQTVHECSPGRGKTLNVQTFLLTGHVWTLGGSADGAQPVRGLTLTVCLSLLNVPHCHWPDYHWTLGVHCL

SEQ ID NO: 927431 - protein, 141 aa, Homo sapiens
MARRPILAPLGGKVELSCQLSPPQSAEHMEIRWFQSHYTRPVYLYKDGKDLYGETISKYVERTELLKEAIGEGKVTLRILNVSADDDGQYHCFFKDRNVYEESITEVKVTDSSSEISSQEHFKLDLCQAECAQLFNCFSWA

SEQ ID NO: 927432 - protein, 136 aa, Homo sapiens
MKDSPSLGTFPVHSSLSTASLSRGPLQFFHSLHTSSRGRPIPNQLLPTTPTCILHQDIHREESAFCCSGPRARAFLGASYSSQNIPAPYNSSSLLEPQLLDARLNSSQVGRNPTLVHSAPTEGYASQLSTFPCQRS

SEQ ID NO: 927433 - protein, 139 aa, Homo sapiens
MENRLRAGIGKGPTGTAWQVKEQIFSEHLHWARSWEGKHSCKTLSWETVFVVLVAKGHFIIQFAFANKPETKPGHGRSEPTGGNGGVEDANESGTENKSCQHHYFLRTAQRLRSAEQMLGIRQNGSELWLLVLLDQGSK

SEQ ID NO: 927434 - protein, 140 aa, Homo sapiens
MMTCWQRGATHSKVPSELFCYSIKLLFTLLTLHLSVYLIFPGHKIRTRNLLNATAVTPSLGPCSSWSLQASITFPGASHGSCLCCAWSSHSHTESHLCWHLELPASLQQLACLSVCSGRTPCSLTHTLLATPRLACPWQA

SEQ ID NO: 927435 - protein, 180 aa, Homo sapiens [sequence omitted]

SEQ ID NO: 927436 - protein, 202 aa, Homo sapiens
MDGVCQSHGVASCKEGPCVDDCPLVPLWVRSLAASHGRDPKGEDLHPRPTWGRGRYRCSEWATPGLKRDGIWGSVSLKEKLSPRKRRQLGHDSDRMCRKEGRNKNEDPKQPLVHCAGPGSSLQQEADWYFLTPHMEESHWSAFPSHLSRPPAFHVPPTSLIKSLCPERHLPFHRELNPPTGLQASGLCGEPQGGEALFPPCS

SEQ ID NO: 927437 - protein, 493 aa, Homo sapiens
MHPHRDPRGLWLLLPSLSLLLFEVARAGRAVVSCPAACLCASNILSCSKQQLPNVPHSLPSYTALLDLSHNNLSRLRAEWTPTRLTQLHSLLLSHNHLNFISSEAFSPVPNLRYLDLSSNQLRTLDEFLFSDLQVLEVLLLYNNHIMAVDRCAFDDMAQLQKLYLSQNQISRFPLELVKEGAKLPKLTLLDLSSNKLKNLPLPDLQKLPAWIKNGLYLHNNPLNCDCELYQLFSHWQYRQLSSVMDFQEDLYCMNSKKLHNVFNLSFLNCGEYKERAWEAHLGDTLIIKCDTKQQGMTKVWVTPSNERVLDEVTNGTVSVSKDGSLLFQQVQVEDGGVYTCYAMGETFNETLSVELKVHNFTLHGHHDTLNTAYTTLVGCILSVVLVLIYLYLTPCRCWCRGVEKPSSHQGDSLSSSMLSTTPNHDPMAGGDKDDGFDRRVAFLEPAGPGQGQNGKLKPGNTLPVPEATGKGQRRMSDPESVSSVFSDTPIVV

SEQ ID NO: 927438 - protein, 246 aa, Homo sapiens
MALAASKPDMRLTGSLLCSQFCLCMAEAILLFSPEHSLFFFCSRKARIRLHWAGQTLAILCAALGLGFIISSRTRSELPHLVSWHSWVGALTLLATAVQALCGLCLLCPRAARVSRVARLKLYHLTCGLVVYLMATVTVLLGMYSVWFQAQIKGAAWYLCLALPVYPALVIMHQISRSYLPRKKMEISLVQEGAEFGASWQMRAGLSSLQRPPRSLLQLKVVPQAALGASAERLLLPAAGPPKSKL

SEQ ID NO: 927439 - protein, 135 aa, Homo sapiens
MLYLLWLLYRFLKIIGPVTGLKFNPSPAFEAFFSQGLQLQTIRTVQILGPHCTSFPLNPWVPKVGASQHPPPHPQQLEAHVSFSIKISLCPRAPCSPVVHHPDCTLEIPGGLLKISILLYYPQILIELGCCRTQA

SEQ ID NO: 927440 - protein, 295 aa, Homo sapiens
MRDQPWKKNLGGTPTNLTRKVQLSDAELCPASLGWKGTVMEYQGSSFSDPKHLSHLPGFADPGSYAGRISSHPPPPTLFNGLHAAILDAQNQHCSICEVLPKFSPPGSPVELTTALNAAVHNGAMAYAFMKFITQSPKSCVDKPSWSSSLVGEIDTLNGNYTTALNVRKEICWDCFDEEHLSQQSGELGSKVRVALSRKQSCLCSSESGVNGEVALAPTTGTSWYHCQLCRGPGIPSGIWTAGPHLLLALLLAASTTIAGAGDSGNFLQVEFTGLKGTLVYTNTSSLCGFAKGCQ

SEQ ID NO: 927441 - protein, 195 aa, Homo sapiens
MPSCLLPCIKMCFCFSFAFCHDCEASPVMWNCESIKPLSFINYPVSEEIPKWKRLQEETEHENSEKVQPDDAIEKKNTFSEEKSNPAAEICISNEGPNVNHQDNGENVFRECQRSSPQPLSSQAWRSRREKWFHGRGPGPCCFVQSWDLVPCVPSGAKRGQHRAQAIASEGASPKPRQLPRGVEPAGAQKSGIVV

SEQ ID NO: 927442 - protein, 137 aa, Homo sapiens
MNILKWKLVLPFPGTYVPLRATRGQQRAHSEEHPLPQDSSACARWFLPESSKAREGAESLKGGRAAWVLGVVCGAVASRVRRVQAPPGRPEMKSSPPAKPPRGAVQRGPLGGGHAVVPEVPELALRGPALRSDELIR

SEQ ID NO: 927443 - protein, 201 aa, Homo sapiens
MIDKLATRALIRDYKDGILHENETSREDENESPFPDIPKVSELITKEDVDFLPYMSWQGEHQGAIRNQIASFGFAAPPRQFDASQFSQGPVPGSCADCIPQLASCPTGPPQNPSSAPYCGIALSGSSLSSTQSAPLQPVGGRTTRPSTGTYPELDSPQLHFSLPTDPDPIRGFGSYHPSASSPFHFQLSAAPLTANNLCLT

SEQ ID NO: 927444 - protein, 1912 aa, Homo sapiens
MDKNSDRHSRFLESKVRDKHSEPSSSVLESYVRDKHSDPAEVFWNTLEKHSDPRSSVLESYVRYKHSEPRNSFLESYVREKHSEPSSSVLESHVSVKHSEPSSIVLESYLSDKHSELRTCVLECYVRDKHSEPSSSVLESYVREKHSEPSSSVLESYGQTNRTQQESSGILCEGQTLRTQQQFSGILCEGQHSENHRSVLETSVLESYMRDKQSEPSNSALESFVRDKHSDTQQCSGILCEGKTFRPSCIVLEFYIWHKHSELSSSALEPYVREKHSEPSRIVLECYVWDKHSEPSSRVLESYVRDKHSEHSSCVLESFVMHKVSEPHSSVLESSVLESYVMDKHSEPSSNIPESFVMDKHSDPRSSVLQSYVRDKHSEASSCVLESHKHSEPCSSFVDSTVRYKHSDPRRSVLESYVREKLSETCSSALESLVRDKQTQLSSSVLDSFERQKYSDPRSSVLESYVRDKHSEPTSSILESYVGDKHNPATVFWNPLDKHSDNHNSVLESYVRDKHSERSSSVLESYVRDKHSERSSSVLESYVRNKHLEPSSTVLESYVRDKHSESRSSVLESYVRVKHSETCSSALDSFVRDKQTEPSSRVLESYVRDTQNPAAAFWKPFPVLEFSVRVKHSEPRSNVLKYYVRYKASELSSSVLESYVSDKHSETSSSVLESFGQTETSSSVLEAFVSEEHSDPRSSVLESYVRDNHSEASSTVLESYVNDKYSEPRIKTNIESQTSVLESYVRDKHSEPRSSALESYMRYKHEEPSSTVLEPYVRDKHSEPSNSDLESYVRDKHSEPSHSVLESYVIDEHSEPSISVLESFVRDKQSGHSSSVLESYVSDKPSELLSSVLEFVLASYVRDKHTEPGSSVLESFVRDKHSETSSSVLESFVRDKYSEPRSSDLESYVKHSDPHSSVLESYMRDKHSEPSSSVLESFGREKHSHPRNSVLESYVSEKYSDPRSIVLESNMRDKHSESSNSVLEPSVRDKHSDPHSSVLESYVRDKHSEPSSSVLESFVRDKHSDPLSSVLESYVRDRHSEPSISVLESYVRNSHSDPCTSVLESSVGDNNSEACSSVLESFVKDTCSDDSRSVLESYVGDKHAEHSSSVLESYRDKHSESSSTVREFYVRDKPRERSSSVLESFVRDKHSDTQSSVLESYVRDKHSEPCSSVLESYLRDKHSDPHNTVLECSVSDKHSDPRSSVLESYVRYKPSELSSSVLEFYEREKPSEPSSSVLECSSVLESYVRYKHADPWSSVLECYVKDKQSEPNSSVLESNYVRDKHSEPSSSVLESLVRNKLSEPLSSVRESYVWDKHSEPSSCVLQSYVRDKHSEPTSGALESLDKHSEPSSSVLESNVKDKHSEPSSSVLEYYVRDKHSEPKPSSSGLESSVKNKHSEPSSSGLESSVKNKHSEPSSSDLESYVRDRHSEPSSSVLESNESYVREKHSEPCSSDLESCVRDKHSDPGSTGLECSVRDKHSDPRSSVLESYVRNKPSELSSSVLEFYVTDKPSEPSSSILEFYVRDNHSETSSSVLEFYVRDNHSETSSSVLVFDMRDTHSEPSRSVLESYVREIHSQTSSSVLDSYVRDKHSDPRSRVLESFVKDKHSEPSSSVLECYVCDKHSGTHCSDTESFVRDKHSDPRSCVLESYVRDKHSNPRNRVLESFVKGKHSEPSSSVLEYYVCDKHSGTRCSDKESFMRDKHSDPHSGVLESYESYVRDKHSEPRSSVLESYVKDQQSEPSSSVLESYVKDKHSDTLSIDTECFLREKHADPHSSVLKSYVRDKHSEASSCVLESFNPQAVLWNLCEGQAFLHFSSVPESHVIEKRSEPSSRVLEFYVKDKPSEPSSSVLILNDRDNPSDPSSSFPESYVRDNTQNPTAVFWNPILVAVFWNPICGTNTQNLGAVVWNPL

SEQ ID NO: 927445 - protein, 364 aa, Homo sapiens
MIEAPEENINAYLHRTALHWACANGRAEVVTLLVDRKCQLDILDGENRTTLMKAVQCQREVCANILIDSGADPNIVDVYGNTAVHYALISTALMLAMCHGSSEIVGMVLQENVDICAEDTCGMIAERYAVACGFNPEEPDPASQIEKSDERTPTPKASTWDPLYHFALLSASDPSPRAAAATPDPTPDPSPAQAVPPPYNSNSWELSSHEPVPCQPKYLSLKGFQHEPSMSPYNTSILPVKKSDGPYRLVQDLRAINRIVQTTHPIVLDPYTILSKIPYNNQWFTVIEAKRCNGYSVIDGETLEEIEAGKLSKNWTAQTCELFALSQALKDLQNQEGAIYTNSKYTFDVVDISGIQEEISQDHT

SEQ ID NO: 927446 - protein, 169 aa, Homo sapiens
MVDPHIEFQNIPALVWVIPEHGYEGMNDCPSHGIPVYCWRVLRVSPSHTIREHCYKALNDCTSHGIPENSCSHLNVCPSDSIPEHCYWVLSVCPSHKIPDHSCCGPNVCSSHSIPEHSCCGLNVSPSYRIIEHYRCGLMVDPHIGFQNTLAGFWVFVPHMGFQNNPPVV

SEQ ID NO: 927447 - protein, 585 aa, Homo sapiens
MIRGIPKHSCCGLSVCPTNRIPEYFYCGLKVCSSRRIPEHCYEDRIREHCYKGLNYSPTHGIPEHSCCGLNVCPSLKIPEHCCWVRNVCSSRTIPEDCYVGLNVFPLPRIPEHCFEGLIPEHCCSVVSVSPSHRIPEHYCCGLNVCPSHRIPEHCYECLNYSPSHRIPEDSCCGLNVCPSLGILGHCCWVLSVCPLCKIPEHCSVGLNVYPSHRIAEYCCEVLNVCPAQWTPEISFCVLNVLHVCPSNRIPEHCCCVQNVCSSHRTPELTCYGLNDCPSYRNPEHYCLEHCYKGLNYSPSYRIPEHSCCRLNVYPSLRIPEHCCWVLSVCPSCTIPEPCHVGLNVCPSHRTPEQCYEEYCCWVLSVCPSFTIPDHCYVSLNVCPSDRIPEHRYEGLNVCPTVRFPEHPSYRLNDWPSYKILENCCWFLRGSLSHRISEHCCWGLKVCPSHRIPEHCYEVLNYSPSHRIPEHSCHHLNVPHLGFQNTAVVIPEHCYEGLNVCPSHRIPEHCYGCLNYSPSHRIPEHSTCCLNVCPSLTIREHCCWVLCISHLHTSPEHCYVGLNVFLSHRIPEHCYEGFQITAAWF

SEQ ID NO: 927448 - protein, 148 aa, Homo sapiens
MLYSTDAEAVVVEEHKLAVSRTGQGSAGGSRAPGTTTGGTPCVQVHGFPVPLPLTKHVKNSKGFRSQTWAQARGAWPVVLAKVGTWVPNRHRSTALARRDWQFQPWDISGGNWSCGHPGDTESGSLCPSHRHPITKMRGFALNICSLS

SEQ ID NO: 927449 - protein, 300 aa, Homo sapiens
MGKHSDIPSSVLESYVWDKHSDPSSSVLESYVRYKHSDPGISVLESYGKTFRPQQPCSGVLCDRHSDPRSSVLESYVRDTHSDHSRRVLESYVRDKYSDPHSSVLESYVRDKHSDPGSSVLESYVRDKHSDPSSSVLESYVMDKHSEPRSSVLESYVKDRHLDPRSNVLESYVREKHSDPRSSVLESYVRDKHSDPSSSVLESYVRDKHSDHGSSVLESYVMDKYSEPRSSDLESYVRDKLSDPSSSVLESYVRDKLSDPRMCSSILCEGQTFRSQHQCSGILCEGQTFRPQEQRSEILS

SEQ ID NO: 927450 - protein, 157 aa, Homo sapiens
MGVTTAYITDTTTPFLGGGDTAEVRYMPMPVPSNQQTTASWESNGLRKKDTKTKKTQSQEHVFHACKKDKERHPCQAALIRDDSAMRLHVHNHLGNHGQGETDVSSAEFGEEEAHGGVERGVRADSQDAEQVPQHRDHIHGQGQGQQSEDRLQFWIL

SEQ ID NO: 927451 - protein, 324 aa, Homo sapiens
MHGYLLYLFVITAKDQQAALLHPHGAFTGTSKSLPAPHRLLGCHSFWVCGQTTRTLAQCPPTPCGPQPITQPQPHHPLLPKPFLMPEEKAMPLSHSLCLVSCHVGGAVSGGESSPGREAHLLLSDFRAASQGKNPEQMEASQKPVAGLWAWWLNISLSAASHGAQNHPFKRVTTTLQSQGWNKDLWIMRELLCNNRPEQLLQETATIKAPIAPDQGSPAPLMVEGGYLRSSCVSTADPWSQEVIYNFCKAVSSVSCMPFNIHFNSNIPPESSGDWRMQQPCKVEQSILGAQHGGGGCRPGSLRELFPCLLAEPNVEEEVAALGA

SEQ ID NO: 927452 - protein, 317 aa, Homo sapiens
MKTSQFIFKDEKITETDSEPEEGEITDSQTEGSYDEGITSKGNATAKDTEEADEEKVWPSYMRVIVIRSPVLQTGSFFIITAVKSATIGRENDMEHTLRIPEVSSQNGTIVNVKWIVQLKTKCDPYEPEHGDKVKIGDTVLSYYIHPGSNSCVGCEPGHVRAHLFLDKKDESLNTDYKDDKILENPKCKDRAGKHREQIGNEGNFQRDDAPASVHSEITDGDKGQKMLKKISGKHMQDWRQTNRLQLKRLTFSKTRTTTTRTTTGTKHRRGLLKTFNNNNNNNNWDKAQERFAENFPETKLQKDDLGTIPWVKGTEE

SEQ ID NO: 927453 - protein, 282 aa, Homo sapiens
MGKGNEDPDLHCSSIQCSTDQPPFQQISFTEKGSDEKKPFKGKGKTAFSHSSEKHTQRQAGSDPNPNKENSEETKLKAGNSTAGSEPESSSYQENCRKRKISSKDICQDRAGNCPEEECNLTLNKKSRSSTAVHNSEIQETCDAHHRGSSRACTGRSKRHRSRALEVQTPSLRKSLVTSVRAMSEAVYQDLAQVWAQQIHSPLTCEQLTLLTRLRGPLCAQVQTLYSMATQAAYVFPAESWLVPATLPGPGDSALDREAHPFPGQEITEPVSGSDEAKLGAP

SEQ ID NO: 927454 - protein, 192 aa, Homo sapiens
MLGSLELLRDLQNCFEENADSDMDNEDQAEVASYGDEELVGNWSKGDSCYAKRLTAFCPCLRNLSKVFKRKQSIKVLKILQLDDEIEKDNPFSGEKFKPAAEICISNEELNINHQDNGKMSSGHVRDLHGYSNHHRPGGLGGKNGFMGPVQGLAALCSLRAWCPVSQSWLKGQCTAQAMASEGTSPKPWQLT

SEQ ID NO: 927455 - protein, 138 aa, Homo sapiens
MLEVHVSMGSGSHVGQQEGPAAQLSVPGADCGRNLGKSGEELGDTGESLKAGGEEVKEMGEGCSKVPGEELPLKSEFLRGEKEKLGEASMDFGESGLGDRSLEEPDKTPLFLDADMIRKPAAPRDPYQFSNPQNEGVF

SEQ ID NO: 927456 - protein, 160 aa, Homo sapiens
MLGARAGSGVARQLLPAHRGRLQLGRPGGGAWSGCRLECVRARLEGPLVVPPASLLGASLPLRLRRRWAFARAELSSPQHRPGEHREGEAEFSSAQTSEIQRRRSSVLSTDPGGRAGSTARAELRSAQHRPWGHCLALVRDENAVLFPYMWLANYPKIMC

SEQ ID NO: 927457 - protein, 259 aa, Homo sapiens [sequence omitted]

SEQ ID NO: 927458 - protein, 206 aa, Homo sapiens [sequence omitted]

SEQ ID NO: 927459 - protein, 191 aa, Homo sapiens
MPPRGSVSVIMKAMPLAPREWHSTAKIDEANLHLGSSYHTGEQSCTHSDVYLRRTFRGPTAVVPTTLWLHKGITGAKSLGPVIVSSGYHKKISQTGRLKQCLFLMVLESGKSKIKVLADLVSGRGLLSGWQTAAFLMCLRMEDRKLCLSSSSYKDTNPIRGSPSSKLHLNLITSLHPNTTTFRIAASTYEF

SEQ ID NO: 927460 - protein, 169 aa, Homo sapiens
MNRTARRACILHPECPPNPAWTPSFLDISETGLKEERDEYTDEAPHCYKSQCLELSWNPHQHALPIPRRKQRTCCQGPRLARKYLRLRDGFSVISEKGSSPRQDERKEVPLWVSKDQGGRKAQERDRSPCPPLSRMASDRRGESISKLQGTARIGDDVFSCFITRIFLK

SEQ ID NO: 927461 - protein, 143 aa, Homo sapiens
MVPSMLGFWGGLGELLVVAGGRRASVSDGKMISQDAWRGGTVQYDSKVSLDVCNEPTLISSIQAHPGYSFTSSFQQVRFIETCEHRSTAYRNRCGCKSVILLLSVETEEGTGLQSMETCGCRSKTCRKRFKHKSTKIDMGKGL

SEQ ID NO: 927462 - protein, 201 aa, Homo sapiens
MELGSQDLFSTLVISVSFPAGTNSETRDGEEELVGNWSKGYSCYVLTKRLGAFCPCPRVLWKFELERDDLGYLAEEISKQQSIQEGSAEGGQSPSTEPSGAVRRGPPSSKPQNGRSTNSLHREPGKATDTQRQPVKAARRGAIPCKATGVELPKAMGAHLLHQRDLDMRHGVKGDNFGALRFDCPAGFWTCMGRDFWSVDF

SEQ ID NO: 927463 - protein, 148 aa, Homo sapiens
MKEGGLDQVEVVVAVKNKGEIHMFRRPNSDPLLPGTLCSHHNPWCLLLPLNYVRDSRFTSLQLTSAPRAGTVWVQGTVLPGPRFPPLSNEEEGPILLNVCLAVQLVLLMTSVHFEGPVETRVPFSLNLPFEGVPSSVIAVSPCAYYLG

SEQ ID NO: 927464 - protein, 134 aa, Homo sapiens
MTASSLSHLQKSPQNVVLQTSQVPAYLTLCVHHETVNSSKAEAVFTCCVSPASPVGSRTEEIFSSIGCLTTLGFRLVFKGTALKSARKLWALQGRKSCKTAWGLEWELWALLLGDTIAVGMKLIQLTHQQFFKK

SEQ ID NO: 927465 - protein, 196 aa, Homo sapiens
MREKQRDPEDRSRISSTWIARAPEGEEGTDGEEARRRVFLDAKDSKERCSDVSGVSSFRWVRGLTDFRSEAADLRSGFVVSLTSGMKLQTFSVSVTAHKGGATTFFAMTCCSSWGEPLQKIAVILSDIAVLQWGTSSPGSYDPMILCDLLHSKHLTRVGFNQGWAPDGKISLSLPGICYGLNCVPLLNPCEAPEHF

SEQ ID NO: 927466 - protein, 156 aa, Homo sapiens [sequence omitted]

SEQ ID NO: 927467 - protein, 146 aa, Homo sapiens
MTGSVERETGVTQDCKESPGGQHGKGTGVTQDCKESPGEQCGEGDRVQGPAPPQTAISRALPKKADSSTTAEQMQCDWKVPKTSEEDERESVPLLFFTRAGRMEESEGIQACLHVKEHKHTLQLHFPLRQRSSGSTAEISCFRTCQ

SEQ ID NO: 927468 - protein, 115 aa, Homo sapiens
MSPASTQCDKISREHGYSSSELGRTRVYLEVPDILPGLHSPALSYQLEPCSCAAEHLLCVRHWKYRSEDVHLPPLTKNCGNTEVGSPPTPTARECQEGCVEEQRGPSMWTGPRCP

SEQ ID NO: 927469 - protein, 135 aa, Homo sapiens
MSALESWASNLTGQKSSLEAPEHTASRAICQPLLLLSSTCHGISLGKRLSLRVISINSQDGVGIRSQLTEPRLLFGPALTAQGKPHMLTENNHSHDKDHNVCHCLSSYSRCSSEHNAPLPLCQVRAHPWPKFTSW

SEQ ID NO: 927470 - protein, 154 aa, Homo sapiens
MGPHVCHAGSGGHGVLALTYLDATETAQPLETDRPLETDRIGAPWCRLALVQSAGAGPWEESAQLMWVFPLVILHPLHASPYSFRFHGCTEHSIVSGIYSFWWVLRLADFKSEATGPHGVKPQTFVDLCCEYYRVVIGPHSTQEVQLASPLSIQ

SEQ ID NO: 927471 - protein, 170 aa, Homo sapiens
MSWVSQALPSYCFFPQEDVSTLTELTRNSEPPSFLLPSRRNHWEGAGPLGEGCLYLGCQKRVRLFAASTSGLDGCCSFKPGLLDDNGDDADEDPGDCTGNRTDAVSDPTENSAGGARSCGFRIALSRLDFLREPVELLTCSKQGMSKDGGGSGDLYFNLHWVVVSRGPSR

SEQ ID NO: 927472 - protein, 153 aa, Homo sapiens
MCRAGQPCPSPCKLPEQKATDGEASELQRFLSHGCRGWKFETQECARRSRPSWALGVIDFWGKLFPRAALPVQMKALESWLEPQLHFLPSAAQQLSELSGCSNKPVDLPQVILRELNWATQARAPAQSLDTPRMLLPPAGGLPPWQRGLSKKP

SEQ ID NO: 927473 - protein, 137 aa, Homo sapiens
MRAGEAFPSPAGGTSCLTGPPKERWGGALGRVWPGFPDPAGCWSGLPYRMITLAIVVREMLCVEGGSMEMRSEAEDEGGCGPAGSRTVLKKGLDLGIWYWKGRAPSFADGGMSVDHRASVEAGGGRALRGGCSRAWG

SEQ ID NO: 927474 - protein, 140 aa, Homo sapiens
MGSEGRGRPKGSGFGSQPLEERNGFTERRFLGPTTNTQDPVFFLLEIVWFLELLLGLGVTDSRFVCWEDTTGELLHLSELPQWDKLWRTFTAGHSSTRGSCFCQPQVPHLVLPEMMPEEDRYQPQLTECMKTKGLPGRGH

SEQ ID NO: 927475 - protein, 195 aa, Homo sapiens
MFQAEEAASARALGQSGTLKWRMEVTVEGQGQRCLGPVSLCEDLGFPPETGRSLAEIVGTEWGDSWEDYAEGDGSVSCEGDGKWPDPGCILKGELAEFPGRNVTIASWKLICEWHSAALDPQHHCPVSKAEDFHTGWVLGPGEERVWNMGYLFVLVHGKNEWKDTTIQYRSWLRSFRNEGLGHLARVPCFGAVSS

SEQ ID NO: 927476 - protein, 225 aa, Homo sapiens
MRISHEGEGGADGLGRTSTGEAVLGAKRTGSGPLWQEELCSSKTETVFLLSGKQPSLMLPPPPDTARHGAYLELELAGWQRYLLQEARRAKKAVCVKSPVLVPELCGPSSYLPGQPIHHVTSSTVACVCQALQGAQLISKSHWFCFHMYPQSVHVSLLIAWVPHEIKEPCRVGLGPTSSWVHVIIDASQVLPFSLDLSLGPRPGYLTVHLRAQQGCPAECDCIWR

SEQ ID NO: 927477 - protein, 127 aa, Homo sapiens
MPSQAHWLLQQGRQLRVQAWALALCEVVAGPGTPQAASTAATGEHSSTWKLGESRNYRAPKRESQPYFQELLVWAPQRAAALLTFSPAMCPQETKVNCKVTCLYSYILEAVLILKIPTHQHLLMHKN

SEQ ID NO: 927478 - protein, 146 aa, Homo sapiens
MQSIVLYINDSIIAGLLLQHSGIHGPLFTDIWSNWLPVPRWWRQGTAPSMASFTHDWQMVPFLGHPGSSPLQEPLRKILKSRGCGHLDWHCLLVLVSWYPSPGTHLLVPISVPRHPVPPPSVERSLVRRGRPLTTPEDTAALHTVP

SEQ ID NO: 927479 - protein, 250 aa, Homo sapiens
MLELCWYSLQNPWLLLAFFVGLPAPGPQLTGVDAWKKLGGRSWVFLYSNTKWIGRRFWGQWTTSSLTCLTQSTPFWRGPCPVSLQTTRLLAAPPVSLLSMPGGRGTLSVQGTDANGEITADFTRKQGILTTEPRLPHGTSAQLMALMLFWWLNIDHGENIYTTESGKYCIVGPYGLESWWFNIFQHSVVTTVFTTLEFKTDKFAKHGKTEAHVLSAIRVRLRYASRASESPLDTSVRKCMRKANQGSVLL

SEQ ID NO: 927480 - protein, 343 aa, Homo sapiens
MELDEWERIGRDFKNAYKDGAKIPVSVWSMWALIKAALEPFQTDDEADSDEEEEDECKNLTSDSECEEQKMEKIKEKKGKLKKVCFTSPSVPTAELSERPPPFSPLNGPEDELATKLTAPVVATLKPGAIGGAIQNSIQKARAEGDLEAWQFPLMGVRPDWGRLENQAVMEDVAIVQLSVRQGPKESYIDFIARLQEAVYKAVTDKTPQDAVIQLLAYDDANAECQTAIRPLRGKTHLTEYIKACDGIGGNLHKATLLAQAMAGLRVEKNMPRFSGSCFNCGQFGHTKKERRKGNKKARATINQQKSPSVCPHCEKGHHWASQCHSTFSKDGLLLGNGKRELP

SEQ ID NO: 927481 - protein, 146 aa, Homo sapiens
MRLHPDEPICPMGPDSDILELVQDVINRVTDVFAKHWRADPHLTSVTSKAPCGSLVVGLATPLRREVHLTALPNCFFVFPEETDDSSPQPLNDPSELELTRDKLPQPSLAQAEDFYPHDGLTILPRSNFNYNSNHFPPSMQAHVLF

SEQ ID NO: 927482 - protein, 181 aa, Homo sapiens
MSLSDSFEESSENLQPDNVIEKKNPFSEEKFKLAAELCISNEELNVNPQDNGENISRAYQSAVQNENMESRPKHGVPPGALPNGAVRRGPPSFRTQNGTSTDVLHRVPRKAADTQCQPMKEAGREAVPCKATEVELPKTMGTHLLHQCDLDVRHGVKDHFGDLRFDYPTGFQTCMRLDNFN

SEQ ID NO: 927483 - protein, 145 aa, Homo sapiens
MSKAASSQRVGSVDGLCDTFQNLLGCSENYYLALPRFKGSRRCSLQGVQEGENLVLMSASDVYHSVCPSPEAMLLSAAEEGISDYIDVWHRTITLNGALVVSRSKWYSQPITDLPSNAVQGTSADCTIQISGKRKQSKTLACCGV

SEQ ID NO: 927484 - protein, 146 aa, Homo sapiens
MVPLSVIKKTEERPGEGSSVLDTSIEMPVRHPNGCVNGAALKAGLAYSWVPPVFLLAEESSGIHVQNVQNNQGLLPVMRNGIVAVGNILMVPKKGTFNPAEDAGYKRGSTRQKNLPGRCVRRCPLFCLAQGDGKEDEEGRETRAFR

SEQ ID NO: 927485 - protein, 163 aa, Homo sapiens
MGNPWPLLHPHPGKKNFLSTAAPEWIMVYVRTFYDVSTVTKLLSDAFLRTYPCHLVTHDCGTMWQDLVADRPVKGSYKDTKGCASNNANAGVKRRKKALEEDAGYRPSSLGQICSIFVILCGFLRHLSVISKVSPIFSQSNIDLLFNPLFERKLFLSESPLSH

SEQ ID NO: 927486 - protein, 135 aa, Homo sapiens
MTRVRGCPMPLKENMRVCKCIRRKAGENRIGLQKRNKEKKGERENHLSQHCSSLLHLPSPRAQQGSLGQCNVLLIKFPAPTLPSCNPSSSQGLQESFKAYIRLCRCVPPLLTILLGFLYIENKSKIHAHSKKIPI

SEQ ID NO: 927487 - protein, 139 aa, Homo sapiens
MGDRPLNHRPKSDILDYNFVSQFSIPHQGLLNFICASKMKSKSESYLGIQPSHILSPEHCAVLYHSPQAKVQLKLCEGRKLSHLIKRRGSKRAWKWDILVWETGLQRKCSQNVVPRPRASASFGDFLRNSNSWTPLWIY

SEQ ID NO: 927488 - protein, 157 aa, Homo sapiens
MSGTNRDPGSMAHHTLSATLHSFPDFPLSEPVTRFLLHPVVVRAESSWVALSSISGRSANGEISEPFEEVMGPLNHFVNYLVTASSPLGTHSYLLALQRAAPLTCGWLPGPKRARHPPSPDGMRAPSGGQSFLSVKCTHRSLDKHLLATCKIIVDGF

SEQ ID NO: 927489 - protein, 256 aa, Homo sapiens
MTLKTPLLRKAQLQSPFYTPAQQEFEEQQAFEKSRKFLRQLEICFAENPSHHQKIIKVLQGCADCLPQEITEDTFDPEDHPCGSVTANPTRARSPMKPPRTGLSGPPEREMPISGIDTSETSPKAPRGGLAKDSGTQGKGPEGEQQPKATEATVCANNSKVSSTGEKVVLWTREADRVILTMCQEQGAQPQTFSIISQQLGNKTPAEVSHHFRELMQLFHTACEASSEDEDDATSTSNADQLSDHGDLLSEEELDE

SEQ ID NO: 927490 - protein, 151 aa, Homo sapiens
MFPLNSLKLLFLSHLSAAADLGLRAARAVPRQWYWQRGFWELHFREMQSCCYSECSAREQGQQENCCCGCRGGTFGCLWEPIPRESQNHFHLRVVRAVPLQLQWQMGCELTLGFPLQRNAKPPPTDMFRWGQGSCTGVPDPSSEKWGWGPI

SEQ ID NO: 927491 - protein, 134 aa, Homo sapiens
MDFPFFPSNSQASLLQVYWSLLEVHARPFARISPAEATEQQRLLPVPSSGSFAPEGHPPDASQSSPGVQETQYQHLLPVRLQEASNHGRGQSGSQWEPVFHTVREQERGEERRERAHEREREEVPSSFKQPDLL

SEQ ID NO: 927492 - protein, 173 aa, Homo sapiens
MVLLPASKQIALLPFSGYRCASLSILLSSQTVSTLASSLSVATITALPVVGNWLKKKGCLSRRTLMWDVLKFKVFKQGVFETDSALRSGGALWAWRRSLFQRSTPSPKALAKSIPHTQLHCQKSADLRFVSRQGWRRELTTRQMAIGMLPSYEHFEIPQPLASAKGTSPSTPC

SEQ ID NO: 927493 - protein, 135 aa, Homo sapiens
MSQEKEFHKTISSIKAGIGHFHFFCGGMSSVEAGTGHLDVQQLVQYTNVKVMHLFNASESANGHGGSPGTRSLEGLGSEKGSWALDYMIIIRCIIKRVSKLPKSIWHIQTNSVDFAMVVVMANQSGVSRQECVRD

SEQ ID NO: 927494 - protein, 139 aa, Homo sapiens
MLGQGQQCLCWSPATGQMGLLSVAAVVGRWLESMHFPHVLNLAVEAHSSSGCRQVNCQGLKLWYWWQQPATAVAAGRRYQQGFRDVETSSAAARKRGHPKSAFFNLAQEGIQGELWGAVRRGSLLKATQLQTKASSSLS

SEQ ID NO: 927495 - protein, 148 aa, Homo sapiens
MAGRRQRRARFEASEGASLKPWQLPHDFEPAGEQKSRIGFWEPLPRFQKMYGNTWMPRQKFAAGVGLSQRTSARAVQKGNEGLEPPHRVPAGALPSRAVRREPAFSRPQNGPFFLQCAFILYPTRKQNVTRWLLLGKNYPEKKLDASF

SEQ ID NO: 927496 - protein, 188 aa, Homo sapiens
MAHVCICKKPARCAHSGPSSAGLLELAGGPLQTLFAWVSPAGATEQQRLLLFLPLEASSQRGTRQMPARALLYEVSVSPCWEVSPSQETWGAGRQGCLSLLKLRPQPPLPTGALSQGDGGFIYKPLTGAVSTVRRKRPTQASVMVDNPPTTKLEHPRWTSDCCADSESFKPVDLSLLGPWGLNIMLTS

SEQ ID NO: 927497 - protein, 147 aa, Homo sapiens
MCSFISWVFGNPVAEGHGQNTELVSGFAHSSNSSSSNRNSSSRSSIRKAYYFHSLTHSGSSTGLRAEGGMVVTPGKIPETFSDKIFNEDELVHTLCMEFSWYQHIQRKWKKAELGRGKKLSYDAISADFSDNPIGNLEARITFPELG

SEQ ID NO: 927498 - protein, 158 aa, Homo sapiens
MLSSLFCFSPVAERQCCFWFPSLINRRELLGINDWINVPFMNAVFSREGQVGTEGSGRDPQELLFHKPQISKSEPLDQTTGYRDTCNGTCTYDQFQTTDQLQIWPFVNYQGKEDLPKPESEKTNGTVSKEPWNTTGKRKRRNFTFVENLQCIMNWVHR

SEQ ID NO: 927499 - protein, 156 aa, Homo sapiens
MAFGALRWRWDRVSGCVHVVFATITSNQAAGNAASERSSNKHSLNICLIPGTVPDTGPSESIPEEGIEIMGHESSMHVIAAEDLPVGQDAEVEDSNIDNLDPVEKSMGKSALVHLLVQQILMQHRLVFCTGSEDTVMSTVQFLPIQNKEAREERHK

SEQ ID NO: 927500 - protein, 147 aa, Homo sapiens
MFRQKFAAGVGLLWRTCARAVRKENVGSEPPHRVPNRAPPSGPVRRKAPSSRLQNGRFTDSLHCVPGKATDTQHQPVKAAGRKPVPCKATGVELPKTMGTHLLHQHDPDVRHGVKEDHFGALRFECPAGFRTSMGTVGPLFWPIFPI

SEQ ID NO: 927501 - protein, 232 aa, Homo sapiens
MIRWALWIWVLLLGIIRAHFMVVVKLRFRAKQTPCYLLHTSFCKTPCYRCQSLQGATGSSSNPGTAAPETWRKAGGRCHHTHFTDENTEPLRFNNLSKLAQLEDGRARTGPRVVRLENPGPICCTKLKGQVRQEVGRIFLKNSTHWGLPSERAQPDHPIVTMCQQPLPYTLSYQGSSQYEQPLMPPLHSFNADALLVLGRDFMCVQAMSTTLPNCQMAEASPTVRSILISET

SEQ ID NO: 927502 - protein, 145 aa, Homo sapiens
MALVMAFIFHKHVEHPWPRGKKLERWARRGSSGVFVSQFCDHHAAPTGYQASGAVCRSGGRVRFQENDPREVPAEKRRQQGAGQGHPATKAKTKDCWVNLIAPVSVEGSCLKLEGAPASGNAIRRGEEKETLLDGVDELRERKGW

SEQ ID NO: 927503 - protein, 136 aa, Homo sapiens
MHVMIIFFKDSHNIISYLTSYSTNLPLSHQEVESNSSPIAGICLFLLIERRRIDAIRFLRLGHWLIYYRDDITLIGPDEKTEAQTGQETCSVAHTNSKSRCACKKQRSCFHTNALKIKHKGRKIPRAHNAKNKNCF

SEQ ID NO: 927504 - protein, 136 aa, Homo sapiens
MKLRDDWVLHDLKELWLEIWIKLQHSFMENLYDNPGEDAPIQSKQEPDLEEKKRSKINGTSRDWERARKTTKYYVMISIKYIQVEVYTLATESVAQELATSAPDGNFLAFPHGPKVHITPLNIQDFNADFFQCFKL

SEQ ID NO: 927505 - protein, 155 aa, Homo sapiens
MPASCFLWISLPVHKLKVVTEFFIFCILVGEFLMSIISPGDLWNFELERDDLGHLVEEVCKHRSIKEEVEHKSLESLQPGSVIEKKNLFSGEKFKPAAEICLSNKELNVNHQDNGENILRACQRQSWQPLPLQARSSRRKHGFIDRAQGPLLCAA

SEQ ID NO: 927506 - protein, 140 aa, Homo sapiens
MYGNAWMSRQKFAAGVEPSCRTSARVVWKRNVGLVLPSGAVRRGPPSSRLQNGRSTDSFPCVPGKATDNASCEGSWEGGCTMQSHRGGAAQGHGSPPPASVWELNNENTWTQEGEHHTLGTVAGWGEGGGIALGDIPNAK

SEQ ID NO: 927507 - protein, 152 aa, Homo sapiens
MLLEQSAQSMQEPEWAKKGPVIQISAIFALIADCCFWSQRWTQRGGISEEDMVIMGDDSCMHVISPKDLLVREDVDVEESDIDDPDTLCNEMKNTTETSQKENKEHCPNRLLRKKCILPSYGIQSEVLLHLKNEKPYKNVTLTPNEESKEEQ

SEQ ID NO: 927508 - protein, 153 aa, Homo sapiens
MIKAFQVFEEALVFWSKFLVTRAISALGSTQSPVKLWFLKTCKGITLVVLDKIQKNDLDCQKDELVSSTTSSGPQGVPPGHCQCAHKAQVSHRDVGSLLPLVGPEKPSKSQGLKLRTLRAHLVPFPTMAKQVPKVSHDPKSTGSIASTALELS

SEQ ID NO: 927509 - protein, 408 aa, Homo sapiens
MWLTCPPVAGVGGDACPAFWELPRTIGVYPLVEFPQKWNCWAKSSSRHCLPGCQWQCQAASCALLSGCFLGQQKAAPSRSVQTEARLLGQKPQQVLPALQAPSVSSALGGIQDMKQKQEHYVSPQVAPKQVRTKKQLFFNKPCSAPSRTRGQGSMLRTPVNIFRTAAKPWREEYAQRETKRQLTENDTLQVAAAADTQRAEYREVIYVGPHSESFWAACSPWAMGWTSLFCNNTVEKWNPYIDTIKNDAPAMAERVQCRAWAVASEGASPSPWQLPRGVEPTSKQKSRTGAWEPLPRFENMYGNAWMSRQKFAAGAGSTGSLHCLPGKVTDTRCQPMKGAEREAVPCKATWVKLPKTMGTYLLHQRDLDGGHSDKLESIASSQKPEIDTSREEQREQEFMLSWVGIEQ

SEQ ID NO: 927510 - protein, 146 aa, Homo sapiens
MQKNETRPCLLPYTEIKSKWIKDLNIRLRTMKLLQENIGENPQDIGLGKDFLSNTLQAKASEANMDKQEHIMLKSFYPAKEIIKVNRQVTEWEKILANYTSDKKNPWNTTNSLNRHQTSGYEELCYLSDGNNLGKSHKESSAKTLR

SEQ ID NO: 927511 - protein, 138 aa, Homo sapiens
MNFQGHSSVYDISLFNLSGVPQGADLTSPLGSDEPVQVGAAGKVLMDIEGGAKLPPHSPSRVSVSHSPTSVGLLSVISQSKAKGTIVSNLITGVKFVILKFLGICKWLRSKPRRLESFLEALNFEKLLTPLSPGIVCA

SEQ ID NO: 927512 - protein, 412 aa, Homo sapiens
MSLPWEKLPQPLQPLATTTLVSEQPTIEALTVETTVTQLQHLNTVGIIGFRGGRGQVAAVNCQKRDIQPFTRVTVHWGKRNDQTFQALVDTGLELTLIPGDPKHHCDPPVKVGAYGHQVINGVLAQIQITVGPVGPWTHPVVIFTVPKCIIDIDILRWQNSHTGSLTGRMKAIMVGRAKWKPLELPLPRKTVNQKPYHTPVGTAEISATMKDLKDAGVVIPTTTLFNSPIWSVQKTGGSWRMTVDYCMLNQVVSAVEAIIIKSPCNLNWVLSDPSSHRVGHAQQHSIIKWKWYIHDRAQAGPKGTSKLHEEVRQMPMVSTPATLLSLLQPAPMASWGVSYDQWTEEEKTTAWFTDGSSRYASTTRNWTAAALQSLSRISLKDSCEGKSSQWAELPAVHLVVHFARKEKWPDV

SEQ ID NO: 927513 - protein, 149 aa, Homo sapiens
MKQFLYCLAVIYELYVINDGTETVLKSNCYCDTKFSKNFMQNVGGKHFSQNADLNLLHHFPFFCDLANAIFGLGRPFLLKDYNSYYHQFLILVLFRIWQNGIGSGPKIMKEKEKTKEKWDGCKTYRWCMESQLPSLQIPFQFSIPFPAP

SEQ ID NO: 927514 - protein, 160 aa, Homo sapiens
MTSYLYPSSESCESFSTDPSNLSPPSQAAPCKATASPSASAPPPYNPSITSTPHTRSGLQFRSATSPPPPARQFPLKEEAGAKSTVKVNAPFLFIRPLPNQLAFRLFFIKYKNPAQFMAHLATTLRRFTTLDPERPERCLIFNMHFIIQSASDIRKSSQN

SEQ ID NO: 927515 - protein, 285 aa, Homo sapiens
MVKRKSSEGQEQDGGRGIPLPIQTFLWRQTSAFLRPKLGKQYEASCVSFERVLVENKLHGLSPALSEAIQSISRWELVQAALPHVLHCTATLLSNRNKLGHQDKLGVAETKLLHTLHWMLLEAPQDCNNERFGGTDRGSSWGGSSSAFIHQVENQGSPGQPCQSSSNDEEENNRRKIFQNSMATVELFVFLFAPLVHRIKESDLTFRLASGLVIWQPMWEHRQPGVSGFTALVKPIRNIITGDVPEEGIVIIKDDNSMCVIAPEDLPLGQDMKVEDSDTDDLDAG

SEQ ID NO: 927516 - protein, 138 aa, Homo sapiens
MFQDGRIGTAPVYSSQHERRRRRVISAFPTEEHSSLPAMEQSWMENDFDKLRGEGFRRSNFSELKEEVRTHRKEAKNLEERLDEWLTRITSVKKSLNELMELKTMARGLRDECTSFSSQFNQLEEKVSVIEDRMNEMK

SEQ ID NO: 927517 - protein, 139 aa, Homo sapiens
MGCGVDPQNRKVAESCFKVGLEDAWQETRPDGGAVGKSFIAFRTSVSPLPYNVPNIQSSVLVVADVEAESGDVKGLGPGHTARHSRAALGASFPNWKPNPVPPLLVQILEPEKKRGKLSCFSSPNLTNIPTRGDFCSDS

SEQ ID NO: 927518 - protein, 268 aa, Homo sapiens
MCLSDILREFNRNLTGYAVGTGDANDTNAFLNQAVPGAKAEDLMSQVQTLMQKMKDDHNLYSAANFVHHLRNALDVLHREVGGGLPQAGNSSSMEVPLPLQPLWVAPMELCDVRPVRPYEVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLAAMPFAWHFHSEQKRSVSGPGSYSQRSKATGPKPHGWQLAEPEVGAKPPEIEF

SEQ ID NO: 927519 - protein, 126 aa, Homo sapiens
MLWATLQRGPRSVVIRRNTALVGAQVKVEKGSKQELADSLGCMRAIGSILIPEKKKLIQKEEPWTAKDRQQLYITINNTSISTYILLLLPLPLLQLHHLQLAFIQCFGSFNTAVTSAYEVGTIITI

SEQ ID NO: 927520 - protein, 152 aa, Homo sapiens
MAGYPSETKLSEEQSGSNICCSPIFAVLQPPLLIPRQTGSGVDLQQTPTDLQLRVLTIRRKTNKQKGHPHQNPICTSPSSKTKAMEQSWTENDFEELTEKGYRRSNFSKLKAEVQTQCKEVKNLEKRLDEWLTRITNAEKSLKDLMELKTMA

SEQ ID NO: 927521 - protein, 147 aa, Homo sapiens
MAGEASESWWESNGASYMVAARENEEEAKAETPDKLFRSCSLALCGSNAVAEPVRRDIIFICKSGFRGHTISNQCGHSHHSPLDSIACAVLLQPSEWTLGNASRSFWDVKIWEQSFPGPNAVLYSGTHKILPYCSHSVLKEGISSNF

SEQ ID NO: 927522 - protein, 217 aa, Homo sapiens
MLRHQPLICNDSPKESEPQFHGKLPLISSFRWVRGLTGSGVKLQTFPVSVTTLKAARLELFVPPGGFVVSLASRVKLQTFVEPSWLHPVLLAWGPRVELPASPPLCACTPQPLGGQWDWAHRGGFGCTGAHRPGEKLSTAAAGPGAKLLNARGRLRWLLRVRGPPSPRPSRIRTGPQAAWAALVPTRASPFAPPGKLREPAPALASPERGSYSAAVG

SEQ ID NO: 927523 - protein, 140 aa, Homo sapiens
MASASAPGEASGSFYSWQKVKGEQLCVGILLQGQRPLPAPPSSLVQHVALGLRDFHARPTAMGPKPSWFRPRCGAAHKAQSKSEVPIVICKAYGLVFSHGKGNFADVISKKVAAYKPGREPSPEPDSAGPFILDFQPPEL

SEQ ID NO: 927524 - protein, 146 aa, Homo sapiens
MDSSCPSTFHHLHCSHSALCSPTPLPSSCTGDSKLLSAVPMGVLLTLTSAPSLPSSFLISVALALSLLAGFKGLMNRTPNLHFFLLQSSVPCTAHSRELKNSLLNERSEQRLGTKASPRQGHGPLVSCVCLFQTTPWPINTTTNNQ

SEQ ID NO: 927525 - protein, 153 aa, Homo sapiens
MHLQHSISYTTPDVFSDSSKPICGSPLMVLWTQGNTFLRVSASQELTGNSSASLPCLQPTSLDAGQPPEVDIYAQQRGGTVHVPWRCHTCGTLLGEPTKAWGAGDSPRQGHLHQANQIIHPIVQLIYGTHRLFHEDEKAAEEKWALNAGLDSR

SEQ ID NO: 927526 - protein, 158 aa, Homo sapiens
MSVEDFQNELNMKGAIYAVANVRNTVTIDTVVHASHSLWLETMFSDDDEQGGNFEGFYMSEASMSRGATIRPNTDHKILNFEPNAVIRLDFGMTPEVAIKVLAGTVFSSELLIEGIYASNLTPLVGRFQFFEGYWPVLCHVGSSSNGSCLPLEQSGEQ

SEQ ID NO: 927527 - protein, 156 aa, Homo sapiens
MTQRSHTADWMVFSTMYHQSLPLPQPKGFTLSETISGCSSERTRGMGNVEIWINILVLSSYPGNPARKTQFHSFTLAFSYNKKSIQLPETHFYLKLNSKLWVKALERKTGSEGSRGKWSQRLKATAKASEGAQTAVSHRQEAVEIGFRPYLYSNGS

SEQ ID NO: 927528 - protein, 124 aa, Homo sapiens
MNLKTLPVFSLYKYFFKMQTLGYNLIKISNLEIMSQFFSIYAILKGIKQAELSFLPKTLHTNLFPFAFQTTGRNGLSVNFQFNVQQKYQQPQRNMFMLQDKTYSSISKNFVFLPFSFPRALSTD

SEQ ID NO: 927529 - protein, 150 aa, Homo sapiens
MWVGPAVTLTAKVRSFTPEASETTSLLGGTNNSRRAALRAVTLTAKVCSFTPEPARPRTHQKEKTPNTSEHQKQQTPDTPPLRTVTLTARVRGFILEVNTVLAVWHKLLIGQTEISLRKKEEYVFIESYYFLTPRTDFCTVRAYQIYLLG

SEQ ID NO: 927530 - protein, 303 aa, Homo sapiens
MRSGYITMWHLIPLSALLLLLPYETFHCCFPTALDFFLMQISEAFLKFPPENGLLFLLHYQAATKIAENVKQVQKPTKSFVPSVGENYRHSTPAQPMRAAAGTENCKATGADLPKALGAQPSCPCALDVGQGLKKDDFGAVRFNNWPAGFWIFMGSAATKIADSVEAGSKLGSGERLESLESLEEDRKMRESLDHCRDLLNSSAKLKSCLAYIEQPVLLCVMKEMTISWNLYLNEKQSFNIWKICNLDKWSKRKADFQGENQEGFGYLHKKEPNANNSRQWEKGLEGISETFVAALAVTGPGV

SEQ ID NO: 927531 - protein, 130 aa, Homo sapiens
MVGFSGVTCPILSYLISNNYDNLEDFDLNKWKDGVVMNCAEEGNSRLGEPGSVFGYAQFDVIFFFCHLSRDASRQLVFRDRSWLEDENFKKEMGFTLERYLRLQVLRPCGTGGKKRSPSGSLGSSSLSSK

SEQ ID NO: 927532 - protein, 150 aa, Homo sapiens
MSLLFKCVQLQSSAAQPTEHPSGILNGEQGTAGFIKSHCQIASVLTQECSSRDASGAINEMFIWALPRSTRPLSRLMGRMNGSLHILVPTHTALIMAFLHAWDVYSSPLTPAYPHPLHLPLSDATFSLKPHQPNLCHDQLAELQYAHPTA

SEQ ID NO: 927533 - protein, 136 aa, Homo sapiens
MVITAMVATIKLLVVIGCPAFLRFSSAICDSFLVCPQKHTVISLTVNQIEFLEDTMRSQQFATKRVSSLESDQADTAIYNFQPPELFIHLQRVKTDTLEDKNSIKQYKMRLLILRNGHYSWRDRVYTNGKRNNTEQ

SEQ ID NO: 927534 - protein, 167 aa, Homo sapiens
MLLNGSSWGRLCCSYLDSTGWLCSATAAAAASGEKENRTGGRCQRGVFFTNSSFAHIIPSPSPYVTSRAKTPEWLMPRLSGVAGSTEHSLIAIVLRKGGDKSKQIVDVPLPKALLRSWDISKTSASLLHDKCGHGSGWGTCWWVSAVHTHSLTRRDYGGGTTLCSVT

SEQ ID NO: 927535 - protein, 228 aa, Homo sapiens
MPEERNAVLIPTWAVAGEADLLFPSLSEQRKGQLVPADEKPERGTASSSNLPQFLAAGTPELPENRGLFSTLGPRHGRLGGGWHGWAAPDGEEGEQESEDWVMRGCSQTYGVWTHTGHPHSYQAQGGHTQQSQCTISFKFLWNYLLLGHRLGGQRVSLKAGAASQCWVVPVTHVTEDASPLLLVPPLVEMSETKWVFISFKPRFLLIKVTGTAGFAPPPPPHPCPPAA

SEQ ID NO: 927536 - protein, 136 aa, Homo sapiens
MSNSDYLPDYPLNSDLVKRLKSALDAKDEERVRDLICTEITPVDAVIELANDDWMKDPSAQLPTGMLLEDCPGGGLGEVVITSSDWTGSAELYILHSPFRPTVPKHPPEADLCKLHQSHLPSGSCWVPLMIGVGGK

SEQ ID NO: 927537 - protein, 120 aa, Homo sapiens
MLISLFICPLLQSSKLHTIWKEPFQCQSNVPANNPTTPPACWAKPTLLSSGPRTHHDPAPGGSPGSPPEAPPLHASILPDQFDTRTTTEVINNKTIPTCSSNSSWILRISLWLSRFPEYA

SEQ ID NO: 927538 - protein, 144 aa, Homo sapiens
MQGKSVVLLCAQPGDVEGGGRGPGPAPFPTRNAIHKSHPEKTTFVIMASPLPGTPVKEAVEGRGLSPGCVLLLSALCPILERGWTYIFPHALMLHHFLGSNQKCAPQRGEKSKVVLPWKKITWDFMTVSQIRIPGKERLKERDP

SEQ ID NO: 927539 - protein, 267 aa, Homo sapiens
MSQEKDFHKIHSCAFVIEQEEKKKTEAHKEGDGVKRADKILGVTKDPGTIAGLNVVRIINEPTAASIAYGTDKKFGAERHVLIYDLRDEIFDVSVLTLEDEIFEIKSTAGDTHLGEEDFDNQMINHFIAEFKYKHKDSRADIYTSITHAQFEELNAVLFRGTQDPIEIALQDTKLDKLQIHVIVLQTQTFTTYPDNQPDVLIQVYEGESAITKDNNLLVIQGKFELTGILPAPFAVPQIKVTCDIDVNSSLNISAVETVSGPEWASA

SEQ ID NO: 927540 - protein, 137 aa, Homo sapiens
MMAQGTFFFTEEAGQELGIQKAVTLALCPCEKAEGPLSWLTLKLSEDGKAKKALAPVLQHWGHKHPHLDTTAALEPKTLTLAPASACLCAPPPARGLSSSSSSSGDRLQASHTPVTCPARRMRELSCFTRTCYFFTF

SEQ ID NO: 927541 - protein, 153 aa, Homo sapiens
MKKETRSVSSDFFLYKDRNSKRMFFAQPGLTGPRTSRCFCIFALCHTAPVPQNASWTATTWNVRPQRGQPLTQHRDLVTCRHRTPTGLMHKGTGLTCLLRNAEEEKAQGKVLVTSGHPREGHLQHLHSSEKKREGGVRAPGVGNGITFPDQGT

SEQ ID NO: 927542 - protein, 234 aa, Homo sapiens
MKLREVRKLHKKSWKGSYLEDTQMYGNITPDWDRYLTNRKNSYSKNDRRNQKFKEAKRFFNSIQKDPSEFAWRDPELPEVIHILQHQFPSVQANAAAYLQHLWFGDNNVKMKVCRLWGIKLLVYLLGHRVLEVQKNACDALRNLFFGKSTGENKITMKDVEARKQMRACEGLVDSLLHVTYTCMNTSDYDSKMENCVCTLRNLSYWLELQVPQAQLLGLNEWDDLLEKVSQRRL

SEQ ID NO: 927543 - protein, 164 aa, Homo sapiens
MFPSLCPCVLLVQLPLMTLLLVRSAAALDSHRSTDPIVNCDALLQVCWSLLEVHSRPCLPGYHQCRLQNSRDCCLFLPPEALSHRGTCQMPARALLYEVSVDPCWEVSPSQKAQGAGRQEGLHLLKLHPQPLLPSGALSQGVGKALSQSPFLTYSHQEAILIPF

SEQ ID NO: 927544 - protein, 147 aa, Homo sapiens
MSQEKDFHKVIFRYSVISNRKQTKTSSIAGDCDYVSWNSGDKDNELELLSACLSTCYNTYFKTEEIFIKNKSITTWKAILNTINGSDIEEVIRNTCVALLEVGTVWEISRPLYVKKIVFHETGPSLVPKRLGIAVGTDMTNVKKKNQ

SEQ ID NO: 927545 - protein, 143 aa, Homo sapiens
MLIQCAAHHRKDVDARCRKFIYRHPSVSTSVMKCRGRRKEETERRDGCRMTCKIKMHNTKCKQRRNQYKLLCIVDGASDENWCSRGGGIFNTCCNTLGLFLLIENSSGSMPNLKERKKRAPKCICTPEIVTVLCHYEELTKHV

SEQ ID NO: 927546 - protein, 134 aa, Homo sapiens
MRKCEHNDFLTDLFYYERKIGDSSSLITVLTSDNFTPLLFNGNITHTILKMEKHFHVLFKSEMIYEMNRLCGVHCYNEKLMESRRGCYQIKEEDKENSSHDGNSDLALQRVLLSWAAVLIRKHASQMVIRADAY

SEQ ID NO: 927547 - protein, 146 aa, Homo sapiens
MPTEFHIAGASLISLANFAVFLHCSRFLDAGNARMDELLSLARRASPSRKRYRRANNCKRFLQAAECTFCIPLISNIQVISQPLLPTSRQNQEFFNLFCPETLPGALLILSATKLTSQSVLWAFPLSAGMKWSTLLPHLVLGSIRG

SEQ ID NO: 927548 - protein, 256 aa, Homo sapiens
MDQSCPRPREEEIQPQKEIAGMCGCRGEIVWGHSEKAATCKSRDEEFPHEYFYSGTGFEGNETNTASPWWGPSSVFLQAQALPSSFPDLSVLEQRMCGFSTSLPRDMQMQKRNEYFDRTRQVNEDGVRMFEGLGGQWSFVGSGGQKFEINVPAGPVSGEAFPPGLQTTAFSSCPHVDLAFPVKKERIGEEKGTGQAHAAGIWWSRDTSVLLNIILPLFYLARSYLLEIPIFLYFEEDRGALEGAKVLAIKNSETAS

SEQ ID NO: 927549 - protein, 378 aa, Homo sapiens
MAASTTLKGLTSQRKLHSHFLESVCDVSRVCLQIGYPTVASVPHSIINGYKRVLALSVEIDYTFPLAEKVKAFLVNPSAFVAAAPVDTAAMTAPAAAATPTKVEAKEEAMFESQSEDELTPFDMSIQELDNPGAKRILELDRFKEQQGQKRFQDLMGMDLTTHSVKCLLSVGIYNPIQKALKPPPIKPYREIDESVKTKTWIFNEEELDDQKIQVPPAGFQLVFLCYADNKGKVPFAKKVMATPEQGDKVKAIVQKLRFKYRSDSFENSVLQQCSRNLEALALDLMEPEQAVDLTLPEVEAMNKRLGSPLVDKFKELLYPPDYNPEGKVSNIKHNNEGFRSKRPKVEYSEEELKTHISNSMLGKFAVPMLKETCWGLI

SEQ ID NO: 927550 - protein, 209 aa, Homo sapiens
MLPTVHSVPMPHGGKINKKLNSGVLGCSSSGSGVVVMFNNRFAEKKIIILHHLNLVCHENQFWEEEDLQYVPPSAEPQASCPHIPQKEKVQPSTHGKSSILKSTVPLALSLLPVHRPFTTVGKAAAKCHDGLETAGFTGKAKIGEEDSTAGIRQAETRVLQSLHLLTSFPGGNVGREVERAFDPFDDLNVKMNPTFCFEKDVGDLDLVH

SEQ ID NO: 927551 - protein, 163 aa, Homo sapiens
MSLKEENSKDEEQDLFNEVLCPLVEGCALLGGKPTPLGCLDSSELPGGKAKSAGPETVATPPPRGSGPGDPGSVPEPLAGVTGVPAGKPCPVRKDESGGMGLRVGSSDLWAAQFCGKSTVSPAGYHAHSPPPLAVGWGLHCPVWLSEIQQMPAAMLPVQPAEL

SEQ ID NO: 927552 - protein, 152 aa, Homo sapiens
MHGRSTEGCSQYIHQVTETKRFIGLAVPCGRGSLTIMAEGKRHILHGIRQERNESQVKGETPYKIVRSHETYSLPRQQYGGNCPYDSIISHRVPPTTTFTALWLWEMKASLYAAKEASDFITSPAMADWQSSLSSSFSNSSIAPRKRHCPYN

SEQ ID NO: 927553 - protein, 144 aa, Homo sapiens
MAGPNQLCHGSLVFFSISFESTVLSGKCTRAVKEEGNTREPQWNTGLGKRPMKALEKGLELFGQGVLYTWREVSKYWKSETKGSAGTCTAVGRRIFSLKAVGKNFFLPFSIFPWLLAILGDPLAYACTTPISTSIFILFSSLAL

SEQ ID NO: 927554 - protein, 147 aa, Homo sapiens
MGKKQSRKTGNSKKQSASPPPKECSSSPATEQSWMENDFDELREEGFRRSNYSELQEEIQTNGKEVKNFEKKLDEWIPRITNPEKSLKELMELKAEARELREECRSLRSRCHQLEERVSVMEDEMNEMKKYRECHKDTPREEQLQDT

SEQ ID NO: 927555 - protein, 140 aa, Homo sapiens
MAFFSVDPWLSPEVQGKRNLVPGKPTLPTPKSQGWILLIGAFYRVLIGAFYRALIDAFYNPFASYRVLIGPFYNPSYRVLIGASYNPLHSSSPNVVHPSDKPFLKSDLRHSPNKPTLAYPESNSRAIFCALKNLKGVGNC

SEQ ID NO: 927556 - protein, 151 aa, Homo sapiens
MSLWVGARAKRNLWASGDPGGPDQCSPFVGADAWAHRGQEGPDVHLRAVDPGGVWEDRRGVPAVKRVPEGQEWVGEAGGPGPGVCRPRSCPATEGPGYQPSCSSVCPSVPVLTHSSRETFPIPRGVVRNACTSSLKLGVCISWVFWCLFSK

SEQ ID NO: 927557 - protein, 171 aa, Homo sapiens
MLGVEELRCMSAFTLYNLSSRIPAGEDWSHPTQPSSRLACSTWKSLSQTQDRDQGVLASPAFNSNMEQMTVEEGPEALPERKPRKGLSDKGIFMDGVHSCCGFDTNCANITIHELENQMGKMKRTLVTGSTTTMAYGKGAIAGMWLWLQLNLDLQMETVQSGRNLDPRLIS

SEQ ID NO: 927558 - protein, 166 aa, Homo sapiens
MYSIQTSEEDRKMWETLKLPRDLLNGFDPNVDSDMDNEVQVEVVSDGDEELIGNWSKEEISKQQSIQEVTWLILKAFNYMLSQREGLKLELMFKRETEHKCLENLQPDHVVEKRNPFSGEEFQLAAEICISNKEPNVNSQDNGENVSRACQRPSRQTSPSITGPEA

SEQ ID NO: 927559 - protein, 134 aa, Homo sapiens
MASASASSEGLRPPPLMVESEGEQAVQTSHEERRSTRGGKHKELSILTLCGSQSTRLLFLPCTVLPLRATPQHYLPGAAFKYCSAALTEHLLCRHPLAQLRMGRQQAPMTQQCLWLMASIYPEWIWDSLNIILG

SEQ ID NO: 927560 - protein, 136 aa, Homo sapiens
MPQRTSQLQSHSWETDPGPGSETKAEDPKEQKGPFIRPFDVLKNPPERLLFKSHTDVRQCTGTGIDPGDTLVSNADNNIVRTSIWEAQSTMETHKGGSLASPGPKGEKESAFLVKQRVQFQCMETVRRFWLEIKKK

SEQ ID NO: 927561 - protein, 157 aa, Homo sapiens
MEMLLTLCAPSALYQLNHAHGFPNTHVVMSLKSKFLRLIHGSRPASPLWCPTDTSNTTCQKRSSFLPSLLQTLPSSSFPFLVINTSLPQTAKPATWAPGPDTNGFESPTPDRPSMAGRQAYLPKRTDLQLHPIACSFPNKLHSSAFSHVNCLLNVCA

SEQ ID NO: 927562 - protein, 218 aa, Homo sapiens
MKVWVLLCYFRRKPTEVDENRKELKQGPWHSVRGCHRENWRVLGMLSTGLGKHRGEPAPIGCGPGTKARKKVKPIVPKLVIEEFLSTSLLLSPHPTPGSHSPRGIISPGRPHGRTGSEATNRLRGIADGRSFIPRWRRSAPPSTEKDENDQWFQQKLDCFSNDSGQVWQQVKNNDHGMVGYGGLKEAISSSLGSAFCIGLAPGQASPYSTKMAPGSPD

SEQ ID NO: 927563 - protein, 188 aa, Homo sapiens
MWYLPCHSLLLLLLLLAKKMGLADNLWVVFGGSCAGSLEVWLRIKYSKLFAAVVDSSASLLAKVDFYVNAQKLWQASDIMVEMLKSSANHDELTKDFKGAVGRTREGVQPECEGYNCCQFAEGVGLSARCLREGEVKAVLNMCKKVGEDLEMKQEDSMKKGWMEERMYKWRRCLSKESGRAYPTFLPR

SEQ ID NO: 927564 - protein, 153 aa, Homo sapiens
MTPSLLLSLIVYLPSAYFQNTELKGTANQQGNLKAFLFMTFMCIRVKRPPNRLCVSNKAVCFTWVQGASEVIGQRQSSAAKPRRSWKESESLGPEFQGLWEWLPGELDSPISSGDGKIESAIFWLFGTTVEFVLGSSGIAEENKMLRFWSGES

SEQ ID NO: 927565 - protein, 144 aa, Homo sapiens
MSACLTFPGHVTRTRFFSTTVIPIISTGFTHTEGEMKRVGNKSDKNSGPSTLAKCLRVQWYIACQDILTKVKATPAIGQWAHEQSGHGRRDGEYAWLQYVDFHSPRPTWLWPLLSAQLLAAEANTEPSIRHHSSRWSANPLVAS

SEQ ID NO: 927566 - protein, 171 aa, Homo sapiens
MLPDRLRSPVDHHRCRALGNSHSGGNRSHALTIPLKPNHPYPAQRQYPIPQYALKGLKSVITHPLQHGLLKPINSPYNSPILPVLKPDKPYRLTLTLIRLSKLPGLYCCKASQTAPITSKLLPHWLSITHPNPFSSHTAKVQGCAVGVLTQKPGPRPGAFLSKQLDLTVLA

SEQ ID NO: 927567 - protein, 128 aa, Homo sapiens
MGWAQGSDILHGQGRNLWIANIQFPNSKHTFRSLSLNAPSVESGELPLVLPVKWELRRVHSNSTVMQVELSVYILELCECISLCCSLTPGVSLSNWFMYLIFHRAACFDPRHIYGQNGTSPYWKNMSV

SEQ ID NO: 927568 - protein, 142 aa, Homo sapiens
MQVAVPELTVLCLVQSGRCGLELGTIQRRGESPQTCDEANDEVSQRKVIEDKDPFCQWDMLGIPTILVTECAWLVLASLPDASKRRQNGTNIDLSVATNTCSPPHLLIVETPLLFYAAFCWEGNQGIYPSILLLIALKENPG

SEQ ID NO: 927569 - protein, 172 aa, Homo sapiens
MAEGKEGASASHGWKGGRERWWKEVSHTFKQPDLMCPELSPGGGQRPALAPEDHCVIFLYSYLVVLPPTPSCPCACDPAPALPAGDHCLCWKLPLFLLCSFQSTVLALLILHITVQSWCIIKSINYSQDPLKAWKREEGQGRAEREKHPNPHPSKTGHKKHLKNYPHRGQVK

SEQ ID NO: 927570 - protein, 138 aa, Homo sapiens
MDGKRMVQGVHVQVCYMGKLCVTGVCCTDYFVTQGEGRQGRMKQGCNDLGPVEVSWSNGLTQGLDGVKQASTGEGMSTLIKDQESSLANNLSAGLLEFAGGPLQTLFAWVSPTEAAEQQISLPDPSPGSFVPEGHPPV

SEQ ID NO: 927571 - protein, 125 aa, Homo sapiens
MLLLFNFLVLQAPFKSHCAQPSNFFLRKIYSSLCETSRACLYFVNSSESLRWMLEVDFLMPLSAPSQEGRKLTLMVEGEGEGDTFFTRWWEGGVQAGEMPDAYKTIKSPSSLFFQNKQDLIMSIP

SEQ ID NO: 927572 - protein, 139 aa, Homo sapiens
MVPKPPYNPLGEARVLQMSSPVSTGCPAARLPAGWEAALSCCCLSGFRNGCDRSLVPSPPLLGFSFSGMSYSRSGAGCGLLLLWSPSSPCQVALAGDNTQECTAGVVNWAHNCAHKWCSWAASQPGILAAEPTHRPWLC

SEQ ID NO: 927573 - protein, 140 aa, Homo sapiens
MAHLHVGVIGPLLSSLATGGRLQRTGTDEVYINEHLVNVSNEDTRVHILPPQTKYFEINYVRKEHHLVPGLSLTVTVTFSPDEWRYYYDCIRVHCKVTSVTGVQSLLPSDMAQDGKVLGCRGPGQSQETRFAAGFPLPCA

SEQ ID NO: 927574 - protein, 274 aa, Homo sapiens
MLLLKMLLMVMLSPVTHSLYVHLVLPNRVSGPPRGYEWFRGPPVNSHVAQHTGLWTVNVDLPLFLDVCEKTCILVLRDKPQFRPCQVGGGESSDEGCGCVRKVKLKTCNGKHKIQSKIMEASPKLQARQKTSFCEKTSACFERSLWPEVSSVPAAPVLPTCFIRVPASTVICVLGFLCYFGTPEGRACGSVFAPQSPSTAIGGDRAGTQCTGSISGLEPLEKVSSTFSPVFSDVCASGASQLQEELSRCADDTHPMQQEFCAGVLQQFPSCSIY

SEQ ID NO: 927575 - protein, 148 aa, Homo sapiens
MRPAWQQLLGENAVLGWAQFSSNSVCPQAGCGGLDAHKSIYSINGLIRQSPWPAWAGRTIAGFSVRPTELMVNGGNKSCTQIIIMTMQGRKHYMPAEDDTALLEEVCRMILEEQQGEVWATNLPAAGDLQQPSARIWASWGCRAWISS

SEQ ID NO: 927576 - protein, 207 aa, Homo sapiens
MDATCLGGLGLIQQPDSQGCPFLKDHSGCREENELESTRLQVEDPEGGDCTIQQRDDKTVDRNWQIDKIFRRSAPQVLGMPFSLQLQEHKRASLNIPAYFKPLPASCSPVYLWRRESHSQIQEVEKYTSPLVGGIAKSHDKECGHREGEELGPIALFIASLFNTSAFPRRIIWDHSGIEKWLLRPKSLFHSSFFHLHVPPSNSFSGL

SEQ ID NO: 927577 - protein, 135 aa, Homo sapiens
MEHLLRSSQAPPKGVEMKWDLTRRLATARLGAQLGRKERKHVKVLRRCLQQDEWRTTQLYTHLCSNPASASYQLCNCEHTAPHPSTGDCIFIHSFAFLTAVLEKLFLFPPIAQDPLPPRPHNNSAPEIMPSLLNY

SEQ ID NO: 927578 - protein, 164 aa, Homo sapiens
MAPICDPKKQKDKLLKLYSDQQKYADHKRAKIYHNELQIEESCEYSTGWFQKSKKRHGINFKVCGDKASADHKAGEKFIDEFAKVKVIPDETLMSEEIYYILLIKHQCVGITAPERLTTADETIPVGIKDAKGRTVLECANAAGLHKCKVAVIEKSCVLTVFKG

SEQ ID NO: 927579 - protein, 141 aa, Homo sapiens
MTKTGVSKPIPLSCCSALICMWNPRPLSYAHLAGGRVKILPAHYYLHSQKCEQANPGPERRKESALQGSESRTIGPGEASLLGGLVTLAAEYPSKHSQGGYQASLQWVKEADPLSSWSATFPMKDRPRSLHPSINSDLPRE

SEQ ID NO: 927580 - protein, 138 aa, Homo sapiens
MLGPYSSFKNQTEFPIRKASPPYFRCYNKVRVQEVCLLEGIGGGVHVAYGSPAGKMWEERMFHGLHLREGQIEMQPEKVVGTELLISLSDYCQFWLRPSSCYLVTAEKVTPKHTAQQQAFCLQAPFQSQRKWSWTDLF

SEQ ID NO: 927581 - protein, 135 aa, Homo sapiens
MCVVEPATYSLISFWKTEKCPGVISDFTKADPKDRTAGQNTGYRGLQEAGVRLGKATLAQPLQQSLQRDLPFKSRKPRAGIWTQPLNPRDTHTQPGSSAPSEICLLFSVMLPIHPHKRLQTASGDWVQSSPGVGL

SEQ ID NO: 927582 - protein, 144 aa, Homo sapiens
MSVLYWKTQEWLPWVSLMDIRLHGINPTLGQAVRDTKSPPSPPHCWWGYRMGLDKNLTPATKSPGAESDCYSGRKGVHGRRLLPFCASGSMPPRDLIFALEKVSGPESVCHVKEIQAELKGTTQTPMAVDMKSIKLATEQGKRP

SEQ ID NO: 927583 - protein, 155 aa, Homo sapiens
MRSYWIGWALNPVIGVLIQRDVEIQRLRHIQGIRPCVEEGRDWSTAGTSQGTLRIAGNQQKMEGAMEDTSLEQQSPTILAPGTGFLVMQEEQCLVELVFKMTPGSSTALAGLNKAIAEIKTSKWILKKSSELPETLSRCFGRPLVVTQSDCPICK

SEQ ID NO: 927584 - protein, 162 aa, Homo sapiens
MAATEGLWLCFKTKEGEGEEGEGGEGEGEGGGGGEGEEGEGEGEGEEEEEEEEEEEEEEEEEEEEEEEEEEEEEEEEEEEEEEEEEEEEEEEEEEEEEEETMLLEQEEAGSRSLERPTRGPLGQLGHDPQVLISPLGLSCHIGQIPPQIGLQCLCKQSIKGR

SEQ ID NO: 927585 - protein, 136 aa, Homo sapiens
MRKRSGFWKGLKEINMRGIGKCEVGARGITLTSPMCCHTGASSPACPALLPSTRGPGSCHSTTRGSQFALADTVHLIQGPSWMLDLLLFCSEMSVHTCTDSTLCPQDPFEGRGFTVSTSASSALSTMRGAAVCTMG

SEQ ID NO: 927586 - protein, 134 aa, Homo sapiens
MAWSDADLDLGTSFLEDKEGSSGFSIPHSPKPYSCPPLLMPSSCSFLFKSAVTSTPSVKFGPHQLHEAISSNSESLIQVEAVTVHIVPFLNIFGCYALDSRLQGDEIVTMLNTSTFVSPSGRRNRQACNSFIHQ

SEQ ID NO: 927587 - protein, 144 aa, Homo sapiens
MSYSWYSTVLVFVLAIHYPGCKAVIVKNIDDGTSDRLCSHALVAGIDHYPCKVTAAIGKKIAKRSNIKSFVKVYNYIKSSTAHKGPKRGQGQVPRQEQDGQERVVLPEAIVLDALTLNMASHCLVASVVSSRNLLLILLKIPST

SEQ ID NO: 927588 - protein, 150 aa, Homo sapiens
MGMTLTWHFHLQESILQKKLAHVHRDVFKKIVHFRIIRKSKKSRLKKEAVKCWKTRKTPIPKKVLDQSFSTRVDHPPGHIWQCLETFLVVTIVRRKCYCHLVGRSQGFCLTSYNAQDSPTTKNHLVQFVNRARVENPVLHINKASVLKGN

SEQ ID NO: 927589 - protein, 143 aa, Homo sapiens
MITRSREPGPVTFFKVNCQSALQGPQARESDFLALPFWGAASLLGAKALKSRHLYWQAQPLSTGFQGRHPQIDTAGALMAGEQKDCDLKAPPNNLDLYEGGKKSFQEHTGKYIKVVILPDGICAPFFPMICPQRHLPKVESHL

SEQ ID NO: 927590 - protein, 134 aa, Homo sapiens
MFLLVPGASYNPGTGAAQQKLWLLTEEFSYNPNHDQAGHFNEVLETTTICPFNVCLWTKFTVCICSHGKEQGKQGGHNSQGKIGPWLPKHRKPEDWRTSKESEEKRLWGHAKDFGLSGLPFQKIIQVAMEKKKL

SEQ ID NO: 927591 - protein, 214 aa, Homo sapiens
MGTFSVLPRRWPGSSLSVKNFWPTKMQKPVQDLHNSSWQQNIDHEAVHDELPNELHSPVAIGVELPQVLSGSKQIMHCEPAEMNKLTEGKEIQADRGNRGNLRNLSLNDQLYYTGNIGPSKDVITLISRHSHQEHSRQKEQPEQRYEEGRSGMCPEIMKIIWPDWTVGHRKWMMWKEAVIPIVSMWLNCFKLYIHKANHPGEIFFLSTISEKAT

SEQ ID NO: 927592 - protein, 173 aa, Homo sapiens
MLFLRFRLPLYTTNLPISQGLLLKHSGSRSLSLSTPPIFVDVSLTHTPIRGIRLVINNSSSANSLKKLERGGCMESTPREDAVNIVEMTTKSLEYYIHLTDKAMTGFERIGCNFGRSSTMDKKLSNNIKCYSEMFHERKSQSMQQTSLTSVATMEVHPQISLQAESARNDSVN

SEQ ID NO: 927593 - protein, 145 aa, Homo sapiens
MMWTCTVGAAIGAEKRAKFGERGAISPPYPMAVGRQSGSAVKVICAGQHPLPREHDERIMALESENPRFKDLGGSDSKSARVVKETFGTVVFIVPVFRCITISGSGSSTRFEPRSTESALNLHPQQCGISMEDAQDCIQNVHGAE

SEQ ID NO: 927594 - protein, 154 aa, Homo sapiens
MGTFSPRSIISSFAEVLSSRWGDGSVVQSLTHQGSHTDFPETLEAIELDLDLSSQTGSPPIQDKQPSSPTRMMDLVWCSVQELSFQEWLKGSFAAFKFYNLLGEKTQATELLPPGALEDSPYSYFLSNPTAATCCECRLAQPPTRTHSVTVKPD

SEQ ID NO: 927595 - protein, 135 aa, Homo sapiens
MTKRKLEPKLSGHFHMKHTPACSISSSAAEESFPLSIIITGWWEVLSGYCQCSLKALGLSSQFVVNAARPETHSSEKWAPLCQRQEEEEEERRGGERTGRRGEREEKEGKEEKEEEEGDRGGGGGREGGKGREKE

SEQ ID NO: 927596 - protein, 244 aa, Homo sapiens
MSLNMFMTPSDSHTRGHVSRSEKERAWRAAEDKSTAAAAGTRLHSPSQSIPRKNYSSFTVYFYRSSSVFCCFFWYQPMDWVRRKIRDSCALGGGRGFLPEGSEAEDVDGAMLASLCIWQRNKGLLSALRGWKHNTNAFQSFFVWRADQVTAIRSCYTFEKKTFAEWRKPKGGALSAPSAALVTLIQGIHSLFISTDIESWEGSQIGSRPLRPCMHKYHMRAMDTKTNQARLFRKLCSESGGEHS

SEQ ID NO: 927597 - protein, 200 aa, Homo sapiens
MGVGHGSSIGKQTHLVISVGNNSYELQLKLGEEMTFKKRTEGSRRTNHAEMQDEEDGSINIIIIIIIIIINMQCKAPKGLGPQGKHSKFWARVILIMEKAMMPSLGTLQLNPGPGFSIENYPAQENWTIQLLLKMSLLLPRTKTIYFPLPTISPGNLFTTKFHSKNNKPYLSQKQILWSCLYGPSLRKQVLDPKERHHAK

SEQ ID NO: 927598 - protein, 145 aa, Homo sapiens
MLYVSSESFLPPPSSLLSFYLCLFTIIAMNAEQCLPIANWWGYRDETVMVPTVEQKWTGIQGEFVRLKAWHSCFGGGSLPTSAWNMKVGGFANLQNCLVEIDKGHLMRGHRQEGTEVGEEERAGGKRWEKLSGFVEICEVPFGNS

SEQ ID NO: 927599 - protein, 131 aa, Homo sapiens
MPQLTIAPRAQPHHPKGAATCRSWSLGSNLTAEHHMKGDKLTREAFPHVTQVTGDNVSKRGYPSKSCHQNHSGEQKAEKMNIKEILNSSYDKSMEEKPSGGEYMYQGNIESAGDGREGCAELMALKVSPGA

SEQ ID NO: 927600 - protein, 153 aa, Homo sapiens
MDCKRAHKEPFQGFSFQYSPEAVKLICNLYLEAISGVKMTEPQDKKNLRNIITNGGEHPTGQISPPFRTFRDFKKALCCVNPLRFGGFYAPAASINLTNIELVTRSGVLLLQKPKICDIDLVVRWQAARKLILELDLWKTMTNRGKPFGETHL

SEQ ID NO: 927601 - protein, 573 aa, Homo sapiens
MKLSLVAAMLLLLLSAARAKEEDMGTVVAIHLGTTYPCVGVFKNGRMEIIANDQGNRIMPSYVAFTPEGECLIGDAAKNQLTSNPKNTVFDAKRLIGRRWHDPSVQQDIEFLPFKVVEKNTKSYIQIDVGGGQTKTFAPKEISAMVLTKMKENAEAYLGKVTHAVVTAPAYFNDAQCQATKDAGTIADLNVMRIINKPTAAAIAYGLDKREGEKNILVFDLGGGTFDVSLLTIDNGVFKVVATNGDTYLGGEDFDQRVMEHFIKLYKKKTGKDVRKDNRAVQKLWRKPEKCWKVLEDSDLKKSDIDETVLVGGFTQIPKIQQLVKEFFNGKELSRGISPYEAVAYGAAVQAGVLSGDQDTGDLVLLDICPLTLGIETVGGVMTKLIPRNTVVPTKKSQIFSTAFDNQPLQSRSMKIEVTFEMDVSDILQVTAKDKGTRYKNKITITNDQNHLTPEDIERMVNDAEKFAEEDKKLKECTDTRNELESYAYSLKNQIGDKEKLGGKLSSEDKETMEKTVEEKTEWLESHQDADTEDFKAKKKELEEIVQPIISKLYGSAGPPPTGEEDTAEKDEL

SEQ ID NO: 927602 - protein, 207 aa, Homo sapiens
MLVGKSSNNTTTLPSPNLSRGNHCLQIEIGAGTDSREKPSSGNRHFQACESRGVLPGLLRVQRRRGLQSPFGQLQLRLGRILRSWPGSPEGDPLRWLRFRKLARVCTLTCASPVGGANTESRRLTQQSAGKGPVENDAFQLANPAEDNTCGCCPQGLEEALSRPAQTLAQHLDLHSLFLLLLPCYSQGSCFWGGEECGPRAGARTCG

SEQ ID NO: 927603 - protein, 134 aa, Homo sapiens
MAGGGTRPSPRRHLGLQLQLWANKPPLKPLEKYPFDSTQGPRAAVFIGSRRGCLGKWKNLCRRRQSCKGVAKQFAACSVPRAAATASAPQSLPGRSEGEEAGERLHSSAGCALRLPHLAQRLQQTPMSPSARRV

SEQ ID NO: 927604 - protein, 116 aa, Homo sapiens
MVKKVLFSWYYFHVIPYHSLSQFSQEPQCLSLRSFSSFKKFGLAYTNNCTSLIKIMISSSMRILIFESLQLASRCAKSLTCAFSSNPSSVMRLELLLWSILQMRKLRHREPAGTYC

SEQ ID NO: 927605 - protein, 179 aa, Homo sapiens
MLENSGSSAAGLLEFAGGPLQILFAWVSPMEAADYCLIFPLEVSSQRGTCQVPARAFLYEVSVNPYWEVSLSQDTQGSGQGCLSLLKLHPQLLLPPGALSQGDVGFIYKPLNGAAAFFSEIPYPERRKLERESGHSGVGLQAQKSKIKELALDEGLLAASSHDRRTKKGRERDKERGCQ

SEQ ID NO: 927606 - protein, 136 aa, Homo sapiens
MSISFERHVGAQEVADLEAFQISDFGFSRLSWFSGFLQLAYFLFLSFFPSFFLSFSFLPIFLPSSLPPFFLPSSLPSFLPFFLPLSLPSPPLSFSFLPSFLPSFLPSFLPSFLSFSFFLSFFLSFFLSFFLSFFLS

SEQ ID NO: 927607 - protein, 163 aa, Homo sapiens
MERNQSRKAENSKNQSASSPPKDCSSLPAAEQNWMENDFEELTEVGFRSSLITNFSELKEHVLTHHKEVKNLEKREKRVKRNEQNLQEIWDYVKRPNLCLTGVPESDRENGTKLEYSSGYYPGELPQPSKAGQRSNSGNTENTTKILLEKSNSKTHNCQIHQS

SEQ ID NO: 927608 - protein, 187 aa, Homo sapiens
MGISVRLPMALSPGHSPQGPVQQLEQESVFMSVRAECPSVRMWAWLDLRGGIQDTRASVWGRGCADARSLCTVFTKLSTSSCCQNKYDQCILPLLSPEPNKGLMYQLQNKVNGKKTNLTQLDLQNPVPHNGPQEFQMHVAFSVYNHRERETTSHGKSAGNIMIWLSLGKGPFPDLTAMPRVWAQFPE

SEQ ID NO: 927609 - protein, 154 aa, Homo sapiens
MWNSNLPSSYFPVLCCFATFGYPVSSTLEAHPGDLGVSKKRCNFNIDKEKKAIKQKQRLQLCSHKPKDRWSHTRSGKRNSQDLEFSVEGSKPKHGRSKQWVPMLHRAKIKVKPFTGNPHLFLLVDLPPHPGRDPQSEEPGPLLAQELARLAVGS

SEQ ID NO: 927610 - protein, 124 aa, Homo sapiens
MSFYYDVPQIWDSPGMDFQPIAALAAAWTAVAARKLAENRGASAPKQLLEELQRHQDALWLKWDQFGIGQFEGMPRYRLPLPCSAEASPKRAFQPDPSGSQDGGPQLCSSCGDCCRLEKVHVAS

SEQ ID NO: 927611 - protein, 161 aa, Homo sapiens
MLAVTADHLCSWAKLLLLKHLSVDTYRSSPLPPVVCVLSLGKQRPNPGEPVPTSNRSESDLPMISGALPASEISGYLSYYKALETNGTDLNADMETHPRRKASVKQYVWEQGRPAGHDHGQGMPQEGLCGDLGTEALWVPYECNSPKGDGSTRCGPIDGEY

SEQ ID NO: 927612 - protein, 137 aa, Homo sapiens
MRSLQVLVGFLHLTFTRLRGACGKRHNGGEAVGSVPLLLRAGKAGPWAGAVTTPWLSFLTCEPVTVMALTSWAVPNTPLQPLHQPITPLQPLPQPSTPLQPLLQPNIPLQPLLQPSTPLQPLPQPNTPLQPLSQPLS

SEQ ID NO: 927613 - protein, 144 aa, Homo sapiens
MSLLVHLENGHNNAQSKERVGEQPRGRPNGSLPAIEGWAGLIPRGTASKSGPQLQSPDVECAFLISLKAPIPVHNYTSLEIDDMASGFQRAPGEVFPVVVRVHLLTKGEKAGAPRLAPRVLDWGLWTPIHEGQKLKRSPGFSKI

SEQ ID NO: 927614 - protein, 214 aa, Homo sapiens
MHDPSLVTPLNFCPTSQVEGMETEAQRGAASGPGPHQMCERNLSTVPDSISGLGKAPEGTWSCTCSEFWEQRVGLCERRRALRANARLTRITHLGAAESLGNELLHVRECGRRNNGPINDAHVLLRRTCEHVTLHGKGTLQSKRLSQVTQLASMSSGGFLLERGERASIRGRRCDNRGRGWSDVLWRQRKAKEYRRSVEVGKSKETDAPQHPQK

SEQ ID NO: 927615 - protein, 170 aa, Homo sapiens
MWAERLMLPIHGCGKAARWHRSRMLTCGQRKNSLTPDSQKGPQFREMWEVLHMPLVRTLSWSGCPLPCACLDRELQRAQKLFTLLHADEQPAGACKERRGKLSPRNLSFHKPPSFLLPAPSPGAVLSDGAEQRRMTIADHSSISGRRSLASVFSPSLHTMGYLMPPRVHL

SEQ ID NO: 927616 - protein, 117 aa, Homo sapiens
MALRYRGWGHTSNANLYLSCFPGNPTCDIPSRKLITTSLKTGLSSSIAQCRVPGKLRQRKHFGPSRWGGILSPHKHESKSLWPAMPKPTHFPCRGTKQSLRINPDPLPMHAECQNCG

SEQ ID NO: 927617 - protein, 122 aa, Homo sapiens
MCISQPHEVGGGEKRGEICEAQAEAAEGPAHTHSPGCPGDTGLVFRGAQGRPVSLVAGCGHITGENTKADNSQFPTLEQKLRSDGERTSAIRTLFCGPRWQFCKQLMNICPVLHSEPLWAGS

SEQ ID NO: 927618 - protein, 136 aa, Homo sapiens
MPFPPQPRDVGAGGAGTACLDPGLSADLSRSHGAGDARAALRRHPVSRRTVEGGRQEEALRQNSQGLQLSPVATPALWFPMRVLLAGFQGGSGPTSHCSHYLPVHWVLLAPQDSQTICPILRPLKGSGSAAWSMKE

SEQ ID NO: 927619 - protein, 133 aa, Homo sapiens
MDASNTHCKFSSSSGLGSSPQDPGPGAEAQLGGPPLCMAAKGRASPEWLIGMPGKSSALGGGPAHSPHGGGLIKGLMVQWAGHQTGHLEAWGPVQLAAALLGDLKQITWPLSAPSAPCLLPVWQSFLEGILMG

SEQ ID NO: 927620 - protein, 149 aa, Homo sapiens
MQSCRQTRSLAYSCPLLLVQVGMVELQPPGSMQISILCTLGHHDGHIKSWHVCLICQSVDCAPTGPQVLFIERHARRSDSTISWEKYGFGVGPSRVLSLTALVSSCVTLEPSTLRTRDHKCKVVLYEILEQKKDIDRKTHLWIVNSVIP

SEQ ID NO: 927621 - protein, 134 aa, Homo sapiens
MIRAIEEPKAAKVFICVATLGPNLELLLPGIKGLGLRLLPSDIGADVSVNGCALQLEEDSGLHNHRVFPNMTGTKRTQIMIRDPKVGLNSLHISTAPRYRRAGRLGNCWPARGTCGVEKKELPSACREERPSLG

SEQ ID NO: 927622 - protein, 197 aa, Homo sapiens
MGRNQQTTPKSRNSKVRKKPVRWAGTKDELHIVEVEAMNYKGSPIKVTLATLKMSVQPKDSLGGFEITPPVVLRLKCGSGPVHISGQHLVAVEEDAESEDEEEEDVKLLSVSGKRSARGGGSKIPQKKVKVAADEDEDDDDEDFDDGEAEEKAPVKKSIRDTPAKNAQKSNQNGKDSKPSTPRSKGQDSFKKTGKNF

SEQ ID NO: 927623 - protein, 141 aa, Homo sapiens
MSAAHQHGTCDDHRECKVTEGKIGDWERPSDEVLWPRLLIPFFSQGGIFPNQPFADQIPHWHLFLGGPQMAQPSEEFFFIEQLSLDSVISIEDKLLMQAVLFSLILKFPNCIKLPPKCSVNKRSFLSCNWENERSYRQSEV

SEQ ID NO: 927624 - protein, 157 aa, Homo sapiens
MQGVLLGNSLQLKICQEGIESGRREDTEAELKREEAMYSAQDCCVLCTGLLCTRFIPDPNASWGRGDFIHRGTLGPGQSRVVLPMRSDQFSLSTPLSPGFSGGASLLHLLAVQPQMPNQDASQELSSYLRVGPLLDQTCTGTLAALAPQTSSNCSCC

SEQ ID NO: 927625 - protein, 234 aa, Homo sapiens
MGRHWVPAGFPGVGGKQSVDLPFWSLKDSDPFLTGPLGSVPVGILSAWNWMKGDTSSPVAPTIGTALDEIPSQNRTESFPRPTVITACVPTMFIHCPRALELASNESNQTSILPFWLVSFRRSWAHLEMPPKSQSLESGTLRIYQVVYSTEAALPHKLQYQVLPLFPPLTLSRRVSPHGHQCPMPTSSTAWLLLMFTESPRTLQSPYGEYCQDQASSYRAVGFLLAQRRFRHTI

SEQ ID NO: 927626 - protein, 130 aa, Homo sapiens
MFSSTPGLYSLDASDTPRTVVTTKYVSRHCQMSPGVGVLSTLENHWANRRLKEKCFWLQEACIKDILRKSSNLDKDSSLSFQSTQVPERRHASLVQEQKAVWQLLSSFPNVFQNDTSLSNLFDVLRKANR

SEQ ID NO: 927627 - protein, 139 aa, Homo sapiens
MLKEPVGHLTDESCESQRSEVCSGLALAADFSRDKNDGYLMVTRGFQGLHCEVRAWYLRPRINLSSHEEPYFPSEEIKMARSSQLVFLVDMIWLCPHPNLMLNCSSHNPHVLWKETSKSYFLMVDYIHKICMSTMWQAP

SEQ ID NO: 927628 - protein, 148 aa, Homo sapiens
MYFAVSILGMKSMLLKRVTEIQRSHLLLGQKESFLRSKRIQGSFILSVWGFNQYTSDLVFILLQKSSVKPFNSQNPNISPERQSCGPLSSSVVVLNTKGSHSRALRKGVTSLDLCFEKIILAAIWRITWKGKSGCVVVCRSCITGDKR

SEQ ID NO: 927629 - protein, 167 aa, Homo sapiens
MVLVMAVAVLGQLLECQAVRPGFGSVCYSPGGPVHRALGGVPRYVYVWVLAVVSIVEVIPCPRQSAQVVKAAGVLQPCCWGGQSCCRLVAVGWWLGITSFRPRWWLRVGFPGFKARENVQQPHFLGVGLLPVTPASAQEVAANSSDNCRQGMSMGYQGYRDAGTIGP

SEQ ID NO: 927630 - protein, 211 aa, Homo sapiens
MSGISTESHEGQECPEASSFTTVAGISAMLLAETLTCGLSTCPGDRDRRQRNSRQEKGRGPGEAPLSSLETAAQYENILFSHLNVVFSKTTPGPPHFPSCTHKNPRLHWQRVEKGRREEAAEDAACGAARSFHLSWFLHLLTCMLPLLQGVESCGLSKPGTPHDACVQDQVAQQAGVEASGLDLETHKAPPYHILLIKQSQTSGALSEVLQ

SEQ ID NO: 927631 - protein, 142 aa, Homo sapiens
MWVGPDKGIKAGCPSQQRQPARVPFHAMGGANNSRHAALNAATLTTEVCSFTPEASKTMNPPEGRNAEHIQTSEGTNSRHTIFKNCNTHRKGHNWRNWLFYQGFDWNGMLSFKESNLTYATNKSPLEKLASYLVYTVPAQGS

SEQ ID NO: 927632 - protein, 146 aa, Homo sapiens
MSLYRDYRKRRLQKCRLYNESSEILTRNNQAKGAEPEESGINDSQYLVLTLIQKECAQLFITDVNKQSTNRKNSSFLGEHILGKEIEDKIKKVKHMVHVIAMKEKEEKYSRKSTGETTEECGAQQPSWRLEPELKKTQNMFSKEDA

SEQ ID NO: 927633 - protein, 139 aa, Homo sapiens
MKIEIAPPPALGSPPPDNETPLHVSISSNTSLHQPRSFGLIITLRLTTTLLVNQSFLVQKHPFCPDSLMADAARAALSSRAAPQLLSFLVWGAKLAPCSANAWFEGWKRGATRLRHQSRITETSSLKGTLKIFTSYPLP

SEQ ID NO: 927634 - protein, 221 aa, Homo sapiens
MFSNRRWIQVGALKQLYGVVDQEDEAEWEVDWEEKMDGEEVEEEEKVDSEEVRVDWEEEKVEELGMVQFLWLFGGGIKAGSPGSQGLGRCCPPLLYTEGHRGLVKAGELIWAILVQACCGPLSSRLPRLGCGWVRQEEVRDLVIQRALAKEPQDTGEALGAALLQLFQHSCEERVRKPWHSKNLPSSVVRLEFDPDSESPCRLSPQCLGKRRGTRPRHSSG

SEQ ID NO: 927635 - protein, 141 aa, Homo sapiens
MPEMHSTVIELHLARALWERRPHPACQAAPCRHGVWLVSVNSMFPTTPCSRGWEGGPISRPQGQFSPARVKENIQGHLFPAPVSLRGSTFLEVKSSGATTLTSGTKHLARSQRGVFGLAWSYLWIKEPCWAVIAGSGKGSG

SEQ ID NO: 927636 - protein, 139 aa, Homo sapiens
MDCSSLRRCFLYDGLAIYISGSLLLQLGCHLLLSSAHMEDIIPEGRYETSLCLAVGEWCGQDSSGKAVMQTLSPGCPYPYHMPHPGFCTWLGHTSSRASMHTLSWPGGEEYSSEGRAKPRLRQCEHIDNYTFLNQEFKQ

SEQ ID NO: 927637 - protein, 152 aa, Homo sapiens
MPSVESLLPNREDSGVQLLGSSKGQRTEWPGQTLQRRWNLTLLHVSDRKACLPSRLPPGMQGPSQGQGVEEQLILQKPRAMLRHSEPFKSDNQDAGGKLRIPLSMGPVFKKVVVSEKKGFCEHSFWAPFIPIGTQATLLPPWIPPSFPYSYG

SEQ ID NO: 927638 - protein, 141 aa, Homo sapiens
MPVINKNKNLNLLVEKQTVSIQRAGPHSGFLFKDDLLSLIHFGTGKEYQMESDQKVVNMLSVFQPFQTWILPSYPLDAAFSWGSFLPHVFWGCLLLFKIMCIPLTPTQQLSPHGPSYSSFLLSWRYAPSCITSLCNQLASE

SEQ ID NO: 927639 - protein, 291 aa, Homo sapiens [sequence omitted]

SEQ ID NO: 927640 - protein, 134 aa, Homo sapiens
MRALGGNLGRLQGAALGNYNCKGNQYEERWSQVTTEEVAAFRGEQGCAFPKRREHIVLHATHDASAAEAENQSQCLEISRRRQLSWRARVQQQPFPQGHEGIFGRLSNLHLNDCNFSAKTELTTLNPAIFLKLD

SEQ ID NO: 927641 - protein, 153 aa, Homo sapiens [sequence omitted]

SEQ ID NO: 927642 - protein, 134 aa, Homo sapiens
MNGKSLAQLTSCDLRSKNDPEPGKQGDVSGLGSERLSTATSRRVSSMARRLRAQGKRTWDGWKGTGGELAGAGKARGREETHRGARSSSVTSARGKRGLRNPGHWALLRCPVWLLIPGSLLFIKGVRHRELLPE

SEQ ID NO: 927643 - protein, 143 aa, Homo sapiens
MQTTLLWLSAFDDFLNLGFWWFLHSLRSEEARFLFREQTNAVAKQPFAKELTVDRREPGASYQNSGKNTLKASQRVTRLPLTAQAQSCRRFQGIGLGHLPQAPSHGCHRSLIPIAFLSCPSYGSSGPRFPTTISLHTCRIIDL

SEQ ID NO: 927644 - protein, 147 aa, Homo sapiens
MLQQSPGSATTSLCTRVGTRSRERPGKHMDAWVQSHGWTAASVPESTELLPRQLCREEGSLRFLVPTGSMEYTVLAAPPLLQLAIPVVAAPDGPCLHHSYKVLWILGLNWKLYAIALVKTHCFPPHLKNAECKFQRLPTILCFHFVK

SEQ ID NO: 927645 - protein, 341 aa, Homo sapiens
MWENLELPGDLLNGFAQNVDSDMHKKVQTEVVSDGNEELAGNWSKGDSCYVLIKRLAAFCPCLRDWWNFELERDHLGYQEEEISKQQSIQELTWVLLKAFSCKRQTEHKSLENLQSDNVIEKKVPFPGEELKPAAAICISNEEPNMNPQDTRENVSRACQRSSQLLLPSKARSPRSKKWFHGPGPVALCCVQPRDLVPCVPAAPALAERGKHRAWAVASEGASLKPWQLPHDVNPERQCRREIWGWSPSGAPSIGAMRRRPLSSRPQNDRSTDSLYHAPGKATDTQHHPIRAAWREAVPCKATGAELPKTMGTHLLHQCDMDAFPVFDDIESSAESWSVIS

SEQ ID NO: 927646 - protein, 148 aa, Homo sapiens
MEHWWCLCANWCESAGGLRRLLGSVLLSWGSWTLTHYTLLSPVGGITCQGVLFWHRTVLAWEKGDGDIVKLFFLPSLMHLFLDFFSSGMLKYLCSTPRFPQMYSCPLVVFKFNALATMNNAANERSQISLVWTYGFISPGAMIPSECV

SEQ ID NO: 927647 - protein, 266 aa, Homo sapiens
MPSCELKVPPDRHQKLKTNVLHINCNANHSAILWRYSSLELKFAHTERLPHREEMSTLTDSQRGPSISNVTEGVTGEKFRLIISPIVNTPPYNIDAKTINGNMAGMEEAATFGSYMNGNLDPDEREEEAASTTEEEAKKNRWRKKKSKGAAAGQQETDKGLRASVDEGARQLERQALEKKERDDDDETEMKEEGKEEKEEGKEEEEEEEEEKEEEEEEEEEEEEEEEEEQGGGGRGRGRRRRRGGRRNNQNSNRPSLPQFQYVAVS

SEQ ID NO: 927648 - protein, 139 aa, Homo sapiens
MKSKLVNTNGKIIEQPLIKIYGRPEGVNSKGNYNRPEKLLENYVCGLTNTNTHIILAAMITENLNSIRGHKKINKLLHHNMASAMLDARPGSMGAQRIHIGPDSGRGRIPRGDSISQDLKENQALLRGGKQSGLRNGEK

SEQ ID NO: 927649 - protein, 144 aa, Homo sapiens
MKNSILKYVVLVNQSRKGKGNFKIHAFVDVAICSKWSVSSLPDDHTPHKSELCTGAREVAVEQRELLLAVNDHVESFTCEINALKDSSQVALWSFRCEMDHSSICNRPFCEALQSNQRIQEFPTPKSGIWQMVGQRNKEGMQNS

SEQ ID NO: 927650 - protein, 140 aa, Homo sapiens
MDLENLEENSGKRDKIIQFKLATIDYNYYHFLETFDIMPITHQTPKHPSYSELTEGPVESALHSLGPGSVHSLHLPLSHSPVLRFCGLKAESAVFNTLVRHNCLLTPNPTVVQWFAALVFPDTLDSRIFGGSLREIPLHL

SEQ ID NO: 927651 - protein, 174 aa, Homo sapiens
MLLAFLVLHLAMAYCGISQPPYETHGWMDGWMNGWMDGRMGGQMNNKREIPKVHQFKSNYVSGLHLGKPPSGKPPSGKPNDPHSLVPIFILLSKIAAMKDSAALKGKCECNGVSQLRLEKSKGKEYNMLINLGSPHIQHDYIVILFDAIQQRICTGLRQSELLPLPQKKFDRGA

SEQ ID NO: 927652 - protein, 169 aa, Homo sapiens
MLEPETLVCRYIASFVPSAPANVEAREKLLTELLQERSQVYANPLNSSNFFYCRRTDVTWEKNDVTRSKNEGSGWGSSRQLVRRALWKAHDPESAVLHQLRESCGAAVQEVVAVTRDFMQEGLSKVSSSKENMAFPEAPPCGFLHHQIYVALIAGCSEAGEGSVLTGLL

SEQ ID NO: 927653 - protein, 142 aa, Homo sapiens
MWDREKKKPIKGQNAIKHFTIEGNWCSVNLGSSDFLERVSLIGWRGSWGVYPSTQERTRDAGAGVEPSKALAAREQTGSESYPPMPLSTHHSLHPGDKHLSIFPKGFPGSQRPLCHAKGRPGAHESRSHEEEPSVNVPNGTG

SEQ ID NO: 927654 - protein, 154 aa, Homo sapiens
MFPALCPCVLIVQLTPMHISSIYSLPFLWLYTQYWDCWITWQFCFSFLKNFHTVLHLTTNTICFNPHLLCVAEVLPHTLLRGLGNIQYMHPVSTLKLEKFCILKPILPVRVSKKGVWVCNIYLIGLEKDEYSLSAGTLFKSCSGAGHCSAQVLQ

SEQ ID NO: 927655 - protein, 134 aa, Homo sapiens
MRTSNQRNSIKLQEPHSKSNLKHIPASYRMPGPLGMPVAADSWQSHNAQPLKEMSSGPCLPEFFGESPYCENHIFSCKNRVPMTRYEKYPGGMGDQIGAALKDAPSGPSSHMPFPFPMASALWKVSVSVTSNLV

SEQ ID NO: 927656 - protein, 148 aa, Homo sapiens
MLPLKPGNFGEDGSKGAKAKGCNGKAHAMGVSKHPLSKSAKEGGEAADMNTTPAEARAEQLTTEMGVGGQVAMDMSHLVPGDNATKCQEGKGPPLSSSALTSVSVLHGSELDYLFPSDVHLSHSCNQTTKHSSGALSPSRPRCSVFCL

SEQ ID NO: 927657 - protein, 136 aa, Homo sapiens
MIASEHTKLHKSNFKRFALAVAAVASRIFDHLGAQYFTRSCSPGPNVTKMGGGEGDSGVVLKGVRKPQQKETCVECLRLLSRETEKAFTKKGGSVSATDADYSPCSLRIWGTMSLCRKMQNFSGPKSQQYTSLDGF

SEQ ID NO: 927658 - protein, 148 aa, Homo sapiens
MLYNRAGANAAGDFKLKPMLIYHFENPRALQNYAKSTLPELCKWDNKAWMTAHLFTAFFTKYFKPTGEDKARLSLSSDEASLPSSWDENLNFLLKSFRHQSSGGIGMDGGKMEDENKLYQKNPKQTIKQRFQKCKEKVHNCATISESI

SEQ ID NO: 927659 - protein, 187 aa, Homo sapiens
MVVTREMNVKDHEKPNDQEKQQAYSRKSLLTKAVERHMTDSRHFDPGLLFIIKSSLQFSLLCHVSLLTFLEQLHTAIYMRSVPSRPAVTTPWLLPMFTQVPGALELPDSKASQACVHSFSAASSLRPRVGPEVPSKSQGPESKTLAVYLVFYCTVAELALKPQDAVLPTLPSPFQRHRSLTSQPPTP

SEQ ID NO: 927660 - protein, 135 aa, Homo sapiens
MRFRWGHRAKPYHGLTDRKRGALVNKISALVKEAPVFFTFSPPRSSTTPAYVLGSRRVVTGKEDVDSEGQDDEVSDGNKELAGNQSKGHICYALAKNLAALSPGNRDLQMFELKSDDLGCLVEEISKKQSIQELV

SEQ ID NO: 927661 - protein, 148 aa, Homo sapiens
MRSPLYYCLAPSIIGQDLPKKTVALAITVCSVFGWRKHSKNSRSLAQQLDKPDKPNSQVVSRGDVELICDYITEVQSILGNLDFQHPETWNTPLITAAEENLTEIGTISIHFLTRSTNIPAISKVITRFYGGSGCESNTDATPEELMV

SEQ ID NO: 927662 - protein, 134 aa, Homo sapiens
MSPLAIPPPPTKILLSKLVSFSLEPRRFVFQNDVVAEWRMDWIEDKHRRVHSLLERYLLVSSSSMARRKSSENGKITSRVAYVIKMFFNNSRKPQKFQCHFPTKYSDFYGDFSDGTIKFCQNKCKHYKRFPIQN

SEQ ID NO: 927663 - protein, 147 aa, Homo sapiens
MASLGFVRIFQIAKAPRILSLRLCSPFAIRLSAPAPVICFGHTIWQKLHSISSGPRFQEALNTSALLLGPRGGSMGTSLGWFDEGWETQGPTLCFKSAHEGTDFSGYSSSGWRCGCGPVPIAGVQDEVEGDGDLPASSSCQGHSATR

SEQ ID NO: 927664 - protein, 280 aa, Homo sapiens [sequence omitted]

SEQ ID NO: 927665 - protein, 125 aa, Homo sapiens
MGKLPRVENDCSSRITYHVNKSSSIQSIYGSDGRAGCSSGCIFVFGNFHGQIRLKWMWSIVSPQECDSHSCKLTVERSKSFWIGYPVSIICDIHRFSEVALKFFLLLKLCVVAVFKHRILIFHSS

SEQ ID NO: 927666 - protein, 157 aa, Homo sapiens
MTMAVLSNRKGGNPFPTQLLETQPFLLLKPQTSNAFFPPFFHTLILIRTFYLALSSKYNQNPTTSHYLQQYSHTLSHHHFFTLIMLPCSLTVYPQHSSQSKSIKTHQIKSPLCSKPPVASSTLTSMQNLNRMLLSLINPALFCHEGYRDATCSQLNE

SEQ ID NO: 927667 - protein, 151 aa, Homo sapiens
MYSLTYYLSLEAISPKSVSLKARCWQGWLLLNTLGENPFPPLFQLLVATCVPWPVSPSSIFKVHGSSLYLHHHTTSTDSDPPSSFLEGPLDYIGLTNIIWDHPLSQDPYFSHIYRILFAIEVKQIIFHDIMGITLSVEGLLRKKTDVSQPW

SEQ ID NO: 927668 - protein, 141 aa, Homo sapiens
MADVIKATTQPTWEAGDSHLKIVINDLEHGSAYFRPSAQPSIHPSICYQLFAKPPTGAKRASFCTSFPPTLRYPRGPPFRSLGPLASFFHTGLLHVVPFTWNVPLSHLPAWVLPLYLQTLNIISFHTACREKPSHISDSLF

SEQ ID NO: 927669 - protein, 135 aa, Homo sapiens
MDKKPLAHISSYYRRGNILLYYRRSKIIEGIQGCGVVENKGVVVDDQESLGGRGRNSPSLFAPTSGFLTPPTEGSVFLPLALTANTLPISEPQMGLKLAESAEPLMPYSTYLIVHHNMLMDHTTRAPKRPALLKE

SEQ ID NO: 927670 - protein, 180 aa, Homo sapiens
MPNVELSALGISDPLEGQCLISYHGAMIPATSPITFHHVSNNEGDTPTGRDPYPPRDCCPSLGWDVEQMKKHMEKKKGLTNWSLLTCEILGIHTGEFRAQRYRNGDRALFSKLLTDLHVVLALGVPMWVAPVSPIERALQNLSEVTSHTDGGAALAQEARGKKLHRLIQEHGNIPRASRK

SEQ ID NO: 927671 - protein, 163 aa, Homo sapiens
MRFLALLVCLLVLGFQGEYISHCRPCRGLNPGHSDNDLSEFWKLHCDVQQEWTKTGIATKKCGAAVTTPKMWKWLWVDDGRVWKCALAKPVLPRTDHKGITATGIHTLFCVDKRFHLGVYNPISGIAGLYGNCMFYHLRNCQTVSQSGRNISLCNKKKESLSE

SEQ ID NO: 927672 - protein, 142 aa, Homo sapiens
MNPQLYLKHYLFGFHHHKHYFGAWRCCTSSCEQNTHWDPAQCDGPKHKALKEAPPLSVEGEAAVPGDVSTESRVRWAQAVAWRVFEEEDMRPQSQVHAPLLCEQGPGLSRAPSRASSFLTPWGAQALQTLQCWLPHPHWTSR

SEQ ID NO: 927673 - protein, 137 aa, Homo sapiens [sequence omitted]

SEQ ID NO: 927674 - protein, 116 aa, Homo sapiens
MEGAGLHHFPGPSNFPVITLWSLRAYFQNTLQQGNTQKTNETTKNASSRKNDVAPGMPIVRDCGCRYLTACSQVLPLGPGSLQAEQRLPRVTTAVFRDECTCCRYKPVGDNFGENF

SEQ ID NO: 927675 - protein, 173 aa, Homo sapiens
MRAPPDKVPGRNMIHHHHHHHYHHHYHHYHNHITITVTITNTITVTITNTITLTITITITTIIAITITITFITTTITITIIITNTIITTIAIITTTVITTTITITTTITTITITVTITITTITIITAITTITITTITITTITITTITITVTITITTITITTIITITTTITSPP

SEQ ID NO: 927676 - protein, 158 aa, Homo sapiens
MKSCDASGTPDLRNPQARTVTHCNTLFGALWFLASPSFLMPSCSSCLDTGAYGGSCSGVVGKMRGHKDVSVLILRTCGCVTLYEKKGLCSCDSGYRPLDKEIILNYPVGLNEFLKVEEGGRRVGQRWGLACLCLFDEQPTEMPASQDTKASNKVLQED

SEQ ID NO: 927677 - protein, 150 aa, Homo sapiens
MSQLLSGHALWIPVSSTVLPILIFMLISAKLIGVGPGRLLKYFIFSACVAVIRTHGLNKNKPCMRSMATPPLFSREERIQNRARHCTFPSTATNHIYIPVSPKNLPCFQSYSGAPELTKTSTLKIEFPLPYTKQYDQKCPSMKIITILIS

SEQ ID NO: 927678 - protein, 138 aa, Homo sapiens
MHFVFPDDNLFDINSYIHGEGKSRKSVERGGGISSTKEAGCTLPTLAVEKKEDIAMTMSPLFFLFFESWIPKACGPLGSLKPEQYKSLLLLLRDPVKSKRMEEDYYVLFIHTYDWENSYFIPGNICYYDMLIFITAYS

SEQ ID NO: 927679 - protein, 182 aa, Homo sapiens
MCFVKQMLEGSMLVKSHHHSLILSTQGHKHCGRPQGPLPRKTRDLCSLVYLLTFPPLLFLASLRWVRTSSFSLEKFVVTDRLKPSSLNSSKSFSIQLCSIAGKELHSFGGEEADHQLHLCWSLLEVHSRPCLPGLSQVEATEQQILQNGKCCCLILPLEALSQRGTQLYEVSVGPYWEMSPS

SEQ ID NO: 927680 - protein, 147 aa, Homo sapiens
MLTSAKIYFFIPVSSAKIDYTIQGFSLNANTQGLCTDLADTSSVHAALEETIVIEKTVVIHSSQENGAQNSMQVLKGKHQGSQEADGVGGKHGQEALLWFLQERMGEAGIEWCQKILLGKGSSMGAVSIPHQGCWLPVAGSCELDDS

SEQ ID NO: 927681 - protein, 180 aa, Homo sapiens
MRILEAHIQAMTGSRGSCGYAGATPDNPRSAAALDSQRSAKLLVNCSCAGSRLCTPYEYLMPDDLRWNSFIPKPFSPSPASMEKLSSMRPVPGAKKFGDRCYRGSFCLVADPSVAHAALHAMACHMSAVSTDLVAEKLVRDDLWALLAKNVLELKNVLNKGKVKTLATVGDRKLTYFTEP

SEQ ID NO: 927682 - protein, 136 aa, Homo sapiens
MCSEFLPSGGGEAADFRDPGAQLASPSGSPTGAAGGAACQSRAVCLHSSALGWSMGLGAVEQEAALIGEARAAQEPTEWRGGSGMVGCRSRALPGGKAAKARVRRGHAHPELALARKHRVQPRFPPAPLPPHLPAS

SEQ ID NO: 927683 - protein, 141 aa, Homo sapiens
MGQEEIHHLGKTFPTTPALSLLYLAWALSQHISYPLKLYLDVCFLRDLSRYNSHEASSYLERKNNIHGKNFLLSGSFQIVADISSISDSVLHCVFGSCSDCWPSARLQLDAREAKMQDKALSEMITGKRNRNSHGESVWER

SEQ ID NO: 927684 - protein, 215 aa, Homo sapiens
MAGCRSRALPRGKAAKARPAPAGPAGHSECWAHRAHAYPELALARSTARSPGSRPRLSLHTSPQAEGASSGLGQPRKGLPQCSGGLKSPSSATKVGAQAEEARRASQGCEDCQHAVTSHSGLISTHCKLRLPGSSQGQFQDLYRRCEDSELEVTPGPCKFYDSRSVVRRGEKPKMPENSSILVRSQGRSFLEKLQDGDWFEEKTKEDPEIGPGSL

SEQ ID NO: 927685 - protein, 136 aa, Homo sapiens
MSTVISRMMLRKVISTSDLHPLWPPSEGVYQRPMPSLQYCPRCSCGDSARAAGTMVGGKATTTVEELVSGVRQVADLEEQFRSYSESEKQWKARMEFMLRHLPNYRNPPNSGGRLDQLLSLLHGLGQPPLPGLQLQ

SEQ ID NO: 927686 - protein, 236 aa, Homo sapiens
MQLRNTMVLAFRDLMSSMGTDADPWALGLRDLKSSRMKGGDLKDGQYLLAELEEGILGRGKEEEPPQQDKAGPVGRKKLEQPEMEQSYPWPSRDQGWGPGSWQEVRAVGSPGHTHSLGPSVQSEASPENAARERSRVRTLRQAFLALQAALPAVPPDTKLSKLDVLVLAASYIAHLTRTLGHELPGPAWPPFLRGLRYLHPLKEGTSPWLFCDSYWEVGEKEGRLRLMEIVLGGFL

SEQ ID NO: 927687 - protein, 173 aa, Homo sapiens
MWLPLHGSRRLLQLEPSRLLSSQQAGEKGRSRACPSHERRHLSLQASNPLWQSRGSTTVSSGGRFRCPSCRHEVVLDRHGVYGLQRNLLVENIIDIYKQESSRPLHSKAEQHLMCEEHEEEKINIYCLSCEVPTCSLCKVFGAHKDCEVAPLPTIYKRQKAGVQWHKHNLLQP

SEQ ID NO: 927688 - protein, 145 aa, Homo sapiens
MRRQVSGAFSHLHTGPPSPGAQEILICRAACTPPLSSYPPSPLAYPEVPFPWVPFLDDRWRRESRGEGTGPGRGEGKAGESNAELQGYSKEKLEIKGPQCRVRTSEASCCSDWREEHGHIGKVLPVSQGCHLGVAQGTVARRVFH

SEQ ID NO: 927689 - protein, 142 aa, Homo sapiens
MLNFSMCVHRKLWISKSAAANHDLFLIFPGKITKKSHQRQKLFNFFKQRLFENLTQESREDIDEAVCAILFKENSIVKDINQTQRQKSTKDARSTEKSVSTLVLNIGDLVLEMLPQRKVRVGDCQLIPEGSRLSGILFKAVQ

SEQ ID NO: 927690 - protein, 242 aa, Homo sapiens
MNTSFPGQLQQSWSNPCDQGLDYAPTFSSWKCELGRWTRPQGAGCLVGPSEKGTSCQGGPGHLPLCRCDVHNCWDTKHFPSELATEQTWERRLKRQDEACGFTQVEFEVPIGQPGGCHIKKAIRCAGLVGVKCIFPIQTTHSRLISYGNSLTDTPEAAQSLKSNAKPPGNQRNGFSAYWSTENNALSLVLYFLPTGFLTLSSDFDNLHNPVKNSHNSFKYMRVDDVCDDKIIKIVSLFMEST

SEQ ID NO: 927691 - protein, 202 aa, Homo sapiens
MEHTGKKVSAFMALRTQCKILGTFIQIPVNCKLNAYEIRVGPIRSLGRHEVPEYVSEGSQRNGQRAHGAYNNSESLLVVGMLPEEADLLAHSPGAGKETLDLPSNLLWKQEVWPGNQSAARSIQQGESLKCDRGAHGYQRGSTYLCLGTFTDGNKVIASFKSCKALLDIKKASSKFLVLYQAWPTVTMWVKHHGPDFCHGGG

SEQ ID NO: 927692 - protein, 138 aa, Homo sapiens
MTLEVLLPGEKRAEEEVAGSTILVQQRPGGLLCSALQVCSSAESSGPQRYLITVGKWMLIKSKSGGNCPGRLYQILEILEQATILRVLCKFPTHYYFSEFVPQMSAEHLLYIRPEVQRENKMEMAPGLQVSQEMEGGF

SEQ ID NO: 927693 - protein, 131 aa, Homo sapiens
MAKGKQTRSFFTWRQQAEVQRKGGKAPYKTIRSRENTLTILRTTWSPKDCADLVDRCHQIPASVKGEVRPSVILSPDFLGSLLELHPGYMSSGGVSCVLWPTDSSVFIVSELQLYVSSMQQEFQFGEKDIC

SEQ ID NO: 927694 - protein, 141 aa, Homo sapiens
MIVGLPSYVELDLLNGFDQNADSDVDNKIQAEVVSDEDEELVGNWSKDTQHQPMKAARKGALPCKATEAELPKAAGAHLLHQHDLNVRHGVKGDHFGTLKFNDCTIDFGLSWGLYPLCFGQFLPFGMGVFTQCLYPLVSRK

SEQ ID NO: 927695 - protein, 173 aa, Homo sapiens
MAAAMAISRTIFPLSELLLQLQKHVPLLHRTLFTQRAAWLPPWANFHTYPKGEDVAHQGTWYKQPDLHDFTLTGSSEPPSCLNAPKSLTCEAVTCARPYAKCQTDKDETGKEEKKSHYLSPEQSLEMENRNQVKLSILRDSEVMGCRCKNTELQENFTKSAICIVVDCAMKGN

SEQ ID NO: 927696 - protein, 137 aa, Homo sapiens
MTENPGSRALQTEKTLPFEYPKPSIRVSKQPAKSGAAGGPALGGESGFHRETARFIGLDVGSRGEGGLKDVKLSNRWCHLWRGRPGSRESKKCHFAIVNLSCVWMQESETQRRGAGSELVDPGCAGSMNGSTYVSPP

SEQ ID NO: 927697 - protein, 178 aa, Homo sapiens
MLTHEADPQVYTGGWSLPAKAQPQEEHSTFPSLLRVQGSGTAFPCGYGKRSGTAVGPCEDSRGARSIWDVGSAGCPRVLQRQQLPFLRPALQAPRAAFFPLVSAVGTPGVPVVRVEKRERRDMRKAQEASFACHCFSVAKGALDLRDSERILESHSSLLAVERDSKHHSAAALAPNVI

SEQ ID NO: 927698 - protein, 150 aa, Homo sapiens
MKNDKGPERLDIHESIISSWNFSNFSKGLIQSNEWKPENVPESDKDEAGVHDENDSVKYTKLPATQIKGFALRTAKAISCKSNFQQVLCARIQHAEQTAHRGQRHWRGKFYMITGVETDSQQLSALPGPLSNHPLFRSKAFHSSGILLFV

SEQ ID NO: 927699 - protein, 346 aa, Homo sapiens
MQKSTQPYSGVAPYVTAVGTTEMWPRFAGSGIVIVVNIAINISIIIIVIIIIIIIIIIANIRWACTHTAFQTLHYGLSWQSLEAEEGPEGTAQGNRPGFLGSQCWKQETVLGLVKQLRACDLSVDSSVRAAWPWQESMRQASLRPQRCRALCETSPPKLREAGGAPSAVEQVRVGLLRLLSLLRLMLPITMDTGLPPHCPLQQVCRPHTALCSRCAAPTLPSAAGVPPPHCPLQQVCPPHTALCSRCAAPTLPSAAGVPPPHCPLQQVCRPHTALCSRALNPKSPWPPSCSLRTACFLTGPLVSTHPLLIAHTYTAARVNGKREGGGCGLHTCDALPVPGHWRAAG

SEQ ID NO: 927700 - protein, 146 aa, Homo sapiens
MNQPLLASSFSAGASLPLLAFKELNRGREGANEHSAPKGGGQGATVQAAGAHCQRTFSPLLDALALPPPCCPRACLTSACQFLSAGPTLPLRELLSMGLLDATGEAHVCVGDPASLGSRPSPDLLCSGAGAMGKGFLILPQEHLAH

SEQ ID NO: 927701 - protein, 136 aa, Homo sapiens
MAEPGTEPKAPTGTMGLCLHPERVPTSLVIPKGKNRTSKVSFCDNIRFRLEVPDFAIKVRSRGDDAIQKRAEKRTAMTAFKKHQNKYIRSVSKRPLLYQKPFVVSVGGGGSQRLTEVLLSSVDHRVVFSSLLLGTN

SEQ ID NO: 927702 - protein, 137 aa, Homo sapiens
MGPSHCAQPDRLAAAEGRQLQMPTQVMALCKAAAGPDVLHTASAAGIHIWTREMQSVLHERLQLVCPHCLRCGRTKYTDNWRVSKVERSFIEQLNSSQETYKGQLLSTGRSSVQVCSSQPRREPEWVAPSHRQPPEL

SEQ ID NO: 927703 - protein, 162 aa, Homo sapiens
MAPPKPYSAAECPGRRENRFNEEMDNKERTYTLNNEFSQHNRGTVIMKTVGSVGHKQEAVHLSSNSGGQGPENFAKIRQLFGGSKKFENSYLEDYTLEMGKFRALNTYIRKSERAQRDNLRSHLKKIEKQEQTKPNPSRRKEISKIRAELNKIEKKKTTKDI

SEQ ID NO: 927704 - protein, 212 aa, Homo sapiens
MAGCSTVGPALLGGPALLGDPAHSPQLLAPVLSPSLPEASGAGRLLRVRGPDWVSTCCPGWSQSLDLVITRLYLPKCWDYRHEPLCPTQLCFFKWSLEEINFAKILRLLISRVEKIFLNSRMENKFLCLSHSACAIFLHQPKQMLVLLNAVLVEVTVEKQKLKRGKEANMMNEGSCIALSGCDDLLTPPNSSSPYPLLSSKAASVFSEKILI

SEQ ID NO: 927705 - protein, 144 aa, Homo sapiens
MEMPGCPGRGEEPSWRPSARAVWKGNVVLEPQQRVPTGHCLVELCEEGHHSPDPRIVDPLTACTMCSGKAAESHFQPVKVAGSESLFCKATGVEVHKVKEPEEDAMKISLPEHKAGQRIVESGKNGPIGLELLRVLIIVNNGGC

SEQ ID NO: 927706 - protein, 137 aa, Homo sapiens
MQWPCTKSGVRKAFSELTYGVTESIKELLPPGSCPDPMTMGVFLFCSKQGNDVTLPLTLKLHSRNFQYPGPDFIGPLIQEKQQRRLAGREIIDTHKIVKAGSRGVTSFWSCNAANALDTPAFIIKFSEGGGRNTVFP

SEQ ID NO: 927707 - protein, 173 aa, Homo sapiens
MLYTTAAVLFWHSSCKTVFPILYSPFLKQREFLPMAITVPGPWKMGESLELPRVLLNGFDQYADSDLQKVVQVEVVSDGDEELFGNEAEIPPGGLPSGALRRGPLSSRPQNGRSTDGLHHAPGKVTGTQCQPVKAAKRGTVPSKPTEMELPTAVEPHLLHQCDLDVVTEKYRK

SEQ ID NO: 927708 - protein, 203 aa, Homo sapiens
MALLHSSLDVSQRFWYGWRGQDGPIETAPVCSSQRDQCRRRVISAFPTEVPSSSPWDWFGSGCNPWRVSRSRVGHRLPGKCKERDGEHLPPPAKGSGERLRYPSWVLCFFHGFLQSTVQEIPSWAYTTRALRFKHKTGQLFGHAPPLVIPRQTGSGVDHQETAADLQKYDLAVRRKTNKQKQQQQQCQHKSLYFYLIIYSGMS

SEQ ID NO: 927709 - protein, 141 aa, Homo sapiens
MLEFAGGPLQTLFAWVSPVEAAEQQTLLPDPSSGSFVPEGYPPAGMFKSAEAVCCLLFRYALPPEVESREAVGLAELQGTLPSSSFPTTLFTPSSIPGRSQTAVLAASKAPGAWDLRSQPWEGMSWSAGCEDHGKSVVFGQ

SEQ ID NO: 927710 - protein, 145 aa, Homo sapiens
MGRNQSKKAENSKNQSASSPAKDHRSSPGMEQSWMENDFDELTEVGFRRLEAKNLEKRLDKWLTRVNSIEKTLNDLMELKTMARELHYTWTSFNSQFDQVEERVSVIEDQINEIKQENKVREKRVKKKRTKPSRNMGLCEKKIYV

SEQ ID NO: 927711 - protein, 145 aa, Homo sapiens
MDHHKVLHFPCLHIEWTEKEEEEEGHVKQANPWVPVVTAAVQASLSLGPMVVYTGTGVSGFRSADYWATRRIPWVLAVTAVSQVGGRVLGPLGIKYGLGDGSSSGRTISGYPGVGAWTLCELPLRMNTVGSLQAAPYVSLRGCLS

SEQ ID NO: 927712 - protein, 142 aa, Homo sapiens
MELAIGEAAGEEEDPASSRVQDSALPPESLPRCPSGSGCPGLRSQSKQGLQSSVRAPCPLGSAASHRRRAHPQGEKWRSPGEYFKTGLCARSARPSAAGQIICLAELGPPIFFRAKTVNSHWKKQNVASVAIEVIQECISQL

SEQ ID NO: 927713 - protein, 153 aa, Homo sapiens
MRPLMNEGESGFRTYLTRSSKNWTGFIRRTASDYEKTKPFQVGDKVMGSGWRKVGMQTVKQHRVTLIKILGNLRHQVLFYHALHLVPPSLSAHDLVLALSSNCCREVDLAQFTFHLLSLKVYGGRVVTHSSNGDFYQRQREWGYYLLNDNHSI

SEQ ID NO: 927714 - protein, 141 aa, Homo sapiens
MKYPTAAVQRIDNWEPAVRRLLLCSLRGDGCLDRMVVEVIRRGQIQDTFWKIMGKSSLSHQCPLQLQPSSPTCNQMVPCLWSILCASVFCPDESSLGTCSARAQIQPAGAGNLLWPGPPLTSGEQEPVDECFPLLFPRKQF

SEQ ID NO: 927715 - protein, 184 aa, Homo sapiens
MACSSPQRVYIGVLTLGCSRLHKASFLSTAVSRTIAFVELFSPVAGCLHCLRLLQGPFLLQAPLKIQALHISRYIDKAVIPGVEYAAPEPKKAFPFCAFFVITGHNAMSCFYFGMDVLTTGFLNILQMWQVLILCILAYHLIAIDEPDSVAGSPTVSPGLQGTATTHLLSDAGACSPAHSKPNR

SEQ ID NO: 927716 - protein, 524 aa, Homo sapiens
MPKVPELPLQLWPLQQMVSDLLACQSSNRLSPTQTMHSMLPNVSLSSYPEVQKDIKNIPFKIVCASNGDAWVEAHGKLYSPSQIGAFVSMKMKETAENYLGHTAKNAVIAVPAYFNDLQRQATKDAGQISGLNVLRVINEPTAAALAYGLDKSKDKVIAVYDLGGGTFDISILEFQKGVFEVKSTNGDTFLGGEDFDQALLQHIVKEFKRETGVDLTKDNVAFQRVWEAAEKAKCELSSSVQTDINLPYLTMDSSGPKHLNTKLTHAQFEGIVTDLIRRTIAPCQKAMQDAEVSKKPPSKAVNPDEAVAIGAAIQGDVLAGDVTDVLLLDVIPLSLGIETLRGVFTKLINRNTTIPTKKSQQASLKLFKMAYKKMATEREGSGSSGTGEQKEDQKEEKQRNDFWLYECEEQPVSHNTWDFKMRSGWGHSQTILPWHVVHNTVMALISFHQPTCPVLPSELNIVPNCHTVSSWDENSIGLTFIHSFIYILILQTTIECLQHGLYCVGIGDRMVSKNRKNPYANAV

SEQ ID NO: 927717 - protein, 159 aa, Homo sapiens
MAKSLWSKWKRKMRAEKRKKNAPEEVSRLKSILKLDDDVLMKDVQEIATVVVPKPKHCQEKMQCEVKDEKDDMKMETDIKRNKKTLLDQHGQYPIWMNQRQRKRLKAKREKRKEKNKAKAVKVAKAFLQGNYPWILNEDCSRKLTQLVHDGSGMQIQIF

SEQ ID NO: 927718 - protein, 142 aa, Homo sapiens
MTNKNAEAANEKLEASKSAITSWVQSFLEAHGFFQAICGNDIHSASFPTVRGRVLGTDNTRSNTLKTPTKCSTLTLFSHSCLDADGLVENCEYLENSGVRYQNHYVEDHSPHVQLDFSNGCSLYTETTFILLVYKHLCITSF

SEQ ID NO: 927719 - protein, 146 aa, Homo sapiens
MPLIIFSAEISQGNFCCVYFSILINSQRQHNTKIMIRKAVKEFKNNKTFTTLEYLQVKIENETMTQVAGNEGKTLIAEKAGKSPLSLLLLFQQYEVFTPPSSSAVIVGFLKPPQKQKPLCFLYSLQNHDPIKPFFFIHYAVLGLSL

SEQ ID NO: 927720 - protein, 156 aa, Homo sapiens
MALLLLQLVNQIQQRLPEVVLCAGAILMTGEEKMNSIDRISDLTEFTFGIRRQVKNLWVNEIARCDCLPKYWDAFVVRKYNRLCGKENKEAEVTIYYILYGRHCTECFEYLLSLESFQQYEVGVIKARVIDEDTEEEEEEEEEEEEEEEEEEEEEE

SEQ ID NO: 927721 - protein, 169 aa, Homo sapiens
MQDSTTRFQNKSQSAKVWQRKQTIFDLNVSDVCNGFEEKIPTKEFGNLLDLEDEEERCFLETQAKTALSCFHFQPYGLEEKTLNYHQDYMRVIIQELGTRTPMEGGVDTCAAVSWVLVDTPGPYISQEDDVKTRRSRILRHLVVSGCIQQGFKHPANLLGPEFILSNWE

SEQ ID NO: 927722 - protein, 143 aa, Homo sapiens
MVLVIPMSLGAPKASQTLAFWSKPFNKSVGSSKLSHILLSSSEPSKLFQPLPVTQFQGHFHIFGYLYNSAPNSRLLTCSHPCAWLLWGSCGRGAQGSQQLAFLHCEPVNAKTFAPFPGDPPLNSFCIHYLPTGPVSEPRGAAD

SEQ ID NO: 927723 - protein, 166 aa, Homo sapiens
MLLGLWFSSRGSPLVGGAGLSFTPFPGWFSWVTWAPVEICIMKVSFGYHSGHSILPPNTPADLPVYMHESQEISHSLTETNTKSDETSDLSCINATPWNAAVISSTKRGSEKEKETSTMQTGPWEPGLINGQFYGSFVKKEILTEPSVYFAPTIHIKKTESRNVGG

SEQ ID NO: 927724 - protein, 402 aa, Homo sapiens
MLSSCPSEVKTLLSDIQLQTPTSRCFSSLALTHGAVSRGPPSSGPQNGRSTYSLHCAPGKTADTEHQPVKAARKGTIPCEATGVELPKAMGAHFLHQLDLDSQLCLYKQHENGLIHQPYETVSSLNLFFIINDPVLEEDRKMWKSLELPRDLKSSEDRKMWDSLEIPGDFLNSFDKNADNDMDNKVRAEVVSDGDEELVGNCRKGDTCYAKRLAAFCSHPRDLWNFELKKDDLGAVQKGNVGLEPPHRVPTGALPSRSVRRGPSSFRPQNGRSTDSLRCVPGKAEDTQCQAMKAARKRAVPQRATRMELPKAVGANLLHQHEPDVRHGVNGDLFGSLRFNDCRIRFRTCMEPLNPFFPPISPIWNECIYPMPVPPLYPGNSNLLRIPGVTWPPFYSGRKFPL

SEQ ID NO: 927725 - protein, 148 aa, Homo sapiens
MLQTQAHKQSRDIAGGENGHATVRWERMRVISAATFVGPQNMTDISEATWKDDLKPRLWLPFPHASGHTLNTQNLESSDSEMMMEDSEEEGLEGEGCECVLGSLCKQHGQRCPGQRCSSQNGGESSQKLHRRFDICSIQLPYPYREPL

SEQ ID NO: 927726 - protein, 209 aa, Homo sapiens
MGEDGSPTFSDVLIFLDREPHRLRAFQVIETQDPPRRLALTPAHLLFTADNHTEPAARFRATFASHVQPGQYVLVAGVPGLQPARVAAVSTHVALGAYAPLTKHGTLVVEDVVASCFAAVADHHLAQLAFWPLRLFHSLAWGSWTPGEECPCKQKMQDLSKKVQKVPCSPNKLQVHLHLASAHTSEWPTWKNSEERNQEWWLTPVIPAL

SEQ ID NO: 927727 - protein, 146 aa, Homo sapiens
MQGWLGAAVAIPEVCSRGHCLAEVFCLFLSFFLLFLLNIAICIQSCNSPKPIRESSDLETSSRNSLTSYLSFFYLHSMKFSSNNTILQKRILVFLPPEDAVFMKANTGPSPGNKPAGAFILDFPAFGTMEPALSSSSPPQHPYSCI

SEQ ID NO: 927728 - protein, 159 aa, Homo sapiens
MLGDRPSQCTTLFLSKKMQVSVLLLATSSKHKSGDEPQKGLISPGFACEKSESDKAISFPIDLALSAAGVRTPHEDCMPHSRPRQEASGPLRPLFRDTNPRPPTAFSTIHFRLPFYDFTTQFFLKFYGISLKPPEGHLIDFLNYRTCGAFYTYICTEAR

SEQ ID NO: 927729 - protein, 162 aa, Homo sapiens
MGHVNSYSSFRIQVTYHFFSSVVHVDHGNVCALPLCLLLESRLVWVNPKDWDGDGWPLLLTTHTVPGPYYMLNKYLLTQLNEPPQVRIQMKIVHELHQCADVDLLRKVMEVKCHSGKSQNIGCRNRLFGGGSENKPSNHTDTDSPGLDGNRILLMPIKLQCQ

SEQ ID NO: 927730 - protein, 136 aa, Homo sapiens
MQNTYSIRSVMFFSKLVILVSSSFRPLFCRSTGVCWRSTLDLVCLGIIQRRLQNSKDCYLFLPLEASSQRGMRQMPAGALLLHPQPPFPPGALSQGDGSFIHKPLTGAAAFLSQMPCPERRNVERQSGYRGFPKLW

SEQ ID NO: 927731 - protein, 157 aa, Homo sapiens
MSHLVFTTLLNCTLFLTGEHLPKSLEGFFIYEEEGSGVPGSSRKGNDAIVVEQWTVIEGCEIKTDYGPLLHTLAEFGWLLTSVLPTPVLRHDRKNQVAQGIEDSDCAGFIEGRGGMQWEDDHLPEFDRPAADLLSNHLQPNSSQHSDAPSLISATPF

SEQ ID NO: 927732 - protein, 223 aa, Homo sapiens
MVGYFRLWIPGFAILTKPLYKLTKGNLADPIDPKSFPHSSFHSLKTALETAPTLALPDSSQPFSLHIAKVQGCAVGILTQGPGRCPVAILSKQLDLTVLGWPSCFCVVVAVALILLEALKITNYAQLTLYSSHNFQNLFSSSHLTHILSAPQLLQLYSLFVESPTITIVPGPDFNLASHIILDTTADPHNCISLIYLTLTPFPHISFFPIPHPDHTWFIDGTS

SEQ ID NO: 927733 - protein, 263 aa, Homo sapiens
MEDLRAQIFANTVDNAHIVLQIDNARLAADDFRVNSAAGDRDPGFQGGAALMKKNHEEEVKGLQAQIASSGLTVVVDAPISQDFAKIMADIWAQYDEVAQKNREELDNNRSQQIEESTTVVTTQSTEVGAAKAMLTELTRTVQFLEINLDSMRNLKASLENSLREVVARYALQMEQLNEILLHLESELAQTWAEGQCQAQEYQALLNIKVKLEAAIATYRRLLEDGKDFNLGDTLDCSNSMQTIQKTTTRQIDPPDSGWQSGV

SEQ ID NO: 927734 - protein, 220 aa, Homo sapiens [sequence omitted]

SEQ ID NO: 927735 - protein, 281 aa, Homo sapiens
MILVWVYHTDFLAFIVLRDLWNFELERDDLGYLVEETSKWQTVQEEAEYKSLENLQPDDEVEKKNQFSGEKLKPAAEICDMSETFMAAPPITGLGALSSSAPAVAEKGQDTARAVASEGASPEPWQLPHDVEPVGAQKSRIEVWEPPPRFQRMYGNAWMSRKKFAAGAGPSWRTSVTAVQKGNVGLEPPHRVTTGALPSGAVRRGPLFSRPQNGRSTNSLHHVPGKAADTQCQLMKAARSGALSCKATGVELPMAVGAHLLYQCDLDVKQSQRRSFWNFKV

SEQ ID NO: 927736 - protein, 136 aa, Homo sapiens
MSVVPSGRAELKNLDKKQRTSIGLKQWSQTLSVLAFGFERLVFKKSGPEEVEIQGAKKLASHSFMDADRRQENPGDWNIHSFWNLREVLELISHGYQGTAVPAVLLDHNASRKEISIIQNLFNCAVEELPLNFNCK

SEQ ID NO: 927737 - protein, 132 aa, Homo sapiens [sequence omitted]

SEQ ID NO: 927738 - protein, 175 aa, Homo sapiens
MTCDQSEFSLGTDTWTPGTSCTTPRDLTRFTGNTQNPQHNCYHQVAAPGGPIGGISHGPISSAVVDWTREEHVIHRDVEQLTVAKRLLSNVHCLEVTAAALGFPGLPRWQTESDSTRLPKALPEKDARFVSPKVSRGRCRATVVPKKSPDKHSAEGASDMKVREHLTRRAWGLQE

SEQ ID NO: 927739 - protein, 160 aa, Homo sapiens
MAERGQCRAQAMATAVRSPNPWQLPCGVESAATQKSRIEAPHRVPTGALPSEGVRREPPSSRPWNVRSTNSLHHEPGKATDTQHQPVTAAGREAVPCKATGTELPKAMGTHLLNQRDLDMRPGVKGDHFGALKFDCPVGFRPDFQKFKCEDKSVPEDIEK

SEQ ID NO: 927740 - protein, 166 aa, Homo sapiens
MTFRSLSNDFSASITDISQTLSVLQAQVDSLAAVVLQNRRGLDLLTAEKGGLCIFLNEECCFYLNQSGLVYDNIKKLKDRAQKLANQASNYAEPPWALSNWMSWVLPIVSPLIPIFLLLLFGPCIFRLVSQFIQNRIQAITNHSIRQMFLLTSPQYHPLPQDLPSA

SEQ ID NO: 927741 - protein, 141 aa, Homo sapiens
MQINGKALRVHNSPFPFTINGFLTAYSTGKQGESSISSTWCWDNWVSTYKRMKLIPTSYNILHLSPRWMLLALERRPSSSSILGLGPQLADGLLWDLAIVTSKTSEFSGIFCKLSFFYSILSDYNSSNLSDLTAICLLYII

SEQ ID NO: 927742 - protein, 155 aa, Homo sapiens
MEYYAAIKNDEFMSFVVQLIGPQKELCLSYLYLNGLQRRNGYVRRNNPPSVLRTKPHSTEKKIKTCDVTKIQLDFDENIFYSIFHNLFTRYGDVKWRMNCYQNHKAIPMATNLNGNLSWILSGTRGLTLPGVLLHSAESPRSTPSYVRGHSIFHH

SEQ ID NO: 927743 - protein, 163 aa, Homo sapiens
MRTKSDHPKYQGEKERVRTSGLQKRLRGSDNQMSLSKGGKVDQASRCGKEMDSGGLDDLLARSEREEARKGLMLPTGVNNRDDIIADQDRNSDTSAGKWSHDQNRRHLHPQGASPNEKPKTKLLNWPQTEHFLTTFSKLKSQKQLAFIVPGNKRPNALLNGFL

SEQ ID NO: 927744 - protein, 154 aa, Homo sapiens
MNAIWFYRNNQQRGLGELSRQRSLGEVSRRGSLGEVSRRGGLGELLIKVNDSQVLKKKSTLSLQVERTRSSSDRGSHFTIVGKGPQAQGEHDCLLHCLCHSGAHAKEALAIWMTILMDYPHHHYHHQSTRLKPNYTCAFKPSEISWINPNNMEN

SEQ ID NO: 927745 - protein, 152 aa, Homo sapiens
MAPNASSTPSEWHHLRLNREPKIIRIILRYRSCPQGVQTHGKDNVTTYAAVKYCCSGSISPASILLMKNKMRAIISMELGRKMIQEFRTPDNPSPKTCHHRSCLSDIREQTDSRLLVISSLGTQRLFFSPLITGSPITSCISPPASLSSPLS

SEQ ID NO: 927746 - protein, 145 aa, Homo sapiens
MLADSTSQPHLLPEKWNTAIISPDFHYQVELLPSNLSRHAVRGSKPYPSLEADSTYMFTHLLPLEGVDLGMARKHSAKLTVVNVQCAICIPQECTNMDSAHLPRNLPQLEPQCQKSGELNYAHLSPVLDNLKLHGFIKRVVIVLC

SEQ ID NO: 927747 - protein, 153 aa, Homo sapiens
MGQRPICRTPRAINRQTEPCFMERLLSPGAHTLKQTGCNTSGLLENQLLIAYPGMTQPPPLSPSWHMTVPSGCFQAGERDPFIFILLVAQSSLQLKIEARVVILSDTSDVTLQLPEMKNWDSCFIQKELEIVPRVWEDAKMVAATECWDLINK

SEQ ID NO: 927748 - protein, 158 aa, Homo sapiens
MPVANLVLPCGGLTGWKQFTCVYGFIIKHTTKQRDDGRAAEGEGWWGLLCTSTCSAAWKLIKSHCSRAFIELHLQLTPAPRGQWVGTKVPTLESLGLSGDQSHPEAILGPQPQSSHKYKLRDKDQIYFLSYYRRGHGHANAMVMTYGPVHGPAHAWGL

SEQ ID NO: 927749 - protein, 160 aa, Homo sapiens
MGNRALPLLACRGCGHTLSATKQNKFPFLWTVIKATVGVLCMYKAYFQLRSSISISYNLRSSLKPTAKLAQDLAGSEFNASSTYGVYSYDFSQGFGIFSSRWGFPCYPSIGHVSVRHGQMVFRSGVLLLVLQFVVTDQRKATVLFLWKALSDTLEKRGVV

SEQ ID NO: 927750 - protein, 281 aa, Homo sapiens
MCKQDLSVLHTEEMCFLREWVESLRVKYHLLLRKLNQKKMPRKKNLIADEPSSEESDLEIDKEGVIEPDTDAPQEMGGENAEITEEMMDQANDKKVAAIEALNDGELQKAIDLFTDAIKLNPRLAVLYAKRASVFVKLQKPNAAIRDCDRAIEINPDSAQPHKWRGKAHRLLGHWEEAAHDLALACKLDYDEDASVMLKEVQLRAQKIAEHQRKGMPGMAGMPGLNEILSDPEVLATIQDPEVMVAFQDVAQNPANMSKYQSNPKVMNLISKLSAKFGGQV

SEQ ID NO: 927751 - protein, 135 aa, Homo sapiens
MFEIGEVDLPFWGLEDGGPLLTAPLGSAPVGTLCGGSSPTFLFCTALAEVLHEGSAPAANLCLDIQGRKFEESAATSYYTKCTVLLTCYSISQVKLNFSPLLLSNISDVSYNILKISKTIVTLSEMFHQYNLYRT

SEQ ID NO: 927752 - protein, 138 aa, Homo sapiens [sequence omitted]

SEQ ID NO: 927753 - protein, 140 aa, Homo sapiens
MKHGFRKESLISISSCKWTFCINTRANGLRSHVCRPSLPCSVMRTFVNAVLIQPSSGHKRRCCKGQSQGTKEANPRGGPGPIASSAYDREAMEGLPHQLLAAIWTLLRCIPQTGKHLISPNIKLLGNLLKRPSIARGKGN

SEQ ID NO: 927754 - protein, 141 aa, Homo sapiens
MKSVYYSTLEENVHEIKLKRGTLMVNIKWQLDWIEGCKVLFLGVSVTVLPKEINIRVSGLEDADPPSIWLRKMKLNEVKLALETRFICKTAATEIFSALHFFYPNSEIFINPNDPIPEAKFIREHSIFKASRHSVMPKYKV

SEQ ID NO: 927755 - protein, 148 aa, Homo sapiens
MGTQPVSIFKPEKGHCMSPSCTLNFIDASSITSLWIPFLPPSSTFKDSDGSLRWQRGPICSSHCKDASCKWGGMTRDACSMELEGAGDRWSPTPYELVGQEPHPPRCSYYCPATTVDLDISALPGAQETSASTGLEVPALAICPLPTP

SEQ ID NO: 927756 - protein, 183 aa, Homo sapiens
MYTFLSGILTFSRGGAILKTMKNSFFEYLCWPPVGRTTAASSTACGDINMFPKEENTPSCIISTSSLLPLIGHVQLVDVCTFSTAGKLLRFGFSAMFGFGGRTLALAEKYRWMSPNQRRDFAVVKALAKLKAEDCEISFLPFNSSDDVQERRAQGSPKSGTCKRILGRHCDTQWLEEACRGAH

SEQ ID NO: 927757 - protein, 144 aa, Homo sapiens
MWQKPRECPDILPAPHRCCCGWGKDSAENKSECVINKQQLPKLCGNLKANGFISMYKPQRNFILENVPEQVTPKTFVNSNLLIFDEIVEAEVMNTKVERRGTVSGLKSIDGDELSSKDEKVRVMPSTDESRKKSVFSYLLVLVV

SEQ ID NO: 927758 - protein, 126 aa, Homo sapiens
MLLIAAGAPTLLPPQRIHGTWKSEYSVLEIAQKEVAVFCCELGFSQHKAMEETFHEEVKDFRVVCLHLAFRQCGEGCQEGQKTLNNVATPYPGGFKCFTCEKAADNYECNRWAPDIYCPRDIQPSE

SEQ ID NO: 927759 - protein, 178 aa, Homo sapiens
MVDFFIIFFVKATIVLSIMHLSGIKDISKFAMHYIMEEIDEDTSTEDLLKMMVMALIYRLLVCFYEIIFIWGAGGATPGKLLVGLRVVTCDTLVLIALSRVLVIPFSNVSITTSTIRALIKNFLIASFFPAFITLLFLQHNRTAYDIVAGTIVVKRNGKKNLLNSSIKIFRSKRQMIL

SEQ ID NO: 927760 - protein, 161 aa, Homo sapiens
MTRLGFLLLLTCEDYSALSIDAYDQELTRRLGPGICLVLAVFLSKPTAVMLGSNVGSGLCPAAVWGSVLSRALGRSVVLLRPPFLPLGAFAYPPTTAVSPWMTDLGTQVGMGACTSIAHVADPLSYKQKLNERGRGQQPRVRAWRPRPGSCKCNECFQRIL

SEQ ID NO: 927761 - protein, 135 aa, Homo sapiens
MQSIVPGCICEGVAKGDSHLSQWTEKGRPSLNLGGHNLISWQHGHKKKQAEECGKTRLVESSGLRLSPVVDTSCPQTSDCKSLRAALGLLGFRPQTAGCTVGCPTFEALGLGLASLLLSLQTAYCGTSPCDCNVR

SEQ ID NO: 927762 - protein, 159 aa, Homo sapiens
MQSSTATLRIDWQFLTKLNMLLPYDVMEERLSLNGGRRGRLRRREQQEDKQGREGPKKLTSPGKLLKDESGSLDPWEGDQLDGWCGHTAIASKKHAVHGNYYDSKHLLAELKLFLSDRLLVNGKAVIAQGDWVTYFWEDVVQVHGGEDQQLKLREKYVP

SEQ ID NO: 927763 - protein, 262 aa, Homo sapiens
MVKVKARVNRFGHIGHQITRAAFNSGKVDIVAISDPFTGLNYMVYVFQCGSTHGKFHGTVKAENGKLVINGNLITIFQERDPTKIKWDNVDAEYIWVSTGVFTTTEKAGAHLQQGAKRVIISTPSADAPMFMMGVNHKKYENSLKIISNCLLKLWCDGHGALQIIIPASTGAAKAVGKVIPEMNGKITSMAFRVPTTNGILDYTEHHVVSSSFNSDTHSSTFNDGAGIALNDHFVKLISCYDNAFGYNNRAVDLMAHMASKK

SEQ ID NO: 927764 - protein, 187 aa, Homo sapiens
MLSKRVTEVDLNFDWVILAIVMRIDLRSISGHAQCSICLYSFTSPSVKCSRSVWTRDLRKERDTETKYRERKVGRGDRRSAYGGPTPAPVCIAAIDNDSSDGSGQSKLKNFWKELIILDTIKNIRDSWEEVSISILIGIWKKLIPVLLDDVEEFKTSVVEVAADVEIASLVELLEDSKFELLTMHTR

SEQ ID NO: 927765 - protein, 153 aa, Homo sapiens
MRKNQCKNAENSKIQNASSPPKDHNSLPAREQSWMENDFDKLTEVGFRRWVITNFSELKEHVLTQCKEAKNFDKRLQELLTRTTSLGKNINDLMELKNTAQELNEAYTRYYPEELPQHSKTGQHSNSENTENTTKILLEKSNPKTHNHQIHQA

SEQ ID NO: 927766 - protein, 182 aa, Homo sapiens
MGGLPLHTCGYSHQGGRETEKRNKTQRQSIEKEQWAQETGVQHTEDLHWPRSLSSLSYYYFHYLSNGNAAGEQGDSWEKVSKKTWPQGFHEKLNAVESQKGVKWGVRSDAIRPVLGKHFCCCVEVTAGSQALVERLSKRLLQHSRCQRVHCRSSSRHEKEMNFRSILLVELIEFGNRWNIQE

SEQ ID NO: 927767 - protein, 143 aa, Homo sapiens
MASNRAVTPHGPRFHSLESAGLLSDCIEVGRPNRGIMSDRREEMTMVAFLDLVGKASTYPVKVSTRTKRYFSFLNWGIKSQEIANSTPILLNSLKVNILIVITEEFDIYKPDPGTYEDAYLIASFGKVNQKLKRMQPFFLTYL

SEQ ID NO: 927768 - protein, 193 aa, Homo sapiens
MTDVFKEYQEDQRGSVHVGDSNVKGMMGPGVNPTTPEAEENLKSCLSADIQSKGHLPSGMWRQPKDGKEWGEEYVTKDHPDKLKEAGQGRHSSLENVLCETSLADGYPVVSASLIENTFCFPLLKKWLISSPLWFVSKAKRQTVALELLESERKYVINISLILKIKATFQGSDGKRNSKERRYPCTHCLCFSD

SEQ ID NO: 927769 - protein, 181 aa, Homo sapiens
MSPSPRSFSLGLAFFLPGSLDGDTLSSPLLIFTESSFSFSALSLNFSFSLAFLSLGSSSLDLSLSARGGLSLSLAVGFCLVPVMPQEPVCMPVPVLPLLLLREAGALPGLLLHGWLLERDLQEGSHPWLLPSVCAAVRGDLTDFITGVVSVLMESFFQLFKQAFFHVSTSQGLPLLGIFFI

SEQ ID NO: 927770 - protein, 127 aa, Homo sapiens
MERYSMLIDRKTQIIFFSVSVLTVSVAKFSSLQIFHCVISNLLIISYSCHFRDGSFLLYILGIGASFSIDLGQFSIYYLDNLVFKDVWKYNLSKQYNMAIPEPNKIAGYLKGNIVSQSPQLLESDLR

SEQ ID NO: 927771 - protein, 150 aa, Homo sapiens
MNSASVSVRRGVLWEPGLVQIIFGFTEQTYFPINAKETEKGKRKGDRTESKAVPLQIKQLSGLLPNQLPTKNDTCKDLGTVHDTLGAKNSTDIGKMFGAKSIDSSFQIFTQNVQYSLKPEEKETLKPIVEKLISKGHLVAFTSTHSIPIL

SEQ ID NO: 927772 - protein, 156 aa, Homo sapiens
MDNEIHAEVVSDGDKELFGNWIKGDSCYVLARSLEAFCPSPRDLWNFELERDLGHLVKEISKQQSIQEVTWVLLKAFSFKRETEHKSLKNLQPNKAIEKKIPFSEEKFKPAAEICINNVGETSSTPPSGYPESGRVKGVRKRQNKHLKGGSRGLEH

SEQ ID NO: 927773 - protein, 163 aa, Homo sapiens
MPLTMAKQTFRLAQQPITLPVWVPTRHLKLCHEPESKEEVKTSERPCTPSLSDGSDEHLCRADGNGKTPHGTPLTWGQMKRLAHIAKDNLRSQNKLLTTSNLMVAMMAVTSLAVSLPIAEADQNYPYWAYTPFPPLMRPVTWLDPLVEVYVNDSVWMPGPRDN

SEQ ID NO: 927774 - protein, 147 aa, Homo sapiens
MQYMAMGLGDGEAWKPRKKTGFPGSGPGSPCYVQPRDLVPCASATPAMAERVQHRAWPVASESASSKPWQLRCRVEPASTQNTRIGVWEPPPRFHKIHGNAWMARQKFAAEAGHSWRTSARALQKGNVGSDPPYRVPTGVPPSGADP

SEQ ID NO: 927775 - protein, 137 aa, Homo sapiens
MGGGLHVSASLLPPPRSGGLLPGWLSPAATSGHMGQLPDTRRRWKVYSVTALTQEVPGSCLPEGSRLFPPSVQRTGARHLPQLGELARNVLQPVSLLSAAGRLTRYHENSIEKTYPHDSINSYQVPPTTHGNCGRRN

SEQ ID NO: 927776 - protein, 159 aa, Homo sapiens
MIQINFGWRPEKLVPQTPFSGMVDCTNEKHLHKGWKTEEKNADENEQREKVLRQSLQETSYSKWHSSERRYSLLGDGEETEHQALPQIPTLGLSHSPRLQAGIHRASKPAPPPELISIPLALDPPLSQANPCRLRFQALSHDQVGSSGLSQHLGRGGSD

SEQ ID NO: 927777 - protein, 150 aa, Homo sapiens
MGVMLLPTWDGSIPVKDRMMNYYKYLACSVNMWHSIKSHLNLERTRNIMKLNETISVLPVFLECFIVLFSFSEKAKGFQGSVSQSIVSMEYLHQCFWVIGYTSTPEWEALGIRLGRSNPAPKDGESITSCHPTCHNSDAHTQYSHRKDNH

SEQ ID NO: 927778 - protein, 137 aa, Homo sapiens
MGLFSNTCEFVDALLLRFQDKFGAPGPVRKRHSLLTTGGSSTRETNLIAVGQSWPPWPGKEETPWAHCRKCQPAAPGTLGHGFQSQQAAGSSDEPLTSPVLSQKGKEKAMEKLQLVPDPWEQQWVEVQFPPLSEISG

SEQ ID NO: 927779 - protein, 135 aa, Homo sapiens
MSQPTLCNCQRVIPCNLESLHELMYLIFLEYVSVILYAYDLVASLQGQQGSGFFGYASGIRHCLPPKCLNSGFHKQRKRSQISEDFKISLQIPLLPADLISLISQSNTAMRGNSNLLTTSPVAVTEIEIICFLIN

SEQ ID NO: 927780 - protein, 152 aa, Homo sapiens
MSWEFCFLAIFTDCKISLPTCIKTSVVEVALSELDGEPDEGWSGKVVFPWSLAAQQLDSPPTAPGQIPLDICIILPSMACQCLLEVASERLKLDGEVGVDPEEQGWRELAPLLGMPLGHVSLKPWACQSYTGSNRRAGSILHCQQRSELPYK

SEQ ID NO: 927781 - protein, 139 aa, Homo sapiens
MDRRVSGSPLVAVCSFGRQQPWSTMQYLSIQRRHVLTSKVPQTFHFARTCLKGNFANTHLVESVRENGQMYLSDGRARGHGGKWKTEPEIVRWVNHRMYSIAKKRSSHYSFQSVSQGGGSPKYPQFIVSWTTEAACRHD

SEQ ID NO: 927782 - protein, 175 aa, Homo sapiens; identical to SEQ ID NO: 880872

SEQ ID NO: 927783 - protein, 154 aa, Homo sapiens
MPSSHGPEQPRKKQRSSRNGDNGYEGRTLGGGALSVRACVLCEETRCSLQSQQTGKVKSAEAWPTAAPSPRCSVPGRWEFIYKPLTEAAAFLSEMSSPERRNPEGQSGYSGFVTLQWVPPVSESECQALQDLFDGHGIEKQEHDSQIGFSASEG

SEQ ID NO: 927784 - protein, 191 aa, Homo sapiens
MGNKQAYPLLQRETSLLYLGEPAVLGVQRCSWIAGHNTPQTKPFTSQSSRDSGQAIWLGLWAGLLLASSSGPIDLVYQGRQSLHEGRPEASNHRSQTKSYFLETNLALKQALNPCLQGTESTEPRLELGKSRTCVCGGWPSDRGHRGWPSIRALCSDGPKGLGRVWDLTGPYPATVSVSLELGSASAGLKL

SEQ ID NO: 927785 - protein, 194 aa, Homo sapiens
MSQKKTEIALGVLTQVRGMNLPTVAYLSKEIDAVAKGWPHCLWVVAAVAVLVSEAVKIIHGRDLTVWTSHDVNGILTAKGDLWLSDDRLLKHQALLLEGPVLQLRAFATLNPATFLPDNEEKIEHNCQQVIAQTYPARGDLLEVPLTDSDLNLYTDGKDNRDKSTNWTSFGKGSSLKLSLGYIKNKNSCVIPKK

SEQ ID NO: 927786 - protein, 267 aa, Homo sapiens
MASKIETKVHLHLQAPWKWNPSAGIWFRQALYPGYTGLLLCGAGPVSISAVVPRGSEEQERADPSSFLQILDLLLIAQEKFKTAAEIWVNNEEPNVNSQYNGENVSRACQRDLASCFQATPAMAKKGQGTAWAVASEGGSPRPWQLTRGIEPVGTQKSRTEVWEPPPRFQKMYGNTWITRQKFAAGVEPSWRTSAMAVRKGNGNRRIQPPDGFRQKQKYWSGITTSSQLVSCQRPENRYQEFNTDQTHQKGALHRWRSDLYILLYPD

SEQ ID NO: 927787 - protein, 146 aa, Homo sapiens
MGKTRCENQMQRLFRASLTWGLRGPDDNKAFLGPLDSATPVSLTIVRCLQTLTTSISGPRDLRLVILFSTAAFPRGENQKSRRKCRSRRKATLCFLQTLHLLSDTQEFLEGEENPGKSKKQEDKRQRRREPHPLGQAGAPDERAPA

SEQ ID NO: 927788 - protein, 162 aa, Homo sapiens
MNRKDIHTKTPSVRHHHQGPKLKEEFQTHRKEAKNLEKRLDEWLTRITNVEKSLKDLMELKTMARELHDKCTSFSSRFDQLEERVSVTEDQMNEMKQEEKFREKREKRKKQNFQEIWDYVKRPNLRLIGVPESDGENGTKLENTLQDIIQENFPNLARQANI

SEQ ID NO: 927789 - protein, 158 aa, Homo sapiens
MGSCAARASLTSTTPCSTVPSPIDHPRAEECERMAQDWQAAPPAAPVWDPLGEASWAPESGGECGVFISSSGIVNTPISTLCLAQGLDCNYTNQHPVFSSRFVSAPINTPYLAALLKVCKHTNQHPVFSSRFVSAPIDTLYLAAMVGPWRTCVWKLCI

SEQ ID NO: 927790 - protein, 145 aa, Homo sapiens
MKHPDTSIKLLLLLPATQSCWRPPAFLGPCSLPPLSKPAKVASANMTSASIITCSSMTLTFLPLSYKEPYDYFGPTQIIQDNLPISKSLIYSRPQSPFYQKESFLGGGAFASLVTWDECQMPQQSLEILPRCYDSLHICSKKVFR

SEQ ID NO: 927791 - protein, 135 aa, Homo sapiens
MSFWLQHHQFTMEILDLQGLPCHFSYTPGNLLSQQDTGAFGIEICYSDPSSYIRTLWSENGVTAGGWNPCLIFEDWSLTVVSDCLIGMQISYLNFAPGEMLAKRHAHKCATSVYHCHDNTRNNTQELPPLSMAMT

SEQ ID NO: 927792 - protein, 135 aa, Homo sapiens
MAAQPAEGHVQQFLLICPLPPKSEVEGSSRIKSISFMIGKYFKSRAVSTTQPYPSGDWKDCPSRSAPGKVLNQAPRNTQASTLNDVDGNRVVMINRSKREIGERKYEESRKEKSKNYRELKRWLGNLFFSMGQCA

SEQ ID NO: 927793 - protein, 187 aa, Homo sapiens
MQGKGYNVRLRLSNEAPGCHVVAEGRAEIRIRAYKSCVVCGFAFILNFFLGRSTKASSVLRPGKVNVHPGDPVTTTGPQKGRAGRACGGHSIHPPHSQNRTGWAVQANSSIPFWFYQESLGGEWRAAEGKEGGDQKEEEEEQEEEVEVKEEESGRLTEIFALPGTLLLPLDLTEPSQVLCTECLYPA

SEQ ID NO: 927794 - protein, 137 aa, Homo sapiens
MPSSAEALSPGPVTCGHRSKVGFMHYQSHRYATDMLFCVCHSHTIVVLCLELVPACGFTVSLTSRMEPQTFVVSVTALKDGTDPKSSIIMNGSNMANTSPSVKSKEDQGLSGHDEKENPFAEYMWMENEEDFNRQKL

SEQ ID NO: 927795 - protein, 157 aa, Homo sapiens
MFVITDLLKPTSDNSSNSFSIQFCSLVGKESDPSAADLLEFAGGPLQTLFAWVSPAEAAEQQILLPDPSSGSSCQTGTFKSAEVVCCLLLYYALPPEVESIEAVGLAEVWWAPPSLCFLASLFTMLISDCCASSEQAPWVWNPLNQACEGISWFDGC

SEQ ID NO: 927796 - protein, 316 aa, Homo sapiens
MWPQHGLRYLVAAVLSRWALVETWAEVDRSPMSMEKALKHLEAYNTEKEGAFASRVGWAFLTMLWKVHAQSLRDTAQVSRQLAQGKGDHILTEWLMAAMWTGWNDARELSKTVSKWQSYAELVEDTRDQRPHVELAIHWYPTNVQQVLVLVGTDADYSLVYGKRDKFLGKAAYTDGYRGQSVKMTVDYQELNKVTAPLHAAVLSITDLMDHLTMELGQYHYAVDLANASLSDDIAPESQEQFGFTWEGRQWTFTVLPQGYVHSPTICHGLVATDLATWKFPKGIRLFHYIDDIMLTSDSPADLEAVVPLLQQHLAA

SEQ ID NO: 927797 - protein, 426 aa, Homo sapiens
MALKGQEDYIYLFKDSTHPVDFLDAFRTFYLDGLFTDITLQCPSGIIFHCHRAVLAACSNYFKAMFTADMKEKFKNKIKLSGIHHDILEGLVNYAYTSQIEITKRNVQSLLEAADLLQFLSVKKACERFLVRHLDIDNCIGMHSFAEFHVCPELEKESRRILCSKFKEVWQQEEFLEISLEKFLFILSRKNLSVWKEEAIIEPVIKWTAHDVENRIECLYNLLSYINIDIDPVYLKTALGLQRSCLLTENKIRSLIYNALNPMHKEISQRSTATMYIIGGYYWHPLSEVHIWDPLTNVWIQGAEIPDYTRESYGVTCLGPNIYVTGGYRTDNIEALDTVWIYNSESDEWTEGLPMLNARYYHCAVTLGGCVYALGGYRKGAPAEEAEFYDPLKEKWIPIANMIKEQCLTQSKHAINVTHDCPECRY

SEQ ID NO: 927798 - protein, 171 aa, Homo sapiens [sequence omitted]

SEQ ID NO: 927799 - protein, 169 aa, Homo sapiens
MPLESSTPLKIWAERGLINTVVPIFSPRKQEKLEEIGAKESHEGKWVLPDKREMLSKPLITGTTPTVSSTPTSTWGPYPHQKLERRKTRTSLGRALPSVSNHQGHSSNSRKRMDSSHPGQKSTTPSRIIDSYPSANSNQEQSFSAEVGPMLYEILKSKDGLPQLVLAVS

SEQ ID NO: 927800 - protein, 151 aa, Homo sapiens
MTDVYIKRQNLEVDVHTWRVQCEYQDAIYLPKREAWNSAFPHSPRKKPSLHLAASAAVTTAAPESPCRGFETSEKTCHLESPAEGGEGVFAKIQQQSPVCRSLQSQRLHSVLRDRDLAKLCSFPRGEGFLHTPLLQDPISVILIFLKLLPL

SEQ ID NO: 927801 - protein, 161 aa, Homo sapiens
MSHASIFYGFLLRLFAGALQIRLTEDGVTGEKQIFQLIILCRVQGGILVMRPTEEIRSHYCRKGLCKRALNLAGNLFGALRMGRFPVSLLREQLSSVIYCKDTSTFPVSILLPGCSNDYWLFQACKHKNTREGRRCICLRNIIVWSNCFVIFLQKYDNMNK

SEQ ID NO: 927802 - protein, 140 aa, Homo sapiens
MSPETLESLQGEPESTARTITYHVAVKGRAGTRTQKASKQCVKHRRQRPLMQMQIDIFHQGLTVHQQIIKKLDIHFFSDEVHLEVKDLICGFEFYLFPVRAQKKNYCITKVLYHVNRFHTHTTVKYCQAAIMKQSPFSSR

SEQ ID NO: 927803 - protein, 151 aa, Homo sapiens
MFSCFSFVSRTFGFACGSHFRMTALKPLSYNFYILLVSLLAFVDLPFLVQVVIFLAFVIPRGCLLGNSELFNTLGFYQLPGQSEGYIYSETRSYVVNTTRWAEFTNRAFLMDKFGLNVDEQKPEHVAFIVPSLRFVPMAIIYAWDILTYIE

SEQ ID NO: 927804 - protein, 303 aa, Homo sapiens
MRQFLGIYQKANKLKPDKLSGFPRPFITIPVWFTSHSVACAYFKLNPETHPLHLVAARTQACELHSVDHGTQGRHSHKRMVTGRAMGESTLQRMESRNSQLLGTVGAILEQGLIPWVVGVGGSLHVQEWWKNSRGTFQAVNLKTVPDAWEVFALCPCESFPSYVSPRLASQRKQGPDGREDSHDDNSHRRGGLRTDVLMNELRFLSCIPQSGEGTTVANNSLGSPKGLLNSKGPTGHVTVQGSRSEGGSLHTEIQADAGSFLYHPGGYFTLWGSAAQENFLQLWKVYIHAVQYNSHSSQMTLE

SEQ ID NO: 927805 - protein, 157 aa, Homo sapiens
MKLPEEQSDSNIRCSAIFPVLQPLLLIPRQTASGVDLQQTPTDLQLRVLTVKRKTNKQKGHPHQNPISTKQSWTENDFDELREEGFRQLNFSKLKEVRTHRKQVKNLEKRLDEWLTRTTNAEKSLKDLMELKTMAQELCDECKSFVADSINWKKGYH

SEQ ID NO: 927806 - protein, 163 aa, Homo sapiens
MTHFQVIDTYQRTQEDWTEGPAAGKGKAPDIEPHTVVVEKPGEERGAPQRLTKRREGVWPMVVGRSQSLSWPQDATFNHAGCLALRPPSEAQPKDLQTLSEHFSFPGICWDTLSLMWACRGPLRRFQPVEVHLGPYSCGESRATWTDSLDWSKQPGVGSTFFR

SEQ ID NO: 927807 - protein, 147 aa, Homo sapiens
MHWFALILLEPCNAVQLWSLSYGTGVIRVEKGTEEGGQGAGQVIDMKVEGKDGKCNPEASRDLEKAVCPDGRDLTGMTKWHRHAAASPVVRKTLGEGEASDTSSPGTCEDEVEREGCFSSHGKTWVGAHSAINLLCDLWTSASTAVK

SEQ ID NO: 927808 - protein, 138 aa, Homo sapiens
MEDAPPPALLLPCSWISDCCASREQSSVGVGPSKPGMGYNVLGYLFFSDAFTPEAVRIMMSYFWSFSFRSLLYGHCCELPTPRPVMLRKTLKESDSEELEITQETPNLVPFGDVSRGHDTPLRATGEVSEWSGGRGQE

SEQ ID NO: 927809 - protein, 136 aa, Homo sapiens
MGRKITEPSMFMNLAPPPERTDPVTRLVRFIDDMLIGLGEQEVATTLDLLIRHFCVREWEINMTKIQGPSTSVKFLGVHGMGGDILYTVKDGLLHLASPTTKKRYNTWRNNHSWASLDFGGNLFLLWVCYSGPFTG

SEQ ID NO: 927810 - protein, 165 aa, Homo sapiens
MCPYIDFYASDGKVTSFSRVRCGHTAVQLAWNPICQGQPVGMFLGPEMWGHSCFAGLVMCLLGAAHRAISQVWDAGAKLLRGMATGGVWNHKLELGLQQIQEELEKMKKEYRNLNTWIDKANYLESILMPKLEHKDSEETNIDEASENTKSNHPEEELENIVGVG

SEQ ID NO: 927811 - protein, 139 aa, Homo sapiens
MPSFSGTRGTLKYPDNHKPGIPVEFRDKAVLGTIHRRVLAGVGGLYWGNRGQKWKSNFGYGLCCNLTFSGGRPHLAATAVMQDSVTRAPCGKPNPRKAVLDGKFVMHARPWNLNSQQFVTFSAIGAWNVFSCYHINHFG

SEQ ID NO: 927812 - protein, 147 aa, Homo sapiens
MLTLRSTTGKCYYSLSSGNPKLVVVSFHLLCQEWLSKTTLSVPKIGYPHSYGTFPVRAAESVSPFCLLVKDNSSIFKISLKHNNRALAQALSREKENSRRITTEKMLLQKEVEKLNFENTFLRLKLNNLDGDPNMSSTDIVGRGCAL

SEQ ID NO: 927813 - protein, 160 aa, Homo sapiens
MSVLPAAERNNPLQGFLSGESLILDGTTCLQRGATHCRSPLSCRTLNKAPLHLLHPLLVCVPHSSWMQDKNLGKGTTSHRGFQPENRHPKDAITQVLMPLCGLLTLSLGHSLKTPGTRAKGIASRIRLLQLQLELSSSAIGSLPVPRSHVTMTQSWKLIA

SEQ ID NO: 927814 - protein, 359 aa, Homo sapiens
MDYTQSLFKSVEGVKGRGAAIPCLACQHNDQYLVVAVAFDEQASKWYFSSLSEHTIYFDLDYILLPFKKMDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAEKATTSLITEGNTERRQAYLPPQNPGKIQQLEVQSVDL

SEQ ID NO: 927815 - protein, 163 aa, Homo sapiens
MLLQAPDLQSAHPLKDQVEPIAWASQARVCRPVSSSEPSVPSSYRSHQLAVLPVSPRASGSPQTTVSVQGLEGSEPSLDPNPEERLLLTVKKALPLLLPSGAYSVIGKICPKPSGANTKENVEDGELGFLFPATVTRPALQNLPALCRICTGLSFVTLKVTIS

SEQ ID NO: 927816 - protein, 135 aa, Homo sapiens
MTMAALWNRKGGKGSDKVPGPPLRSLEDSALLTGGILAIHSILARAEASGWSVSYPLASGLQTPLKCPSICPSPSPTEGRTALGYTQMQLAVCHAREIPKLEDLGTRSSSGIYWQCGLKEVTLTLEISAPSAAKG

SEQ ID NO: 927817 - protein, 138 aa, Homo sapiens
MRHQSWPTGSQNVEFRFQVAISMAEDLLKKKLNPVPNFRGQQENATERPGRRATIPGMSFPGTNLPWKRPKRGNKVASPQGLSVLISYAGKEGPSGGRMGLAEHIHTYERKLCHSVGRTKWVWEAKLVIVAAIRMHKK

SEQ ID NO: 927818 - protein, 160 aa, Homo sapiens
MAEERIAVGGVMDVNTALQEVLKTALIHNGLACGICKAAKALDKRQAHLCVLASNCDEPMDVKLVEALCAEHQIDLIKVDDNKKLGEWGGYAEATTRVQLLLTTLEDISLKVLKENENLLREGPAGVSPKEKQIGSVEGFQPEFSCEHLTTFQRPLTYLD

SEQ ID NO: 927819 - protein, 167 aa, Homo sapiens
MLSLTPPPIPQQAPVCDVPLPVSMCSHCSIPTYDSEQFDRLKTSSLNLSKSFSIQLCSNAGPSAAGLLEFAGGPLQTLFAWVKAAEAAEQQILVNSKCCCLIVPLDVLSQRSTRPCEVSICPYWGVPPSLATQGSGTHLRRQSVRSQISSCVLGESLLSSKLSDRDI

SEQ ID NO: 927820 - protein, 191 aa, Homo sapiens
MSSSGIVNTPISTLCLAQAVTLTAKICSLTPEASQSTSPPEGRNSEHIRTSEGTNSRRSTLRAVTLTARVHGFILEVIRERDVKTKAGTTVNQKLDDATGFENGERGMRKAHRQLLMDSSLEPPGGMKLCQYLDFGPMRHISDFSPSELQDDKHVLFKATKSVSCKRAENVGSSSEHQEFCVETDTLRTGI

SEQ ID NO: 927821 - protein, 167 aa, Homo sapiens
MTLLLPLVAQAQGDLNSISETGWSYWRSCRETPPTEKGWVRVRPEEALSPQTATAGVFWALTNKIQYSVCEEKEIKDIQINKEEVKLLLFTNDMIVYLENPKDSSRKLLDLINEFSEVSGYMINVHKSVALLYTNDDQAENQIKNSTPFTIAAKNKIKYLEIYLPRR

SEQ ID NO: 927822 - protein, 163 aa, Homo sapiens
MSVRSACVEGDPSGLLLLAQVASFYSLIWPRYILLIGPFYRVLIGSFLQSADWCVYKPLARHRVLIGAFLQSADWCIYNPLARHKSSASPHSTQEVQLASPLNLPSKQDTPTVVGNWAMTALATSCWILDGLDPRGNKFDKEFKNTGPKASNSKMAVTGPRKG

SEQ ID NO: 927823 - protein, 156 aa, Homo sapiens
MCPEFIASSGFLVSLTSRMKPQTLTVVRPELFVPPDGFMVALTSGVKLQNFAVSVTAHKGEETNNQKDEASSKCYTICEKVVFNPHPPSKLHTKAGPGIYCSSLCIHAYSMFSSHLEVITYSIWFAALVLICLGIMTSSSIHVSAKDMISFFLMAA

SEQ ID NO: 927824 - protein, 154 aa, Homo sapiens
MVSSFIHVPSGGGIALGDIPHVNDELMDAAHQHGTYMLKASLFKALVGREERGTMTIPYVANHSTSSELIYNGLKISKDGKTAGKIAGDAKEKTAPKKKQHKHNSYGSPPHFHLLFDLPPPPPCCSLELPAFPTTVFQLKPMWRKKSVTRFWVR

SEQ ID NO: 927825 - protein, 210 aa, Homo sapiens
MRCNRQPFSRELPCSVTCALLWPVLGCGDGCWDDHILSHSPAQCLAHGRCPVSTGKLMTAGLSPSPACLPPAQESLEEDGELSPEKGTVGWGHSSDQGVSPTSMWRQPEACFAREHPTPFREGLANDGKAGKGGVTQTVSEEAVLRVKMGSKENPGQVRSAGLNPVTSIYPGTPQGQPLLSPLMGKDRTADMPANHGSICPFPFHQVMKE

SEQ ID NO: 927826 - protein, 147 aa, Homo sapiens
MKGWPAPPHLWVLLVRWNERLRKERDTETKYRERKVGPGDRCSAYGGPTLALVSEFPQYLLIIISITISEKGMWQDNRVIMGRRDEQETDAFLLSQLQRGVPLLLILLSTDPLRVSGWGMIRSFPSHEAISQAITWGEILDTHPAQP

SEQ ID NO: 927827 - protein, 152 aa, Homo sapiens
MTSSNELNKVPGTNAGETDISDLSDREFKIAVLRKLKEIPNNTEEEFRIPAYKFNKEIEIIRKNQAEILELKNAIGIMKNASKSFNSRMDQTQEIITELEDRPFENTCLKGANLIVIAHKVEVEKEIGVESLFKGIITENFPNLEKDTYIQV

SEQ ID NO: 927828 - protein, 156 aa, Homo sapiens
MREPAHGSTPRFVWDPIQASQVEPPHLNPNLQDPNSWNPSEQPQMLGTFMCMEPIPWPALCRHVPSQKPDPQMDQSLCISILSLAAMSLFSICAISSRPGLGSAIADHGVLILPAKAEPVGFSFPITAHWDQETQSWERMVLSCMKSRPGEWVPDP

SEQ ID NO: 927829 - protein, 183 aa, Homo sapiens
MALGETGLGTQSKYHPYHNSLIPGRDIGLFREAGRELWSALNLFSMDTVSEEKEEAKPTPGCQTSGWVMMEPFSTISNIGKDQICPLFFPFTLCALRGLSLWTISTGPLMLWLLAGFGQAAAPAGDQRVGGGRDEATYPWLPLCQAAGKQRPQALLLHSGRQELSSLNGSPVWLMPRRIAVPC

SEQ ID NO: 927830 - protein, 191 aa, Homo sapiens
MSKNSLRPHQKPSRCWHHASYNIACITMRQLDLFSLYIIQPQANPGAHHSQMFIEPGSVQTQRTQQGTNQTKSLTAENSHDCHGKQLLAVVCSVWQSHWITAADQTVIGGAAGRIHRQLAAGGLHSPHHNLALVEGGDIKECCKGHHHWPWPKEPALEKGRISSWEDGAPLAPQQSTPGFQRKQENDVLSL

SEQ ID NO: 927831 - protein, 154 aa, Homo sapiens
MNECAGPHAYTDLLQNEQKQVAKELTDLAPSPRSETRFGPLSHLVTAEALPQGAIGPGAVPRERQCSNGTYYHKYQKQIKATAWRACIIISDVKEGIRISLTHEAIITKNVANGRQKSNMAQDPCPQCSCPESPCTLWVLAGPPLLLINRIWQN

SEQ ID NO: 927832 - protein, 147 aa, Homo sapiens
MVSLNEQYASIYHFPLSTVFFVSSPPQQSAWLPTAVRVVVAGSLSLGHVQVHYGPVAGGSMAADSGCSCRLGSLSRLPANPSELTALLLSPSMPVVFSVTSLLNSSVLSQMLYSKCDCLLVILIFHGGGKCQMLPVGYLEGPPQTLC

SEQ ID NO: 927833 - protein, 205 aa, Homo sapiens
MLYSKPCAFSDPELTRLEFLAPCRFLHSPFPSSPLPRDSLRTPTPSNSSVPCRTSHPSPSTAPSYSPAPPPSSPFKTHQSPRTLSTAILRSVRQPQYSHSKGGLRKGGVSCLVHQAVFGCGNEPGGRKMRKQEGSREASGKEEGGPPGCIRENLPSVERRSSRILGPASLVCVCVRCKLSEARNHIEVRSLLYPPHSAQCMTHND

SEQ ID NO: 927834 - protein, 157 aa, Homo sapiens
MAHVFSFHPPPHNSFPKVQLTAPLRMEDNQMALVDEEKVFSAEKFWLINAEGIIEFEKYYFVSSNEISGAEAITVGVHGKGLLKKVVKGPLDWDGPTGLPGIFWQCKRIHVEEEDSIETWVGDVEEEDSIETWGFLEIGQTVFLVTSCFNLLLLPLS

SEQ ID NO: 927835 - protein, 142 aa, Homo sapiens
MTWGFPVHTSALPAGAQPLLEKFNASKADWWNAEDVGFEVTMSQQEVYSTEKDESTTEGKKSRENGTCCIGMKDNLQKKSGRLSQCKKPALCNENISVNFINRDMRAHFPGLVATSTHAALKPTWLTLLGEDGYVHTLKTFF

SEQ ID NO: 927836 - protein, 142 aa, Homo sapiens
MRGWDPEPMWKAWVWQEERHFLNCKGAGSTGEKEGGGGDGRWTREQYGGLERCGSSQLMTCLYVLALLDQEKVGLSTGLSHDVAADVPWGKGGEFKSRRDGVSCYLNAVRGKRECQQEYRSSSSSKPTMIQVSLQDPEESIP

SEQ ID NO: 927837 - protein, 167 aa, Homo sapiens
MAAVQSSFGSASEGDRGKRGRGRPLFPSLSLAHACTHTHTHTDIHIYMHSLNQYPSKVHTWNIVDLSLKSNTTISPTVSVSLSFLLSLSHTHSHSLNQYPSEVHTWNMIDFTPKSLFSLWFPSPPLFYLHIRLQPVCPVVSYILNFGDCILVVVFSCFYFPEFSINW

SEQ ID NO: 927838 - protein, 153 aa, Homo sapiens
MLSIDILENIKDLKEVIACEQQYDSSYDARCDVWSLGITAIELGDGDPPLFDMHPVKTLFKIPRAATANDHKLGGLKQQTFILSQFWRSEAPHQRVSRATLPLKTLSKNPSLPLPASGGSSFSLACGSMIPISGFVFTWPPFPRLWVFFSGLI

SEQ ID NO: 927839 - protein, 171 aa, Homo sapiens
MAPQVFGQTGFRILEDMEHEGPPISRKASGYGFSEIYPYNQFGVLKIPYSLMDLLSKMVVGQPHFVRCIKPNDDREALQFSRERVLAQLRSTGILETVSIRRQGYSHRILFEEFVKRSDRPWVFRLEGGTIAGEPSSSTEYFPVFCSYHFPMVYKHWKPFYIYLIDLTWVP

SEQ ID NO: 927840 - protein, 200 aa, Homo sapiens [sequence omitted]

SEQ ID NO: 927841 - protein, 177 aa, Homo sapiens
MLCVTVEWDSTNHTSLPYDSPLDSQQGMLEENYKARGRRGTCFFRFASCSYHGHHSNRSSFWQQCLISAVAVVPVCRVPILPELASAIPSETSISRTNNAQMTVSSRTNNQNGHLLNKISPAGLTIMIKENRQKAQLPKNFHTRSKSDFATFETIVLASQYINLGSSSRITPVSESP

SEQ ID NO: 927842 - protein, 169 aa, Homo sapiens
MGKGDPKKPRGKMSSYAFFVQTCREECKKKHPDASVNFSEFSKKCSERWKAMSAKDKGKFEDMAKVDKDRYEREMKTYIPPKGETKKKDHLPGKGLTDQSSPGPLPEATAFGGVQRITVNKKRGKMKMQHRHEANNGFYLVIQSSSSKAAPDNLCLQCPQDSHQSSGRL

SEQ ID NO: 927843 - protein, 182 aa, Homo sapiens
MLSLTPPPTPQQAPVCDVPLPVSWCSHCSIPTYEFVKDQSGPSAAGLLEFVGGPLQTLFAWVSPAEGVDQRILLNSKYCCLIVFLEVSSQRDCCASNERGSVGMGPSEPGAGYNLLVCCLLRPLEKHSIRVGVTRFSRCHLSQLCLAVKGNSLTPCASWMRQCLALLWLTLSALHPPSDKPL

SEQ ID NO: 927844 - protein, 184 aa, Homo sapiens
MLLDSGHLGPDPAAPPRRPGLVHSRSLRPAGKPAPHLPHWALRPLVLPRRLRVSQPPKGVSAAPNGSPGGEICLHIRLKGVPFGEGAQAHPPRFRTGSEMERKRGTRALLPKNGKRPTATPRPRPGALRGRPGDPAAAGGARLSQAPGATWWPVARTVVPAREAPLARIPLHVGGGKTGVPEQR

SEQ ID NO: 927845 - protein, 128 aa, Homo sapiens
MLYLFLYFMLCMWIPAPCPSHDFVIQSRVHNLSYNLPSLNMKFLFIVEYTTLFFYWYIIKSLLIDNAKLRKLLGVDAKMQGRLLEMGGLMEETMKDSKGRNLMILAFLHHPRNRVENELEEDKTRDSS

SEQ ID NO: 927846 - protein, 121 aa, Homo sapiens
MEAVLGELPASPCSKEDEKSGAVNNRLVTLGRHHFLVACNQGFSEETLSNDWSVGYEVGIMTDEAGDASRSWIMGGLRCFAEKLGLGPEGDRSHQKLSKDLNPPNNNNDNNNNNSNTSYIC

SEQ ID NO: 927847 - protein, 155 aa, Homo sapiens
MSKITNHCCFKLPSFGLNCYAATGNYNRYMYLKSGAIIIESYNVDIGFGTTQPNSHKENVSENLKGLEKIVNEGIQENLGNIIEILKSRGSLPCSGRKFSNTVACSNMENRKDPFLEQIPMGHRGDVQRSTQNPPPSCWIREQADFCVRSEERRL

SEQ ID NO: 927848 - protein, 119 aa, Homo sapiens
MACQNAILFVPSFPSYLTKDISISVFCANMETSSSIPLTHMHHFVVNKTLSMSPGATNSLEEGGAHLQHLTPGSPVQGGDLLTGKFGCLISPNLTLTFDSQCWQWGPVGGVWVLRVDPL

SEQ ID NO: 927849 - protein, 141 aa, Homo sapiens
MIGDIKFQSRREHVFACNRLKCLPNCSVMFSGRDFTDLTSGSDCHTDRPGIPPVLSNAVGYNCSSFDSENGLQLIAAMVVQLCDYSNHGIICCNPTATCGCGKSSTMHRAVLGCQALYGSRLSYLSIPATPPCGVQATLSM

SEQ ID NO: 927850 - protein, 142 aa, Homo sapiens
MSPPASVIQGTHGFSHHTWTPVDIGAHVGGKENLQQPRPFGLEATFWLRSTLLSSQWDNEQKFAINLMRVGFSKDELCAANSLLSSPVYGWLNKQWCDLSPPLSSRADEGFPGEGQRRILPGGPCKQNHILSVGDSLGGRGL

SEQ ID NO: 927851 - protein, 221 aa, Homo sapiens
MAALANNSVESRQVSPYHQAMGLHGIQQCDAGSSHSPWLVRQKIHKNKALALERSSFQFRVNSTLGTSRRVTFKLRKEKKKLLHISQGKPHTNVNSTRVPPSSTDFLWETYTEPRKPPRRLHVVWLSWETIAEPLFYRSADTIQCLELCGISCPSELSQPSREWCSASGARDREQGQTSLQSASSGQVKVIEFLSPVTNSITPGSRPDLPQVLRILKPDLS

SEQ ID NO: 927852 - protein, 177 aa, Homo sapiens
MWPLWWQGLGLRVMSPAHGRWHTTFSALVPIMCGSCSLCCLLTAPVMPAMWGSLLSLAHGDRGQTYTIYLLCHVFCALRGAPYCSLSQTHCILGSGSLSECLGRSSGRSFSLDMAALLICPLHLCHSPSQPLVVSSSQTASTHLLLTGGVGLSLSFLLKLPLSAVCSPSSQRFLLVL

SEQ ID NO: 927853 - protein, 144 aa, Homo sapiens
MCPSGLGVRGSGAQDSAAALACDLSPILGPTSSSCSGHSPSAPHLRSAFPVQNENNGPLFQKLHSIKPSAGSSEHGAVCDFLGHISVRLALPPGHSEALEGPRCSGKIKELYAELDKPQSILSFVCYWLFDLGQVKKVPLFPPL

SEQ ID NO: 927854 - protein, 137 aa, Homo sapiens
MQRPFPATYLQIRQHQHISSQSAFIIRLLCTRYWPMCLGIERLLRGSLPECIKFSGNRQSRAFYNPREPWQASVGMSQKAPSKEITARGEESGRCQSQDSPVSWPRWLDLSLQVMDGYGWAFSRNVTCSNLTVRNFL

SEQ ID NO: 927855 - protein, 140 aa, Homo sapiens
MGSLIFELLQAKAFPDLHTLSPPSQPKVLLLRNLQSAVHRHALLSREGSGEKSASRFIQVVGRFCSVRLEDRHPGSLLAVSQGSFLATRGQPSRIPWSVPSIFEARNGMLNSSCALNLSDPSFCHQLEKVLCFKGLRGLG

SEQ ID NO: 927856 - protein, 134 aa, Homo sapiens
MTSQGTSSRRTAPATKPMEVGVDGKGTHDASPALRQRQVSCQDTQDSGESEIQGSSAAVQVGHMQVKLIYCRTAFLSLRGAAPHELKRKVNEKNIGLGLSPSQGHGFSSDLFVSTMSYQASNLTFLGLCFLLCK

SEQ ID NO: 927857 - protein, 151 aa, Homo sapiens
MVPTLLSFWGGLGEPLLMVEGEMGACSSYGKSQKQEHGQGVVCHTLLNDQISQELREPLKGEKPSARRSWRMRGHLDIPAPAKLPAECSRMSDLSHPTWSRSSSQWSSINRRTMTSNKSHSYCALRWLTTQQSIAELCVNKLLSSLHRVLT

SEQ ID NO: 927858 - protein, 190 aa, Homo sapiens
MPLREQRYTGIDEDGHVVERRVFRYQPFTSADLLDWKNNTPSYTEKPQALIDLLQTVIQTHNPTWADCHQLLMFLFNRDERQSVLQAATKWLEEHAPADYQNPQEYGRTQLPGTDRQWDPHEREDIQRLHGDREALLEGLRRGAQKATNISKVSEVIQGKEESPAQFYERLCEAYGMYTPFDPDSPEIST

SEQ ID NO: 927859 - protein, 229 aa, Homo sapiens
MNPLPGQGGIAGETLLKQETNKKEQVLPPQDSQSSVTHKPSTLTGNHTDSSSGGVGCPTACPWCLLATISGSWHHALLKWMLSASTQQRCEEGNGETMSGLDLAHPSCSNIWTLCDKCRRNSLKPAQSPVLPGVTAEHSPGKGWSSNAPWGGWGSMLSPKMEFCPFNKDLEQKRSMQHPATTEGDHRAEQQLKLSSCFSVASLPTSATDKGFIHQDPGFMRRSYVSVCF

SEQ ID NO: 927860 - protein, 142 aa, Homo sapiens
MYLVTVLRNLLSILAVSSDSQLHTPMYFFLSNLCWADIGFTSPMVPKMIMDMQSHSRVISHAGCLTRMSFLVLFACIEDMLLTVMAYDCFVAICRPLHYPVIMNPHLCVFFYKIVPSILRMSSSDGKYKAFATCGSHLAVVC

SEQ ID NO: 927861 - protein, 146 aa, Homo sapiens
MDPELQPVLALLSLSLSMSMYLVTVLRNLLSILAVSSDSQLHTPMYFFLSNLCWADIGFTSPMVPKMIMDMQSHSRVISHAGCLTRMSFLVLFACIEDMLLTVMAYDCFVAICRPLHYPVIMNPHLCVFFVLVSFFLSLLDSQLHS

SEQ ID NO: 927862 - protein, 140 aa, Homo sapiens
MQMHKIGIGGCPLVPRGWGRRTGWGMGGCVESWGRGEPIPSPASAASTTGVTYQLVSAQVSTYWAPPHARHSALVGRYTPPCGPPRALHWGLTLEPALVSVLQPLRYEMSTTFSISQIEASGEVGRVGPWSPRRTCQLDA

SEQ ID NO: 927863 - protein, 154 aa, Homo sapiens
MWLGQTQTLRTFRDTVPRQPSEVLRTYVPTPLNARNHALGSGWTGETRHAPSPRGGCRQQGKPLGKLGTAVHHWDHELHPALGGRFGGSVLGREEGKDIQAEGAPGQRLEGAEFVHSLTERHLDSLQVLEIRNKAAKNIHVQFFVWMYIFNPFG

SEQ ID NO: 927864 - protein, 195 aa, Homo sapiens
MEQFFSLLGGKDEGLCAPAWSPLQLILTVSPPSPSGLNQSKATFGFNRKNLELVISSFRIGSRKLGEWAQACILRGKMVEFNWYMAYGNTQLVRKERLKAAAAKFHRLGGLKQQTFILPQCRQLEPAVKVLAGFVPFGGSERDLSHASLQDSGGCQRFPAFLGLCLLHCNLWLYLQMAMVRVCVYVCLSVCILSL

SEQ ID NO: 927865 - protein, 465 aa, Homo sapiens
MQLHDLLALCFCPWSSAETNKKTVHAKYCSRFVHAPWKDGSLVHVNITKEKCKWYSERIHTALARIRRRIKWLQDGSQSLFGRLHNDCIYILIDTSHSMKSKLDLVKDKIIQFIQEQLKYKSKFNFVKFDGQAVAWREQLAEVNEDNLEQAQSWIRDIKGLAGTQPVSVATPSSGLAMGHSGSNPIYQEIWAQTSPLLKTGTTTGCIVVVIDAVVDIQGQKVLDSGAPIESPVGPETLSRIMNIIGEPIDESGPIKMKQFAPIYVEAPEFMEISVEQEILVASIKVVALTGLTVAEYFRDQEVQDVLLFIDNIFHFTHAGSRVSALLGRIPSAVGYQPTLATDMVGMMWGKNCHYQEEIYHLCTGYVPADDSTASATSFAHLDATTVLPHAVTELGIYLHVDPLDSISHIMDPNIVGNEHNDAAEVITGHMGKSVLLKETIKGFQQILIGEHDHLSERAFSDGTH

SEQ ID NO: 927866 - protein, 149 aa, Homo sapiens
MGTRSPPAQQLSFLRSGLLNILYLHMPDCPVSLLQWLFQSGERWEPLLPPKVCVSGCCLCPHVAFLRDLVYPVDLRSNLSVNRSKPLNKCFLCNKANFFTSGHRSLIPYAAGGPFRAHGNPAVPAPNPPPKAQKEQWKAETANSVAYGD

SEQ ID NO: 927867 - protein, 200 aa, Homo sapiens
MRVHRTKLEAWYQPTELENERSQLNPPYTTIKLPRASKKIKAKNNLSKGQQLRRLKEHNPTQMRKNQCKNSNDSKSQSAFLTPNNHANFPAMVFNQDEMVGMTEIEFRIWTGTKSIYVQEKVETQSKEAKEYNKMIQVMKNEMVILRKNQTDIIELKSSLQKFHNTGGAQQHKDGQQLEKDRPPNGFSMFGYKVGLLAGT

SEQ ID NO: 927868 - protein, 151 aa, Homo sapiens
MGLPESQTVVIVFALLSLSIQQSYQALGWYWGVLSKDSCDLICPQAFWPWITASAPVELWSYREEANLPEGLLVKYSGFAGSGQGHRAAKRLYPLSSATRAGRKRPLGEVELFKALGAHPLYRCALDMEHRVRRLFWSFKIWSLPCWVFYL

SEQ ID NO: 927869 - protein, 213 aa, Homo sapiens [sequence omitted]

SEQ ID NO: 927870 - protein, 141 aa, Homo sapiens [sequence omitted]

SEQ ID NO: 927871 - protein, 150 aa, Homo sapiens
MLSPLNNSRQSGPRVAGLLEFAGGLFQTLFAWITSGGCKTVKFAAYSFLWKLRPRGAPARCQQEMSFIYKPPTGAAPFLSEMPCQERRNLERQSGYSSFAVLQRALPSPNFLAALFILFVLEIQHPGGVVTRGNLLVCKLGRPWEKRQFT

SEQ ID NO: 927872 - protein, 154 aa, Homo sapiens
MDSTEWTRMAVTTVTLYDHWLTVKDLEVLKDGKDPVLAAFIKCQLKSPSALNNQQQYPDLGGSEQRKELFVWEKLREENKYLSGNPENSPRYCPRLSRQYFYKSARITLLLGLRCPLRQIQFRSQHLSPFEYLQSLLNKDGHKQAQRVKTTVTI

SEQ ID NO: 927873 - protein, 140 aa, Homo sapiens
MPIIKDRRKEPWERLAGNEALRSDWPHFTGKTALLCPGQTVNKGQCRLEECGKPQKLLRTRKESWCSATLCRVPSFLSLQPKVCTLPPSTLNALLLKICSEWASLLEGLVSQWRKLFLAASSQPSWLSRRMLLGVESGYS

SEQ ID NO: 927874 - protein, 138 aa, Homo sapiens
MEKDHEYPGMMDLEGETVRFSELERLELSFLVEPEGEQLHAEESYRGCRAEEETLMTVITFPQTFTWKFESWEVNVIPEDVNFTYRHTLSASYPIHIAKHRRSTEECKIRSLCSGSVKDMHTHIKPKYKAVGTEEHGR

SEQ ID NO: 927875 - protein, 159 aa, Homo sapiens
MTWHYWAAHYNSKVISVFMFLPQHGDSRVTALGSGCGQGLLAGLLGTPPQRDAVFPLSPPPTTTKHSGTWSKKQKRQEPSNSLQRPATPGQAEKPRAQSLSRALQPHRSPSSPAHSQAHCSLMHNSPDTCLPCTLFLLKANDLKYVLPHEYLDEHSINI

SEQ ID NO: 927876 - protein, 131 aa, Homo sapiens
MLCCPGWTQTPGLSLWYSGTWITGVSHHASRTFTFTASTAAEEERPKEATAVVPARGDDNGLVVGGGSGRGEKWTRSACVLRDQPPLLDCRFLQGTWSLLQSVRSGSECLGPEAGKYFPSMRALLEGTVGV

SEQ ID NO: 927877 - protein, 135 aa, Homo sapiens
MLTHPPLTSCCETWFLTGHRPVPVHGPGIGKPCWERRRRRRKKKKEEEERRRKKKKEEEERRRKKKKKKKKRRRRRRRRRRRRRRRRRRKEEEEEEQEEQEEEEEEEEKTLTSFSYGSAGIFESQQLQLYSTTGE

SEQ ID NO: 927878 - protein, 190 aa, Homo sapiens [sequence omitted]

SEQ ID NO: 927879 - protein, 137 aa, Homo sapiens
MNVAKNSSQRCRRKPGAYCATEIQRRESYEKEREIDNARDLWLPLFYSLLLWEKLIILALILRQSYRIDLASTLKYSLERAHGILHLTLRVKYASVKWGVMIPTFEIRYGFIGNNIGPFCKNYWLLLKAGTFFPHRQ

SEQ ID NO: 927880 - protein, 288 aa, Homo sapiens
MNNKVKAEVVSDGDEELIGNWSKGHSCYALANRLVAFCPCPGDLWNFELERDDLGYPAEEISKQQSIQEVTSLFMKADLHSNSSHHQPRRLGKKNGFMGWAQSHTAMCSLGTRCPVSQPLQLQPWLTEANVQLMPLLQILQASSRGGFHVALGLWVHRRVEVWETLPGFQRMYENVWMFRQKKFAAGTGPAWRTSSRAMQRGNVGLELPHRVPTGTLPSGAARRGPPLSRSQNGGSTNNLHCKPGKAKGTQSLPMKAATGEQPWGLYPADLSCPRPGEPTSSISMPWI

SEQ ID NO: 927881 - protein, 151 aa, Homo sapiens
MRDKRRRQTQSNGNNQLNSERGKFYRRKKTRCLQQVVGMGERRGEEKCKAVVPCSALKVWAPLPLKCWMQILAWHSWAAHHSRGASSGFMVPPKREGSRGRDLGSGNGRGPEGLSLVSQGCTPAQHKAVINQNNQSEVGRLCCGPKLDSPA

SEQ ID NO: 927882 - protein, 152 aa, Homo sapiens [sequence omitted]

SEQ ID NO: 927883 - protein, 147 aa, Homo sapiens
MLGPKYLKLENLILKLKSLKRWPKVRTYIPGFPLECYLFLNHPGPCPTPSSAYKDPRFSQQRGEAAGHWGLRLDVVDFRGTAQRQPLSSAIKSPTFTILQFVSVTSFFLDAGQELGNHECGHKRLSHWLFSCSGKGQPPHAKRERAR

SEQ ID NO: 927884 - protein, 215 aa, Homo sapiens
MLSSITLGFKDTAQYLLMFCVATESTIQKRPLSVPQDCMLWYEGLQSFTIHSTDVFVSVARCWRHYVEQNRCGPGVPVWRRHSQEKRPVQFNVMCAAIGQIQRIRGAQREASDPALGSQERLLQESGDPSETCKMSRHSPEETRSVFKVEQRGKQSMFLKHHGPGVWWSHGRRIEWALFKQMLAHIGFENLRKECRLYLKGNNFVISPRCCGGVV

SEQ ID NO: 927885 - protein, 140 aa, Homo sapiens
MNHLFRCLVDSLWCVTSARLPPCLGLCCTTCLKCSFPLLSQPNFIYLSRSSTCTVFGTCPIVVPYWKTDGLNIARRHEDTKPVVLKLEWPKTSLGDLVKGFPGISPQRCCFSSGFPSLPTLESPGEHYKNLQARTTPPVN

SEQ ID NO: 927886 - protein, 154 aa, Homo sapiens
MRAERLCFCWSPSLASSLPVTGHSGDFKPWRLKPVLVFQHLMKALNQIMKYIGKSASTAGGSSESCPCGSVAVLLADALIYPKNCECPKCERGIFCPQTYTLTGKPEGPDPRSQEKDLTLPGAEMNLESQVKYRGRSSSEKSPVGTFILQGCHF

SEQ ID NO: 927887 - protein, 134 aa, Homo sapiens
MALGSLASGPQGLCLTSLITSEAQPPTSQNGCHLCTNNAGACPVNLSPVPGGFPSLLQQASLALWVSFHVASVLLPGISGSKENTDLHFSPLKHFENTRSSREVTFGDFHSKCLIRLFLKKTKTKQALFNALIF

SEQ ID NO: 927888 - protein, 149 aa, Homo sapiens
MPAEICKKFAEGVKKFAEGVRPSWRTSARAVQKGNVGSELPHRVPTWAPPSGTVRKGPPSSRLQNGRSTDSLHHIPGKPTDNQHQPMKAAGRDAVPCKATGAELPKTMETHLLHQHDLDERHGFKGDHFETLRFDCPAGFQTCMGPVAP

SEQ ID NO: 927889 - protein, 150 aa, Homo sapiens
MAKRDQCTTQAVASEGASPWWLPQGVGPVGAQKSRTEIWEPSPRFQRIYGNIWMSREKFAAGVEPSWRTSVRAVWKGNVGSEPQHRAPTGALPRRACACLSPFAQLLKFYRKATDHQLRVFSVYWEAVFSWRQLQPIILERQFNNNLTIT

SEQ ID NO: 927890 - protein, 127 aa, Homo sapiens
MAFIGRILVQNRDGHDQQTGWIAGGPSRETLTVGDERSSHCRLNESSETFTPGEFGQALKDIKKSAKGTESRRESVKNKETWRVRKAQRPKVEEWGQEKTIRGKQVAGSDSGDINVELAVDTAGSGP

SEQ ID NO: 927891 - protein, 149 aa, Homo sapiens
MDVTSRSIIRNVKGPVGFFNVKGRWVRPHGRWEWCKEYPAGGYSSPSGFAAMHPGRTTGKGPSTHTQIDQQPPRLLIVHIALPSWADICTNLCEALQNFFSLACSLMGPSRMSLFSLYMVQDQHECILPFVNHSEEKDFQRFYASPSLR

SEQ ID NO: 927892 - protein, 160 aa, Homo sapiens
MQRAGWWELHPSRTTSPHPTPILDRFCNCLACLSDTVPVYGLRPYGTSGFHFLLWESGLSEPKCHTARKLQQPQRHMWEGVRVPGNQNKDRVVGFLTLSQCFFHSILLELSGSLAGPEIQKLGLELGTVVTYSVLYSAVAELIRKPQDKVLPPLPYHFPM

SEQ ID NO: 927893 - protein, 150 aa, Homo sapiens
MLSTGRQKFSVALVLVQYVGICRDEEPGGQLVTDKFHIDWDSVLIDMDNVIVARFDGRGSGFQGLKILQEIHRRLGSVEVKDQITAVKFLLKLPYIDSKRLSIFGKVYPDEGHNVSEKSKYHLYSTILKFFSDCLKEEISVLPQEPEEDE

SEQ ID NO: 927894 - protein, 128 aa, Homo sapiens
MVPDNRNSCCTSYHFYHLTILFTSAEHSVAVACILRVATVLYKLAYLLTILKCEKVPRWKNHTPHLSHCYPDASELPFLLTTGIAIRVLGCPPASSTLSNCCSSNPSTWIRAPTYGRRLPRSAQLGRP

SEQ ID NO: 927895 - protein, 137 aa, Homo sapiens
MKLELKNYRGDLHVSISFCLVLRKPVVPITSLQNHVSGESFPKGYLSLPSRRGQRSHGKGKLYLEAHRELSNQVKSTAQTADMAGSSCQNQPVVNDKWIRVSRRLDVMKKKAYHGNVLDLELGVIARYDYVIFLERV

SEQ ID NO: 927896 - protein, 170 aa, Homo sapiens
MSNGNPQSWRWRLVGDDQMTGEISHEWFHTIPFGAISTGTSLSWKGRSTLLLLPTWPRLSSQEGRPHHPWAVLNVQALHLASDDTTQGGEEGMPHYCRVSRKGSPCSLPGLYRHLGDGWVRRGLGPCNCPVELKVPALLGSSLLSPVTLLVWGFRHFDGAWKEWKYRFSM

SEQ ID NO: 927897 - protein, 213 aa, Homo sapiens
MKTAIYKPRREAWNRSALTASEETPASTLTVFFASRTRLLKEDYPWVWQFKRCCEQWKELRMMVKTTDKTLRVTEGWEYGLACLGAEHLFLTSWLTTNWVRDFQHCLHVRTTWEALEILGARAAPPNQLGQNLCGRDPRSSICNPNSSYHPGFGTFLPGVEARGGGKSREYEAVAEVTDAKPGEPHKEINGSNTQAEERRLNRSWGETSENKT

SEQ ID NO: 927898 - protein, 173 aa, Homo sapiens
MLTLGLWLRCIYFVYDLQWRKIFDDEPTIIRRAFYSLGNYIVASEIAKESAKSPVIVDRYWHSTATYAIATEVSGGLQHLPPAHHPVYQWPEDLLKPDLILLLTVSPEERLQRLQGRGMEKTREEAELEANSVVEMSYQRMENPGCHVVDASPSREKVLQTVLSLIQNSFSEP

SEQ ID NO: 927899 - protein, 423 aa, Homo sapiens [sequence omitted]

SEQ ID NO: 927900 - protein, 141 aa, Homo sapiens
MEKRCDLRPSHPLSPLGGLGQALLNANTRQQGPNNLLGPEHDAGSLTGFVQNLHSTGEGRKANKPSEINLKVEFCATLKNRQWSCDCLGRNGKTSQKRGKLPLKEIRVKAEAGRQAGQCREFQITGWFPPGPRVQPCWRGR

SEQ ID NO: 927901 - protein, 153 aa, Homo sapiens
MITWSEHQREAEHHQLKLDHLTAPSPWAAGLPRLPPVGQCGFGKGEIWDAEREWDNRRQGLQGFAEGGPLAKPRDVKVTFKDVGVICAEGPCVEPAAADANSLSLALSLGLPFPLGPYPASLLPPHCAFTQDCGEGYASGLRIHCRCSSQTEP

SEQ ID NO: 927902 - protein, 162 aa, Homo sapiens
MTGCLKPTPIKSRLCNRVSESLRLPRSAGCSHSVTLILNRKGKGSSICPKAFNRADTIGGTEFVILPGLEMNPKQKSSSISKLRRKLLGLLKCLVSKHLRWRVTPPGHIFFCLYWLYRTRSTQGAASVGHCLLVAMFLGKGIFFSWDSCHYSHLVATLSVYC

SEQ ID NO: 927903 - protein, 149 aa, Homo sapiens
MSLGPTLKTLKPLRMVVLENGRYLDLRMTVSKVTCLPIHTGLSMSKKEMLVVDMDETGSHRSQQTNTGTENQTLHVRTHKWELNNENTWTQGGEHHTLEPVVGLMYQWWGLYLMSGDWVKEGSPQPYIPHHVELQESRNAGLLHLQGVP

SEQ ID NO: 927904 - protein, 147 aa, Homo sapiens
MGSNPLHTACVTFVSLDPHLIKYVIAPWKDIKMHQTPCQRLPEFETYISKAVTSPVLQISYREQYLPYKTGSVTDFSSYFLNYNTKNRPLDNNAYIKPRDYISDKVQMHLETIWNSRANEVLRFCDAKQSSHRCSYLLVEKQNSHSF

SEQ ID NO: 927905 - protein, 147 aa, Homo sapiens
MESRAGGEDDPVQEVSRQDSAFYACLRSRELGLYHEGEGKQLKVCKQRISNLENCSKDKWEQKEQWSRIPLTESPQKIKILTEAWLTWKGSQAFPLLCHLGFPHYEDSHSTISYPQECFLPFLTSSLIIACPVASFLGTHSANGQGI

SEQ ID NO: 927906 - protein, 155 aa, Homo sapiens
MSLHLAALRWSPCAPGPPPAAAGVHWSSYGFTHSKSKRPDMARKSPFYAPIRNTCSAPSRLSSPLLFHFVIVLLYFSLSRAFYAAICAHLELEFRPNSKAHASSIFLHSNTWKITVGRWTEKMLPAFIMEHPGGSWRVERTSTPGPGMRVLTYLS

SEQ ID NO: 927907 - protein, 154 aa, Homo sapiens
MLDDKAMTDTHLYLIELFAVCASFVKTFSSFFPKCFIPFSVLTIPSLFGPSFGSFVTALLYLLAFLGVQYFLLDLSLDRKDSIELCMYTVVTECQVLLRLLHTFKHGLAEWSNTVLLTYSVLRAHSTNALTLHMQADAPGSEAMNAGSHREQQG

SEQ ID NO: 927908 - protein, 134 aa, Homo sapiens
MPSADMSFSGWLFYKKLPYHTQCPQYNSSSPNWFLQAACSTFKEIMQRSPLHKRGPGILGVLNSRSWAEKCKRKPTFWGQLVSAGSTLAFDQDRGSVMSPQPCGRPWVSSVLQHHLGLDPTFRDSASSTTKGGY

SEQ ID NO: 927909 - protein, 144 aa, Homo sapiens
MVASLMFSDPGFLASRMPRNGILVHAMSVTALLEAVGHGREPWNPEQWQAFSAIGSGNGRLAGSGEQRTPCWIRRDGSQRGSAVVANSSGGRIPSHRSASGLGTHKSAQDYFGSCEKGRNELTINFVSLYQQQFRCRALELEAL

SEQ ID NO: 927910 - protein, 213 aa, Homo sapiens
MEACCRVEYLMWGRESWGPGKASGVMRSESEGLTARGTDGVNPVLRAGEAFYSIQTFKGLDEANSRWKGQSILTESADSDANLIWKHPQIYSETVFHLGTPWPTPIDPHKGLGYSSGFLATREFSIIGDHQARQEDASLREGDVNGIEWELAPEQFDNSHQKESYGKTNPRCGENTGNEAPSPTVFQKLNSANNYVSLDTILPQLSLQMRSQS

SEQ ID NO: 927911 - protein, 149 aa, Homo sapiens
MSNEIEFIMKSLSQPRKAQDWMASPPNSTKLTPILLKLFQKIEEEGILPSSFYEASITLIPKPDKDVTTTTTKLQTNIPGEYDAKTINTIPANQIQQHIKKITYHDHVGLIPEIQRWVNICKSINVIYHINRMKATNHMIISIDAPKNG

SEQ ID NO: 927912 - protein, 153 aa, Homo sapiens
MDGLSPPSAQSQGSALKGVLWPWVPGPGPQTPEQGIGSCRLAIGGQRALEVPIENLSTGHPERGLSGECVNPAYYTRISLHHRVRKRGTEHLYDSTRGKEEGRKGIQEGTSRVCAVIRNSVYVSLRCTLGKAAHDFDGWGLLRGAEIGATSGH

SEQ ID NO: 927913 - protein, 183 aa, Homo sapiens
MSEKNKDPWLNPPFPTFPKKKWAIPVGSISTQPTHTIASCPRLLPTPLILPPDSASRLLLHMDSLCAVSSIPANSMPKKYAIRACFHFNVSVGSFYWSQSSRLLMPIRKSPITSAQISLVLFYNELLLHSLLLNFPLPALHYFIVLTKSLAVTFKFCRFPAMPQYWALAEANLDSNPKSSMKS

SEQ ID NO: 927914 - protein, 139 aa, Homo sapiens
MGKKQSRKTGNSKNESTSPPPTERSSSSTTEQSWTENDFHELREEGFRRSNYSEITNAEKSLKDLMELKTMAQELRDECTSLSNRCNQLEERISAMEHEMSEMKCEEKFTEKRIKKKRTKPPRNMGLCEKTKSTSNWCT

SEQ ID NO: 927915 - protein, 174 aa, Homo sapiens
MQVRYSPLGLVGRASPVANPGLSKAWARVSPAGGLQLISDQEKSCVSNTQFYYIQHVLSNHHESQCILTSQKEKGAGKMHVGGFYRPGLEVVHTTSSHISLARTQLRDHKREMDLTVCSVGGGNGEAQEPRILVLASHTTPQVVQKSIHTEDNGENIHPLLVADALAPNHKVDL

SEQ ID NO: 927916 - protein, 161 aa, Homo sapiens
MTTQKPYLKVTNIKDQREQNWMENEFDEFTEVGFRRWVITNSSELKEHFLTQCKEAKKLDKRLQEWLTIIPSLEKNINDLMELKNTARELREAYTSINSRIDQEEERIAEIEDQSNEIKCEDKIREKRMKRNKQSLQEIWDYVKRPNLHLTVRTKTMYQNL

SEQ ID NO: 927917 - protein, 140 aa, Homo sapiens
MGLPYSLFYVQLTLLGSTLLTFHFCAKASNVLPQPLIQIPFPSPECSGFTHLAPDDLSAFHPTEYHVFCSRHPSSKSSDPFPFPCLERRFKSLTNVWSSKEFLSRHNANPSSSVKHSRIAGHTIVDSLNLYSSNPVVSLG

SEQ ID NO: 927918 - protein, 145 aa, Homo sapiens
MKHISQNSLYASSDKCLAFRGPTHLLLTDMFLGSLPRPATVHIRMFPWVNAKVLPGGEKKLFKHVKVFPIQEEKINNEKENWIRAEVPQLELAKHCLQVQGSALQNATRTSSFRLFSVSSKMSYRVNLPAVLSESFQKQLLFSKN

SEQ ID NO: 927919 - protein, 155 aa, Homo sapiens
MLSRPVSVRRFLAEGLKSLAKHWPSNGISEIHQNIKMLFEKYPEHSWKKRALQRDSESSRDPQKIALTSLAEYRSVHTCKDITQYVEKNRRNDVQSSPKDRNHLCFHQPEWNNLVTHMEYSNEYFLNNKFKLTETKACPLCLDMPNKALREASKE

SEQ ID NO: 927920 - protein, 124 aa, Homo sapiens
MTKKKLLFHFMERATETQNHRQEVIKPGVESRAICLQSMCSFRCSPWPPGILPSSRSHADVVGGGDEMLWMLGKEKSISGCGESRDAPILEDQLKCYARQDSFSDPPTALELLRKHPSFPGLTL

SEQ ID NO: 927921 - protein, 186 aa, Homo sapiens
MPSSVLSPAHEFPVMTSESHHLDLITDENIRLCLQKNVRQKETAQYMLAVLFSCSSLYHHHHHHHHHHHHHHHRHHHHLHLELSSNGANSSQSSRLHVSRRMLNPNGTGDIAEVSSLASLNQVSKFVSMVEFGTLDPPTFSPSWLQVCTSISHQDHQTKGSAKTCIFLVLNRRVCDYFIAESPASI

SEQ ID NO: 927922 - protein, 139 aa, Homo sapiens
MQVVHLPPLGRKVLLRSLVLGLSTENIHLPHLGKTLLKTIAFHTLLATARNSSNFLVLRVFSRKMLSKGHFPFHPNLSHTWPLSCSTPPPSADLDTPREKVTPHWEAVLEQFQLQVIPESTAHSAYNCSSNMLSTFLSL

SEQ ID NO: 927923 - protein, 199 aa, Homo sapiens
MFSMKTGKGVPAAWWGMLNADWLLVMEKGGECSQCAAQRISRLTGRMLPPCGKGPQRVWGEVLRQWTLVCGADHHNYGLQREKEKKADCRALGMDEKELAESGLTWLHDCIYDNGGKTAAERAQIGRASERGPQRQTGGSGAEVSSQHSCIETQGWMLGSRLLGSWPYTGTLSQAPGSVWINLQCCYGCTRQQTQPKTA

SEQ ID NO: 927924 - protein, 137 aa, Homo sapiens
MSHMYHHFPGPTGPFRKAIPAYTENCPCLTLKPGRKMLTEELLCVRRCCRSKGYNDDQGRCSPYLQVVESGYRLEAGSCKMCDKCCAGSAHGIRRAGKGGWGRERTTWRKRHLSRVRKAEEESAGEREGNHDMPPQL

SEQ ID NO: 927925 - protein, 255 aa, Homo sapiens [sequence omitted]

SEQ ID NO: 927926 - protein, 139 aa, Homo sapiens
MERYLPDTPGSLKYRDAYDPQKATPTTCPLPSLQSKCQRSGHLKVYETETAKCKGVPRETPNGLRTGRGAHWGGASGSWCCLQPEGAWPLLFLGFRLNVGFSLRGGKHTSRKLMLVLCLMCSLKNHEPIKPLFLYIIQS

SEQ ID NO: 927927 - protein, 140 aa, Homo sapiens
MGAHFTGRETKAQIQGAAFMCASTRLSPQAPGAHGQQWGLWGSPCPALPTLPQAHRLPLGMWLPTCEAVSSSLRSELCRAGSSGCRNHSRRPGRSKDPPQESAEGAHFCPHLDFGLVASRTLTSSTFLFIFPFLIQTHAH

SEQ ID NO: 927928 - protein, 147 aa, Homo sapiens
MEVKKSNSRREWQQDFIIGFCIREFENCFIEWARIKAQQKWVEEEKRSCNSWCGQLIGGGCCKEEWRIGKEARGVEGYSYCEIHTILGLRLALLSPQLADSLLWDLVIVPLLKMLQWLSMALKVKYKVYKRKSDLQSPSGSDPRSLV

SEQ ID NO: 927929 - protein, 168 aa, Homo sapiens
MGEKFARFIHRLKNYPHNNIEIKPIYNPTMASKRSSEERVTHLPLQIKSYKGLSLAIAAIDSDSSDGSGQSTLKTWKGFTIPDAIKSIHDSREEITFSTLTEVWKKFILIFMDDFEGSKASVKEVTADMVEIVRELELEVDPEDGKRKSCGTAKGGNSTRNEDEMPLR

SEQ ID NO: 927930 - protein, 137 aa, Homo sapiens
MPISLMNIDAKIFNKMLANQVQQHFKKIIHHDQVVFIPGMQGWFNIHKSINVIPCINCMKDKNNTIISIDVKNAFDKTQYFFTIKKLSKLGIEGTYLNVIKSIYDRPTASIILNGEKLKETKFKANNGYTYLGAAYT

SEQ ID NO: 927931 - protein, 160 aa, Homo sapiens
MTREPIYAWWVALLGLKLAFLCLAPGPPEPSGEDPALNISQKRWEQLVAEGTCIIFSVAPLEFLKKKRLKGSNLVMLWVEGVQVLGSLNKGLDKMHKQSKEGMKQQKQKFIENESTLHRDKNLPHKIISHTKLFSFLLNLCYQKYIFTSVTLFTSLSPIY

SEQ ID NO: 927932 - protein, 232 aa, Homo sapiens
MPVTKLGRLVKDMKIKSLEEIYLFSLPIKESEIIDFFLGDSLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLIAKSRDGQIPAIKWHSICI

SEQ ID NO: 927933 - protein, 150 aa, Homo sapiens
MGLGAVEQGAVLVGEAGATQEPTEVGEAQAWRAAGPEPCPAGRQLRPSEKLSTAAAGAGPAEPTSTRNSRWPASTARSPGSPPRLSLHTSPQAEGASSSLGQPRKGLPQCSGGLKGSSSAAKVGAQAEEARRASEGCEDCQHAVTSQREE

SEQ ID NO: 927934 - protein, 175 aa, Homo sapiens
MYASSYPPPPQLSPRSHLCPPPPHPTPPQLNNLLLLEGRKSSLPSVAPTGSASAAEDSDLLTQPWYSGNCDRYAVESALLHLQKDGAYTVRPSSGPHGSQPFTLAVLLRGRVFNIPIRRLDGGRHYALGREGRNREELFSSVAAMVQHFMWHPLPLVDRHSGSRELTCLLFPTKP

SEQ ID NO: 927935 - protein, 141 aa, Homo sapiens
MTAWILLPVSLSAFSITGIWTVYAMAVMNHHVCPVENWSYNESCPPDPAEQGGPKTCCTLDDVPLISKCGSYPPESCLFSLIGNMGAFMVALICLLRYGQLLEQSRHSWVNTTALITGCTNAAGLLVVGNFQVLPLLPCKP

SEQ ID NO: 927936 - protein, 158 aa, Homo sapiens
MSFPQKFEAGLAGWQCPAAILGLLPRSMAKGKGEGRDAGQGMTYSGPTEYRIWTCFSAFMLLSPEHSGILIQAVDNFMEFLKAFVTDTRCQPHRHDQTCPPPNTTVYFKQQGRGRALYPTLWPSAGADTPLPLPLNGQNTLPIAAPNCRGDWEMQPWF

SEQ ID NO: 927937 - protein, 176 aa, Homo sapiens
MVNSVGDVFNEGHRVSSALYHPKVELLKVTHLVRDKVKIPLGLPVANSGALAFGQRERQHVEEKEPVWKPVARLGALLYLHPAWLIIPIQSLRLLLPHGISVTFSSIWGEVGTGLRISMSGSFGIQPRCDFPRHSLASLRTKFSPARDFSHNLTSHGHPSLQLHPSLGCKGALAAG

SEQ ID NO: 927938 - protein, 221 aa, Homo sapiens
MPRKTGSGVDPQQTPADLQQRGLTVRRKTNKQKAIASTSTKRVTTEKLHPKKGVNSNSSKLKEHVLTQCKEAKNFDKGLEELLTRITSLEKNINDPMEVKNTARELHEAYQVSIAELIKQKKGYQRLKITLMKESVKIRLENKGMKRNEQSLQEIWDYVKRPNLCLIGVPDTDRENGIKLENTLQDIIQNFPNLARQGSIQIQEIQRTPQRYSSRRATQDT

SEQ ID NO: 927939 - protein, 191 aa, Homo sapiens
MSACGSCHCLNTFGGPPNHKPSIKPNHHSPAKAGYAIVSSTSIIEATALPPSTTSQQVKLIALIRVLTLVKGLLINIYADPISCTTMLLYELKVFLTTQGSSIINASLIKTLLKAALLPKTARIIHCKGHQKASDPITQDNAYAHKVAKKAASVPTSIPHGSFSPHLVTPTYSPTETSTYQSLPTQSKWRP

SEQ ID NO: 927940 - protein, 173 aa, Homo sapiens
MTVSQTFLVFDDPDNFKEYWQEAEGDWRLEIRAEGGTEEETGTKRAQQGQVSSDKTSPAGLTGGNKTKCRLKVCGVSSAAVNTGFNRITWFLHVCIKAFAVRQAPSSFQLLNGGPMVRAGWCAERAEPAERDRREQRTGKNERVILIYKQQLSLALPFKISLHNEKNKCYFAL

SEQ ID NO: 927941 - protein, 382 aa, Homo sapiens
MTTVSLQNSTPLTRTCFRKWLVTENALPLTLNDLSSFEMKEADSHNMEVQGGGASAVIEAAASYPEDLAKIIDEGVWKKLISTFMDDFERFKTSVEVTADVVEGTREIELEVEPEDGIELLQSHDKTSTNEEFLLIYEQRKWFLQLESIPGEVAENIVEMATKDLEYYQHFVDKAVAEFLLKEIILWEKCYQTALHAKEKSFVKGIIAGLLTGACGARAVTSIWHRHGWLLRYLAWRERFGDTDSQGGVPCDYRGRDWSNTAASGGMSRIASNHQKLGRKRKTPLWGPQKEHDGQYLNSGHLASRTQCKNGLIQKAFTGKFRRRVGDSSYQRYEVLFTREYNTEDINASNSTRNKTVSHVYFASPQFLISCSAWGGCSANTD

SEQ ID NO: 927942 - protein, 160 aa, Homo sapiens
MEMSLQPRSFVNIRKEDSTNLPAHSSQSHSLFQQVLNINDHFYNKGREWLFAIELPNHLSCVRFSTAARFTIFSSSFYHCENLQREENPPQALLGVNIGGNTSPKTSFALTNCHGSPLGHFVPSKPNRAMGSKLAFASVARAVVLMLLELHGRCAASGIQ

SEQ ID NO: 927943 - protein, 143 aa, Homo sapiens
MHNRHRHIKWLAESLHWLPDCATIKDLKDAEVVIPTTSPFNSPMWSVQKTDGSWRMTVDYCKLNQVVTPIAAAVPDVVSLLEQINIFPSTKYAAIDLANAYFSIPVHKAHQKQFAFSWKGQQYTFTVLPQGYTNSPALCHNII

SEQ ID NO: 927944 - protein, 141 aa, Homo sapiens
MSPNGDMLPGSCVKERIDYLKLGAWGKKAGRHIGLTESLEFRDLLAVLALNCAFTLSKILILASLQYLQGEKRYKDGLLWRTKTSIQSNNCFWYAQNLRCLRRWEALQHYAVGLKAPDEIRSFLMLNRIWAPLLNGPGSLF

SEQ ID NO: 927945 - protein, 281 aa, Homo sapiens
MRSWPWKNSAIKAFPALIKWLDPRAAVAKAWLRFVLTLRGPAATVHAYFCQGSTGSESTPETKYPLRERGADFSPPSERKRSATALITICCHLLATGPRHSMLETGVWLRVSQAPGSCTQMQTACVFSKEVTLGGSTIIPFIKPHKKVDFIKEIYFIHALISQLQTLLELHAAWCPQSSQSRPLTAYVRWCHPSAQNAAEAPHLTENESRGCVLRPPSLGCSLTSSPSSFPISRPAPACQLPGYARDHQSHSPQGLRCCSLCLQCSCTDICLHLLQTPPPQ

SEQ ID NO: 927946 - protein, 149 aa, Homo sapiens
MGTGTAHFLPFIFSVLGTNIKIKLYIVHWLNSSIVLAVDHIKTGTGNVDQSQGQKLSHRTRTGPEQDCVTTLGREYEKLAMEEFCHQSISCIDQVVGPQSCRGQGLASTQRKREIVKQDGGKSIPAPGRNNTKQLFTDCLLDDKLSAKS

SEQ ID NO: 927947 - protein, 150 aa, Homo sapiens
MKENVVLVLTFVGGSLENHPPPQQQVGVPGKGWFVGGGGGGVFGGCSPFHSKHAWEATLPKAFGQSSVNTASQVVRPAGTEPSDPGGESGMDEFWNRWALEGPDAGDGMQRFQVVTPAGRAWVRTATRAGASLLRRCLRKPSQPGAEENL

SEQ ID NO: 927948 - protein, 160 aa, Homo sapiens
MSPNKVESDGHVVPPQNLGKVLMQDFSHPLHLTHSRGAPPTWPATLALGPLWEGTREQVSKGSSQQLWALTQEQASCKAHDQTRCEDACDPEAAERVLQCSFSSTIPSVMDGGMLAAQLAPCLVAWGSCPPPARARTTVAAFSGYPYLVGPELFSSILKE

SEQ ID NO: 927949 - protein, 150 aa, Homo sapiens
MGSEPPNRVPTGAMPSEVVRRGPSPSSRPQSGRSTNSLHYDPGKTADTQCQPMKATRRGAIPCKATGAERPKGMGTHLLHHYANRSKMYLGVKFKDKLSLGKTERRKELLKDQRQAKCTGWCCLETRKPSRDLSYDESVIGNGDLPLCFP

SEQ ID NO: 927950 - protein, 167 aa, Homo sapiens
MLKQLCKWVTGRGWNSLEGSEEDRKMWESLELPRDLLNGFGQNADNDIANESWAEVVSDGDEELVGNWSKGDSCYALAKRLVTFCPCPRDLWNFELDRDDLGYVAEEISKQQSIQEVTWVLLKTFSFIREAEHKSLENLQPDNVIEKKNTFSEQKFKLAAKICISKE

SEQ ID NO: 927951 - protein, 127 aa, Homo sapiens
MSYPSNSIVTLQPELSNISWVLSDSPSHKAGCAQHYSTIIWSSGYVIEAKQALKAQVIQRSDTNAYDFPSCCYTAFSLPACVYSLIVAVSYDKLTEASLKDGKEGKSSQWAKLRTVYLVVHFTWKDK

SEQ ID NO: 927952 - protein, 143 aa, Homo sapiens
MRWSPGLHSVHNLRRTCPPCGNWQSGNCPARGVPALRPNWIPCQVQNGEIISLLPDFLPSGELVPFCTPSPISNLGLLEKECEHPHKTYGPVESYLNLGNIVARLYYKRKYFFMLRWFPTKSNAVLENVIQRAAFGNQISSLN

SEQ ID NO: 927953 - protein, 156 aa, Homo sapiens
MVSWNSPGPCYSVQPQDMAAFIIASPAPAVAERCKGTTWTITSEGASTTPWKLPCGVEPVGPPFSRPQNGRSTDSLYRAHGKATDTQCQPPMKAARKEVVSCKAQLSLPARVSVRVIRSPAAKILEVHGKNVPFLAFSAYSFTRSCWRPGSSPGAR

SEQ ID NO: 927954 - protein, 143 aa, Homo sapiens
MLSLPLPLSPQQALVYDVPPVSMCSHCSTPTYDSLERCLLTLQGNKNGILPISSHELSQFMSFGLWASWDIWLWNGRNTLADFLIIHVIYFLLSKHCDEVGAVCLWTWHVHNGHGWSGAMKPLANTMISSLSKSILRKICSKI

SEQ ID NO: 927955 - protein, 127 aa, Homo sapiens
MSISETSSAAYSLIWLLALLHLASPFSSLKRMLPNSCSSKQLDHNNHAMIHQDPRPHNILSTICLKEDSKFFSFWTLGLSPVICQGHSGLQPQTEVCTISFPTFEVLGLGLVSWLFSLQTAYCGTSP

SEQ ID NO: 927956 - protein, 144 aa, Homo sapiens
MGKCSRWWQKRLQEEQWQPWVPMCPASSVPHVRERERERERELSPLTTPRLACMAGMGSRPVVQAKSSLPGQVGGKKSVDRAKLEQRPNWPQRFLAGEMTPQGSQDNVYCSTVFKKHSVIWAYLTACDTPLRACTGNNHFMILV

SEQ ID NO: 927957 - protein, 142 aa, Homo sapiens
MSQEKELHKTMSSVKAGIGHLDVHDENALLRLNSKMAHKLAQNPWYKIQVPLSLLRVPFKEMMASGPYAKSESDSHEQSFRLQPTGQLKLIILTTVNKNGYFWEALLFSHKETQVNEHEKYGNHCLPSSRSLGPPNSSQTGF

SEQ ID NO: 927958 - protein, 134 aa, Homo sapiens
MGPLDGLHVRAGLRERYWIASSISPGQVVLQSMFPGQMVPLAWLHIEVGSQAVLCDWVGLHAVRSSWLGSQLGGASALALWAGKTTGWALQPGDVGIEDRTRRKSHKITTSNWSSEEIKIGQSISMDSQLPKVF

SEQ ID NO: 927959 - protein, 146 aa, Homo sapiens
MGKKKDCFLDLDCTPNSARLVPGETSILCCQQEQLKERSRNTGPMRAAGPRCRRRLWKVTEGSSVPQRSNPICGNCLSGFYADRINVASQFPFPTFCDTEDPGCLRKEDSLSPRLYPPVKTSRFPGKQMILIHESCLRIAETFRVL

SEQ ID NO: 927960 - protein, 134 aa, Homo sapiens
MCMRVCMRLCACTRAKATCEVTDREQIAEEAGGKYVSVKVHSHPATPPGPTSQETQFLSGHMAFTETWFATTKTCHYRGLRQLPSRDSIETQNYALQNRETSLELRELPSIDSNGQPLDVLPVFPKLNSAAVGS

SEQ ID NO: 927961 - protein, 210 aa, Homo sapiens
MEECEQSPDNIIFIHPNIEHNSMKKMQLLPVILLGWAAGVVDWPVALPPCPEITRHSSRKPASCWSSGDEAGLSSIPTTRCHVTQAEPIRESHPGESHWWKDTLSHGGDTVSPLPVQNEKLAYKELPTFRGYEDDKPLEKGAKNEQRNKIIRQCNALGEKPLDTSRNDFEAVGVGFKDKSSSSGPRKFSISSITSTPTLSFLVNSENIQQ

SEQ ID NO: 927962 - protein, 161 aa, Homo sapiens
MKPFQPRYVQFEVVPREALAEDTGDVRNEAGFKTDDNNGLGVGLRDTTLLLSWGQCVHMFQPSKERISWPEVPPWTYRIGNSGGGAKNLSSNKPSSDSNASSSLRTNVLEPCSSKYRPLEAYYMHGIPGRPSGLLNQNCSLTRSPGDGCVHLSLGSLVIFR

SEQ ID NO: 927963 - protein, 364 aa, Homo sapiens
MGQSQSGGHGPGSGKKDDKDKKKKYEPSVPTRVRKKKKKTKGPDAVSKLPLVTPHTQCRLKLLTLERIKDYLLMEEEFIRNQEQMKPLEEKQEEERSKVDDLRGTPMSVGTSEEIIDDNHAIIQGSSGNWLLGPAQPQGACRDGVLMDDTDPLVTVMKMEKTPQETYANIGGLDNQIQEIKEAVEFPLTHPEYYEEMVAEEHELSIMFTDEIGAIGTKRYDSNSGETVDLALIRPGRIDRKIKFSLPDERTKKRIFQNHTSRMTLADEVTLDDLIMVKDDLSGADIKAICTEAGLMASRERRMKVTNEFFKKYKEMFFIRNRKAPLRGSISSEPQLPSGKWLGDSSTPEKDEVGGVAQRNPCSR

SEQ ID NO: 927964 - protein, 169 aa, Homo sapiens
MQVWKYTVGSSTRIQEVKEGEMAHILRARTQGSRGPGPKIPKQSPSPSPSYSLCPLRLSPGYPESMNLEQREEENELQRSIETGPYSRGKIKVLTGWVLIRRLWEKSTSNDFQVFDKIQFLGVIGLSRKYQCKNKSKGNNENEYEGKRSSGWVMALYCLQVAHLKQNET

SEQ ID NO: 927965 - protein, 153 aa, Homo sapiens
MIETVTQVFLKVSWVPGTVPNGKVSPGQVERGYTYGNRQVSLQRSSVGAQCSLGPQSRDSQLNEACSEKCYPAQGRDFMVKLKPSVEAENEEARNESLCAENQKLLDVGAKSTEQEWSEIELERWMGPDSDESHESLDWHGLCPGWTVGIYGL

SEQ ID NO: 927966 - protein, 148 aa, Homo sapiens
MCLLMTATLKGSWKAGCLCILASWLEAPVEDRILLFCCMCGCGFGPHWTSQYWLQFSLVSEQNKLKHSLGLERNCLEELMEKYKFCLFAYLIPVLLVYLHLLALDIVERSEETPGKALSESASKWTRRRSFQHLCISPPITTLHKVSG

SEQ ID NO: 927967 - protein, 143 aa, Homo sapiens
MKEEEFSDSVHNTFDHMWRTKEQNEAGWLLLSSADKVMKENEELRDSVSRLQKQILSLKSAKIALTESLISYREKAEIVGKQTQALIMVTVQWVKGNNQTFWELLDTGSKLTLIPRDPKCPCSPPVKVGPYGGHVLNGVLAHI

SEQ ID NO: 927968 - protein, 200 aa, Homo sapiens
MGSHGRGQVRPYGFVGNSLPPGCFHGMALSVCGFSRHAVQAVSGSTVLGPPDCSNHCLLPSSNVTSTFSGIFSAAPHFWYQFSVLVNFHATDKDIPKTEKKKRFNGLTVPHGWGGITIMVGGKGQQAKRKRACAVKLLFLKPSDLMRLIHYHKNSIGKIHPHDPSISQPGPSHNSGNYGSYKMRFGWAPRARPYWQLTKW

SEQ ID NO: 927969 - protein, 135 aa, Homo sapiens
MGPWQVSPTLPFPHGWGVLRQCTIMVEGEGEARTFLTWQQEKEVQAGKMPDAYKTIRSSISESSCCSTSLLKFGVASALDFGQSKMCVVISHCCFNLHFPDDIQAEASFHMLIRHLCIFFGEVSVKVFDPFFIDT

SEQ ID NO: 927970 - protein, 145 aa, Homo sapiens
MVNFGAMLSAVRTSCSPPESLTHGVRQAYRNHKATGNIIINIQINLKECYTFIEGSEKQITQFVVTCCKRHNSRLSCFFQMVDDVANQLTLRLKKKARRMGSVVTIDEKATSIFYVNRYRKIALSGCANAHTLSCIRVPVVQYPR

SEQ ID NO: 927971 - protein, 220 aa, Homo sapiens
MPLNCMKMVKMNLSVGTLHTLSKLQAPDLIHGSPTSQLENSVWLIKEQSFRPYPLLLPAPAQKNDCMFETLKGSHRTSCQHKHTLPISKLLLSTSYSQLIAKKQSKQMSSGILMTQIRPHSEQQEHDEKWLYHLLFGPGILPTPLHPSPALHTSKVGCLGCLLSVASCLDSYSSFDLSNLIIRPTMGLPLTSHPADPLNVGIQFSLQTLTQALEISTVVH

SEQ ID NO: 927972 - protein, 146 aa, Homo sapiens
MLRLWSSGLATGEYGVAFSGSSHRGEGLCVWLKEWTLSTGQAFQGASQLQCKPTALAGRGPVPHMALHGTQEQWQVVMEPVLRAKSNHMLLTDSDGLTCPKGHRKRDDKYIPKCMESGKPGSLAHQLSRHMVWSSLEFLGLCFLIS

SEQ ID NO: 927973 - protein, 148 aa, Homo sapiens
MLMPLCGLLWWWWCCCSGWYCYGLCAPAPQMLRHQGLLKCRCRMLFNDLKVFLLRALLKRPCPCTATPSPPVWRPTTPFRLWAPGDDWGGPATEPPASLLSSASSDDFCKEKTEDRYSLGSSLDSGMRTPLCRICFQGPEQVQDYMIC

SEQ ID NO: 927974 - protein, 144 aa, Homo sapiens
MCAEGKLSFPIYEAQGIGVIKGAPFGSRGQMGLVCGLLTVRWLISPEPEAACRLMAKPISQHCLCSRQGLAMCGCVAVWLCGCVAVWPCGRAAVRLCGRAAVRLCGCAAVRLCGRVAVWLCGCVVVWLCGCVAVWLCGCVLACM

SEQ ID NO: 927975 - protein, 152 aa, Homo sapiens
MGQESAGPNACAHIQPSPLLDMLQVQALRTVGLPISVTVGWLPVGSNLFQKLSVRTRNFQTSEKAAAEGKKPLNWSVNTEMSINRMDESIVGEQGILNDGPSETAHGPRKNLAGVNKRKEGMDVRLETTDFEHLDSLRSFLGGKAKSRFWFP

SEQ ID NO: 927976 - protein, 150 aa, Homo sapiens
MLRGIDFKMQLPVNGLGEKTGEQGLVEMKYCEELMWGSQCTTRQFIGSPRFPVSRHPRAHFADGQEAMACPACSGNLPCWSLKLPTLSAFGANPGICTNLHGSGSVCLPSGALLLTARFSLQASVERKRIYPRVAGQKRRNRFRQMKCSG

SEQ ID NO: 927977 - protein, 163 aa, Homo sapiens
MQPCGKRRSVNENGAVGENGFSYEDNSISDRVLKAVAVFKTIRKTEFPEIDLQNDFVWPEMFIEQRPKGFGVEGTAFCLTLNFIDHETEFLRETDLEGEFAPSFVEFLSLQLNLPSHLPFTLTSVWFRQYVTRPPTVAAAAAAAGLRLLSRSTSPTTLLLFFP

SEQ ID NO: 927978 - protein, 140 aa, Homo sapiens
MAAKPLSTEELHFPTISREECLSAPDQTSFPGEHCGQLEKVFTFLAKQYWDHHIRNNHNLTPVMSTVNVVDVNDGASSSITTEDAGTNSPDDLHTNIPGLFVFTLLSCWHHNFVVTNIKNVTSLLNPSIQRVQIQAETDL

SEQ ID NO: 927979 - protein, 266 aa, Homo sapiens
MNTAASVFCKAFPHRLLETLSLLQEAQRLRPRGHQCHPGYRSQERRSQCSKEPPGSELYTEPLQLMEDTYHYDLPGSSSLLKFPVPWLQNEITIPTFQSTSRLLVSTLQQVVSAKVFSMTVAAGSIITCTCQQQQQCGKVHASLLQQGASRHWSDSGDPWREQVAPCQINSHVLPVTGGQEQVLVYSSPMWDFQLLSPSAQLLCLPSVHSQCLSSEDLLGACQSSRGLVPHFCQSVEQETSRYSSGFCPRKKSSYNETFSDHQNYS

SEQ ID NO: 927980 - protein, 135 aa, Homo sapiens
MCMGYSELSCSEKTLYPSTHLSCYCTSSVLEADPVKSHENREVVAPETGKGHILQKVQVTTFHSKRKGLFILLAFQPLLCKFSHTHTPTKRHNTCKKESSPLELKCLKKSYELNVLEEIPSIAVERRQLTLDFEW

SEQ ID NO: 927981 - protein, 134 aa, Homo sapiens
MIRSSHEPLKKQAECSRGGLCSSPGFVVSFLHVLEQTTYCLSASVSSSACTDDHNPGNDTTLLRKYTMQACRFEPPRAPGAVQSSKGRWEKGSSGFEGVFCSPAEERLCILCVLVHLLEDVVVMALGSFQSTIS

SEQ ID NO: 927982 - protein, 146 aa, Homo sapiens
MRTPMNLDKATVFVGNSALSTGQPSPMGSQTLPFIRILKQRPQATWPSDHSKKKPWKIPSSPPHLPEMPKKQFNAFSQQFLRPAYSRHEIDKSNSAFIWEHMRSAQLLASARRDVESLPTGISGGILTPSLLLCFQNFLKFYFVFN

SEQ ID NO: 927983 - protein, 150 aa, Homo sapiens
MAHVYLFSCILFFLAYPLAIRDESEVGWELALWQTPLLLLVLPFASSSPYSRKHWGCSAWSSSLSFLGHKLLHKGVRTGFTSMWSLNHRHSRKFLLCVPVSLEFIADLICSNTATGSSVCNSFGRFRFNQEEDESGCPFLSTPRLFHHPS

SEQ ID NO: 927984 - protein, 135 aa, Homo sapiens
MWGDLWVCGWCQGSLDGAPGQPAEGGSLDGRCSGLTAGLQGRKKCQAELAGREEERWDSDRSLKKKHSEKSLCSLRYAAGAEPASLLTPSGNPHRKPHLVASHWGRFRLALLLFVLLSPSAVNPYIMGFSCSSNL

SEQ ID NO: 927985 - protein, 126 aa, Homo sapiens
MRKVRHTEKLHKLLKIRKLSVDPGFKGRHSALLNILYASFLCDKNKDVFVSVFVLLHQVLIQETLSCLLYTGLENLLVPSILDKEYSSCVRCFGKPTQIAKFAQCSPVQLLHSWWLSGHLPPPLPC

SEQ ID NO: 927986 - protein, 166 aa, Homo sapiens
MRPYSIFVQTRRRPIPWADQPQGHTAGLMHSVFVEMIDEIFRCVTEWETVATSLAVTLSNRSSMEPQEPYLCPRCQHCPCTAGPSGGLRGSREPLSGKGPLDYSAGVKNCTPSPWPQLPPQLGCRYSVLGLLPASREHRKPTLLGSKWPFPPGLGSENEHIASVCT

SEQ ID NO: 927987 - protein, 161 aa, Homo sapiens
MGNCGNQPCSPTKTPPTTNATHPFLPSTEKGEKPRFQPWEHQTLLGRQPVLTLSNRSSMEPQEPYLCPRCQHCPCTAGPSGGLRGSREPLSGKGPLDYSAGVKNCTPSPWPQLPPQLGCRYSVLGLLPASREHRKPTLLGSKWPFPPGLGSENEHIASVCT

SEQ ID NO: 927988 - protein, 144 aa, Homo sapiens
MGQDSRAQSRLLVSSGLLSASFLSFCHSRVPSVSSCESVSSTPREPQVTFLPSFFPQKAGAHSPCAYSSFSPGHLPSWVLRRGQRTWLLLGGSPGSSGVSVLRLMIPICLSLPGSQNFDTVVRGMRASFQFWHRHFLAVYHARY

SEQ ID NO: 927989 - protein, 171 aa, Homo sapiens
MSRYPVLAEHRSFVWSSRIPLNARSADYSAPGLEEEEGELEKGARKLQGGPSQHLTAIKVQPSSATPSPSSSLSSLTCGSQVKGRCIAIPAAASASLVPGNPATSLLLLAEVPLPPGHSMSQLPSPCLHPFPISPSPVKPSVCAPPSEDLRGFQGWSNPVCPQTEGTLARL

SEQ ID NO: 927990 - protein, 157 aa, Homo sapiens [sequence omitted]

SEQ ID NO: 927991 - protein, 137 aa, Homo sapiens
MPRPRSPLHKSAGLVQQPPLTLHPLAPSTHNRSGFKKNPHLPALPGAQKMSFQPPGLLASARAHALWAHVPEGSRAPGGGALLGGRGHGSYGIQRLFQCKEHGYASVSDSPRERVKLLTLKGKPAAQLCMGAARSSS

SEQ ID NO: 927992 - protein, 187 aa, Homo sapiens
MQAVRAVGESRQSQASPSSHVIRRANLTPTMPLPTALSLFPGSGWRFPSFCGLFPAPLAALQKDPCVARQKRLAWGPSEFPGHFPLLPLPLYFAQLSKLTQFQRCTSTNVSEKKRSSPCEEWWEECSRLWKQHLERSWIRKEPRHTRKWRTDNVGRAEYTKSGIRDDAGAGGKTKPYKALKTDQGIG

SEQ ID NO: 927993 - protein, 309 aa, Homo sapiens
MRSDDYIKNGSFPEQAVFSCLPPRETCLSPFAMIVRVLQPRGTPAAEICLSIEVPNVNHEDNGENVSKTCQRPSWQPLSSQAQRFRKKRWFCGPGPGSPCCVQPRDLVPCVPATPAVTKRGQGPVQAVASEGGSPEPWLIPCGVEAVGTQKSRIEVWEALPRFQRMAVQKGNVGLEPPHRVPTGALTSAAVRRGSPSSRPQNGRSTDSLHCVQEKERALSINPDVDYTPSEDRAKYGWFLWTKCGSWVPLGSFPRKTMGSQKRGGLKDDRERRGAGDNIVRAGEEEDSHSGKRGPEAIHDFSPTVGFPA

SEQ ID NO: 927994 - protein, 213 aa, Homo sapiens
MLLIGFYSQRNLMRENMCVDVDVDVDVDVDVDVDVDVVVDVDVDVDVVVDVDVVVVVDVDVDVVVDVDVVVDVDVDVVVDVDVVVDVVVDVDVDVVVDVVVDVDVGVGVVVGVDVDVVVDVDVDVDVVVDVDVDVDVDVDVVVDVDVVVDVVVDVVVDVDVDVVVDVVVDVDVVVVVDVDVVVDVDVPCSKWCLLFSVLTTCSPHKNLERQET

SEQ ID NO: 927995 - protein, 144 aa, Homo sapiens
MYPEEGGCDTSNITTSGGTHAWTFWGFWVKMFDCDFQKSFEMTTGFASQKLLKRIVKRLNREDGDKPGAWNNRPISTRVIIFIQGEADNGRGFYPSHSLLLISLDLHQTMNENKTHRSPAENSTKEKEQYEHEQQKIPEKKEIT

SEQ ID NO: 927996 - protein, 135 aa, Homo sapiens
MPKTVRLLRTATPAWGKQLLDALQDVWTLPLWENDSSVSTNNNISSTHATDIPLFSQCFGECLLSERGTGFRWLTFCLASSALMFMSGVSVYICTIFIRLSYQCNINASSNGFRMFFFTFSALEKSVPTSTLRKI

SEQ ID NO: 927997 - protein, 165 aa, Homo sapiens
MGLPLLEFFSLEVIKLVYFENQPMQNKNLPGEETTPPVGLRQGTQFPGIGLLVSHGATPPQREVLLRSGAAPPPSPPPPPPPSPPPPPPGCLLTCLLPKYSGAPLSTELGEQLRGDPGGHVVLGTFASHMSQDASVRPLLSVLLIICKPSTNELMPTLALSYQNQ

SEQ ID NO: 927998 - protein, 161 aa, Homo sapiens
MMCFPSEILHISSTTCLSALSGNKSGPSSAGLLEFAGGPLLTLFARVSPADATEEQRLLPAPSSGSFIPEGYLPDASQSSPVWGVCQSLLDALPREENLERQPGYSALPPVDLSLLGSIGVRAAEQDHLVPWFQPPFQGSEWFCHIGIPGTNGVQGKKSCS

SEQ ID NO: 927999 - protein, 134 aa, Homo sapiens
MSKINIKSWFLDQFIIATTQIKGYSLESWTGGFLVCWKAPSRDFVQGLTGMDIDFSFQVNLTAILSGVLGTHADKKMMYVFVGERQDSRQLLLVPTKPHDCYTKMEDVIACTYTYADLKTPSKWRESLLPTEHL

SEQ ID NO: 928000 - protein, 167 aa, Homo sapiens
MLEDRKGQEVFKDNSSTGVKSEKCGEIGVKKPAKTYQNQDAAKSNLWSSSLLHSHQCHDSLQMPENCPIWSKRERYECQEVALYGLKGRAGMHNEILKAVPPCWKDTGPYLRSFGGAFTISYPMRELRYNSYYSGTREGGTCASCTEPIQQPDMAHVKTQQHLKNDG

SEQ ID NO: 928001 - protein, 173 aa, Homo sapiens
MLFGKPRSTGFPMSKTCQMNEWMKYVGAWYPYYEMLHLVRVGKDTPVDSTVLPSSPKTCEMSGHDIITGLEDINNVRGIQTCPLSCGSLNLMKKTDKDNIMTQIKCKLVESVGKERAVFANETEVTFWDFWESLQLATGTLEWNTCSWSPEGPLKVSNYSEAPMLERSQNLPA

SEQ ID NO: 928002 - protein, 187 aa, Homo sapiens
MGASLSHDSEGIQCQLSTYGALSQGDGSFISKPLTGAAAFSFRDALPREEKSREAVWLQLSVVGSAQFELPCGIVYTVRGKLPTQASVIMDAPPPTKLQHPRSTSDCCAGSKNFKPVNLSLLGSLGLESAELDYLAPWLQPPFQGSELFSLTGVPGTTGAAAVNTFEFKCFWQMLPKMAPNTGNAQS

SEQ ID NO: 928003 - protein, 172 aa, Homo sapiens
METCILFVCLTFGHATLHLVNHKTFAGENLLTSSRNGVSQKMFGKHCIRGSSFGLFLFILDFEEDRKMWESLELPRDLLNGFDQNADSDMYNEVQAEVVSDGDEELVGNWSKDDSCYALANRLAAFCPCLRDLWDFDLERDDLRSLAEEISKQQSIQEVGYKCFWKICSLMM

SEQ ID NO: 928004 - protein, 189 aa, Homo sapiens
MNTKPQKQPQASLLRERGKSIPLTDWAHLDGELSGILDLTLSQTDYPCSLGQGLVVWIEDQTSHNIPLSQSLIQSKALTLFKSMKTERGEEAAEGKLEVNRGWFPRFKEVKISTLTGVWKKLIPTFMNDFEEFKTSVEEVNADVMEIEGALELEVEPEDVTELLQSHEKTWTDEKIQSWWVSGWVYRRC

SEQ ID NO: 928005 - protein, 186 aa, Homo sapiens
MVRMDIVRKEEECGFFQETNSRFVEKINAVDKPIARQRKKEKMQITKIRNESKDITADLLEIKRIITEYYEEWYDNKLDNLDGMNEYLGTHKLLKLTQEDIEKSTNLLQCLEVELPLVYDQQIKLSRGLTKARSDVKNHGRCYSGIVQRGEKSIPMRQVHQRALTLSLPAEHCEADLRQTQPMEEC

SEQ ID NO: 928006 - protein, 140 aa, Homo sapiens
MLWRKGDFTSASTPRELTHTEKVSGSLFPSLCCRIKETNSRFVEKINAVDKPIARQRKKEKMQITKIRNESKDITADLLEIKRIITEYYEEWYDNKLDNLDGMNEYLGTHKLLKLTQEDIEKSTNLLQVGRLNQDEKIIL

SEQ ID NO: 928007 - protein, 191 aa, Homo sapiens
MLEGFVLGPSGGSSEQITPDLGLQILCYRDSEEFKMQKQIAFKNLCDKTQMEEPCQSRSPSKIHNTHGLRAPSSAETAAVSVGSWNITVCLEPLEDPPKKVRHKQSQNMNIKIWNPSMWRTYCMSISIKNFQRNVTSPNIQNKESETDLKGMKICDLANKEFKIAVLKKFSEYQGNTEKLFKIIREIYQRY

SEQ ID NO: 928008 - protein, 163 aa, Homo sapiens
MCLYVLIVQLPLMNLREKAVSFPPLRMILAVGDFLYGVNCYSLLLCAAEDPHSTATATTVPQGILPGYHQCSIKAQGPFSQLVVNVTRPRFTLQGSKLALLSRKGPEMSSKSQCLALVTLRDHLVFCPIAAARQSHFTLLSAFLKQKQCLPIATTAVNMMSDT

SEQ ID NO: 928009 - protein, 186 aa, Homo sapiens
MALEVSLADKDAVWILWQASIGEPQWRPLGFGSKTLPSSADNCSPLERQLMACYWALVETERLTMDHPVIMRPELPIMNWVLSDPSRHTMGHAQQHSPALMASWGVPYDQLIEEEKTIALFMDGSARYAGTTRKWTAAALQPLTRTSLKDSNEEKSSQCAELQVVHLVVHFAWKEKWPDVHQSNVG

SEQ ID NO: 928010 - protein, 151 aa, Homo sapiens
MGLWLTSSVSYGSDLYGSIQIGRLCGSNPTAVSRGECLQLLKPQWFAVYRQLVLTSSIRPPSLSQGQKEFLEVALSREGSQKKDGFPLESGHLAWRTALAKLCGILLVNGLPSGRPGAVRMLPPGVLSMISCLCLLPMCSSQRPAICVSAC

SEQ ID NO: 928011 - protein, 142 aa, Homo sapiens
MTVTFHWFFHPCLPQKMQTCKQMNEGMPPLRKIQILYEHSRRYGLELELMFKREAEHKSLENFQPDDATEKKNPFSEEKLKQPAEICISNKELNVSHQDNEDYVSRACQRPSQQPLPSQALRPRRERCFPGLGPGPLCSVQT

SEQ ID NO: 928012 - protein, 159 aa, Homo sapiens
MVTDISARRNGKCRKVKEAETEEFVVEVANRKLEYFPEWKGFTNADSTWEPEDYLECQELIETFLNSQKAGKEKDDTKRKCLSDSESDDSKSKKRDAADKPRGFARGHDPERKIATERSGEWIFLLEWEYSDKADLLQAKETNMRSHQIVIASYEERLP

SEQ ID NO: 928013 - protein, 161 aa, Homo sapiens [sequence omitted]

SEQ ID NO: 928014 - protein, 145 aa, Homo sapiens
MECLFGMIPFGPTDSTCQASISCPRQRTEEAHAVETPQSLLELTLQVLINNHQALQGAACPPGCRCGAMRSPPALCFVCPVPYMRHSYNVYDAHSRDIRARLPQLVPATSRPACPAGAIAIMEAAKAPSSRSPRYLLVIQQRNRQ

SEQ ID NO: 928015 - protein, 141 aa, Homo sapiens
MDGDKTSAGHSECQRDCGPQPSAVCWCPSSLFPDHSRVSHRPSEQFCSVALADPPENSAQNLFSPTNDLENVLPDSPAEASFTWPLRSPRNPTGSSHHSFQCLHLYDSILCKVESSGELLETTDVQPHHPQPDIPTQSIPK

SEQ ID NO: 928016 - protein, 154 aa, Homo sapiens
MVNEQRYLSAQRKGDKGERTGKAVIGCHFYQSSGYKRAKTAVNLAEFGELDWRQTSLSASSKVRVEGALFLDECLDSPTGDLASLPGSGLLLVVVCTESCDVNHLWISQPWVPTPVLVEMAGGLKWTLPHSRPTESETPGVDSAICFDMIFRRF

SEQ ID NO: 928017 - protein, 139 aa, Homo sapiens
MTHSHNSSKQECPAEGQSQIDLHEAHWSLFVSVHPIFWKLQQECGPNLNTGLVAGVWDDGDETTKVVRSQMEKGLGATLMTQLYGYTKIQMVSENTAFSCALCEQREIQTALETDFFPILVTEETIGSAVLPELKFLNS

SEQ ID NO: 928018 - protein, 153 aa, Homo sapiens
MTALEYRCGYQLLGCDQYLLSDSQGPWTPCEACTSPASIPIPERVTHLITNKNHNDIWRKRPQNKGKGIFPIKENKTGGLHFHFAQDPTNCVPGLHPPTAENKQANQQTKPSIPALSHALHSTLDRVISMHYLPFSSIQSSAHSKPTLADTIP

SEQ ID NO: 928019 - protein, 142 aa, Homo sapiens
MLPDSFSSRFTLLENTKSILGRGLLGHLWVRRKLRQWAPAAADISVRSAGKDQNPGSRDVPAGVESAGSETSEIWLRCTKLEVLTPQFPDAASVAEVFPECSSAPGLQHPEVPLSSPVSCFFHHHIEPRRTLRTEGKMKTHR

SEQ ID NO: 928020 - protein, 192 aa, Homo sapiens
MRRNHSRKAENSKNQSTSSPPKECSSSPATEQSWTENDFDELREGFRGSNFSELKEDVQTHRKEAKNLEKRLDEWLTRITSVEKTLNDLKELKTMAQELHDACKSFSSRFNQVGERVSVIEDQMNEMKPNLHLIGVPESDGENGTKLENTLQDIIQGNFPNLARQANIQIQEIQRMPLLDKDAPREEQFQDT

SEQ ID NO: 928021 - protein, 160 aa, Homo sapiens
MVVEHLSDVLCLGIVPVASWLSFFTGTSSKSNTYIGPISAPRFFPESRATKTILLLKMMRGVKVSLLAARDSGDKTHAEGIDKPKATNMESCQLYSWLQIYSDLARKTTQGPAYLLYWTSYVKSKATFSYETYGEEFCFDSFSFCVCWNPWHSLADTEVC

SEQ ID NO: 928022 - protein, 138 aa, Homo sapiens
MWALKAPRSSVIPLMNPPMKQCDPSYEPSHEAVQTSRSAGSTGGKQKTAGAAGDFSRSHRALGMFKRRGRPCSSFPHFRVDSEILLLALLRVLISHSCLHLSLVHKPDLLPISTPAQLCAPAWPRSSSPVDPLGSPVP

SEQ ID NO: 928023 - protein, 159 aa, Homo sapiens
MITIYTHYLLLCGAEISDFNGKTERKEEKDRKEEGRKEKERKKERKKERKRKKERKKERKKEKERKKEKERKKEKERKKERKKERKKERKRKKERKERRKEGRAEERREEKRERGREEGRKERRKEGKEGGREKGRGRKGRDRKGNERKGKEKKERREG

SEQ ID NO: 928024 - protein, 144 aa, Homo sapiens
MGFYFFAWSCSLVWLLPLLSVPATHLRGNLPFIVLAGGHFPAKSGKGPANLSKQPPRGHLAGIDSRPCSSQLAHQENLPAVHRPRRSCSHHPDSASQAAYGGYRTPRSIPVFTQSPQYSPSVSATLGSLAPALWLLSLSHRDPS

SEQ ID NO: 928025 - protein, 144 aa, Homo sapiens
MACDYSYVPTGTENGQLVRAKGIGEGFLQQVIWIFGEPPSEHGAPPSEEGNNYFASLSLAIHTNKAGMAAEGEAFSVRKHSHRSVENSDWMRQLILHMYQSFCQQHYFFLSKPSCFNFALLILAYPRGLHLEMSSRISLTPPGC

SEQ ID NO: 928026 - protein, 176 aa, Homo sapiens
MGVPFANPELCSGEDKRHVMLTPSLPRQQLEISVAAMAFFQDLAQAHWGHFTNLVLQAALGLPSSQDPSPEQGLRAQPVDGAGMLQAASMLGASGVPRSQLPRNAASVHSQSSTSGTMLQALLFLPLTAWQTEGMLQLIHSCHLQLSKFPVLVRQRRGIKVRRCQSVSKAEKNFIE

SEQ ID NO: 928027 - protein, 155 aa, Homo sapiens
MLVFVTLVSQQSRSADSEAAMLGFVQVPDGGLVPRHVTHSLTFFARGDRSWDSEETVLDYFLKDSQLRVFKTVDSYPVTLCFFLPLPENDNGNVQKIRGRHEQMGELMSRRTEATESSLHNSSWELIKNEEVGGLKSLLEKADLGLHFEFKKGCK

SEQ ID NO: 928028 - protein, 196 aa, Homo sapiens
MELFHFVIPAPLLRAPSKGWNSQDMCALHRGYSGLSDSWKKNQQGELSEQAVFCCVKMRRASIQVEGRESKALGDERMGKGSEPVKPYAAELEFQLKSADTKATALPCPAHTPGPGTIGRKYRRTVGSIGEPGMRLLRRPPGRAVTHPAENKLKESVMSLQEKKAHVLRRLRLDQLISEDLVDRSTLKQLNLQRQQ

SEQ ID NO: 928029 - protein, 158 aa, Homo sapiens
MCTPAPGPLHLLDPTLHKCPVSEQDQGCNQHICPGYLHGALLFSRSAAQEEQTTYSSRATFKVSNFLPVAAWKAHLCPFPSTHLQDSGIIPASPAGAAFLGWRLAHPSASSQCAGEHCRWPLKLGSHTSGYYKPLETGTVFHLRVLNNTQSFTHNKIL

SEQ ID NO: 928030 - protein, 154 aa, Homo sapiens
MLSPSHGGKDKKRQTAPLNLFVMGILLQQQEGPETPGVVQNRANGVQLEGYSSPQLHTPLAHNPPFPAPPNSLCASQTSPCDAPSPGTFLDLHTLASAVSSAEDAFGSLRCPEVNFESLLLSYLFIKWANISYCVALAIKIKAENTYRGLGTEP

SEQ ID NO: 928031 - protein, 139 aa, Homo sapiens
MLPRILPELTLLLIRKAWAAPIPHGFPERSRETNYMEVRGRLAPGPVKKAPQCSVSENSMYYSTDTITLTIPKNISPLLNGAGHFKDLSKEMGVSLHKLSTADIVSRHYELKSDGKTISIKIPLGAEGGYYKLELRGRP

SEQ ID NO: 928032 - protein, 151 aa, Homo sapiens
MNGLVVPVHFIFYRRNWRAIRHDSLSASLPQEDRNITSLTSENSLASLRNKWQTLFPPGRPYEGEKAGNPRHIWKNPMAKDTNATFTSNICFQHGDGTRVVTAEGAGLERGGQELREELNSHSHAVSSMKVYPLFSWPQMAARTPVTSSTF

SEQ ID NO: 928033 - protein, 136 aa, Homo sapiens
MKSEKVENRDVLLDALIISAFSPHGMPPKVAKAAALSHGKSSQSLEEFVTHQGSGPAVHVAHFDGEPGFITVFVQNLQHRRILDFIIVFKFCTTKDPHIVSTRGRLLPCGKLPLFIPLVYQAMTQRPLPPTCFPRD

SEQ ID NO: 928034 - protein, 145 aa, Homo sapiens [sequence omitted]

SEQ ID NO: 928035 - protein, 177 aa, Homo sapiens
MDINLMTSSPGYDVLNRFKLQSTAQILVINTTINVLGMRETKGGELLTPFFGKDWGLLVGPTEMDGGHTGPVTQAVQKANVGSEPQHRFPTGALPSGAVRRGPPSSKSQNDRSTDSLHHAPGKAANTQCQPVKAARRWAESCKATCVELSKTVGDYFLHQRDLDELRTTQATKFRAP

SEQ ID NO: 928036 - protein, 194 aa, Homo sapiens [sequence omitted]

SEQ ID NO: 928037 - protein, 186 aa, Homo sapiens
MFVQPAELSGGCSCGMENDGGAGPETGLDPESGGETSSEPEEISQWGQSGWRGTHCSSDGHLLSNCSAPSLILKTVVTETVTTCEYFIKCKREKQADTRVAFSTQQGNHNVRGMYVLCVHCRGHNELHWRRVGVREGCTEEEVYELDLEARVRFHQVLSRAGGREEHRGWEKNLCPGIGIHKVMLA

SEQ ID NO: 928038 - protein, 212 aa, Homo sapiens
MNDRFLKSPLERLGCVSLFLLTVPSDAGLLEFAGGPLQTLFAWVLPVEAAEQQRLLTVPSSGSFIPEGHPPDATEFERCAGRSAALFTAGRQKCLSLLKLYPVPPGALSQGDGSFIYKPLTGAAAFVSEMPCPKRRNLERQSGYSGFPKLWSSFVLETQGPGGVDLVRLIHYHENSIGEIVPMVQLSPTGSLPQQVGIMRATTQDEIWVGTS

SEQ ID NO: 928039 - protein, 152 aa, Homo sapiens
MLIRVLWSAYTKASIVYTASLERLVNEVCCQLGEPWYSIPRISHQGADIAGQNVVSDFTLQPLRKHLCLVPEIAPPNLVEVADINGKMNLSGDGSVTLMSDGRPQETSIERNRAIKPKVLGYGTRQPDIEGTTKIYQCSFSSITGCVGSFKI

SEQ ID NO: 928040 - protein, 134 aa, Homo sapiens
MCLSDIDSLGGLFGTDVHFHSTAFCPSAIQFFPPLPLNYMAVEPLLLRTHQVSPNSRGPELPSQGAGDAVSEERKIPCSAPLSQEESSIGFTSQKSSLFFNKDGTHFLGYSERPSTRTAKSAPSTLTISNVVDT

SEQ ID NO: 928041 - protein, 143 aa, Homo sapiens
MVRLLISPHKNALSSSANRKDKCFDSKGEGAGKIQDNLMHKRISDWQHPNPSITQDLSNISFCNKDKGGGERKGGDKSSSYDDTPNKTELIPGNFLSWEVGEQVFVPLKTQQIGSYCCFLSYLGQIPRKERGEKCLLPGCHSL

SEQ ID NO: 928042 - protein, 188 aa, Homo sapiens
MVPLHSPCRLQQDSVFGTHVWLVPELTISFHFCPEITLLEKKKEGEEERRRRRRRRKKKKKEKEKEGRRKKEEEGEEEEEEEEEEEEEEEGEEEGEEGEEEGEEEGEEEEEEEEEEEEEEEEKKKKKKKKKKKKKKKKKKKKKKKKKKKKKKKKKKKKKKKKKKKKKKKKKKKKKKKKKKKKKKMMIE

SEQ ID NO: 928043 - protein, 157 aa, Homo sapiens
MGVGPSEPCTGYNLLVCHLLRPLEKCSIRVGVSRFSRCRLSWLPFARKGNSLTPCASWGIAIKIPEDVKMALKLGNRHKFKSLESSPEEKKMRESLELLRDWLNGCDQNADGNMNSKVQVDEVLDGNEEVIGNWRAHPLHLHALDAGHEAKDDYLEL

SEQ ID NO: 928044 - protein, 156 aa, Homo sapiens
MWLPVTQTAVIDVSPLGLATQQVYLASGWYWGLSTQSPVILFTAKRRELYAFHKSPWANDLHVEFYYPLSKKKHVLPRHRRERSFFWPLLKFLPLPRNYSLGQPQHILANSSHCQNIWGDKCIYPFKLFSPEAMPNICLTRNSCVLVCLGCHNKMP

SEQ ID NO: 928045 - protein, 166 aa, Homo sapiens
MKVANPQHKLYKLEATTPICEKRWKELGYWAGVVVQYILMAHTRFPRRAAQSALQHSQQCTDKIPMQLSTRVSDVGPVEPAGRKWVFEETGTPFSGIIVLEDMPELQASTHSCQHCTSLNQCHLRISQQIQGHKDISLFSSKNIIVLALTCKCLSHFELISVYGVR

SEQ ID NO: 928046 - protein, 145 aa, Homo sapiens
MREWGCCLQINRDLLPVRILVTKFSEKTENTIVFTDQQRHANVMLAVEGKGHVYCKQRCLSCHRGCWRGILRRRRRAAAAVDLQSPDPHGLSSCVIDMPMLSHDIRDSLCLEHAAHSCWPRCLLPVSPASESCYVPRKAFLDRCI

SEQ ID NO: 928047 - protein, 147 aa, Homo sapiens
MHPVHWANASDPTCKLPGPVQDQNPAVSTTCAPSSPALLQQGVHGGEGEKQDVVKWFSKCGPTGSVSITWNLIGNADSYTAPGLLSQKSNKCSRLKQMLRQEPSAVPVTATACETVDACHCCDWSGLRENGEALKTNPGCLSNCLRH

SEQ ID NO: 928048 - protein, 236 aa, Homo sapiens
MTENGELRDSVSWLQKQILTLKSAKIALSESLVSCRERAEIVEKQTQALTMRVADLQQKVHAQPRQLSTVKTFGGLLDTGSELTLIPGDPKHNCDPPVKGRAYRGQVINGILAQVQLTVGPVGPWTHPVVISPVSECIIGIDSSWQSPHIGSVTGRKTDGSCRMTVDYHKLNQVVTPISVAVPDVVSLLEQINISGTWYAVIDLANAFFSIPVHKAHQKQFAFSCQDQQYTFTVLL

SEQ ID NO: 928049 - protein, 145 aa, Homo sapiens
MGEPAVPGAFWDQVWVCRGSRSFAYTHFRSTDTELCAQGWFLPLAPQDRDMTREAAPPSHCRCCLESEAYWAALWALGLITTLRLHTRSAPDRSESNGHTSPWGWVIRSLSCDHFYGNRIPCSFGWLLGVSYKLHWKSHSEIIMC

SEQ ID NO: 928050 - protein, 141 aa, Homo sapiens
MVDPLTACTGKAADTQHQPTKIAGRKAVLCKATDVELLKTIGTHLLHQCDLVAGRQNCLSLQKLPPELPLPPGALSQGDGSFIYKPLTGAAAFLSKMPCPERRNLERQSGYSGFATLCNGEHPSPDQAQASQVGFRLLNWQ

SEQ ID NO: 928051 - protein, 154 aa, Homo sapiens
MRTCVDQMTTGYHNHIASPLLVAIQHILSFQRVALSLDQVEVRKGMEEEERRGGEERRREEGKRREERRHSGLHSFVYQINKKKFQGTVPNFKIIAILRRILNPSGPVEKSQSSTAGVEASQLGRVGRTITAAHVASTSTTVWAASSLLSLTLH

SEQ ID NO: 928052 - protein, 136 aa, Homo sapiens
MYPRQISINLEVYFAKVKNMPVTQLQEVLMTCVQGELCKTRIRRSHSEAQATEALGPNHRATQILNTHLARIGLSLRVSWGRGYHNHCCGCLKSKPSELFRGGAAVNTVAVGPSCRNSNSSEELRDRTLISLGLNP

SEQ ID NO: 928053 - protein, 164 aa, Homo sapiens
MAHTWKLIQKRRIDQAQVQGPTHSCIKMIEIVSTPHKYPRGYSLLHHQQQQQQQQQQYQQHQHLHHHSYRFSGMHVHNVQVLTGIGSAVGASDGADHSKNTGGEFSCYCGTIVHVSNNVSCASKSTGLYSKVMFLPEALVEVLWMTASTLASSASLAVAINISF

SEQ ID NO: 928054 - protein, 146 aa, Homo sapiens
MQYVIQNCDSRLLLTKITTIGNSVRISAYLLQLLFLFVFFKFLFFFKFLLSLSHYYFVAPVPWNCQRFCCFSVSSSSVLHGPSPDSQAPPASKIDKDPQEQPQILNLYFLPESQKHHLLEPEEVPNELHVTLYGKLENTVRLTLTG

SEQ ID NO: 928055 - protein, 134 aa, Homo sapiens
MMIASERRQQGNGLSHACVGMDSVVAMESVHAPHNLAGGGCRLVHVSGEWLWADLFTIMRISLERPAPMIQLPTPGALPQHAGILGDKIQVEIWVGTQPNHIIPSLAPPNLMSSHFKTNHAFPTLPRSLNSFQH

SEQ ID NO: 928056 - protein, 154 aa, Homo sapiens
MKAVMGAVTCRATAAELPKALGIHHLLQCILDARHESGPSAASLLEFAGVPLQTLFAWASSAEAAEQQILQNSKYYSLILPLEALSQRGTRLYEVYALPPQVESTEAAGLAELRWALPSSSFQAALFTYSSLSNGRCPSPHQAVASQLDLRLLC

SEQ ID NO: 928057 - protein, 139 aa, Homo sapiens
MRKNQDKNAENSKKHNASSPYDRSFSPVRAQNWMENGTDKLTEVGFRRWLITNSSELAEHVLTQCKEAKNLDKSLQELLTRITSLERNINDLMEMKNTAQELCEAYTRSGINQAEERISEMEGQLTEIRCEDKSREKKE

SEQ ID NO: 928058 - protein, 322 aa, Homo sapiens
MIKGFRESVKNQVQIFEFLEGSEEDRKMQESLELPRDLLNGFYQNADSNMDHKIEAKVVSDGDEELIGSWSKGHSCYALAKKLAAFCPCPRDLWDFELERDDLGCLVEEISKQQSNQDMTWLLLTTYSHMCSQRDGLNLEFILKMEAEHETLENFHPDKKRKNPFSGEKFKPLAAEICISNEDPNVNSQGNGKNGNAGGYLGLEPPHRVPTGALPSGAVRRRSLFSRSQNGRSTDSLRCSSGKASGTQQQPMKIANGAIFCRATGVELPSKALGECSCMLLHQHVLDSGACGKICSPLLGHAESDTSPELLGLTDIYDATFR

SEQ ID NO: 928059 - protein, 144 aa, Homo sapiens
MNIFVCVLLTGKVHRSGLAGSQKTTLNILDGLMPKCCLMPKRSTHDQVSHSQETCLYQQAPLWLLSDLCPVYFYQDIHCVRELSLGKKLDSGPMGRGSHSRHTCSTRTRKWRAKERVRGLCAKAFIGLQDIIQVGFHGSSNLQV

SEQ ID NO: 928060 - protein, 154 aa, Homo sapiens
MPPDWETPPSRGQKIPHTGEVWLASGSFPSVTKLPEEGTGSNLCCSAASAERNSVNINKNDVHTKTPFEGHQHQRPKVDKSTKVRKKNQHQKAENSKNQNTCSPPKDHNSSPAREHNWTANEFDELTEVGFRRWIITNYSQLKEHVLSNPMKGS

SEQ ID NO: 928061 - protein, 140 aa, Homo sapiens
MRILGHDYNSELAFFVHLQNAILRISLQASLSQMRKWRLLEAPQEERVEILKNTFGSPVCLIYLKQSLPTTAFNEYLLTERISEETEERGPNTGQCQCRKGTRYKKFKKHQEREGSGQKTSLRESAYHRFHAAYKFVNGV

SEQ ID NO: 928062 - protein, 174 aa, Homo sapiens
MKLGNGHQSMSPLVLGVLGCGLLTQLWPAWEALGSLHPLEKLPHSLEDGLPCIKLARGRTEQKEPRGAPPASTLGGQARGFIVPRRLHTVRAKVIPYKEIRAWLGSDTTECLPPLNRIQYSRFGAFCDEVNCHFGLLSVSATSSRVVPGNALPQNRCLADSSLPFWSQLRRCLP

SEQ ID NO: 928063 - protein, 168 aa, Homo sapiens
MLLPCWSLISGFLLATVWIPWLGGCIIPQLAPSPSSTTPLHKLYAGLHPVPVNPRGSDQAQLCALSSCHMPNAAAACSVFCPEHSVPSLQGCSSWSLNGSTEAPSPESKSCFLCMEGGPALWQFSSSCKVSTVQFGELPPPWTECCLQDSGWLSARNLEQGAAFGVEG

SEQ ID NO: 928064 - protein, 193 aa, Homo sapiens
MNVFDMRLAASPSFCLNILENHPNHQHQRPKVDKTTKMERNQSRKAENSENQSTFSPPEDSSSLLATEQSSMDNDFDELAEVGFRRSVITNLSKLKEDVRTHCKEAKNLEKRLDKWLTRINSVEKTLNDLMELKTMARELFSSRFDQVKERASVIEDQINEIKQEEKFGEKRVKRNDQSLQEMWDYVKRQTYV

SEQ ID NO: 928065 - protein, 135 aa, Homo sapiens
MAGYPSEMKLPEELSGSNICCSAVFTVLQPLLLIPRQTGSGVDLRQTPTDLQLRVLTVRRKNNKQKRTSTPKPHLYVTIIKDQRLQMTNFSELKEEVQTHHKEAKNLEKRLDEWLTRITSVEKSLKDLMELKTMA

SEQ ID NO: 928066 - protein, 134 aa, Homo sapiens
MSMVLWMRNCDLDITYDHFFHMLMFLQTNSDLMWKGVIQGCEYQEAGSLAAITGYHHSPVVSSCNWNRKQTPCHGLQVLPDLASASSYLMSHHVPLLPLGSSHAGFMSPEHTNLTLFQVFVNESVQVSFQIPGS

SEQ ID NO: 928067 - protein, 187 aa, Homo sapiens
MEGRGYNLGYMKNGFELQTVAKHFGSPSWLGAVGTCEVTNVPLSASQGTMELCLPPEFRHKQELPGGTWSSACATDFWLKQGHWAGSWHRALYGNGEWTNMTVPQHRDCSLYQGIAVGAGLLQGSKPVEFPMDLSVASAKNPGSSLGADSSTAQDRSLATYLYLSSRWDINDKEAFCNLRNRSMTNG

SEQ ID NO: 928068 - protein, 134 aa, Homo sapiens
MWVGPDKRIKAGCPTQHWQPVGVPFHTVCSFTPEASKTTNPPGGMNNSRCATLRAVTFTRKVCSFTPEPARPRTHQKEETLNTSEHQKEQTPDPPLLRTVTLTARVRGFILEVSETKNPPIPDTLTYAIHSTFK

SEQ ID NO: 928069 - protein, 155 aa, Homo sapiens
MAIGGGKECPELLEKEACIVEGELLQQCPRRVPTGIWWVPLWGEASRGRNRQQSAVLQPLLEIPRQTEPEVDLQQTPADLQQRGLTCKNAENSKNQNSSSPPTDHNSSPAGEQNWMENEFDELTEVGFRRWVITNSSQLKEHVLTQCKEAKNLKV

SEQ ID NO: 928070 - protein, 200 aa, Homo sapiens
MLNTPPEGFNLDFFHISRPVEKALCVGPAPLPSQLCNIPCSTDCIVSSWSAWGLCIHENCHDPQGKKEILPLGIMEGLWLLVIQSTLENQPVFTAFTPFHRVMTGRQGNHDRQVGACQVKLGCLSEEFKLGFRTRQRHVLMESTGPAGHCPHLVESVPCEDPMCYRWLASEGICFPDHGKCGLGHRILKAVCQNDRGMTQ

SEQ ID NO: 928071 - protein, 156 aa, Homo sapiens
MDPRNSQWLQRKSCEIPCRMDCVLSEWTEWSSCSQSCSNKNSDGKQTRSRTILALAGEGGKPCPPSQALQEHRLCNDHSCMQLHWETSPWGPCSEDTLVTALNATIGWNGEATCGVGIQTRRVFCVKSHVGQVMTKRLKRKRERKGHIMESSSITQ

SEQ ID NO: 928072 - protein, 143 aa, Homo sapiens [sequence omitted]

SEQ ID NO: 928073 - protein, 146 aa, Homo sapiens
MGPDNLSFYKGIQCFCCRSEDHTLRSTRLTGNIAEMLPDSQSTADYHSSSTWLQVSRLTDKDGDWCSCCCSGSHQFLLMLPEKAEIPQVRHLVLLSGGRSFMAWVAFVFCPPNSSWWRRKISGPAEKENSSCAPSLPTGLPVNALR

SEQ ID NO: 928074 - protein, 134 aa, Homo sapiens
MSGVGSFRWVCGLLDFKNEAADLRGGFRQTIASKDAIGQRSSKLTRVGLHSSRAIELKASVSYWLFFATELPHDRTAGFFKMKVVTDNLKGRGETGIEVYKKSELFYVVETKYDKTESQLGPGGKWWYHFFLAY

SEQ ID NO: 928075 - protein, 169 aa, Homo sapiens
MGSEPPDRVPTVALTSGAVRRGLPLSRSWNGRSTDSLYCAPGKSSYTQHQPMKVARIGDVPCNATGADVLPCGMQHSRNSWKQQRGPHQNLGDFLAFKSLPDISRHSLDMKGTHFLKGKDSTSWILDDISRPTWGQGDLTTLKGRTQAWLLVVVYKMYTKSADYRTLGP

SEQ ID NO: 928076 - protein, 165 aa, Homo sapiens
MVALPAKPLKAVEVKAEGEGNSEEEVYGKRMSYGCGFKTIWDRFHQCCNELFYAVCTHCKMYRSQEQGVGNLGTHSCDEASSVHSSKAAAPLGQGPNLYKAKEEWWKSTYVFVAPYANGLVHDSVVESQTNYGMEQMAGFRRFYSVSPAPNIIGVKNLTYTNFKL

SEQ ID NO: 928077 - protein, 146 aa, Homo sapiens
MFGLKSTEEEETTQFQSLGCGLVGQSSEKFDRLNPSSLNSSKSFSIQLCSIAGEELHCFGGGEHPKCNPWAIVVCSTFKRGLEPKQFAYIYDIPGPTQSHLHLGFFFISSIPEFLLPPFPAAEARGIVLKSKSGHFTPPLSGAAIH

SEQ ID NO: 928078 - protein, 153 aa, Homo sapiens
MQKAEGSFLCTRSVLYSKVLRQLPFALVKYTPIYLQKKLSVKQAGSSGGIPEVGVVIIGDDSSLGDIAPEDPLMGQDVEVEDSDIEDLDLVISYCTVLRVTDTVDGKTANKWGLLYSFRFVRFFGGLTFIMLNNVSLSECTAVYLSIHLLKIS

SEQ ID NO: 928079 - protein, 138 aa, Homo sapiens
MRRSQRKKAENSKNQNASSSKNHNSSPAREQNQTENDFDKLTEMGFRRWVITNFSELKEHVLTQSKEAKTLEKRLDKLLTRITSLEKNIYDLMELKNTALELHEAYTSINSRIYLCQFLSTTGSVYYLINDSLMNEWI

SEQ ID NO: 928080 - protein, 208 aa, Homo sapiens
MQPLTWQVPFSPLLSIRSTRSNLPSAGKDPADPTVLEVSVANRDTFWSLWQAPIGESQWRPLEFWSKALPSSANNYSPFEIQLLACYWALVETERLTMDHQVTNVTRTAYQELGVLDPSSHKVGHAQQHSIIQWKWYICNWARAGPEGKRKLHKEVAQMPMVSTLAILPSLPQPAPMASLGIPCDQLTEEKKTRAWFIDGSARYAGIT

SEQ ID NO: 928081 - protein, 177 aa, Homo sapiens
MSGPSGGSSRPTVPVFGFAGSIHRRCCKQFLAGQFLGFQAACLGADSGQQWVKWMEGSLSPWAASVAWMIVVVVMGQTLGSQAAHAGFSIGCNGQGNQFPCSQGVCKNAAALLLVEEDCYQWQFLFLSLHLKIDLLLVHACAHGHYHQRGDRSRTAVIAAGSYSITPGELAFRGSLL

SEQ ID NO: 928082 - protein, 239 aa, Homo sapiens
MRILWRISFPQIQKNPSKMHYQQPLRPKPPVLSQPCYRALHHPPVQPGYEALNPIPVRLDNEALNAISALNSAFLSMHQAPQKSDLQSVHQPGTQALQSMHQPGTQALQSMQQPGVQASERPAQQATARQPGLKALNFSSIQNSNFLSASGPFLRQGNMGIPRHGSFLLFYNLLYLLPLFLPPLLQLAAPVQPQPFDQAQQAADPAAAAPPDPQLNDQAPQHFSSSSHSSPNFRKPSWE

SEQ ID NO: 928083 - protein, 135 aa, Homo sapiens
MDLNPVLQCLNQEFPLFVEWNNKDSDMSLYGLGKEGPFMPETIILNLPSNFFAPSRPMHHIHIAHYLERQRTQLAWHPTLHPDRMGLGYRSSQELVTKAREGEYDDRLSQSRVVLELRPKHMSFLGERISIIRKE

SEQ ID NO: 928084 - protein, 165 aa, Homo sapiens
MSQEMQGDRKIAWSRTSLWEIAALVSKEALDKALGLPGPPRYGNINSIVHEYQCVMPPVLNLPGTPSPSLALGHPTSPSRPSDKPLFTLKTQLKRQFPCKFSHKFPCKYSSQDKTPEPIVPKVPEKSKQMPNNNMGSSSTLLAKPRALRSGGKKEAAMDKTLAES

SEQ ID NO: 928085 - protein, 223 aa, Homo sapiens
MPGGGRQSGWLNQELPERQTKWTKSLTDLSYCLGPGDPAPGSPSLSAIPAPLPVVHYCPEGPLECKPQTGRQTWEDSMRLHSNQTVLKSASLASSSNTGHSPVAPLPGNLVEADWAAQGMPVGCGEERLQGQLGWIMEARVTWGCDSRYEGREGSETSSEGALPSLPACGLGAVGEDSKGVTLDDEVNVLWLTGTGKMGGGVGLQQREAFYFIQLGRETSLWR

SEQ ID NO: 928086 - protein, 201 aa, Homo sapiens
MLTAQTQPLTRRPRGAWSHAWWFAPPRLRGRSVQLRPHDGARFLRTRPTAAAQTKTGIGPPPRGGGGGGRPGWPRPPLRAEPGSCRPSLCPTLLALVLKDKQRGRGELAAPARHPPDSRPSSHTPKPGPARAGVAASACVGTTPKACPGSFPPPPHLCKEFSRNSALWRFCSTALTSHLKGYRAWVSRVQRRHAFRLTANS

SEQ ID NO: 928087 - protein, 144 aa, Homo sapiens
MSFLEAVGIDLGLQGSECRRTVAVRSVEATGASEGFLLDLLPYPSFGVALGEGPGYLRGRCVYLQTFEQIPEDKEVGHGDLWGKGAAGRGTGQCKGPGQRACVMLEEQRGGQCGWNGEGQEKVPQPHCRTGLKMKPPLQLLRTQ

SEQ ID NO: 928088 - protein, 150 aa, Homo sapiens
MDHGENRSSIQQKEEKQSRSWKAVGPEATCSKQSVQYLLWLPPHRLASPQLPQLSEKTLDRVIPNDLKKHPCRSHSRSFFLSLLLSGYSGLSLWLQSLHNQTHTQYISEAFSILGQPQSHSLHSSHIPGCIFNLVSAPLGGVHAEKLWFF

SEQ ID NO: 928089 - protein, 150 aa, Homo sapiens
MENSFTGMRNLILMHPLVPFRSLLSWKRPQAKPFYASGAVGTVPRGCGNAECDGAAHMIKDNSMLAGVPKHILVLLAVSCEGEESEPICLIVRESKSDGKVKNTFVPDSHEITPKVIKTRGNLTYVYIPNPEPSLETVQLSYPRGSLHPV

SEQ ID NO: 928090 - protein, 147 aa, Homo sapiens
MKETSKDENTEATGNGKQGSSVAAEGKQLMRIPHEIVLSSCTKGLAGVWKAWEMSFVDLVLEGCLMLGGQVPGAWQVIVHGSGGLQGSLGNVFLDWTAKFPVKTSTTVDREDNRYWSTTSTLAFNRNSSVTEAKPCGRPVFRTFNMM

SEQ ID NO: 928091 - protein, 139 aa, Homo sapiens
MSQGKVFVLGMLKDGKALSCLLEVKVDGPVVCFSQASVIEPEALPEEGTKDLDENNNNNNNNNNNNNNTFFNSPKWYLFTFSPGRLSAAILDLTPVTLSPHVLYLKCSVQTHLSFQAHFKFSFFHETFPFYSKSMLPLN

SEQ ID NO: 928092 - protein, 171 aa, Homo sapiens
MILKPPRPCGTASPIKPFFVPSLEHDALCHEAKHTRLVHHSEKLKENPRESRAVAGPKLLHTNEVSQQISNSVLQLQGDCADSDILGTQEGQTQKAAGLITFQRPPMASVCPRWGVRGHQYPGHPFLFQSSMEMFLACCLEVILPNLLEHLQLSCPILFILETTKMMGGER

SEQ ID NO: 928093 - protein, 161 aa, Homo sapiens
MGLPKTEALTLMVKRGVDGAAVCALAHSSCPRPGDNNDDNKSWHLLSQYHVSALRFRFRRPCLGDLGRAGSDRCQIAEKDSGALCRVGHCADICRSVKYRRYKADYDSTRGGGREKTLHKVLGRSIVTWHQCVRGSRQVSATWWVSVLGMGVDDSRETELA

SEQ ID NO: 928094 - protein, 169 aa, Homo sapiens
MMGKRGCVNTPMDFSKKGKGDKRGRREGPWNPYNRPADRGRKHFKGSKLSCSHSIAKNLFRPHLMKSSGGGLVHCATNITLLGGNKHPDYCKNVEICWQFRINDYFEWANSSNSEVEHLFVAHALVDILEEGKSSKSGTCMRVGDRGKFLMVVRKQVSELLVYKHMGLG

SEQ ID NO: 928095 - protein, 149 aa, Homo sapiens
MVSEGASPKTWQLPCGIEPASAQKSTIEEPTHRIPTGAPPSGTVRRGPPSSRCQNGRSTDSLHHAPEKAADTQQQPVKAAGREAVPHKATVAKLPKTMGTHLLHQCALDLQEIKQRSSLYQGFPTRGSWTGIDLQPVRNLAAQEKVSSR

SEQ ID NO: 928096 - protein, 141 aa, Homo sapiens
MLVGKHLSGALGKAPRLSSRGCTVHMLLWEQPGRELGKGGRQGGLLNTCAPVLGGKDDLVLSWPWWGQIPLPIQMSTGVLGSFVAKIPEARGKSGLPHLHFTHTSLGVVLSTSLFCRHVKKDVFAALSAMIESFLRPPQPC

SEQ ID NO: 928097 - protein, 172 aa, Homo sapiens
MGCRGLCPVQSPLNHTTVCSGQKFPVASELFSVSRHGALASQLLAFPFAICTRYGVYILKNCGKIPPQTKDLLTQTHISVLYLFHYINDNILTCESLTDLETVLLIVLDSLKDKEWKVNLKKKQGPSIEIKFLRVSWLRCKTYSELSLIRQHSSPFPRHQALQKVLECICFK

SEQ ID NO: 928098 - protein, 172 aa, Homo sapiens
MKLDPHLSPYTKINSRWIKDLNLRPETTKLLEENTGKPLLDIGLGKDLMTKNPKANATKTKKHSWDLIKLEFCMAKGTVSRVNRQPTEWEKIFTIYTSDKGLISRIYNELIQISKRKQTIPSKNFKDMSYISSSDLHSIIIFRYNTINFTYTTIHFSVPSYCFCQEYTDKSL

SEQ ID NO: 928099 - protein, 199 aa, Homo sapiens
MRKGKILKSGQFCGGESTLQSGNCERKEEQQSIQDMTCVLLKAFSFIHSQRYSLVLELIFKREVENKSLENLQLTAIEKKNLLSEEKFKLAVEISSQDLVPCIPAVAKRGQRTAQAIASDGANTKSWRLTCAGFICCSSRKRGGTAFLQPHEVEIQVLHTVFDTLGVEILITARLPMGSPLTILWSHLIITGDDETNIG

SEQ ID NO: 928100 - protein, 143 aa, Homo sapiens
MAHVDICIMAGYFPRKTGNAWCRSSGVDNQLVFVDSLKEEPMRPLEDGQDKKTDRGWEKTLNSNHSTGNASTNICTINVSGTEEIPGIWTTLKKSGIGNVFDGCKRNMAENKIISSCPHESNNQVWKTDRGTDRQKHSGTNWQ

SEQ ID NO: 928101 - protein, 176 aa, Homo sapiens
MGDQGLAKDFWTVCSNSGGLVLGLGSDFWLLEVRNVLCWRGRGAPRWLVTTLQWLVPAKVLHRAVAAGCALMCMCQQQWQQQHTGCMLISCSRVLVGAGVLASVQAFAAVIVLVWLRRMGAPASNCVHICTDRGVSMGTECWWAQDYVCLPCVFTLVAVAAQSRDQGDYSEFSDIS

SEQ ID NO: 928102 - protein, 474 aa, Homo sapiens
MTKCFLPPTSSPSEHHRVEHGSGLTQTPSSEEISPTKFPGLYHTGEPSPPHDILHKPPDIVSDDEKDHGKKKGNFKKKEKRTEGYAAFQEDSSGDEAEKKYGMKCEGIYRVSGIKSKMDELKAAYDQEKSTNLEEYDPNTVASLRKQYLFEEAYGRTTETEKVQEFQRLLKELPEGNYLLISLFVVHMDHVITKELEAKMNIQNIYIVVSPTVQISNLVLYVFFTHVQELFGNVVLKQVTKTRRWSNVATMPTLPETQAGFKEEIRIQELLLNCLHQDLQGGIKDLSEEERLWEVQRILTALRRKLREAKRQGCETKIAQEIASLSKEAEKEILTKQEELLGMEQFLRRQIASEKEEIECLRAETAEIQSHQQQGLSETEEYSSESESEDEEELQIILEDLQRQNEELEIKNNHLNQAIHEESEAVIEPRMQPWLLQLQPDRAKQQAQEDEEPEWRGGAIQTPKNGILEPVAAK

SEQ ID NO: 928103 - protein, 184 aa, Homo sapiens
MGKPPNHHRNDQRGEELRGQELHDASTKQRISSCCDTPLTLKRGDVTHPSLAAGILHHLDMTLIHLTATLSHSPQAPQPEGWHTDALSRAQAGLLTGHVDLSIIQEVKLSTSPVAENNTEASALQDNTALLLLPNWDLPTSFLPAARPVTWIMSQFSQAREMSDTLREKRDDMLKELQDLANVY

SEQ ID NO: 928104 - protein, 144 aa, Homo sapiens
MENKTKQKSMDQIEFKKKEERPPNLISLHVLSYEMTFSKPKNQGSNSSQGVTIHSTCSMFLPPLPSPERHKEEGDWIPIPSRASIPPLGAEWEMGKCLVGALEAPNCQGSTEDGKEESSRTNDKHVENRQDFQVRGSMESSSRI

SEQ ID NO: 928105 - protein, 155 aa, Homo sapiens
MTVEFCSGFIEKVVLLHSGLRAWAQEASRLLLLYPGGWHLLGAVVRAPCNSGARRRLVAGCILFLGFHLLYPSPGGFSVAVLGSSTCPEWVTVQLRGQPPPALPWSASLLLALPGDVICPRSGRGNGMECPGAHESAGIVESWRTQRRSQKSAGA

SEQ ID NO: 928106 - protein, 136 aa, Homo sapiens
MLQLAHQEVQSRFFQHAQRTLGKLPGFLNQAETSELSDTAAPPPAAAWLLRLVHLDESDVYVFIPFLPEPLVKKVHRGIHECLANSKVLGGHEPVTLNVMLSPAGSQYDSPQITKVEAHSYKISVVWIGPGLQGQL

SEQ ID NO: 928107 - protein, 216 aa, Homo sapiens
MLIYHSENPRAFRNCTKSTLSVLYKCNNKAWMTAHLFTAWFTEYLKPTVDTYCSEKNIPFKIFLPIDNAPCHPRALMEMYKEINVVFMPANTTSILQPMDQGVILAFTSYYLRNTFCKAIAAVDSDSSDGSGKSKLKTLWKGFAILDAIKNIHDSWGEVKVSTLRGVWKKLVPTLMGDFKTLVEEVTADVVKIARKLKVEVETEDVTELLKSRDKT

SEQ ID NO: 928108 - protein, 155 aa, Homo sapiens
MLTSGNTLTYRPQNNALPGFYVFLNPVKATPKFVIDICVKIIVWTYTFFFGRGGVRNNGMEYGGWLFKFLRNWQTFSKWFQHLIFPPVIYRDQVAPHLHQHLIWHSQLLLFLLLLPTGECLMSLSPVPFLYIWYQHLFHEAKEEKAPKNIRIHIK

SEQ ID NO: 928109 - protein, 146 aa, Homo sapiens
MNSKWKPILFIWYSTEGTAFSTKELSDTTVSDHGITFVFVRFKQFVDMNLICEVLIMPHSWQSKDVITISCHPVHHCVQHETCCFDYIYPPHIYYQSIKGAETGGSSSHYDLVDGVSVMHYAVKKEDVAVYQPCDLPGIGEHVRPG

SEQ ID NO: 928110 - protein, 143 aa, Homo sapiens
MKRIWGIIVAIICSFEEQKVSGKETSYQQDRQQDKPEVKAFDGNIPWVHFDSVTLGHNCLNSGNYGPLIPCPTSVTLYAPVEATRDQKPRAPEPHVAGGYWIGQHSTKGITNFFGKQKRLVVPYMARVKSAQSGMDGVPKVPV

SEQ ID NO: 928111 - protein, 136 aa, Homo sapiens
MYFYWWRKEKDLIPALDFAFLKTTHLTFICSHFGKQGLRHLGPFHLLLDLVINGSCDVDVGAVHLNRENLKPTELSPNHKFPCADALSCSLLDPAVCRSRERCNRQCGLCDKWYEETEIKEDLNLGHPAASEGTMI

SEQ ID NO: 928112 - protein, 159 aa, Homo sapiens
MIEASFSISEAEQEILSTPSSHRQSIQAGRGSPRRWRHCLPNFRNSAVHGLLSDKPLGEPATGVLPPQYQIEDWVCTSRNTVKNAHPTLLAKGPSLQHGYHQVPQPMLWPHGRPRISGAKAHSPRDPANYAKCQVLAQAEVQGEWVCEWQVAERPLEES

SEQ ID NO: 928113 - protein, 195 aa, Homo sapiens
MPVGLLLYRVSDNPYWRVSVVWHGEQDPFNEALCPLVESVCFALGKPTCLGCLDSSELPGREARSAGLQRLQPPLPIEAQAQGDPNSVPEPLAGVIGDPAGKPCPVRKDGSGLALKRHSSCRLPQPMCSVVGTSLGMKPSSFLGSSRERVQPRVIEIGASLPQTRELSMPGSCESQCWPPLLQFSRLKKIPAERL

SEQ ID NO: 928114 - protein, 171 aa, Homo sapiens
MSADSAYSLVPCLLTSSYYSGHGQPQIPHKAKLSMMTRQYRVKEFRGRRACPSSQGSLHSGDSIRGNQNKFLIRENKQYQPTDAEASKHTPLLASPPSSSSFPPITVQVVNAPQILIWNEGMTLLFLKDLFLPLENDSVEYPPNGLYSAMKIKEILKYVTAQMNRKSIMLS

SEQ ID NO: 928115 - protein, 166 aa, Homo sapiens [sequence omitted]

SEQ ID NO: 928116 - protein, 206 aa, Homo sapiens
MFPFLCPSVLIVQFPPEKPEAVLSLEDFFVIPYLSYCTYTFLCLFSVQLQKNPTSLKFKRQINHLLPKFGGRIFVPAGCRCWNDAVNQLSPASLGPAFLRAVFTLGKLAKHVHRRQGGRQPLLGNLWPTKTAQQKESTSFRKLPSEAPEWVSFTWLCFMPNPDPISVLSGSASGSKPTSSSSISFDYQGGGENVLRQQLFTFPYLW

SEQ ID NO: 928117 - protein, 146 aa, Homo sapiens
MVRSAGFPFAFRHDCKFPEGFQSCFLLCLQNLCTQKPMPKPCMTSEPPAPFSEDRLRQAQEGRLVGRADTELKFLVLHLSLKPHSSQDIPKLLVSMRDLRYTESNGFSQSSTLIPTQCHFCSNNNSMTTNGCVNLFSYLEYRTVPK

SEQ ID NO: 928118 - protein, 251 aa, Homo sapiens
MNFEELTLNRKNAFSGPLAAGLLEFAGGPLQTLFAWVSAAEAAEQRILESSKCCCLIVPLEFLSQRITRPCEVSVCPYWGCLPVRLLGGQGPTSRGSLSILSSPAVCWENHYSLQSCQTGTFKSAEDSAAFCLAIPYPQRWSLQRLAGLLELQWAPPNCCASDERGSVGIGPSEPGTGYNLLVCRLLRPLEKRSNGERASSEYLGCWLYRYYIGDRSITAGEHKSKIPRQGEPRDLLTLHPSSWSDYMACV

SEQ ID NO: 928119 - protein, 145 aa, Homo sapiens
MHENGGLSQKHQFFHELTCEESRLHTPYKNPMPDDLRWSSFIPKASPDSLSSTMEKIVFRETSSWCEKDWGPLPDVDVLSPHLCSNCRSHPQLFSMALPSGAVRRRPPFSRPQNGRSTNSLHRVPGKATDTQHQLVKADRWRAVP

SEQ ID NO: 928120 - protein, 204 aa, Homo sapiens
MKVQGEAANADIEAIEWELLPEVTGLSFRILEDQDAVFSGEIIDSVMVNIECQLDWIEGCKVLILGVSVCCSFLEVHFSPCLLGYHQWRLQNSKNCCLLLLLEASSQKGTGLMPAEALLYEVSVDPYQEVSPSQEAQGAGRQERLSLLKLPLQSPLPPGALSQGHENFACKPLPGDAGFPAEIPCPVRRNPEKQSGHSRFAVLW

SEQ ID NO: 928121 - protein, 145 aa, Homo sapiens
MVNAAVNTYGAAPGGSRSRTPTSPLEELTSLFSSGRSLLRKSSSGRRSKEPAERQTQGKKTAQDLEVSLGPEMQRVLRSKLHMEKSVKEDRGSRWAQALGFMDSLSHVESCADLPLFQLAMGIAQIFPSARKTNLIHPHPPLCHF

SEQ ID NO: 928122 - protein, 125 aa, Homo sapiens
MASEWYKSEDGRKVHNRCCLPDGNKRVFDWLPSNSSARAVMMKSKRKWKVKNRVRVALSTENAPQIHCTKSVPIHGMADSRFVITVAPQNDIWPHGSSEENNMGTIDSCQGGGNKSNKKGTGIGV

SEQ ID NO: 928123 - protein, 135 aa, Homo sapiens
MPWELGLLNDATWLPGFSLLPRKMDGSPASLEFPGPEYAKAPGSPCMPKQPQEVCTALCFGPKALVAWAHVGCHPTLLFLTLHRLHRLPSQCQCENLDTSVEGIEFTSHFFPLLQPCGLQLLLIGHLGPPLVIYS

SEQ ID NO: 928124 - protein, 138 aa, Homo sapiens [sequence omitted]

SEQ ID NO: 928125 - protein, 139 aa, Homo sapiens
MRLKAQGHSHMNAQALLEEGDAGSSENSSEKSDMLGNTNSSVLYFILGLHFEEDKKALESILPTAPSAGLKRQFPDDVEDAPDLNAPGKIPKKDLSLQRSPNSETEESQGLSLDVTDFECALCMRVFRRIEDLIISDHR

SEQ ID NO: 928126 - protein, 172 aa, Homo sapiens
MVGTPPPASLPPCSLISDCCASNERGSVGVGPSEPCAGYNLLVRRCLALLRLMVSALHPLSCTHFPTLPSEMNWVPQLEMQKSPIFCVAHAGSCRLELFLFGHLAECFKECLNDSLLGQRGSRGWSWNLNCRLCDSGGQIPTQKEGPQKSWKEQPLPKWPSVAPPGMFRRSP

SEQ ID NO: 928127 - protein, 145 aa, Homo sapiens
MIPAIPLHPSPEVPRAALSLRAGGPVVQAGAVPAVAAAGFGVAFLRSATPGTLTFCFPGSKSAVCSSALTCHAVQGASTDPSGQGHTHWLLSIARPWSWNEVGGVYLSLPPPRCLLEEKTVSLCARALAGRCCGTAQGMAKSSFR

SEQ ID NO: 928128 - protein, 135 aa, Homo sapiens
MWLVPRHHAKRISKDWQPQWQGSIKGSFQLLVGVGVWCVHWQSMVSWARHMPCHSPEQWAPQELMFNIKFHAGAFTLHAANTIERCRENTAEDWKKLMLEQITQCGRFALQCAESTDVPNMAQLKRREEVEAWRA

SEQ ID NO: 928129 - protein, 134 aa, Homo sapiens
MGTGLMWKVESWCPGSNEKAPVAPREKGDDYDYSPSCMQLLWGSLSLYLEDSRSQDCHGLTRLLPRPESPDSPCQAIHLSTSQLPHLQNGYTVRLRGSGVGPPSPAVLAPALLSSRSCPLQTAPTWCPAVLLPL

SEQ ID NO: 928130 - protein, 134 aa, Homo sapiens
MKFSISLIISAKKPGKIWENSLDSQAETCSLCLLSFKQTESLSFSFCLCAELPGAGEKAHGNYCLPTAYDVHSRPKGSSVSLWGMLSVLSLSLQGSRLPSGPGEVQKYCPGAKGYDWKESLSIAIIAGNVLGHT

SEQ ID NO: 928131 - protein, 165 aa, Homo sapiens
MDSIPQGFETQISILTQFCRDFQRAGRQIITSKKWPQFLPGEATSQKVIQLLPDSPSWKAYPWSLVTMLRGSPGHVERPRVGVSANSPSEGPSWSRHGSWDMCPTGHRKRGEGEQALGCGRWVPGGHSPQSLPLADDVPFERHQVTAHSMQAHYLKALPHLETLQ

SEQ ID NO: 928132 - protein, 147 aa, Homo sapiens
MADRRPLRGHLAVSLALYLTISTLSGTADAMDFRDLKSPAGLQVLNNYLADKSYIEGYVPSQADVAVFEAASGPPPADLCYALRWYNHIKSYEKEKASLPGVKKALVKYGPVDMEDTIGRGAKDSKDDDDIDLFGADGRRKVKKRRG

SEQ ID NO: 928133 - protein, 144 aa, Homo sapiens
MMTMAVLWNRKGGKNLAQEYRGVGKGRTFGTTAATRNKDKDGLGQARGMQGPETRIPDFCSISGADGQAEGLPSETPFIRSSDSPKRKWWDKIVNAKRYGRPPPTTDNWSYGIVTVSSAVPRAVAFTRSQAPRCSGSREDPARG

SEQ ID NO: 928134 - protein, 136 aa, Homo sapiens
MLLSRADSGILFPTAEPAGLVAEVRSRLAGSRALVPGRLGRHCAHLGSSRASDVLSLSSCYPLQVSADLRSVLSGSLQQPSCLQLCEFSNSLPSVRKGWQLPKMINGEGKQDEGSKWSLPVPLGGNCKCKPLQKKV

SEQ ID NO: 928135 - protein, 146 aa, Homo sapiens
MEGRGCRVPPKGVFLAPNKGQKLAQSISGLRNRVKRKGKGLFSHGIGSKVRVRRDVTMNTEVGVMWPQTKEYGRLLETGKGMETDVSLEPPEGMQALILLSWLGSEKFHKAVSSELLGLYPRQAEDGTITWAKSHPPNVLLPDTSP

SEQ ID NO: 928136 - protein, 256 aa, Homo sapiens
MRPELPIMNWVLSEMSHAQKHSIIKWKWYICDQTQAGPEVTSTTRKWTAAELQPLYRTSLKDSGEGKSSQWAELQDSQDRSRNQGVKVKVAPLTITPSDTTAKFLLHVPAALHSAGVDVLVPEGGMLPPGGTTTIPLNWKLRLPPGHFGLLIPLSQQAKKRVTVLAGVIDLDCQDEISLLLYNRENEHISSSDAIQSILAASLSQMFGNTSGPAHVYLGNNWKPQAFYLGKALEPIPTWRTTNPHYHVGHSPGYAE

SEQ ID NO: 928137 - protein, 147 aa, Homo sapiens
MVFQPVLGLRWGHREPLNSHPLQVPPATSQRGPEGPAALSGATEPMAGSSPDQAYLTFPKAPEGCQGHTTASCKGTERQFASAAIRVCLPGERRGKPSLLHRLMEPTSFRTLLCPTERTAPECDFIFIAASPLLGLQFPISTLEHEL

SEQ ID NO: 928138 - protein, 142 aa, Homo sapiens
MSGVLKGCDTFSSAALQNLSQAIVCSSNPVFQGSPAPGPWTGTGPWLVRNWARQQEDHLVARKQAQGSYMMVLITQCSHFPSTVGFLSTYDETPWSALEEARGVFIWMWVKGGQGNSTGKLFLLLIEHSVNVYVTSFAFNFY

SEQ ID NO: 928139 - protein, 134 aa, Homo sapiens
MGAACRDQLAVALNPERVLTSSEVPAVWPPTVWPLSAPGAHSSASLGAVTTQPGVHVLRPVLTCQPPATLALLGLWVLTIMGRRCPQWKPLVMHLIQPQACMKPESVLASGADYPTAAADVPGCAQWPDPLLAH

SEQ ID NO: 928140 - protein, 341 aa, Homo sapiens
MGNKLPICCPLLEEGINPEVWALEGQFGRAKNARPFQIRLKDPTTFPYQRQYPLRPGAHKGLQDIVKRFKAQALIRKCSSPCNTPILGVQKPNGQWRLVQDLRLINEAVIPLYPVVPNPYNLLSQIPEEAEWFTVLDLKDAFFCIPLHSDSQFLFAFEDPTDHTSQLTWTVLPPGFRDSPPLFGQALAQDLGHFSSPGTLVLQYVDDLLLATSSEASCQQATLDLLNFLANQGRPRANTHLVEREPGAETAFKNLKAGPSTSSSFKPSDRTKLLFVCHRGARIALGVLTQTRGTTPQTVAYQSKEIDVVAKDWPHCLRIVVAVAVLVSEAIKIIQGKDLTI

SEQ ID NO: 928141 - protein, 138 aa, Homo sapiens
MSNTELRIVPKPTLPSAFHTNAKDFVTAISCPAVFSDSPSLAESDSNELRWTTKALRYPTPTYSRTNSISQLKLKNLPQSKEVLIHAATAVIKVLGRGANLSLLTEFIPERAAIGQNIIGSQKFLRRIMNDVKKNVLV

SEQ ID NO: 928142 - protein, 145 aa, Homo sapiens
MCPEFIPSVRTIPPLPPQPTQCEDNEDEELYNDLLPLNELKKTPNHTAYQPEEKMTQWLPCLPGTGCYSCVPLRPRGPCVEISLRNHCCPPKSNASAAHSPAHWMHMQSRFKSYKKAVSDKSLSHSCPPVAEYHSLQAAHASNFL

SEQ ID NO: 928143 - protein, 188 aa, Homo sapiens
MWNCQLLDSERIEAEGRNVMPENDYEVSHHKVDKAMQREGGNQRSELYYLLSVFRKEGSGFIINCDHLGLTAGPVYPGEDIPWLGCIALSLTGLLIQFRRESPPNPTCKCDPQCWRRGLCGVQSDFTACPCIRPDLVLKSKASKRFNKVKTHEMSYTRLYLPGLQAGKLLLPGTSVHSSEEWDLEIKM

SEQ ID NO: 928144 - protein, 160 aa, Homo sapiens
MQFNLALFGNTMPVNLAFCCHWLEATAFTQPLVLELTSSLEETKISVYAATLCSWSIPALQEQSQSSNTAPSTKLFSSIYGSPLNSFLRKAKNPHWLSSTFGFICPASIVFKMWKWQFSGAKKSLLEFLVCKQQKATRVSLKQANEKNNNFFISRKRNKR

SEQ ID NO: 928145 - protein, 163 aa, Homo sapiens
MYLVIGTKKQERILLMLLPGELGGVPGNKAHENVHGLLRQEPPLSSNCNKVAPPPPWLLQASLFPVQQKQHGWMQQALNQGQIRIPLRMCCCSTLGMARVFTLHSHCFLWTFKKEIILSAPFTLLSVPLHAQAITFHVSKFSLRLPSPHAAHTALRGHVIIGP

SEQ ID NO: 928146 - protein, 241 aa, Homo sapiens
MILGQLFHTSHFGKTVLGNTPQAQPNDETLPTGRTVAENDTGKVEKVTELLIYAAVPTERPEKLTVSHGSDLFHVKAFCTCHHLMEDSMDMDTSTLRPQNYLFSCELKANKDDHLKVDNDENELKLSLKTVSLVVGAKDELHTVEAEAMNYKGSPIKCGSGPVHISGQHLVAVEEEAESGDEEEEDVKLLSISGKQSAPGGGSKFPWKQVKLAADEDDDDDDNDNFDDEETEEKVPVKKSI

SEQ ID NO: 928147 - protein, 332 aa, Homo sapiens
MGSFGPCPALCPGAALHPSCLQELSTPHSGEGVTVQWEHLELLTPGANAWHEAQRLPLTSWEDFHPIMHGGGGREKGGGGDEEEEKEENKEEEENEEEENEEEEEENKEEEENKEEEENEEEENKEEEEEEEKGGGGEQGGGGGEQGGGGRGEKGGGGEQGGGGEQGGGGGRGEKGGGGGGRGEKGGGGGDEEEEEPLICVTFHWNVCGRRPESLWQTTGVSSRVQKLKNLESDVRGLEASIMGERWRPEDSASLVLPHSSACFILTMLAADWMVPTQTEGGSASLSPLTQMKEDNQSAMKQEAALTGHRICQCLDLGLPSLQSCTKLMFVV

SEQ ID NO: 928148 - protein, 130 aa, Homo sapiens
MTQVTEITGLTQGPRTGHILHFSKPDNGSLVTDIEGVTGKSKCPSTLDILHGCSDAVLAKPSFTNGLESSHDTDIRTFPVSMGMPVTLTQSQEPAQQAARARRRVGPGSQPRSRKFSRLGPLGCSHPPGP

SEQ ID NO: 928149 - protein, 131 aa, Homo sapiens
MLGSDGHSSLSATCPLQWTAMPKDFSRLQANVDSKGKEPCKYDGIPPKTQDSVYYAKEEKKKTLAEPLVQRGAEGDVYKAPTPSKETQGALDVKEEHNVQLEVPVDQDILGCYLYAKYTVVTRMLLWLSGL

SEQ ID NO: 928150 - protein, 132 aa, Homo sapiens
MIIISSKEKELPFFILWWSRTDGLNTMQVASLPLSFRFCGTRCDRYQAGMGHSLIHLVVHEAVVRCWQHAKHTPLARDTKMSGVEAQKSRFTLQTCVQPERGGLCGQQATNHTRMCFVPESGAKGLPSTLQG

SEQ ID NO: 928151 - protein, 160 aa, Homo sapiens
MPLFAEHTSKSGVATGTECIRASLAAALGCRWQCQAPRCSLGTCACCFALRLRMSPIVENRAENMQHTVRRVGEGVNGLLSCVLQQPDAGERARGSPDGVTGGLSWWEYEKAGESMGSCSMISERSQLCHGITRFVPRLLGQSSASGCHLLPEAVNGTVV

SEQ ID NO: 928152 - protein, 182 aa, Homo sapiens
MGSSSPKSTLDFLSKIPPTGSCLKFMPKLYASEISTLLMDLSIFNVKGVLKYARCLLSALSFLCCPGSTATFTELAGEMKAAPASDSLLSTPCQNLSCGPNFLVQQGVFMYGPLHTVAWTKDNDDRLAGGSNHFNENSPWQLGSSQAHISLAKIWPVDSSLIDSNNFEVSSRSEIENWPYVS

SEQ ID NO: 928153 - protein, 136 aa, Homo sapiens
MEVEIKVSTGLVFREGGSVLDIALRLEDAIAALRFRVFLLIILESKELFKNRITGSDPGNEFFRWRCKGRGREACGKMSTATETCLRKFKNASLGQWGPGGQEWSPCTTWGESMVSSPNNIFQRLPGRLMNKPFLC

SEQ ID NO: 928154 - protein, 135 aa, Homo sapiens
MLFELSLRQSSGRPGASAVSAVRSRGACDSLGPVKSRCRIQLGVGFQKESVRDERPPASDISPQSLFHLQLPGGSLSGVTLKPEDVALLLGFRAGYKLVSRRASAFVLFCLLTGLQCVEFEFTLFHDDCTKFLQI

SEQ ID NO: 928155 - protein, 131 aa, Homo sapiens
MRELSSAEVAITLENPGMENTACLRCPGMVGGDVMKSGTEKGVRGDTFVPLEVTVHRATGFGCLSATLKPPRSLHREPYLGNATSPVPGQELHVLLGKAGPLSRECFVLLEAPTFLILLASISFSCEHSVQ

SEQ ID NO: 928156 - protein, 158 aa, Homo sapiens
MILVFKFNSVFSLGQLNLLNDHWLLSMIRPQNAKDSTANGMQNTENPWYEWFRELHKINAFDTPDSLLVRGKEFVDSIHNTFDHMWRTQEHNEAGWFLLSSLDKVMKENDELRDSNSCLQKQILSLKSKIALSQSLISCRERADIVANQTEALIIPVT

SEQ ID NO: 928157 - protein, 167 aa, Homo sapiens
MSRTCWNLQSPTRPGPGPITHCSVLQTTKHVSAASTTYCSLSHPQSLILRETGNSQLDAWRHLIPESHSTTLSYPWNYLPPPGTMAASVSKQLLCFSDNSPGPSKRGNYGIYNSRQDLGGDTAKPYQNWCIQRRLTSQAGLHGTFIQTVSETQRARRFHSTVAGEAY

SEQ ID NO: 928158 - protein, 168 aa, Homo sapiens
MALGQTKTLAFTYGHLTTHVAGSHLVGCHGGEDPFNEALCPLVEKVCFTGGKPTHLGCPDSSELPEGEAKSVGPQRLWPPLPIGAQAQEDPNSVPEPLAGDPAGKLYPPGRMGQVPVLTAALPLMSSKGLESRQPQPVLVAPPPGSSAGLSRLQLRGCKNLCLLGLGC

SEQ ID NO: 928159 - protein, 137 aa, Homo sapiens
MPAASSVKKPFVLRSKMGKWCRHCFPCCRGSGKSNVGTSGDQDDSTMKTLRSKMGKWCCHCFPCCRGSGKSNVGAWGDYDDSAFVEPRYHVRREDLDKLHRAAWWGKVARKDLIVMLRDTDVNKQDKQKSQIKIAKF

SEQ ID NO: 928160 - protein, 134 aa, Homo sapiens
MYGCMCQSGFADNGNWENIQRLLLNAHSQKSRFGSRLEGGNCDVAERNKSAPQPAGIRWGSEVKPQHRNGLNIPALCWYKSLCIPCVSSQCRCHEPSIALFSPEKFLLFNCLPGRLGCQKKMPFIFKFSLSFQS

SEQ ID NO: 928161 - protein, 151 aa, Homo sapiens
MGKWCRHCFPCCRGSGKSNVGTSGDQDDSTMKTLRSKMGKWCCHCFPCCRGSGKSNVGTSGDHDDSAMKTLRSKMGKWCCHCFPCCRGSGKSNVGAWGDYDDSAFVEPRYHVRREDLDKLHRAAWWGKVARKDLIVMLRDTDVNKQDKQKR

SEQ ID NO: 928162 - protein, 176 aa, Homo sapiens
MGVQPCLGQLHCGVFLFPGHLWPQQRAPATLNWGPTLGIPSVSSQVLGTMLSLLPPPGFWALAPTSPNPMLPAGPIAIPALPPSAHTHSSGSETLPCQHQAPCYGLAHPFQGQGAAPSLTGPRHRRTQAQGASGISTALKEWTDASGGKIRCCPKHEGKFLVQSHQIRRSQWSSKD

SEQ ID NO: 928163 - protein, 155 aa, Homo sapiens
MDLKPETKKGLREKLDPIETNEIANANSHQQIQKLIKDGLIIHKPVIVHSQAQCWKNTLACRKGRHMGIGKQKRTANAQIPEKVTWMRKILHRLLRRYRESKKIDGHMYHSLYLKVKGNVFKNKWIVMEHINKLKADKAHKKLLADQAEAPRSKT

SEQ ID NO: 928164 - protein, 435 aa, Homo sapiens
MRLVAATETAAPPEQVGWRIEGDSSCIGIGASGGSSSKSGDLEHCRTQPDLGWGGTCRRCFWTSSRSDSLPAPPPHAAAPTSSRGIPQVLTHPDVESHTTPVPGSGLPVAGSRATTTLTAGSLTAGDLRRPGGSGHSSSRTTRPAASRITGYLAAGSAEQQILALYTPGQFLTDSPLPPISEFKGPLPLHPLSASRTPSAPMQRAKGACPVMETLRVQEQRQTHRTEGHKTCALAHKEKYMAYRVHYPTIVQLASYQRAAGTVQAPSSASCPPLQLTIPLRTGHSPHPKLLPLLDVPAGATPQTGPCPDSAPFSSPFLSPMSVPTPRPVLSAQDPRGSDGQISRGTWSSHSTPQDGTHPESMWVGGPFPGPRPTGLLSQPGGDGRVTGTSPSTHVDTQLGMYSHRAGRGQVAPKLSDLLQGHKSYWIRAHPYDLT

SEQ ID NO: 928165 - protein, 120 aa, Homo sapiens
MHSRAIMREPCKCLVENLEHSSFVTVFPNSWAWEQLCGRRFCGDITLENSDYEIPLLERYSIPSCINSCIDVPVTIAGICDYSGLYNKGEIKVAGTNHSNCCEQKVTSLCSLLLPCKLAN

SEQ ID NO: 928166 - protein, 141 aa, Homo sapiens
MKLPEEGSGSNICCSAIFAVLQPPLVIPRQTRSGVDLQQTPTDLQLRVLTVRRKTNKQKGYPHQNPVYKWLTRINSVEKSLNGLMELKTTARELCDTCMSFSSRFDQVEETVPVIEDQMNEMKKYREHHKDTPQEEQLQHT

SEQ ID NO: 928167 - protein, 143 aa, Homo sapiens
MSCWYSGIVFPGPSGSLLCSPGPLHTPCSQHHEPVGISAQIFISVLLLSSWTLSALLQEHTAWKKNFYQLGLKETDTTQNGKYYQRPQQSLGRRQPENAKNYKWDHSPWTGRLRRQSQCHGEPFPEAGLQSCGHINYRIEVDQ

SEQ ID NO: 928168 - protein, 223 aa, Homo sapiens
MPKAVTQHGSVSTAVTQHGSVSTAVTQHGSVSTAVTQHGSVSTAVTQHGSLSTAVTQQGSVSTAVTQHGSVSTAVTQHGSVSTAVTQHGSVSTAVTQHGSVSTAVTQHGSVSTAVTQQGSVATAVTQHGSMSIAVTQHGSMSTAVTQHGCSTQNSHLGQLHKGLLKPSPDLIQCAVAEDHFLMFARMRGMRLAGTPTVRLGPTQPGSRVLQGSALPRSRKSSI

SEQ ID NO: 928169 - protein, 158 aa, Homo sapiens
MPSSQEMGQGRAGTPGLGALQEQASDCAGSAIPFLQGWQAAGIPPRWLPQDAACWASDPNVLGPPQALWSVALRWPCSNSASQALTAGVGRVIQGGLDLESLHPECSAPGKLGIHRLDSGRMPGERRPGWAFTCCITPTKGIGDGNLAEDPVLSHRFL

SEQ ID NO: 928170 - protein, 402 aa, Homo sapiens
MMVMVVVAMVVVVVTVVVMVMVVMVVVTVMVMVVVVMMMVVVMVVIVIMMVMVMVIVMMVMVVIVVMVVIMMMLVTVVMVVVLVMLIMIVMVVVVMVVVVVVMVVVIVVVVVMVVVVIVMVVVVVMVVVIVVVVAMVVVVRMVVMVAVGDGGDGGGSSDDGDGGDSDDDGGNGGDMMVVMVVMVVVVVVIVMMVIVVTVVVVVGMVAVAMVVVVTVVVMVAVIVMVMVVVVGMVMVVIVMMVVIVVLVMVVMTVMVVIVIVVVVIIVMVAMMVVVVVIVMVVIVVVVVVVMVVVVGMVVMVALGDGGDGGGHGDGGGHGDGGHGGSDRDGDVVAVMMVVVIVVVMMIVMVMVMVMVVVVVVVFITVVKTVLQIVEAVESLTLEYKDLHFGGGKRIFTSTSPL

SEQ ID NO: 928171 - protein, 143 aa, Homo sapiens
MECKLPAVGRSWAAGPGDGSAGVSETSPATLLHSACTAFLVQVPAAAAALWVPLPLGSCSSTSMMTLFLYGVFGLFLDPVLLSGKLALGWALLLCPLFLHSEHKASALVGAADWELLLGPRQNVSSIPFLVPTARLDIDKARC

SEQ ID NO: 928172 - protein, 143 aa, Homo sapiens
MTPNSTRALQLKFFSPTADSFFAYAGSFIPQAQCSPPPQSQDHSGGVQEGTGACTQGSGGLLQEAALKHLPLGLAGGSFHSHRAPAFCGPSPGFPLDGGGSLSFLICKVGLVLTERSRVLQQVLAIRSCTQWVSSSASQALGQ

SEQ ID NO: 928173 - protein, 150 aa, Homo sapiens
MHVLKYAHLFVKDVVVFGRYTYAINYGKALNKCNETIFCREKHKIKTKKTEAKTELRLYLGHSALKVLQPDSNSSNSGGDGSTPGEDPRIPPPTLPSIQLLEWGTLLKGSIMQITNKYMKRCLTSLVIRKLQIQITMKYYCTPTRMAIIT

SEQ ID NO: 928174 - protein, 118 aa, Homo sapiens
MGKLHVSGVWCTDDFLMQVLAVLLYSLNSLWPSLTAGLILLTLSPTFVTVLGEKLGMTDCGGEWRWPAEVGPEGAPNTACELPTGTDRRVCLPHAGVGDFAIPGSWDQSLVDTKRQLY

SEQ ID NO: 928175 - protein, 150 aa, Homo sapiens
MCVSIKGKVLQTAAITHTLRAKDNGRRCSSWTPMCTGTRTTDSPHLAQQLIPRGHTGGPGLLSEDMPLPHNTYPKLGLGIGVGIPGSLMVPYEGQAGHLRNSPLGPKAQNMHGLGAGHALLTLDGSIRLLEGGSSQLPRWQAPPRAISLL

SEQ ID NO: 928176 - protein, 249 aa, Homo sapiens
MALMGGIGFIHHNCTPEFQAKEVRKVKKFEQGFITDPVVLTPSHTVGDVLEAKMRHGFSGIPITETGTIGSKLVGIVTSRDINFLAEEDHTTLLSVGSSRPDLVAMITCTDLKKNRDYPLASKDSHKQLLRGAAVGTPEDDKYRLDLLTQAGVDVVVLDLSQGNSVYQIATVHYIKQKYPHLQVIGMTAAQAKNLIDAAVDGLRIGMGCGSICITQEVMACGGPQGTALYKVAEYALCFGVSIIADGGI

SEQ ID NO: 928177 - protein, 165 aa, Homo sapiens
MSNTWQAIFRGACGRQSSPASGFVEIKESPFSVSESQIQGVSGKLGSTLEKFVITNLLKPTSVNSSKPFSIQLCSIAGEELRSFGEEVLRGGAANLHWSWVTRKALGTTRWGVPGGPGSSVSTVESPHLVPPQPAEAQARQMEEVAGALLHPRTQKLVRAQPRGL

SEQ ID NO: 928178 - protein, 145 aa, Homo sapiens
MHRAQGERASVDEEVDLCSSRYAFSEMYSHTLAALWSLGCPLVTGLQHYNPSMHGTEGACANQWRKERGSARLSGLGGRCSLINTHSPFVTGLQRYNPSMHRAQGKPFITGLQDYNPSMHPAQGQCALLEEKARLWTPPSASWER

SEQ ID NO: 928179 - protein, 1996 aa, Homo sapiens
MDKNSDPLRSALEFYLREKQSEPSSSVLESYMRDIHSDHSSSVLEPYVRDKHSDHNRSSVLESYVRGKHTDTCSSVLESYYVRDKHSDPLSSVLESYVTDIHVEPSSSVLKAYVRDKHSDPRNSLRESYVRVNHSERRSSVLEFCVRDKHSDHSSSILESYVREKHSNNCRCVLESYVREKHSNNCRCVLESYDKEKHSDPPRSVLEFYVREKHSDSCSSVLEPYVTDLLVDSSSSVLEPYVRDNHSDPRGSVLEFCVRDKHSDPSASVLESHQYSGILCGGKHSIIAVFRNPIVLEFPVRDKNSEPSGSVLEFPVRDKNSEPSGSVLESYVRDKHSDSSSSVLESHVRDNHSDHHSRVLEFCVRGKHSDRRNSVLQSCVREKHSDHSKSVLESPVRNKHSDPHSSVLESYLMDKYLEPSSSVLESYVNPDSSVLESYVRDKHSDHSRTVLEFPLRNKLLDPHSCVLQSCVWDKISKPRSSVLESYVRYKHSDNRSSVLESHVRDKHADPRKSVLESYVRDKHSDNRSSVLESNVSDKVSDPSSSVLESYLRDNHSDTFSSVPESCVRDKHFDHCRTLLESLVGNKHSDPRSSSIIESHVRDNISERHSSVLEYYMSEKYSNILGSVLESYVTDKHSDPRRSVLEFYVREKHSEPSSSVLESYVKDIHVDHSSSALESFVTDKHSDPSSSVLESCVRDKHSDPSCSVLVSYVMDSHKDPRSSVLEFFVRDKHSDIHSSDVESHVSDKHSDHSRSVLESPVRNKHSDSRSSVLESYLKDKHLGPSSRVLESYVRDKYSDPDNRSSVLESYVRGKHSNNSGSALESYVMDKHSDPRSSVLESYERDKHSDPPDPHSSVLESYMSDKHTETSSSVLEPYVRDKHSDHARIVLETYVRDQHSEPSRKVLKSCVRDKRLDSRSSVLESYVRDKYTDHSRSVLESYVRDKHSDPHSSDLEFYVRDKHSDIGSIVLESNVRDKHSDPHSSVPESCVRNEHSDHSISVLESPVRNKHTDPRSSVLESYVTAKYLYPRSSVLESSVRKTIQNLVAVLWNPIVLEFCVRDKHSERRSSVLESYVKDNHSDHRKSALESPVRNKHSDTSKSVLESYVTDKHSDPSSSVLEFYVREKRSDNHSRILESYVRDKHSDLSCCVLESYVRDKHSYNSGSVLESYVTGKYSDPRPSVLEFYVREKHSEPTSIVLESYVTDRHADPSSIVLESYVTVRHVDPSSIVLDSYVRDDHSDPRCSVLEFCVTPINLHPSSSVVESYMMDKHPEPSSSVLESYVRYKHSDPSSSVLESYERDNHSDPCSSIVEFCVRDKHPETHSSVLECSVSSVLESYVTDKHLDGSSSVLESYVRYKHSEHCRSVLESPVRKKLLDPHKSGLDSDVMDKHLDPSSSVLESYVRDKHSEPRSSVLESYVRDKPSELSNCILESYGETNIETTARFRVLESYVRGKHSYTHSSVLQSYVRDKYSDHPSSVLESYVRDKYSDHPSSVLEYYVRDKNADSRSSVLESYVRDKNADNHNRRVFWNPMGGINIQKTARASDILRFGQTCIPSSQCSGIYVRERHTEPSSSVLDSYVTDIHVDPSSSVLESYVREKHSGTSSRVLESYMKDNHSDPRNSVLEFCVRDKHSDHSRTILESPVRKKHSDPRSTVLESCVMDKHLDPSSGVLESYVWDRHSEPRSVFWNLVDKHSDNHRSVLESDVRDKHSDSCISVLKSYVKDKHSNNRSSVLESYVRDKYSDPRSSVLESYVRDKLSDQSSNPHSCVLESNVTDKDLDPSSSVLESYVMDRHSDNRSSVLESYVRDKHSEPSSSVLESYVRNKHSNKQQRDFPEFYVTEKDSELRSSVLVFYAMDIHADLSSSVLDSYVRDKHSDPSSSLLKSYMRDNHSVPRCIVLEFCVREKLSDNHGSVPESYVRVKLSEHRSSDLESPVRNKHSEPCSSNLESDVTDKPLDPSSIDLESYLRDNHSDPLSSILSSYCSGIRCEGPTIRQS

SEQ ID NO: 928180 - protein, 139 aa, Homo sapiens
MVFPWSWLLCGLGSPPTTPAKLCVVALVSGLLAGGFCPCTALPACSPRRHLDVQPLVSSADVFLWTSSHLCVCVLMLRFQGFHRHRMGVWWARVGLGNATFGHEGRSACPHLGLWVHGKLSSPKPVPGVKKVGDCCSRQ

SEQ ID NO: 928181 - protein, 149 aa, Homo sapiens
MFLSFVLFVLHLRMHCPIQASEVAGSTGTCHHAWLIFVCFVETGFRHVAQAGLKFLGSEEKQSFSGIFVRSCFTTWGKELTEVRLLTFQGNWEIAVLSSLMCRFQSDGPKPWRKTFPGHKIFKRLLDRFTSQRNSDYKFPKLLRMGVYS

SEQ ID NO: 928182 - protein, 249 aa, Homo sapiens
MGRFRSSSSLGPQAAYSYLALQGSIERVARGAEETTQMRRNQKTNPVNMTKQGFSTTPQNHTSLSAMDPNQEEIPDLPEKEFTRLVIKLMREGPEKGEIQCKKIQEMIQEVKGEIFKEIDSLRKKQQKIQKTLDTLLAMRNALESLSNRIEQVEKRNSEPEGKVFKLTQSNKDKEERIRKYEQILQEVWDYVKQPNLKIIGVPEEEENSKSLENIFGGVIKENFPGLVKDLDIQEAQKYLGILCKKVFS

SEQ ID NO: 928183 - protein, 141 aa, Homo sapiens
MHMRHAAELQWLISDMHQQDREGQPTADAEYSRTNLEGVQTLLEKMWVSSLDTRKVLNFGQTTADPSSLASERPPAGCRGSTTLSKCIQGIPGNWWGRRSLERTVCGSSGFQRVLCKDNHQTEAAMSQRDKGWAGDWGRLY

SEQ ID NO: 928184 - protein, 184 aa, Homo sapiens [sequence omitted]

SEQ ID NO: 928185 - protein, 120 aa, Homo sapiens
MCLQISQCIVKIPMHELELTRTCSQAIFWTEQPGRRWVPRAAAPGTPCLPARVTGHRPGCEDEEASLLGSTLTASPREKPQAQEATLAMSWRTYYLYTEWKPTKCQLDRWTDSGCQDGCC

SEQ ID NO: 928186 - protein, 145 aa, Homo sapiens
MWAVGAADRLCVQESERRAPAAAGCQPSNGSQGPREVVLAGDGSSDAKASAKEASPVPPGEGTELAGAPGLTRPTLPGHRGGIDGTRAPQLAQHGHCWVLEGGVGMSLQPELLPNRPLNPKARVPMVSLCPGHPGLQCSWAGRGT

SEQ ID NO: 928187 - protein, 139 aa, Homo sapiens
MPPAGLPSTRPDLKEKKEVVEEAENGRDAPANGNAENEENGEQEADNEVDEEEEEGGEEEEEEEEGDGEEEDGDEDEEAESATGKRAAEDDELRCSSCGGTVSDFVGGHCVVLNLKNRKETGLGSTSQRPWAVELGVPG

SEQ ID NO: 928188 - protein, 146 aa, Homo sapiens
MTAVALPITPAFLPARKRNEEDVAKSRHLLSLKEDSQKLQHTLSLTSHGLSLGLGLYLAVSIQSAKRERLVVTCPLNKELQALPTVFSNPSLTGEYESSKAGMGTHKRLPMSTIPPQPALQPYCPVPLRSGFCWCMSTKSCHPFSV

SEQ ID NO: 928189 - protein, 135 aa, Homo sapiens
MVVMISIRAGPRSLLDHSQLPPVCQIHLWALLPLLLHFQCPLLDVSFHFCYTASRLNRSNCVCGVSALYLPGLEMEILKPSNEGHYRIPGPSEAKCSWQNAQEVPFLPGYSAVFSYRLLKIQISVEVGSHTDVEV

SEQ ID NO: 928190 - protein, 146 aa, Homo sapiens
MRVFDFGDVNTDHGYNDFFPSSAALISVVDNHMQGMGHASALEISVERTVMLRYVFLLPELWVWSASSKPICCAAKASSWLNWSKLHGKGKKAESLEYQRGGDLTFPSVLNSVSSSLKMLARSKVKHQSSLAKWVQSVLLKMKGLL

SEQ ID NO: 928191 - protein, 152 aa, Homo sapiens
MFASGLMRRAAYCLVETVLACYPRHIFGHDENVGRYTDGKGHSEEVSDGTEEQDLEETQKLRRVESGASLKNTGRGDSQWDHLPFCLVRAPVGYLSPCLPFSALGHIPGCPKIPAPGEELSVGVSLPKCGIRKDSACPEAADLRVFRRLTPT

SEQ ID NO: 928192 - protein, 143 aa, Homo sapiens
MADKTGDAQAPAQWRIRQQTKDKKSELSHQNCALEQESTTMWDLVVIYVFEAKPRQTRHQAYSSKPSPPLLTSFSECPPSENHFTGADPPKFFCVSLLTLHLREKIKKSSPELPFFKTLCSRSGSGECGEQQGGISRGLNSKC

SEQ ID NO: 928193 - protein, 152 aa, Homo sapiens
MTPLAVENFPCVLFIRVTRLVVSLANAGDTVALQPGGMCDEFLVLEGISFSLGATLPKGRFLYSKIASFSNMHCLFPKAHYSFASVPISGYSVTTCTGFDSLGQGPGFPFGAGNIKTWGHRADPEGLLSIMASPSLLPFTPGSWTHRCQPAK

SEQ ID NO: 928194 - protein, 294 aa, Homo sapiens
MSDKLSYKVADIDLASWGHKGLDIAENEMLGLMSVWELYLGSKPLKGTHISGWPGNCHASNIHYFKDVPLNMILDDGSDLTNHIHTKYPQLLLGIQGISEETTTRVHNLHKMMAKGILKRDTDVMIVGKVAMVAGYGDMGKGCAQALWDFGDPFVITKIGPINLLQTAMGGYEVTVVDEACQEGNIFVTATGCVDIILGQHFEQMKDDAIIWPGLAEEQHGTILLVEGLLVILGCSMGHLGFVMSDSFTNQATVQIELWTHPDKYPGGIHLLPKKLDEAVAESHLGKLNMKLTS

SEQ ID NO: 928195 - protein, 170 aa, Homo sapiens
MLLVSLTRWLCHVWPGIVVEKNWALSVDRCQLQALQFSVHKAVADHTSGRPTNSDQDLFLGATLALASALELLPSPTTELVVAGCHIKSTFQPGYFLFPGEWWRGSSPHPVALPTGLTLRKVLLHFPQYSGMRGGRNAEAFSSWSSTGPMSLCPSMLSEDGMLGTAAATL

SEQ ID NO: 928196 - protein, 125 aa, Homo sapiens
MNSAVKPSGPKFFFAARFLIMVQVLNFFMIQYWTQCFSLTLPLIKNSNNSKYQYSSVKSMQSLEKQNQGQQLIKRRNRAMPFDAKLPTFNSKAQKIILHYIALVTLTTDKLIYLHFTFNIAIRFC

SEQ ID NO: 928197 - protein, 125 aa, Homo sapiens
MSSRPQNGRYTNSLHCALGKATDAQHQPMKAARREAVPCKATGAELPKTMGTHILHQCDLDVRYGVEGDHFGALRFDCHTGFWTCLGPLDLLFWPVFLIWNGCIYPMPGEDYKKINLKVRKKPGT

SEQ ID NO: 928198 - protein, 252 aa, Homo sapiens
MWESLELPRDLEGSEDRKMWECLKLPRDLLNDFDQNAESDMYNEVQAEVVSEGDEKFVGNWKEISKLQSIQKVTEHKSLENLQLNNAVEKKNPFSEEKLKPAAEICISNEKPNCNHQDNVSRECQRPLWQPLLLQAWRPRREKWFPELGPGPHAVFSLRTWCPASQPLQPWLKVAKVQLRSLLQRVQAPSLDNLHVVLGLQVCKRQELRFGNLRLNFKGCMETPGYPDRSLQQGWSPHEEPLPGQCRREVWD

SEQ ID NO: 928199 - protein, 157 aa, Homo sapiens
MRKRPSILLKSIKELKLTKSLHPDNEMPDPTFIMIASFPLPTPTWMDRAACGDLYHEILFQELLGEHTRKVERIRRPFEGGGLPLQALCYSRGTVSLLAFSAERLEAWGKFSTLLTGCLEINTVLLWGQGGNETGHSGCGLHGSGVRTVTAGFLPLP

SEQ ID NO: 928200 - protein, 168 aa, Homo sapiens
MGLGLRVFTLTSTASVLLELEGLHCPQSSAGYTCVSLLPDFCLICQPFQEGHGSVMTHRGRKYLFTHPSLILCGCLTCSSSILGSQGPDKTQGRVRELEICHALTAKLGSSQASPRGAASFCQMGTDHPSHGAGGNHYPLHPWVNHLKQKKYRTPESSIVLYQVDPFG

SEQ ID NO: 928201 - protein, 141 aa, Homo sapiens
MLRTQAGQDWQGAPPSCGELISPAQGPRFSRGTRYQIQRYTPRATFSIPGNHRRWLCAWGKPYVDRSKIPLTCHFLVIPVLDSSSARCTGGGFARESSHVCVIDPTPRHPGILRRLVLRLDFMLDICTSLTFQMAHSQFER

SEQ ID NO: 928202 - protein, 226 aa, Homo sapiens
MGGSQSYWVAFSAFSYNRRNIRALTLVLNWGGENKMEQPGQLAPLKGTSLIEVLPVPRKAGVRRVTSSTQVHGELVQPRRREWGIHSRSWAPGLRDTQPFREAGDEDAVGIIVSAPPMAVPGRQRGSNEQAMLPGGLGQLRSVVMRVGACEEGEEGEEAQSLSHNLNRAPRGGAGPRVVPCSIEPVGARNRKELHPPRAEEVMDDQLQRGAALSAESWTLLRTLWL

SEQ ID NO: 928203 - protein, 176 aa, Homo sapiens
MPEHAAVTVAPGPGRPGDNVARPGPGSFNNSEIGAATDSRVCAVTGQTCSHHPRRCVIQELAVGVLVKGVRAPLNGAKGSNGMERREKKGSRLEGVRSMGDRRQESGSLIKTRTVLPERDSTGPSPGRSLGQGQTQDTDKSSAPAPKETIHRTVGHARQQREMAGATVSGEERAGA

SEQ ID NO: 928204 - protein, 150 aa, Homo sapiens
MRREGGAAAAESSERRPGICTVALLCFLCLTETADLPNAREMHHPFLYLLLFTSTGCHLPHSSGSLRIAAKALFQGNNKEMETRKTRHWLVKPARQPHWFLLNLVKNLRDQAGLHGGGVLAGACEDKEELTRQQQWRQRDIAGFCSSVGS

SEQ ID NO: 928205 - protein, 144 aa, Homo sapiens
MWMMWTTWMRAPAGSKAPSCGKAGGTEWSQAQGPCSQTLLSDKARAPGRSMGDREESRCRPWACFLGRQKGLGGKLIPNIQGPTPELCAVWGFPGMAATPAGGTGTSYVTGFSTVLQKLPGIGSAGPRWVYELGIAFLRSILGR

SEQ ID NO: 928206 - protein, 138 aa, Homo sapiens
MSGKEHMKTLQNPPFSWRAVLAQPPRSVTPPFSGKELLLRVEIRACAQKKIATNYDTLKADKHYKHHNMKKNSSNSHLIIISLCGKTVLSFKNWVTALPAQPNTPIGTVGKTAHVQVRTLLGGVQKGDSLLESGLAVP

SEQ ID NO: 928207 - protein, 157 aa, Homo sapiens
MPAKVNTKHLQKASPAGPSPLVQGSRRANLRTILGDLLCCGLLDLASRARKPGEKSLWEDCGADAGRVQGRECRGRSRLALRRPTLPQPFDSTALQLLSETTPLLCILGSEPPQCSEFWVQGLPYSELKGASHIFLQSNGVRSTGWPGPQTTCWGLP

SEQ ID NO: 928208 - protein, 119 aa, Homo sapiens
MNDVPLCVHVCFIQSCVDGHLGCLHILAVKDVVGYLGPGELNIDPMGVEQHSFPTKGLPKAASGWRSVEFKDFKLASLDLTQTQQRQAWEGGRVILHEKLRAGNPGQREPEGTLEEEGV

SEQ ID NO: 928209 - protein, 146 aa, Homo sapiens
MPFGGSAPPAHHAVLVSPRGRILTRSAWQLFRVPQESLSTADAPSSRAPHPVLTPQSLSDDSSEGFPRADTFLETLDGGCTLLIEGSVSVSPSSHVATLGAIPLIASCPVFCLQFCLQLCTGILFDQTSFLHMVPPPFLYHCRSQQ

SEQ ID NO: 928210 - protein, 221 aa, Homo sapiens
MLIAKKMGKVSPEHVRDLHGIPPLHRLTWLQPLLSIQLQQQRTTLSPQYGTIPWRDPPAAWWQIDYIGLLPSLKGIVLTGTDTYLEYKFAISTHNAFAKTTVHELTECLSSIMVFHLALLLTKELISQQMKCGSGPILLEFTDLTMFPHHPEAPEVFAEGKENIKRVEKKGFLFSPSYYTELNIQIHSGADPKPPSGCSLVFSKEKEKKSSVSPEWAQLHS

SEQ ID NO: 928211 - protein, 173 aa, Homo sapiens
MQAEEENELRKKQEQALMEKLLEQEALMEQQDPKVRSAALMRQSPSHKSKRQQQELIAELRRRQVKDNRHVYEGKDGAIEDIITALKKNNITKFPNVHSRKRVGQGHTNSNESRSQEVSLKGPLADFSTQAALIGCQLAFVLLRHMLLKVAILSLALSPLQILETNHTDEPMR

SEQ ID NO: 928212 - protein, 141 aa, Homo sapiens
MPRISYPHLTSSADKHRTHNLQSYPSGTFQHLPNVPTLLFKQSKHQTLTIPNASKDMEQWELSFTADGNAKWYSHFGRQFGNFLKAESSNSAVTLLGIYSNELKSFVYTNTCMQMCIAALFITAKTWKQLRCPLVGKWINK

SEQ ID NO: 928213 - protein, 327 aa, Homo sapiens
MAKVLTLHQTFSDITVEGERDTSLLLCGDQQGNISATFEPFPFNLLKEFKQAISQYGPGSPFVVGLLKNAAVSSWMIPTDWDALTQSCLTSADFLQFKTWWADEASIQAAHNAQAQPQINITADQLLGVGSWAGLDAQLVMQEDAIEQLRGVCIRAWEKLTSGGEQYPSFSAIKQGPREPYVDFIARLRESLKKMIADSAAQDIELQLLAFDNANPDCQAALQPIRGKAHLVDYIKACDDIRGQNQQPIWIPSRHLKPYHEPDAKEEIPGGSQGHLNCSHVKTDTEEDPNCHEQHPLNTATYLGTDQEAITDGGRKPGESRTTSQNE

SEQ ID NO: 928214 - protein, 140 aa, Homo sapiens
MEETLRVCLVRLPSRKYEISMHTAIMNVDIVSMMKYKKHALGSRLSSALALLSLVMWPCANCWTSMSLSLPSPQAGKMRGNLRADGTAGKNPFTTNKWLPKLLIQCRSNGIWYKNETLLRKNNSFWRGCGEKGTFIHCWW

SEQ ID NO: 928215 - protein, 158 aa, Homo sapiens
MQPSVCGQTPKSPWKITGGPERWRLAHGPELSGPRALRLGPIYWLTSSLFLGQMGGGGRDEERINQRRRTRGSFNKMYSRGAKKFDYTPLLQGSVFSLRNLWNATERMVIFSEAYSFGRDAHGVVREEGDTCLASQISRINLGNQWGDRCSSQIVLTP

SEQ ID NO: 928216 - protein, 134 aa, Homo sapiens [sequence omitted]

SEQ ID NO: 928217 - protein, 148 aa, Homo sapiens
MYDIDLTYTTPDGKDKKERESVGSRAAKPWFSSGQGRQSGRGDHKQARTDKHKRECHKDGQKPRSALVNSDLGYKGILLKLGPFFRELHTHLTQMSEKVEEDPREGGIIIGLLLLHVHAADRQQHMCVFFLTPSTSQKNLSHGPSNPA

SEQ ID NO: 928218 - protein, 148 aa, Homo sapiens
MIWAVGLSQTALIILSIHHNGRGNAAGIRGEGLLLVIMCMVVLEVVLAWRQGACGHSSRWLLCAQQARVVTQGEVGSPVLCAMLTQSMVLVVAEMAGSAHQGFTCNGIWSGEQGWSTDIHIYHTDIQTAKQCGELLWAKGKLQHKEGA

SEQ ID NO: 928219 - protein, 213 aa, Homo sapiens
MVNPIALRLNSYWACKAQTQNTLVARMNPKGSGRQPGRSPPRRHSVSPPKAPNLWAKNLQQGSKKALMLAVLGSLSVSHLPSGLGTITFSFRTFRSGSEASVSERARRLTERRPAASRDTRAQRALCFPALPCGIPQVAALTGRELSGFQPLRPAGLGLQAPGEAQQVPHPPLAKRVHSPPLRGLKEGGRQLFSDHLRVPDTGLSSVLNIEKQ

SEQ ID NO: 928220 - protein, 148 aa, Homo sapiens
MSLWCHSSNKFQMLLDNFKWPVFKFPNYLICWFKSAVEPMWLKMSIQLLHFSVQEFRFGTLKIISICSYAHFVPIYFFLISFSYLFFFCFLSIFKTVVLKSFLPFEMCVRRHRDKSLSQPLHKVEIANLISSAFCASLMGSGASLSVP

SEQ ID NO: 928221 - protein, 135 aa, Homo sapiens
MLGPSVNAKFAHRGELTNRRMENFLIIDDSSQPVKPSSLEFFLLLEFLSLQKINMALGRCETPRAIATVSCCTQVHHSLAANTHPDAALGEQGMQSLFLKPDKPLLPQGTFFHRRHGAKLPVEETHPKEQKLDMK

SEQ ID NO: 928222 - protein, 138 aa, Homo sapiens
MGASHIGIHGWHLPRTLGLGDKDGKEKEVCLLSFHLTFRVFAERRKGMRDAKFPVFQNGQQTSPPPVYTQKRTMGPDSTLEDLLKGATLVFQTQERGRSFNGHHSSSQTPEFLRKDQILPAPSPFQFPIPLRATSISQ

SEQ ID NO: 928223 - protein, 153 aa, Homo sapiens
MVTEMEVTHEDSEGTRKRVGSISAARGTWPWLQQTKDGQEYFSHNVSTDISRMLNRGIHHNQKNARSVPPQQGLARTPKTKKKFKDSVTPYHKFTGALHPPNSVMPHCGHTDEGRIDETEKVPKGIIYNIGLDTVLNQIRLSKFPFLSSNKGS

SEQ ID NO: 928224 - protein, 136 aa, Homo sapiens
MCKSNMLLPFSWGSSPHSFWCSGSPCDLDLQVHGCNLVVPPPHPPSPLILPHDCLSGGEVSKVVPAGPPSLPFCSACQLSTGLPQSLGTSLCYRIAEILIDSKHYQRSFYHRFLEKIEEIYAKNKSQSLPYTIHKN

SEQ ID NO: 928225 - protein, 118 aa, Homo sapiens
MKNKHFEPRAVERHWVVQGSLGHLFIQEEMVTPGPKGVVGIRKLGEGTPGGENVKDKGLDGIQRVANFASENSPRMHVKVPGLRHQVDIGISGPGVVMSEVLDNSPKAGAYFKGGKVK

SEQ ID NO: 928226 - protein, 145 aa, Homo sapiens [sequence omitted]

SEQ ID NO: 928227 - protein, 305 aa, Homo sapiens
MLQNVSQSCLWPSCACAPDSINALECISAIVGLCPQLTVNVLECTSAIVCMCSRLTVNVLECILAIVCVCSGLTVNALECTSAIVCVCSRLTVSVLECTSAIVCMCSELTVNALECTSAIVCVCSRLTVSVLECTSAIVCVCSRLTVNALECTSAILCVCSRLTVSVLECTSAIVCVCSRLTVNALECTSAIVCVCSRLTVSVLECTSAIVCVCSRLTVSVLECTSAIVCVCSRLTVSVLECTSAIVCVCSRLTVSVLECTSAIVCVCSGLTVNALECTSAIVCVCSRLTVSVLECTSAIVCMCS

SEQ ID NO: 928228 - protein, 141 aa, Homo sapiens
MNPSDMDPKAQSSIGVTESLQLGNHPALTHHAHLHLLHLQEAAGWQERREEPCDKEGAWESGPILRIGHYKYRCKTQGRLTRTALLQGALGREHAEGRAYTGQCKLATHTWPVTTHVTGLPGTLHSAVSSLKSLDASRPDT

SEQ ID NO: 928229 - protein, 118 aa, Homo sapiens
MPGLVFDAGNATMEKANLVAKCNQQALKMPSGLGEMHSIQQGEPKVKTVPRSRSNAAPAPRCEPSCGRGFLSPGVCLVQGNLQRRCPKTCQMGTWRYMWEAAFKRETNRTPTSREQLS

SEQ ID NO: 928230 - protein, 287 aa, Homo sapiens
MVAETWGKGPGIGGPGLHVEWPLGPGIARGLCLASPPSALQPGDPGGCRHLLPPLPSLFTDPQLQPFSSCVRVGRCNSSCVRVGRCHSSCVRVGRCHSSCVRVGRCHSSCVRVGRCHSSCVRVGRCHSSCVRVGRCHSSCVRVGRCHSSCVRVGRCHSSCVRVGRCHSSCVRVGRCHSSCVRVGRCHSSCVRVGRCHSSCVRVGRCHSSCVRVGRCHSSCVRVGRCHSSCVRVGRCHSSCVRVGRCHSSCVRVGRCHSSCVRVGRWNSSCVRVGRDETISPQDEIQA

SEQ ID NO: 928231 - protein, 249 aa, Homo sapiens
MEPNYRELEPDGTEPEPDSMEPDGGLEPNGSMEPNSTEPELTAQNLIMEPESTEPELTARNLMSARNPTAAWNPTVHNRNQQYGTRTDSTEPEGTELDGTELEPDRWNPTAQNPMAQNLRAARNLEDAGGDWSMNSGRRTYLVLDKGAQGAQAKGAWCSMGHRTKNVGRPVSMDRDIDENAQLTGRQLGALVKGDKERHRRAGGTGSGAECGTGVSRQTWPSEPDDLRATTLRDVEKGRAAQMQTKAFQ

SEQ ID NO: 928232 - protein, 145 aa, Homo sapiens
MDPNYNDRGAAGLDRAAAASLSPSPAFPRGSGQPGVASATRSGDAVTPELGCSQGPHSVSSCGLQTPPFPARLCLSKQELKGCGRGKFAEAMGTSLLQAPLPACPQSPSREPLHPDPTLPREASQAQGLARGGPHCLTLLPVIKV

SEQ ID NO: 928233 - protein, 153 aa, Homo sapiens
MSLHELCLPSCSIYSYILQAFRGVNISYGNVKPMFLEAVGAGNGKSSAAVNMGKTPMYQDVEDSNSRRFLVRFCARHWRLVWWDFMLLTFLSHYFSCDCQLLALYSEVGERTTAPATGEGMLLTAREVPRRQQSNTGTLATPTTSGELHVTRA

SEQ ID NO: 928234 - protein, 143 aa, Homo sapiens
MRKKEDSRGTQRRAWYLSEKYRKDAECSPVWNNRNQSSLNLTYFSQSLYKSTGNFLPSFHSFSQEPGPPETCLGLRKGEQLVKTHGPHVAKKRGTVASPSPPSVERLQELPSVAPHAEHSRHSKQPELLEQQAVILLEPGMAE

SEQ ID NO: 928235 - protein, 266 aa, Homo sapiens
MRKGHFEEDLWNFELERDDLGYLAEEIFKWQNVQEEAEHKSLENLQPDDAIEKKNPFSEEKLKLAAEICINNEKPNVHHQENGKNVSRAHQRPSRQPLQSQVWRPRKEKWFPEPGLGPSCCVQPRDLVPCVSVCLAVAKRGQGTAQAVVSEGVSPKPWQLPRGVEPAGTQNSKTEVWVPPPRFQMMYGNTWIYKQKFAAGVGPSWRTSARAVWKGNVGSKPPQRVPTEALPSGAVRRGPPSFRPQNGRSTNSLHCAPGKATLDASP

SEQ ID NO: 928236 - protein, 150 aa, Homo sapiens
MPDTPRPTVGSRAAEASPTGTAPCSVAPALINRPKAEECWAHGWELAGSSASGPGTGTTRRNQLASNHKPTPAGRNEQLQTGRANNSRGAALRAVTLNGKVCSFTPEASKTTNPPEGRTFEQVRTSEGTSSGYAVFKNCNTHGEGLQLHS

SEQ ID NO: 928237 - protein, 194 aa, Homo sapiens
MLTLMHIPTRYMQQCTLTRLGRLETSTGNGGEAALYTQGPPAPSRAQPRQLRVHSRQRVHSREREHSREREHFRERVHCREREHYKEQKPDWETRSSFPCSQPRPSRRPCGFCLTSRPCFPLSGFHRCLPLPAAWLRSRWAPPPISSIASVQHKDQDLSLKSVCSTRGNRRSAALLLAPTGPSGIYNVSNKEIT

SEQ ID NO: 928238 - protein, 121 aa, Homo sapiens
MLGLAASYFWASHGIEFSSAKEALALTARGPAMRTKGMEGPGTTPSQCSCGADAAAVPLLFSKYQYFDSRGMFISIVFSAPLLVNAMIIVVMWVWKTLNVMTDLKNAQERRKEKKRRRKED

SEQ ID NO: 928239 - protein, 155 aa, Homo sapiens
MRPSEIVPRDLRMKDKFLKHLTDAGYTSTRKTGFLSIDSCPEHIHEKGVFLYHWKSYSVHMPISRPLPPLRWLLLEAGAVTLKDVVMSVGLRLLYGSLRAHVLLCKRHSDALQKSCGRIPLIVPSTLHITLPITRQPHQSLTDDEMQVKSQKIFL

SEQ ID NO: 928240 - protein, 147 aa, Homo sapiens
MLIPQTMGKMSPGHVRGLHGSPSHHRPGSLGRKNGLVGQAQGPHAVCILLDLVPCISATPTINKRGQGKARPMASEDVSPKPWQLPCGVGPVGAQKSKIEVWETPPRFQRMYGNAQTFRQKFATVPEAADPPGNIGGCEWYLPRKLC

SEQ ID NO: 928241 - protein, 140 aa, Homo sapiens
MKTKFLIYYLSKLYFDIASMTRNEKKIAFYFLTFKRSRTMLLQKSELLPSCTSILVFRFFCSFEVLPEVHQAENTGALVTSAKLTQRVEVSRQQKQAEKIREAHPPLSAAHVTSRKTEAIKAGHWADEIKFLKPYTESST

SEQ ID NO: 928242 - protein, 141 aa, Homo sapiens
MMCVGYFLKDRNCLSTTAEQQLIGLVDIWDEEIFLEENLQAEQASKRQLSLATHDSKNSSSPYNRSSICKPRVEDQGCCYHPTMHRRAPTAKNHVAQNVNNGVFENPWEWKRLTLRKQNHKLKVYFLMGEMYSEVQNIHQL

SEQ ID NO: 928243 - protein, 144 aa, Homo sapiens
MGWAAGKTSDMPWRHFPLCPHSKKNRVICQFMKPKWRIMEKFPCRSLAAAKANSQDEVYSHSYFSTMCLTLPIQKCLFCDLENGLFISFPPSKITFFSFTECRIVVVWRKPEVLWKQETQTLHCNGTRRNSLISHCTVTRHKGD

SEQ ID NO: 928244 - protein, 218 aa, Homo sapiens
MAPKSLPLRAELSMKIFNKWDQDPETFLQRIITGNGTWIYQYDPEDEAQSKQWLPRGGSGPVKAKVPVKAMAVVKDFGDSQSILFIDFLEGQRMITSAYSLKSIQGSPTLRQMHYQEEWMREQPIDQPERCIPDKRIGRVEAAWPSICGDNEWSNSFGTKQKALGVGKGPWRQSRHSSHKRKFFVMNRSSENSSILDANVHEENGNIHQPGSLNNCID

SEQ ID NO: 928245 - protein, 141 aa, Homo sapiens
MMLLLPLMKTVVINERQRQRAHHNRSMSSGKNCENHHTVNLSLKTSSAPNEYKRVKANICAMADKALHNQSRLLPPSLASSLPFSSPAAVHFTPSTPRSAASLLKSARPRTHWKEETLDTSEHLKEQTPDTPSLTAVTLTV

SEQ ID NO: 928246 - protein, 148 aa, Homo sapiens
MGDSENSGSPWNAHVRGRSCLANPCQGECGAGHRGHNLDQQGSEEERKMWESLELPRDLKSSEDRKMWESLELPRDLLNGFDQNADSNMHNEVQAKVVSDGDEELSKDLWRFEIERDNLGYLVEEISKRQSIQEEAEHKIWKICSPTM

SEQ ID NO: 928247 - protein, 169 aa, Homo sapiens
MILFIRSNINRSCHSLPAYKVSTEKSSARHIVTPLKVDSLLAQDRSKNAIKESHPGIRDTQEPAYCSVLVRFHTADKDIPETGQFTKERGLLELQLRVPGEASQAQWMVKVTPHMEADKRRELVKGTPLFKTIRSHKTYSLSQEQHRKDLPYDSITFHQVPPTTCGNSR

SEQ ID NO: 928248 - protein, 177 aa, Homo sapiens
MLFPFSYRQSLFQLPAAVATTSSSTLASQPALPLRCPQMTRQIPEVLVYERASDADCILGRHTYCNENPEIIHTDFKLCHFFIGVLCLLLDFHLVIGIVSFWWVLGLTDFKNEAMDPRAIFLSTPYSVHFYISLYGFVLSLTDLVFVSFSSCKCVFIPQQPALNSHSPENVHDQCHH

SEQ ID NO: 928249 - protein, 139 aa, Homo sapiens
MWIPHHDADSRAKSWSVASLLKSARPLTYQEEQTTLDVPPLRALTLTAKNLGAKYQAPVSQLIATSTAAGLKTQVSGFLGKGSLVTPDSLELGAWFAWNKLPLFLYFWAEPTVNRKESHSAPGRTGKGAGFRECIGKGH

SEQ ID NO: 928250 - protein, 138 aa, Homo sapiens
MALSAKFMLEEGSYKHSCGDQYHTVPVPSLPTPVPSRHYTGLHLKPVWYWVLSKACGNYSSLPGVGEDVMQALLGLHSWCHTGSPAPQMHCVIQTNLQVSLKDCSPSSLTATHIYSGPRPLYIQPVGEPARTQIPPAG

SEQ ID NO: 928251 - protein, 161 aa, Homo sapiens
MSWVQLAGTSRKYEDTLRESSRHNSREGAVCKEAGAGGKFYRVLLLGLHAEQDHFKQHLKCDHKRNFISFRPSLEKSQLSHGLNPPVEIKAAFTAPDVGHQSLAFLFFGVITSVSISDITWHSLCVSLSIFSSCYEDTSHIELEPILMTVSYFFCKHSSFK

SEQ ID NO: 928252 - protein, 167 aa, Homo sapiens
MVAKTKMLLVHIKVFEASRTAHLVLTLTFQRKILRSRENKANLPGQCQKGRTHLAYSEISQFEVKSKHLVSIGSKKQVFFLHNGALSPIKKNEAMLFICLTFKKIKTDSRQNDGTMDKEQTQRFPSLLWTPPCEFPQRGEHRCESELAGWSSGKPSPGSLRAWIPRG

SEQ ID NO: 928253 - protein, 180 aa, Homo sapiens
MSRRSAAQSSARPRELAGPRAGSARETEGARGELRLAQTPGAHALPGLEERPGHLSRGSLWLRASASVLPGPGQLPELAASPLWCIFRAAPRWAERSALSRDCAPPGGLSALAAEGTSCGLHQRAAGKALRWRPGQGRLLTRCPRLKPRQFSGIKREPDPFFLSKANLSSWPGSFINKQS

SEQ ID NO: 928254 - protein, 148 aa, Homo sapiens
MDPVLGAGHSASFVPQKSKGESLLPHAVCGWRAESSSSLSSLGKDNSKEYYTTWRNRRKISRDTKMTQVLKNMIHATKNTLQLSLKRKRLGVNIPVAQMAVHEWALVRRMVSRWSPASQRRRLCNRAWRPSEDLRQGEEDNFTRDKTA

SEQ ID NO: 928255 - protein, 258 aa, Homo sapiens
MVLLTSGMKPENPVNEQLLGVLSGISGRSCLHRYHPFSLLIPNYMFQVVSEAQDFPELPHREHSFSALVCLPALKIPECEDFNLFEGQPDSSLSLKVQHKCHVLWKVFLNSPGQKKKKKKKKKKKKKKKEEEEEEEEEEEEEGEEGGGGEGEGEREEEEEEEEEGGGGGEEEEEEEEGGGGGGGGEEEEKKKEEEEKKKKKKKEEEEEEERKRKKKKRKKKKRKKKRKKKKEEEEEEEEEEEEEEEEEEEEEEEEEEE

SEQ ID NO: 928256 - protein, 226 aa, Homo sapiens
MALLRRLPGAPWKVVHLQGGLLEVPLSPDIVPLVVIQKRRRLDYKLHRTIPNIDGKGNRIGTWTIHAHLIYLHECRGPGFSGSIVASAVSSRISADMSGGIDGGGGHNVNADGDGGADGGGGDGGDDDGDGGGGDDDGGGRGNGGDNGCGDSGGGEGGNGDSDSGSADGGNGDGSDGTGSGGVDSGGGSGGDGDGDGNGDSDGDGGSAGDHQCHLAALHIPKFKNT

SEQ ID NO: 928257 - protein, 179 aa, Homo sapiens
MDLEERAKVTSGVRPGCPGHCSSYGSICHNGGKCVEKHNGYLCDCTNSPYEGPFCKKEHYCSQINRGALAPPLLKLRFWFIYSPRCMTLVVYLNLKIPWFPHLRDVGSAGLFHRESCLTFDEHSTKNMGQPTALDAQGVLLIVARWPWRIIMVTRNHLQVKYLYPFWPVVLDAQITQPI

SEQ ID NO: 928258 - protein, 184 aa, Homo sapiens
MRPGQNYGTMGTVVALRTNREKGGEMENEFLLPINVNLAQQVPEQVSFVCLFAAKNLMDQQLRLSYNFSPEVEFRVIRSLTLGKVTENLGLDSEVAKANAMGFAGCMSSVQYNHIAPLKAALRHATVAPVTVHGTLTESSCGFMVDSDVNAVTTVHSSSGTLKSMHKGASVTSTTFCVFKKLPD

SEQ ID NO: 928259 - protein, 155 aa, Homo sapiens
MFPLLCPCVLIVQFPAMKTALRETCSQDSTRSHPRLTVTTTKVAVMFTQVPRALQSAGGEASQPCVLLFRAASFLRLQMGPEVLFRSQELKSKTLEVYFVFCCTKTELVLKPKDSILPLFSSLSTGRGASPHGHHYHSPMGSHARWFGDLNISEG

SEQ ID NO: 928260 - protein, 138 aa, Homo sapiens
MVGSAQFKLPGSFVYTVKEKEEEEEKKRGRRRMKKENGEEEGGGRKGGGDEEYGEEEEEGVEKQEEERRRKKEEERKSRSKSEFSSWFRSIAGVLKNLVFRITRIVILVLSHFCRLCQREDLGLKADVQIPLSRGMFS

SEQ ID NO: 928261 - protein, 155 aa, Homo sapiens
MLVGTLTSCCLFCVAGIEPLDREEKAVPMTCHALNLDDLVYSSQQTSSKGPIPAPPPPQEDLGSEELTDPLIQSSQPYREALSLSLPYRIPADEWVCTIIGDNMVHTLSPGLSVEALPGREERWLQLSVGRKDGECGVLRASLVVTPTWAQILPF

SEQ ID NO: 928262 - protein, 134 aa, Homo sapiens
MKRDRQSNAFPPSKMPTPWECLGSAMQVSTRPAGSPEGGTLTKLGRRLPGEADVNCSFEGWLRSSQVTDGKDRGHSMNKHAEEVGLKVTSHIQKPPRGCQPPVFSLAYNKTIATAQYYIYFPKCTSVCNEMKKQ

SEQ ID NO: 928263 - protein, 137 aa, Homo sapiens
MEYSGMIIAHGSLDLLGSNGNTRLLFQRQCAPWEAFSSASSSAGYCSTWQAAAHGAGNMWSSCLGSFPWCPSGGYTMSSEPHCLPVSGFYWHPREWIPTGHLSGLLYHLGIGSYQESIKHCIGQFTCILSFNPGNNL

SEQ ID NO: 928264 - protein, 175 aa, Homo sapiens
MGDARMNGTSEQVKKEAQSLNQRNYKWEVEFELSLKKARMIWIAEGSNDCKSCCSGTCHFSSFTFSIIIINTLITTLNITIITIITTTKLTTINSNITSIITIIITIITIIITTITTIITIITINTIITVSTIITIIINAIITIMTIIIIITIIVIIAIIIIFFILKIIPLLSNE

SEQ ID NO: 928265 - protein, 133 aa, Homo sapiens
MQDQGVPTCKLKFGKPSTISRIALSTAHLPVPSPECILCLVHSLKLCRDDNQDLDAFKSKTGLFAYGIPYVHTHGHYHIGAGGPCLRLKNPTDAPWMGQTEHLPFLLGKRGKVNSPVGLDATNMAADSGLCLL

SEQ ID NO: 928266 - protein, 145 aa, Homo sapiens
MIELEQRLVDSKNCLAFLIEYVNFSPADMRLNNSVFQWYGRMGEIFEEHRKIIEEKIEQYQEGLKLRCERFVEELESYAKQSEEFYSFGDLQDVQRYLKKAQILNGKLDLAADKRKLEEKEPYPLPYKIFTEFNCILYEKENENI

SEQ ID NO: 928267 - protein, 165 aa, Homo sapiens
MEQKGCGLQGLTQRQCGQMPTGSHFCLATAVYTAPLQIRKWCLWVGYGQLIGQLLHAEPQVGSVCLGAGPAEWRCNRAAYQPHRPPGSSCGKDWEPLSASGPDWNGKEGKQAGISKASSYPHSLHEQPSRIWALAHLVPQPDTFLPISWPMPFQFPGGASLQFLF

SEQ ID NO: 928268 - protein, 142 aa, Homo sapiens
MGCICLSHREMVTRRWVYKADIWVGRIEELGGGGALDTVSRAINPASGRRGSKLDSKCTHTHNYKNSLHSGNSLVLCTDREGPRGRSATVENTVNACGPGTSDHHSGLHGDVELSRGLGARWLPKGQGGISDSSWIPPKNVP

SEQ ID NO: 928269 - protein, 173 aa, Homo sapiens
MSHEVQRERGQRGLGKYPWSPMDQRPPLPSVTTGPGIHHCVPTANCDYLRTDTLAWSPALCRCGRQVLDDGGPTPRGLGLSLQLVQQSGHSGAAPSQGLQCLPTDDATRGQLQLQLLAGSTGFCTTCSPQPGATFPCANQYPSMDRNGAESPLGGTSKYPSMLVTRPVSNVLL

SEQ ID NO: 928270 - protein, 149 aa, Homo sapiens
MYSNLYVCHFSLFTLFMNHCWGTSAIVWRCSKSAGYNTLTGGPGQSTDVVAVGSALTQGASSSSGTAECMWGSGPGCQWRQKGVSMHAYWQKQQHCEVYACVSVGGVLVFLRGQVADGVGGSAGCTCADTTVEGCRQVHTSKAVGGGCN

SEQ ID NO: 928271 - protein, 221 aa, Homo sapiens
MRDPNTKRSRGFGFVTHATAEEVDAVMNTRPHKVDGRVVEPKRPVSREDYQRSDNIFELYGKIKGIEIITDQDSGKKRGFALVNFDDHTVTGNDHNYEVRKALSKQEIASASSSQRGRSSSGNFDSGLGVGFSGNDNFGYGGNFSGLGGFGGSCGGGGYGGSGVGDNGFGNDGSNFGDGRSYNIFGSYNNRSSNFGPMKGGNFGGRSSGLYGGGGQSFDKP

SEQ ID NO: 928272 - protein, 228 aa, Homo sapiens
MDMESAWKIISRFILHHVCEDFGVIAATFHPKPIPGTWNDAGCHTNFSTKAMWEEKGVKYIEEAIEKISKRHQYHIRAYDSKRGLENVWFLTEFHETDGRSDPSGADAAIMPAAVGEAPPGLCAPWSRWEPKTGEAVASQPQLRTQASLCSREPGKPPLPPDCFCYLASPGSWCPLRFWSKVDAEPRHSCDLTMEYVQGLGLNGSAKVLYFWNPLNDFYEFSYHFALG

SEQ ID NO: 928273 - protein, 159 aa, Homo sapiens
MCALDINTRCGACHFSIHTQELISRPHLESTFKMQSHSLLAYKVSAEKFVAGLWSAGVVQVMAVAVVEQPTGTQAVHGSVCIGEPGFIVLPQPGGHELSLRTGCNPALLSQNGSLDQKVGRVEPLPDKQCGEKAVGCVVTPHLSLTEAHCRAVSIVLDV

SEQ ID NO: 928274 - protein, 162 aa, Homo sapiens
MTQAWKKQGTFYRKTVGNCLEIALSSYQRMCKNDLSQDVREAEGIPQEKATFDVRQEGATIMDDTDLRLLDILQNITFIHYINDIMLTGLEEEEVGGILKAMMEVVHPGLGMNRTRGHKQVPEQVAQIPVASTTIALVIIPWLMPRTVCGISCKQLRKEEKG

SEQ ID NO: 928275 - protein, 230 aa, Homo sapiens
MVGAPPPALLPPCSLISNCCASSERGSVGVGPSEPCTGYNLLVCHLVRPLEKHSIWVGVTRFSRCLLSQCCLARKGNSLTPCASYVRQCLTLLRLMLGALHPLSDKPQSQNGRSIDRLHCTPGKATGIQRQPMKAAVGAVPCTGTELPKALGPHLLHQHALYARHGDKGDYFGALRFNGCPAKIIIFDLMGPVATLFWPISPIWNKNIYPYLYPHCILEVTNLFFDFTGS

SEQ ID NO: 928276 - protein, 137 aa, Homo sapiens
MTPDHKEYYQITAIQKKGVSFGALSYAAWFRGGVMPAFPWLPQLVSQYVTCPLSPLSLDLVQHWDSPNSCSPFGLDCLSSLLGDTACCSPRCSHKENKGKLKILLVRSKLSTCEDKTYRAENVLPKESFFVANFSQS

SEQ ID NO: 928277 - protein, 147 aa, Homo sapiens
MSVSEQMGRTEDEFVHLNGNGSLRIKIFEGSVKGVEEKKTECLSLIIFLWLLLDDDDDDDDDDGNDDYYSRVFHDRKFAAFKGDAGSAQNWRSSCMNFGLDCCPWSQLSAVALLQTFTLLGIFLMELPGASAQRESWGHCCTECEPE

SEQ ID NO: 928278 - protein, 204 aa, Homo sapiens
MFHLKLSEIISGGKKCTRGRRVEIYTVRRWLSASQKKRPHQNPTMLAPWAQSSSFQNRETSHSSRVLQAIASALPQATQLAVMIDVGVPCESSSPERKPGRWEDIINHCNIFCTNKILNWKFSPQTLNPKEGHQKTRAIEHKRKLAEVQLKRTLGPVEGCRDSPTGLSENDNSNILKPAQQQANKEDNHSCTFPKVAAKKRNRT

SEQ ID NO: 928279 - protein, 159 aa, Homo sapiens
MELAVLEVAVEKKKEPESLNLNLTKFLEPKQQFQGSERFKDLYNAGMKSEESSCEKFYKANGLVSSTNKLKEVEYYKGPLSLLFHCYELPTVSDQSFCLPRRAPDYLFIRNNYYCSPCHSQKCPDLYDYCTQSHYPSACITVQTHSQTILHPTVYIEFV

SEQ ID NO: 928280 - protein, 303 aa, Homo sapiens
MACGNRQWSAGDTDHTSRAAASGPQGGGEFPKKTLRFIQLFFIDTIIIIVITVNTNAGSSPHSRLQEACVPTLGIPPPEPEGCLVWVSAPHQTSASDPSQCLPPRPVPPTQVNASHLGQCPQPSQCPQPGSVPSTQASPIPPGQCPPPWSVPSTGPMPPILPMPPNWVSAPHQDSAPDLGQFAPPRPIPSTWVSAHNHVNAPHPDVCSPPTTRLVPLNQASAPGSLGFAPQLVTAEAALQEDEPRGPQGVPAERGVSQMLLGAHPFRAPSGQAFPGSCGSRRDAVCQMQTPGSVSSGAGMRGG

SEQ ID NO: 928281 - protein, 299 aa, Homo sapiens
MDESSLLDLLECSVCLERLDTTAKVLPCQHTFCRRCLESIVCSRHELRCPECRILVGCGVDELPANILLVRLLDGIRQRPRAGTSPGGSPPARPIPGQSAAPTLAGGGGGAAGSTPGSPVFLSAAAGSTAGSLRELATSRTAPAAKVSICLGGSGHGTWECVGGCLGVGGSDEVRRRPRVVLRWPTPLLLFLQLRLLGGGIRPLGSSPLVHVCPILLWSGHAFLSRRSPPIPWPDLLPCLLNLASPLRLPRNGDLLPLGPQTLPLHTLGLPREKLALNVSDRALMAALGSPRASCLRCG

SEQ ID NO: 928282 - protein, 138 aa, Homo sapiens
MLCLVGAGHHGWEQPLGKVLSNCPAQGVSALRRCRWWGSGHSHVEPAQKFPESRIASAFVQDIRWFDTLSHNTQMLSIVFRLSPGFSSHELCSSHLWGETRKLVTLERGLVGLPLEFRVTWDKSFCPVRRQVFLQGAR

SEQ ID NO: 928283 - protein, 461 aa, Homo sapiens
MSCTGSAPRLHRSCINRRERPCTGSAPHLHGSCINRRERPCTGSAPRLHGSCINRRERPCTGSAPRLHGSCINRRECPHARSARHLCGGCIKRRKHSPHRECSTPAQELHQQEGTSLHRECSTPAWELHQQEGTSLHRECSTPAWELHQQEGTSLHRECSTPAWELHQQEGTSLHRECSTPAWELHQQEGTSLHRECSTPAWELHQQEGMSSCKENGNLSVVPLWESMLKGLEGGLENQALLFAVFPGLYMVTIPGNLTMTMVIILDTHLHFPVNFFLRSLPLPGPWPCLHHPNALVNFSSSSKVVTFAGCAARFFFSLLSTTETFLLAVMAYDCFVAICSLVWCPVTTCLSICIILGPGTYCRVCLSSIVQTGLMFQLPSAGTNHIDHSVTCPSCSGWPPGTMESMEQGKVVSVFYSLVIPMLGPFIYSLRNKDMKEALRRLGQRQALMGRMLIFHSILK

SEQ ID NO: 928284 - protein, 188 aa, Homo sapiens
MRWCLQKSSSGISVAPVRFGARERSSGHGVDIPGGALLSLQHRKVCAGRGEWQAVASPTVPTHLESRIHSHTTAAFKPRPSLSAAKVGVQPLHPRALRPRLLHRPSLHPGPCIQGSRTRGFCTWGSCIRGTCTQGSCTGVPAPGAPEPETPAPAAPAPGAPAPGTPAPTAPAPKAPAPGTPAPKAPEP

SEQ ID NO: 928285 - protein, 148 aa, Homo sapiens
MPLHPSLFIYASSATALAWLLLDTHVVAQKHHCPLTVHLQLMSFPEMNNKYIAPRVSPAIPKNSNMRRKKIVQPQKSEKNSKPTVRELDFHIHDIPLPKTAQHKGHGKCPPDSQFLRWKNQRRCQISVAVQQHHAVGGLFHTFPGHKL

SEQ ID NO: 928286 - protein, 322 aa, Homo sapiens
MRLSTPKHRGMSGENVTKVSTFILVGLPTAPGLQYLLFLLFLLTYLFVLVENLAIILIVWSSTSLHRPMYYFLSSMSFLEIWYVSDITPKMLEGFLLQQKRISFVGCMTQLYFFSSLVCTECVLLASMAYDRYVAICHPLRYHVLVTPGLCLQLVGFSFVSGFTISMIKVCFISSVTFCGSNVLNHFFCDISPILKLACTDFSTAELVDFILAFIILVFPLLATILSYWHITLAVLRIPSATGCWRAFSTCASHLTVVTVFYTALLFMYVRPQAIDSQSSNKLISAVYTVVTPIINPLIYCLRNKEFKDALKKALGLGQTSH

SEQ ID NO: 928287 - protein, 145 aa, Homo sapiens
MGQQGLTLWEQPPSQEVTEQGALLTTVAPSASVHCGLCLRPSSETYTLSPSVFLSCCRGRPRGSRIVGEGVSPGATEAHGDWACLWPHSWGTLIGFLQPVATRQGMEAATAQELSEPPCFVPCAQPCAGEALQARVGCAHTGGCS

SEQ ID NO: 928288 - protein, 134 aa, Homo sapiens
MEEFFNPRLFQATGNKDWLLLPEAAELGKPSIQMSHYPPVHRNKILVLQDSGFPYVCINVAAFDDIVRSQGTEHGTSQGGATGAHINPGGMWSSLSFSPFQQAVLSEHLQGGNIKPQALPGRHSPWQGTGRLWG

SEQ ID NO: 928289 - protein, 156 aa, Homo sapiens
MIGIKPLEIRSWPSSPAHCRLPWGSCMFLQIRPIIYLPCSCDYRVVGIPTSGGGHPYSRWWASLQQVVGIPTAGGGHPYTRWWASLQQVLGITPFPSHNGRIRHYRNNSFCFFSTSIIHSDGLISVSTHKPHFISHVKLLYECCRIFAVTLMSSPQ

SEQ ID NO: 928290 - protein, 160 aa, Homo sapiens
MLDFSGKMISDHSSHCPFLNYPDSQSCSCSQLSGVTSHESLHCQGNSCFSMCLVSLGLLQPPGQGLSWNVLPCVSGALLPMMRALPLIPLTCERQEPAELFLLPSLLLKGRAPPFVLSLAVVGFRPTCCEFLDSDLYRSSHRIFKGWVIWFGCVRIQTSS

SEQ ID NO: 928291 - protein, 174 aa, Homo sapiens
MAGYSSETKLPEEQSGSSICSSPISAVLEPLLLIPRKTGSGVDLQQTPTDLQLRVLTVRRKTNKEKGHPYQKPICTSPSSKTKDEWLTRITSVEKSLKDLMELKTMARELRDECTSLSSRFDQPEERVSVIEDQMNETKREEKFREKRVKRNEQSLQEIWDYVKRPNLHLIDVP

SEQ ID NO: 928292 - protein, 123 aa, Homo sapiens
MCKTFLERTTNMLLKGPKEEFEEEKHQCFGQEYLDNSKFSNILAFNGFWVNRHCEKRKEQSRQCRSVPVTSVTCSKDRFMSRINANIRDDTKNGNATAVTSEKMVAVETTGNSMGAVGALKED

SEQ ID NO: 928293 - protein, 157 aa, Homo sapiens
MGPSSGFLDVQLQAVHPGSPAELAKALECTSTRGRNRGSGCGQYAINICGMNTAQEEESVTYSDVCQPPGVAQLDANIQFTLCSSCAEWPDAWVLIVVCCGLNIPLAFSQEEVASPEIHEGQLKSLALAPQRFCSCQLRFSEPTCLCLQIWGPCFAW

SEQ ID NO: 928294 - protein, 129 aa, Homo sapiens
MGVCSSQCPVLLLSSWSAPPVIPFSVSHGIVGICSSQCPVLLPSSWSAPPVIPFSVSHSIVGICSSQCPVLFPSSWSAPPVIPFSISHGIVGICSSQGPVLFPSSWSALPVSLRACLSAHAVLVHRGVP

SEQ ID NO: 928295 - protein, 139 aa, Homo sapiens
MPETPGPYARLRNVPTHHPSMKQKTPIIEFAATNPNSKNSSPAAAKIMSQAKTAFKLDGKIRTFSDKQKLRDFINTRPVLQEMLKGYLNLKEKKLASKKKSSEGTELTSNSTWKNIEYHNMLCSVAGEELRSFGGGEEL

SEQ ID NO: 928296 - protein, 302 aa, Homo sapiens
MALSKYHLPISPVLLLSSWDGMSFTTRSTFTNYWSLGSVQVPSYGARPVSSAASVCAGTGGSGSWISMSRSTSFWGGVGSGGLAMGMARGLAGMGDIQNEKDTMQSLNDHLASYLDRVRSLETENRKLESKIREHLEKKGPQVRDWSHYFKTIEDLRSQIFANAVDNASIILQIDNAHLAADDFRVKYETELAMCQSVESDIHGLHKVTDDQCHSAAAGDRDRGSQGRAALYKEEPQRGSKRPTSPDCQLWLDRGGRCPQISGSFQTSRSNVMSWLGRTERSLTSTGLSRLRRDHSGHHAVH

SEQ ID NO: 928297 - protein, 141 aa, Homo sapiens
MPACRSHHHGSRKDLEREGLATSLEILYRCKFPPPQSACPAAAISKYGIKWFDFLQGKLKWKDGQPAYGAVLPMSETFSALYWLCQRSTTYVPALSSLGKSFQLQEAMHLHFFALKITNLRRVISQPCQSSVVWLYAHGRT

SEQ ID NO: 928298 - protein, 136 aa, Homo sapiens
MGREESILPKHAVQAESHGTHAKSVTKTGAVLTQGDIDQKWLLLVISLVTAVIFHCHEPALRCFVLRRPTTFCPVLANPSHFPAANGEEAWLILLSSHVEGAAEGRPPLGKGRLLSAELKVKPATKSQGQIITWGL

SEQ ID NO: 928299 - protein, 141 aa, Homo sapiens
MCRVTARALITVPVSVQGCLYHNRPSDGRCPQSITARGQEAWWEPVNDSALWEGYRGGWGTHLLCATPSSPGPACSVGSQLPVLSQPSGLVLWRHCLWTTELPHVSQPDTHGVIPPPRAGPHPPCSAPLSGQWKAMMLMES

SEQ ID NO: 928300 - protein, 164 aa, Homo sapiens
MPKRLNPNTDPCMPERRARHWVCEKIRAENAYLEFYEDICESQVSLKHLVLQIMSSGHSFPLPWSWMEGSTQALSNGMLLADTAQGDLQLPEGSLLTSEPTQVYPRPTSFVQASIPSRQNPDSNSDPSDSKPVTQLLIVGPSLHCYLNSESAEEDTEKGKPYCS

SEQ ID NO: 928301 - protein, 218 aa, Homo sapiens
MVLIAYKYLLLLAHHCPFVFSSLVAFQNIGQLPNNLKSADFGNYKTGWYCLVLGIRKSIRPKHSSANEAEVCMIVHPPGEAAVMKSVGPGEEERIKPSIVSRCQPGRQIREPIPVGGPEWRVPRGGPDDSSVRREQVVCREHHHKCEVRCQHLPGIIAALVSPCYIGRVTVSHWLHEVADLIREWHHLQPRQTLGPRHLGRLTRSSVRTRCGSEFTPG

SEQ ID NO: 928302 - protein, 159 aa, Homo sapiens
MGLWDRIVFQKQHRSTLHCEEVMQKPTSILKGMHEEPNGEAVIRVKKVFIVILLQSQILKDEVGLTRGSKEEENERQEGKVFAAEELESKCSPTSVRPLFLGPQLENIPSTLAANDWVLASAVVGRSDECHFQVLLELDLADPRKSSGGPRGLWSSSSR

SEQ ID NO: 928303 - protein, 171 aa, Homo sapiens
MVVKARRAPALWKRAEAGGEKAYVWGLRASSSPLVPQCQSRAWAGGLSWRPQHPHRSNLQPPVLPSWQMRSTRASGLCASDTRGVPPWPGPSLQGHQESGASGQGLPSGVNARLTQDCPIVSDYAGVGSVIGHSYSIRDLSLRNICRGLAIRSLPASPGSLTTSPFIPHSH

SEQ ID NO: 928304 - protein, 163 aa, Homo sapiens
MDPTEFQNPQPSFPGFQRPTNPITQIFLRSFARAAQIIKILELDLEICCVMRLDLNVTGTWKPCYTEKSGYTDIWLMYSVILIPRAGKGMKYKSFRLFGEPDQITKLVMSPGWGHWQLLGSCCNTCLLLIQQANKLRELLELPGWIWSLRLTVFLMDVGLRTG

SEQ ID NO: 928305 - protein, 144 aa, Homo sapiens
MLKQSINEFTQAQAKIGKVGAILICERALDCLLLRTCVDFMRQPQNWSAEDSPVAQQQAASCTSMPLTWSLYAGTSTTSQVSNYNHHSHTMATPRNLCGLCPTEDLQPMAYLSGGEFQVCTQGAWEVVKAKYLTSEISVMGGNF

SEQ ID NO: 928306 - protein, 142 aa, Homo sapiens
MAPGEDQALSFWIPSGLVASIVDIVMCLHPNLILNYNPRNLYVSKERPGGGALSPSLSTSPSCHLVKKVSCSPFAFCHDCKFPEVSPRREELDLSLNQQAYKPTRPLGQGSPTPGPWIGSGGLVAVHGLLATGPHGRRCNVY

SEQ ID NO: 928307 - protein, 127 aa, Homo sapiens
MGKLDPHLRILPTIVDVFFMLLPSFVNLAKRTLLNIPAFCHIFINIKQGLADIDSSICSSEGNRGVKWTLFYGLRVTLPSLIDDCSVFQAEGQFPGGIVGRQVASGEAAKRVIGTFCQQLKHRQHGS

SEQ ID NO: 928308 - protein, 142 aa, Homo sapiens
MPLAVNLSKRKSHHQSKVMGPRGVVIPLNSQVSSILISDFFTSVSWNHTLRPPIDTRDMEMEIMTFILVVNMKRQCRRQDDDQEQAEVNKNQGPCQKEACRTEALMGPGLGPHNGRGDANVSQLGISGKVCFSAKDGYLFFG

SEQ ID NO: 928309 - protein, 146 aa, Homo sapiens
MPKWGEECLQVSVWGHLRVGICECVSACGYLHVCICMWVSARGYPCVGICMWASVFCMWVSASGESLSEIKSRGRMECGQLQARPCCDMTCMLGTGRSKKCVRDAGDADSEGSQGPGKEHVVSASLDAPLLRLSSDQNCILDQPLR

SEQ ID NO: 928310 - protein, 142 aa, Homo sapiens
MALKEFQKLKFSEIVNTPGRQLNLKIKIKFWCDPDEDSQQRRAGPGRTTEVLNRSMLGCSSEWGPSLLLLSHLLQGYTGVLLFSRCWAITFHHDFWQNQIGLTILLAFPLRPQEGAPESYLHMGKLKWLALCNWTEGLGCSK

SEQ ID NO: 928311 - protein, 138 aa, Homo sapiens
MGIGPLGYSIAWATEEKVLGSRDFSPRALEDVAGIPPRDSTLRCPDACPLLDGEHGAFLGCWPTNAKRLAHSPSRHSQEPCLEPSVSCRAWDISEESEARMPELRGALDSETRLREGSTSDNWLREGGPSNAAQPAPG

SEQ ID NO: 928312 - protein, 134 aa, Homo sapiens
MVVTHSISFSEELANPPRPGKSPSSWQQVSQAQGEGSACFLSGPHNALAWQGVPPGAGAERVAEEETPPRGTRDQESQQGLQKSPDSGFSLLSGDMEPYRGANFLWVINKQFLAEGPPHWTWEAHTTLPLTQAH

SEQ ID NO: 928313 - protein, 149 aa, Homo sapiens
MLPAPTNLVNGFVTGVLLFAFLYGIPHVWAKQSFVEHLHALPPFNSRRAWEVVFYSYLTEEEMLQEVFQDLLQVHFLPPLQMANRPEFSMKERATDSNGAALRLWTPTIRVGPKSQLCSSLSACYSDIPASDPADRSCSCSCKCLPWLL

SEQ ID NO: 928314 - protein, 178 aa, Homo sapiens
MQAGSISRSKVPQNWNGGRISQSSAGTKIGDGAQIKKAWFPEGPEPPERTTLTLKCESGYTGSCKGSWEQGPPLSSCELQLMKPCSVKGPLQGSPAAIELTEDNVRRGPTAAPLASPQPWTQDSQASKLQTGSFWQTVHPAGSLRGSFLCKAKKEERGSKPALHLSFSPIIHRYIYKG

SEQ ID NO: 928315 - protein, 138 aa, Homo sapiens
MSLLRPHSLILVLKLRDAADQTDVASLTLKDPAADKLLECVQTESSCYNPDIRPCCTDSVAPGPGTWTPTRSRTLYSHLKSMTLSLAAAPQRNSPQSLLLWVIHSRFKILAVVSGQVRVTCHAKVQDKLGGHSGCCED

SEQ ID NO: 928316 - protein, 141 aa, Homo sapiens
MILVVTSASAAFSFEGEQQQQCQLLCPVFRAGASQSPFFSSILAAAYSMCCSDIREDLQGGPLKWRSGSLELHLWVPTGFLVLESQPDSLDLSVEAGSHLDVFQFVGLGGKKYGGGKIVQTSENVPWPYAFLWTGGWEMLG

SEQ ID NO: 928317 - protein, 149 aa, Homo sapiens
MMVIKLKEKLLAASSLLPSGEVRDAWRTAVAAPSKVLPGCRPGKELRNMMTVYLNMDKMREGFGNIRVAPKKGIPEPKPAAQLLLVAQVLRLRNGEAPSPLFSTQLIGRGRKLAAGERSWAKHFSTGESEDSSNRSQAGLTPATSVSHS

SEQ ID NO: 928318 - protein, 258 aa, Homo sapiens
MVIVLVADDNGSGHDGDGGGDDDDDDGNSDDNIGGDGGGNGNGNGDDGGNGGGDDGDDPAGGGSVDGNNSGHGSGDDVVREVLLQGDTGHSSEIELLLCFPFGFYPYAVIPLAGNLEGREMTPRSQLETKTISYQKTSFGASTHPMTNHTVRLSICPASCRQDQCLSNRSFCTLGEGTLAPSQGFAGRELEGQQDGEEEGALQANWRQSGKLPETPAKTAERAWGSTEAYMTSRPRVTGFQKAGKLMTCISVPLCPYR

SEQ ID NO: 928319 - protein, 116 aa, Homo sapiens
MAMKLFLNTGFIIIQVWRGQQIRTQPPLKRWFITHSPKRRRHNMPWVVSKAPDFEAPEIQKIKRHDEYRSRGIPEGGIVIIGDDSCMHVTAPVDLPVGQGVEVEDSDIDDPDPVEA

SEQ ID NO: 928320 - protein, 136 aa, Homo sapiens
MVLTMQRSQDRIHPHRKKSIHNLPWAPSNDSGHTSPLSGDRPSARGVFAHNGWQALAFIFITVLKVNGICHILSWLTLMWGEFPLPNDRKSWNPRINIKPESDQLLEVKPFVGKAENRLLNCKEKVPGHPKGQLPN

SEQ ID NO: 928321 - protein, 150 aa, Homo sapiens
MKAAVQMLAPTEDQTRGHSMVLQWEACGDAQGFQGNQDLKWLCHPVLQTLDGSSWTWIKLRICAEVRAACLANSWISGEEIGTPAQGEGGGMDTEEQSRGQLHSQVWRAAVGEALSGLSAQQLRGGYHKNIREARWVGGVLDREAASRMG

SEQ ID NO: 928322 - protein, 145 aa, Homo sapiens
MAGVWSPTDQHFWHPAHENRIPAPDNGTAGCYQGQEVQLGQWKKSKLAADTAQWTGRQETGPTLGWTGVSERAKGRIQTWKHDGASYETGSKASPSLWIWSISTLTCQCTIAQFSPDLLGMTRGLPIGFSEYRLITLGQWLVEVF

SEQ ID NO: 928323 - protein, 145 aa, Homo sapiens [sequence omitted]

SEQ ID NO: 928324 - protein, 117 aa, Homo sapiens
MGIYKEMNIAFITANTTSILLPMDQGVFLTFKSYLRNIFHKALVATDTDSSDGSGQSQLKTFWKKCIILDGIKNICDSWKEGDIATATPSFSNHHPDPSAVISIEAKPSTSKKMMTC

SEQ ID NO: 928325 - protein, 141 aa, Homo sapiens
MDIDKGDWATKQKSAFGRYQPAREDATGSRTTWASVGPGNGVLFVQGPWRQPLCESLLLLLINQLTQICPVALSSMTLAQSLARPPWPTEPKCILPRTVRVAPPCDHVITGHSLHALIMSITTRATPERIQDHCLMLSRCC

SEQ ID NO: 928326 - protein, 200 aa, Homo sapiens
MPSTFQYLEAAIPVSTVPFMDQFICQSSLQEELGPSWRPAYACQPLWPDDKRAAHSWERTGKSPCAEPPWSSILGLFAPAHSPWWCCTLTRAPRLFLAPAFSAEFQACVWLYLLGRLTGSSKPTNVKPVCPDFYPKPDDCFIPCLEKSPLPTHCLNQSPCSHSIKVEMTESLLESRSSHSVSQQHSSSSTQRTAVHGGRA

SEQ ID NO: 928327 - protein, 133 aa, Homo sapiens
MQLSHQPGNCPLPEGPGRSTVPQQQQSRTPGFQRETSSGQSAVTADSTRPGGAVLERGTLVIQWHQRLIVTSGTPTEKGFRGCPCNGSPASPPLCSLFLLTCQELTEGLRGASGPAHNTHGAAADWGDLPHGI

SEQ ID NO: 928328 - protein, 162 aa, Homo sapiens
MRVWGRPQEIVGEHGYKFLLWAAGFRLFGLKSHQSPQVFADLPTSLEGAASLSDPSILPSSCPAQQRFMDSCGVQGTVRPWYHNELGGESSPVNEHFISPFRTQSDNVVRVKIIYSLFQTKDLSVGEMRSEAAGSALSLSLHRVTVPEMHTSCLCSLVLDRS

SEQ ID NO: 928329 - protein, 128 aa, Homo sapiens
MSHLWQKCKKPSQTTWVQVRTVLASCLLTFRGQESKSCDKPLNQPKIDCPPHIAPGGTKESHGTSSSCMIYYREGEGRAPSGDPANSLTLPALQTSILLHVSQPKGWLGIEADKKPSWSHKSKLNSPI

SEQ ID NO: 928330 - protein, 130 aa, Homo sapiens
MRDPAPMAQSSPTMSQPQHWVLHFDMRFRWGQISRQYHKPFQFCLFIIPSHSHPHFHFMEKFIVYKCSSCLFDQLQILIDWVPQHYFYFLKFLFILQQTLYLNLSFTICSSSTPENTILQLNSLEKKQNQ

SEQ ID NO: 928331 - protein, 154 aa, Homo sapiens
MNRLFLFSFGWSSFISTRLKRLKSRCQQSWMEIMGKVNLLLKLLRFLAEFSCFSLYDEDPYFLNLWLPSSSSQKWWLFFRLQISDFLFCPVFLESLEISNCTHSKREKRTGRKFATILERRMKESPKEVTAVAAMFKEKLEYKNEQAQTEKRSR

SEQ ID NO: 928332 - protein, 140 aa, Homo sapiens
MQVCAAVAAWHEVGGRGPAIRACVCTSGSSSTGAELAGRVLAGALCTCVYLGSSGHAGQGGKDARLCGNCSGDARTLASLYDHPGLNAYEQYRKRQLIGQNIMNLADGGRVGSYLTSFGTMNAKRAIIIYVNSLMAKNTK

SEQ ID NO: 928333 - protein, 150 aa, Homo sapiens
MFPFLCPCVLIVQFPPMIENMRCLVFSFQLYQISLVLSLKGCFAFQLLYCFTGFLKFLGLDFDILLNLSGLLSCPDSEFYVCHFSHLSLLKSHGWGASMAICRASWSVSVFLMVWCLGEKLILAAASQPSWLPSPKNIFYKQYKLSVQYL

SEQ ID NO: 928334 - protein, 237 aa, Homo sapiens
MKDLKFLLPFRTKQEKIQRPPPEWPPKWHFHDRLVITKGLLQFAGSPLQTLFTWVSQVEAAEQQRLLPAPSSGRFNPEGHWPDASWSSREWGVCRPLLGGLSQSGSPGGSATVFRAGRQELLSPLKLHPQLPLLPGALFQGYGSFIHKPMTGAAAFFSEMSCPGPGGVGTRGNPPKPKPSALVWLEAADQSCSYSVILPDPYLPPNKFKSYVNLSYQRLQFEILLGFDDNKSEMERD

SEQ ID NO: 928335 - protein, 143 aa, Homo sapiens
MLKTLNKLGIDGMYLKIVRAIYDKPTTNIILNGKKTGSVPFENWHKTGSPRVAAVSGIVHIENLDTCYTFLNTTRLREQGIIIGFVCQGGYFKHPNDTGSKSLYHGKSDGENFILSMQVLESCPWRIPDPTQTVPSFSLHCQD

SEQ ID NO: 928336 - protein, 152 aa, Homo sapiens
MRYEREITLAPFWLLSQYMQTDKLYITCGHCATSLVPSLSTMSELLLQRTVFVALEDTSLSLPSMCLDIALVFQRPYILCAPREQTIPRLLGSSSRASVRGQILLSSALEVDEEIYVSGYYGVISPALTTSDNPVLTSMLQKSAFPVYSRTT

SEQ ID NO: 928337 - protein, 141 aa, Homo sapiens
MIHGSRNQGEEVEVAPLTINPTNPLRKFLLPVPATLHSAGLEVLVPEGGTLPPGDTTTNPLNWKLRLPPGHFGLLLHLRQKTKKGVTVLDGVIDPDYQDEISLLLHNRDLAVVPFQPSAKSLSCLTQRHFGSLLGSLLQVP

SEQ ID NO: 928338 - protein, 179 aa, Homo sapiens
MIAKALISFVFPGEIQQWMQGRLEGDQDGEQSKGQAMQDLASHVEDFDLHSKSTGKPVTEEDGEPWGMMPMAIFHCSCPTRKTTWVSHRVELCLFLISRQISLPIQMPERVVGSLIARIPEVHSESGLPCHHFTHPFPRSSSGPGTSSGTQQPHAGFQASSFFSFGICITSSQLVVFSL

SEQ ID NO: 928339 - protein, 146 aa, Homo sapiens
MPPLVGPELVLSSGFMVLADFNNEATDPRTLGMMQQETPHQMGCLSHGLPSLQTISQINVMLMQEVGSHGVGQLYPCGFSGYSLPPDCFHGLAISVCGFSLCMGKAVGGSTILGKLIIMVKGEANMSFFIWRQQGKVLSKRGKSSV

SEQ ID NO: 928340 - protein, 142 aa, Homo sapiens
MRIGLYAQENLASLSRVGWSVASALPAQIQAKHGLQLGISLSKLYVDPGIREAVPWLQPCLYSWYRGSQNGSQLKLLQAWLPVGFCLHQKLQIDVNELLYGVWRLSFHNNVCLFLSFRYFLYIVSQKGHLLFFYQLHSAITF

SEQ ID NO: 928341 - protein, 167 aa, Homo sapiens
MRVTCSCQANLELYQHSVHRELDGFSLPQDIVPTHHVDDDMLIEPEECVFTPMISLSHSEFKMYTSWTVVIQARLHNASTGLAPSCLKLSYPVLGHQTLQPSPPTSPKDFIQQLLMTSSVVGSRRSSKAILKAKLAPKKVIVTVWWSDAGLIHYNFLNPSKTIISEK

SEQ ID NO: 928342 - protein, 152 aa, Homo sapiens
MVRPACFPFAFCHDCKFTEAPRDTSRTACRADVSRNVIQDVDPGMGAVGLCLVPIVLIPSCTIPEYYPSCKAKSSLLAPLPNQKEEISSGAVSCTPWGWASLLYFDPSTTQHTLLLVYARDLDLHNSLTLSQATRYCPKMDCPLRRRFGSSA

SEQ ID NO: 928343 - protein, 146 aa, Homo sapiens
MCNCYNYDIVTIVFTITIITTISSTSSITIITTILSIIIIEFVDFILLAMTCGLRAVQSSCGECCWAWDTPFRAVGSSLAQSTSRNAIQKPRPRIRDPKSLFGADTHEAELAPMVPDKVPFTFASAFLKKKEFLPEATTAENGNVS

SEQ ID NO: 928344 - protein, 134 aa, Homo sapiens
MCPEFLPSGGFVVSLTSGMKPQTLTVSVTAHKEGFLYPGFLPWCTGRIESHVGLENECKILLSGGSSGEVRRDGMGRCSPGVRPLTGQGCPPTPQPNSALFYFACGWPGSVSVPVSVFLSMSSHPGIPPLMCSS

SEQ ID NO: 928345 - protein, 351 aa, Homo sapiens
MHSAPPDIRPRQTCTVHLLDIHPRQTCTVHPWTYALDRHAQCTPRTSALYRHAQCTPGHNTLERHAPCTPRHTTSTDMTCTVHPWTYTLDRHAQCTPRKYTLERHAQCTPGHTPSTDMHSAPPGHTSSTDMHSASPRHMPSTDMHSAPPAHTPSTDMHSAPPGNTPSTDMHSASPTHTPSRDMHGTPPGHTPLTDMHSAHPYIHPRQTCTVHNPDIRPRETCTVHPPHIRPRQTCTVHSWTYALNRHAQCTSRTYILDRHAQCTPRTYTLDRHAQCTSWTYTLDRHAQCTSWTYTLDRHAQCTPHAYILNRHGQCIPQTYALHRHAQCTPRTYTLDRHPQCTSQTYALLCS

SEQ ID NO: 928346 - protein, 174 aa, Homo sapiens
MLNAHRGLIIPGRSLGWRPSVPMGWCPLTDGCKASSGTQIPMTHMGVHTPQPVSLSGPAELARKSSTLEGRRGQIFVFRKFIRENTAFGNRGGTQGGDRRGGHVKMEAEIGAVGLQPRHSWGPQELEEAGGGLGSSGCCNKMLPTGQLQQQTYISHHPGAWEVQGQGAVRDVFQ

SEQ ID NO: 928347 - protein, 197 aa, Homo sapiens
MATWRPQLVESGAAGLLVGAGCPLLFLGVLGYLLWLPMQPGRDLSVFEDSQEQAVAGVEKDEPRSLTQCHLLSHPQEFSVQEQDAQFPGSLLSWQGVETSQSSPCTSSGNLPSTTRDNPQAANPLTATSTSSWQVFLKVASGCGEAPTAPPRWSTELASVLGSCRRRFFLLGRKMAPGSAVALPPLAVRCLCNQSKP

SEQ ID NO: 928348 - protein, 150 aa, Homo sapiens
MVLLIWTAICQCAPRDLQVVSSQIGPRGGNCWCVRATLEYPTPLLTRSGLGAVGGSASQKEHMQNELGAPTSRPAAPLSTSCGRHVAICVCARLEEAAKGALAKCDSKDTFLRNDLRFSFHIKFLPYDPRRLVHALTRPCPHTHAFCLRG

SEQ ID NO: 928349 - protein, 159 aa, Homo sapiens
MVLGAEVIFITTQVETHAPKYLFNAVNTGAIRNTICGIQNVLMHITSFDFGRQRADHVSVLQMRTLMPKELRAPSRIPYKIRGGFYDRSPLAHRALFPSSSEKVMSRIPKVSVSNEVYDLAHCIMGDSAAAVPDITNPSQQEVISCMSAETLIPNEVMT

SEQ ID NO: 928350 - protein, 205 aa, Homo sapiens
MTETFMAAPPTTGPRPRRKKWFHGLGPGSSCCVQPRDLVPCIPATTATAERGQGRTRALASEGGSPKAWHLPRGIELASTQKSRIEVWKSLPIFQKMYGNAWKSRQKFAAGVGPPWRTSARAVQKGYVGLEPPHRVPTGVLPSRAVRRGPPSSRPQNSRSTNSLHHVPGKAAGTQHQTVKAAVSILQSHRGRAAQDHGNQPFAST

SEQ ID NO: 928351 - protein, 166 aa, Homo sapiens
MLRFSQACILILAHLHLQTPAQVKLQSTSIHSGFPLSHHKQSPCTKCAQLKHRGESHVLFKADCVLCISNCSLMIPIPQLSDKHFIKESPKVIAEIQISRLHLHCPVSSYPQNTLKDNSQIQVLLQVHLITTASERHAFQNKRLSVDLLQRSMAWQTSSLPGPLYT

SEQ ID NO: 928352 - protein, 141 aa, Homo sapiens
MRLSPTTTRDILATVWSMDGGCQGPSLSIHLLKDILVVSSFGSYEYGCYKHQCADFCVDKFSIHLGKYQGIRMLDHMLKFSSSSMLTHVSVLHSFLWPNNILLCGYSIFFIHLSNDDVLDCVHLLTFMNNATINICVELYV

SEQ ID NO: 928353 - protein, 177 aa, Homo sapiens
MDPMQRQEPQPWNGKGVHSASKELGNELIPESSEMNAALSFNLAICPLMANAQKTMTLQAPTRSEGLLSLKEPQYNIPFCLEQFLPFWHQLLSMYGTTQAARFEPQIVVQKYHSSGKQIRTSQETGAEGYKMSPGHRDIPNGKKAIKDYWRHLEDTRFTLKRPHHPKMEQLELQLGR

SEQ ID NO: 928354 - protein, 120 aa, Homo sapiens
MLSRKAGFNHIVIAQKCKHICESVLINASASLGEKYRRYRWKQASKNLKAPIISHVCVNYFELMKMKYDQECTSLATAASFKQLVTFMWDSTEQATSSQKAPSGISGSHFHNQVTFYFNY

SEQ ID NO: 928355 - protein, 154 aa, Homo sapiens [sequence omitted]

SEQ ID NO: 928356 - protein, 136 aa, Homo sapiens [sequence omitted]

SEQ ID NO: 928357 - protein, 177 aa, Homo sapiens
MAPGEVLAARGLAKPCKGQGCQEGGDPGSNELSMKTDSRLNLLDDGTLMIQNTQETDQGIYQCMAKNVAGEVKTQEVTLSRIKSSCGLSSIWAPSGCKLCSDPPVLSMAIAQKRSWALEEQRIEALGVPTMALGNDTDQFMPLDGSACRPVQKPVESEPLPREAAGVTSSLKPSGCL

SEQ ID NO: 928358 - protein, 154 aa, Homo sapiens
MSDLLTHTGGSTEHTPHNDHEKEYCERSPVSWKSFELVLSLGGERKVEGQELKKPTVGYYAHYLGDGITHTPDLSITHRTHVRNLYMYLLNPNCSTICTSNSKTGHLPKGKEVILPKRHMHVGYRIKQKWFFYSIEYYTAMKKNKIMSFAATWM

SEQ ID NO: 928359 - protein, 149 aa, Homo sapiens
MSDHGALGKCYQVQQEVSKVRHLRSKSQEMVVMAPVKSEGWSDILGYLGPDSCTPVPGPLDPRGFCNIFRDRDVAPDGWELAWLYQSGLSVATSWPGTDSQAMMFSCETQFHQYQHQTRPLRDHDEDKTKTIIAQTKHIVHITKIAQHH

SEQ ID NO: 928360 - protein, 287 aa, Homo sapiens
MIEGHFRDLHSSPSHHRLRDLGEKNGFVDQAQGPVALCSPGTQHPYPSCSSSSSGGQGTAWAIASEGEPLTRFQRMYGNAWMSRQKSAAGVEPLRRTSTREVWKENVGSEPLHRVPTAALPSRAVRRGPPSFRPQNGRSTGSLHQAPGKATGTTCWFIKAAAGAVLCRATGVELPKALGAYPLQQYDLNVRHEVKGDFGVLIFNGCPGKTNCPHPTQDIHPGGVMLLVLTRTLQDSNPNKEDNRNTREMRNKVSETYITHPCSNGFATWVVATRIQTQNPNIWKIKA

SEQ ID NO: 928361 - protein, 167 aa, Homo sapiens
MEGGKDERNWGERQRRGKEKEGRKEDIVYLRTGKEQVEWKKEREGSSFTLARTFPCSFQFSRFSQASKPTKSKRHTFTGEITNRSQPSCGPLCICALDTSFSFVSVDETSVFLAEDDTSTCLHPPFSPTQEHCSSNFSSLLFSTSFSLSTKSFLSALKNAVVSLHLK

SEQ ID NO: 928362 - protein, 139 aa, Homo sapiens
MTQSPDSLAVSLGERATINCKSSQSVLYSSNNKNYLAWYQQKPGQPPKLLIYWASTRESGVPDRFSGSGAETTLTQSPAFMSATPGDKVNISCKASQDIDDDMNWYQQKPGEAAIFIIQEATTLVPGIPPRFSGSGMYQ

SEQ ID NO: 928363 - protein, 327 aa, Homo sapiens
MLVYHATSPQGFLSPPPFPTHQARGFTPTQDWQIDFTHMPHICKFKYLLVWIDTFTGQILQAVSQALDIQWKLHTPYHPQSSGKVERSNGLLKTHLTKLSFQLKRDWTVFLPLALLRSRACLQDATGYSPFKLLYGLTFLLGPNLVPDTSPLDNYLPVLQQARQEIRPTANLLFPTPDSQPYEDTLAERSVLVKGLSPQTLQPRWTGPYLVIYSTPTAVHLQDPPHWVHHSGIKLCPSDSKPDLSSSSWKLQVLSTTSLKLTHISENSNNPYEPNMFLHSIRSIHPYSTFCNRALHSHPHYLDCAPKLVIPTIFCLVILLFTILNYS

SEQ ID NO: 928364 - protein, 138 aa, Homo sapiens
MFLKSSFLEILAGSTCSYSVYLKKKKVRMWSTFHNDTVIEVDNRNGEKTKKSYATVDYSHPCSDDVIPLHLYGRPFPKRYHQHQGSEIQLVTAKFAACAKTSLARQSEEKRDIFVWNVIFRFMLFCALKFTTQKIIKY

SEQ ID NO: 928365 - protein, 154 aa, Homo sapiens
MGAAHQHGTCIYIEICYFVRAVFPTAACSCSGGVSLLPANYWKFLPRGILEPLSPPFSPNTGTSSERTAEGADLASVLRMKHAVQGSKLQDEIGGQHKIQVMKTLPIKQFAEKKLAKSYQNQDSHKSDLWSSSLLHSRQCHDSLQMPWQHQELP

SEQ ID NO: 928366 - protein, 154 aa, Homo sapiens; identical to SEQ ID NO: 889699

SEQ ID NO: 928367 - protein, 137 aa, Homo sapiens
MEGPALRIFGFNIRLASWANAWPNRWGLPLNAWVAPAFARMSLPNKGVGRSGIIRKACEKSKVPQSQLSGWEKYLVTGCPRTPQIVTDLEDRTGDGQAYPGLCEGDGMGWHLPRAPSVLLLGSSDPVPIVKVLGHQF

SEQ ID NO: 928368 - protein, 146 aa, Homo sapiens
MGPRALSMTRDEVAGSPRWKTIAGVKDETVCPSDLWRTPALSLMGAGERAAHPGVRGVIQGSKEGHLRRPLGFLCCCCSCYPLDLVRARVFWSPAAHPAPLCPENVLETQSVEGGRQDPVECRQKEPGFQEPAWRKRTTWCFEFDF

SEQ ID NO: 928369 - protein, 185 aa, Homo sapiens
MMLPEEGSGSNICCSTASPCDTQANSININKKDIHTKTPSVGHQHQRPKVDKTTNMERNQSRKAENSKNQSASSPKDRSCSPATEQNWTENDFNELTEVGFRKSVVTNFSELKNILTHCKEAKNLEKRLDKWLTRINSVEKILNDLMELKSRARELHDACTSFSSRFDQVEERVSVIEDELNEMK

SEQ ID NO: 928370 - protein, 176 aa, Homo sapiens
MHVLGPLLNEEAQGILWVLAGPVGDGVVTALGHTLQDSKGGNKLSASAQYGNRLLLHHTVPALFNPGGIPGPDRKKDIQADDTDPECGSTRGLLWAKHPWTPLLLCPHPLFTSSFPPNTTSPHAMAETGACVASKPSEGGSGVISTPSRGGRTPPASFAAPPFLPLPLLLLVQKIK

SEQ ID NO: 928371 - protein, 153 aa, Homo sapiens
MVHLSVPDHNTDSTKEVQRNSVNWGYHRGLQTPNLQQEVDVQPALTDTGPSALRANAPCMACQEIKFSPTSELGDLYVFTRACDQTYTLSGADTVVASKEKHFGYGALGSRAGLYDQTWVRIRTLTPSRYVTFVSDSISATDSKAVVHNGSGR

SEQ ID NO: 928372 - protein, 144 aa, Homo sapiens
MQLSPLCLYMCEILGSALPRNLLRSPPSTKSPFFPMGFCAGTSFFGNILPGMTIILIHKNAQRKETAQYMLVVPFSCSSLYHHHHHHHHHHYHHRHHHHPHLELSRNGANSSQSSRLHVSRRTLNPNGTGDIAEVSALASFLEV

SEQ ID NO: 928373 - protein, 125 aa, Homo sapiens
MGRGETEECDEVGVQGQWDRLSGWESGLEEVAAGPDYFSHTLIPWDPQGTEGSAGSNLSPRSCGSLRGPWQREGGRGKEQEGAREKAGQTHPFYQKPAPSITNSHDNIINPLMRTGPITLKYPSS

SEQ ID NO: 928374 - protein, 338 aa, Homo sapiens
MCPRHTEPWNLTGISEFLLLGLSEDPELQPVLPGLSLSMYLVTVLRNLLIILAVSSDSHLHTPMCFFLSNLCWADIGFTSAMVPKMIVDMQSHSRVISYAGCLTQMSFFVLFACIEDMLLTVMAYDRFVAICHPLHYPVIMNPHLGVFLVLVSFFLSLLDSQLHSWIVLQFTFFKNVEISNFVCDPSQLLNLACSDSVINSIFIYLDSIMFGFLPISGILLSYANNVPSILRISSSDRKSKAFSTCGSHLAVVCLFYGTGIGVYLTSAVSPPPRNGVVASVMYAVVTPMLNPFIYSLRNRDIQSALWRLRSRTVESHDLLSQDLLHPFSCVGEKGQPH

SEQ ID NO: 928375 - protein, 139 aa, Homo sapiens
MLPGHANVTCICHCSQLSDTCCLTPTLHLSSFSEKSYKRSLLEGNIPCEKPDFNTNVALKKLAFLARQTRPQNINSSDNICVLHEETKELFLGATASAGTGKRSKRAFPTTTRQSSENDPTFRKDERHVQRAVGDVPHA

SEQ ID NO: 928376 - protein, 191 aa, Homo sapiens
MVIMVMLMMVVMVMIMLKMMMVMMFGNGHGDVKDGDGDDDGDVEDGDVDVGDVDDDDGDGDVEDADGDIEDSDGDVNDGDVEDGDVDVGDADGDVEEDDGDDDGDVEDGDGDVEDGDVDVGDVDDDDGDEDDGDVNGGDVEDGDVDVGDADVGDADVGDADGNVEEDDGDSDVDDSDVEDGDGDVEEDSQP

SEQ ID NO: 928377 - protein, 196 aa, Homo sapiens
MAIAAQGRNAEQLGSTLCLCPVHAGDRPLGKLAALLAWPARQCGAGSVATVASYSCAACGQLGLRPPPGAFSGPERTQRPETFSCVACSSLDLCQDLSELGCLTTGVGEGSHRYRLSAMAGGQMGTSPCWWVPARRDEDSKESGRIPTILKMPGGQMEAEDPRPPPTGGSIDDMPPLGEGETLTLTKFTMNPLGKL

SEQ ID NO: 928378 - protein, 148 aa, Homo sapiens
MSESEKAFCSPQQVGEVMKTKQFHCKSCWHLGWCIMRLGLWLWSPTTTSWFFTHHPGCPSYKGNIFCKHLSVFPLHVTGTLLQPALGTNFMLRAGAAGSDAAGAQTLRPVHTGPDPSPAPVRRPGAMSVLLLLCLTEGIPDFWSHLLP

SEQ ID NO: 928379 - protein, 154 aa, Homo sapiens
MVSVTALKDGLSVICSFRCSDVSGVSSFQNQPSGCVRAGHRGYEGLAWAQRPDTDDMCPLWSGHSLVLYILGRHETSFNMCKKYIGSLQKEGEILCETGEKMKTDERRTRKSSEEEVYTSLKQLPQHHLEGFLEQSAGPSPEEVWGESNDNLHY

SEQ ID NO: 928380 - protein, 196 aa, Homo sapiens
MPDTFYTFTHLGLPPAFVRQALSFPLPDVENEAQRDKIPKFTAEGYHITTEESEPSQRRMQEEDWDGIRRLSHALALGSLSSSNLEGNVRAHEPIVPCVYFPLEQGFGPNPSKVELSQEQRSWLPVAASLTFPSCLKSTCKGARAKRPHFPFPRPYSLGVRNIPFTPPILQCKTTGSRSVVHQPTGQQGWTEVLGL

SEQ ID NO: 928381 - protein, 148 aa, Homo sapiens
MSSPALSSPGCIPRISPVVAGSTFPGVESEETKYRSGLSSLTGDKEVPTPCGSSGDHIGNPDLDSHPEKQSLPTLPCWWGIRGGLPESQNFCPCPVETTPPPTPMVSMEATKEAKTESLGALWEGDTTSLWEVSPSLSCQEPLECPLL

SEQ ID NO: 928382 - protein, 168 aa, Homo sapiens
MSPLPQTDQRPLNLSLRQLWRSLDPPLLHPGLVIARVKSTISPLKNSALFAATDYGGTGLSDIEQNSYDQGILRMCGCVWLCGKICSVPLPWFLEDEWSFVFFGLKKHHPDLYLYLHLAFSLWKSLWLKSLPAAFQKAKEATYLGLFLKQPRCQSSCCELFVPLSSPH

SEQ ID NO: 928383 - protein, 164 aa, Homo sapiens
MVLYRGLTVGFCCQDFGHSAVAGLEVLVTGCRCKAFSIAGCGIIPKMKPPLLRAALTAGKIGRAASGLIPTSHPHSTPMDKVRQPNSQPYQRPQTQFLLVLSTRSQFPASPWNMSNMTITSLCGSQGSPHCLDTAQPLVVHSVPKCKFCVALHGVQCLLPQAPF

SEQ ID NO: 928384 - protein, 136 aa, Homo sapiens
MSYDCAAANQKPQAKKISRLYFIQVVGNKCETVHLVFIYTCIFTFCTAVDYILGEKYSYKVKDQEEDVPHVVRLGEWDFSRRSSGLQDKVCSITPSSCHALLPGPAVTSDGMQNRGAFGELQFTSMGAQGCEGLTQ

SEQ ID NO: 928385 - protein, 164 aa, Homo sapiens
MARQIKRGPQRVSHLPHSLHQILLCRLGNLPRAFLGMPIVHWSPTCALGELGGAMGNACLMQGRSLPSSAPVVTWESICEVEGCKFCYSPFYVSASLIFPGQERYHRGKQCRFDSNTSSDGNSTGRTGTSVTSLSCSKLLGKASRRLTRKVLKIQTKSLKCWKL

SEQ ID NO: 928386 - protein, 187 aa, Homo sapiens
MCRLVTYVYMCHAGALHPLTRHLALDWAAGQRCPPPPGRGSWPGGGCPPLPDGSCRAEMLLTSRTGRLLGGGAPHFPEGAAGQRRSSPPNLPDGVAAGQRHSSVPRRGRGRAEALFTSQTGRRGRGPPHIPDHGQPGRDAPYFLDGVAAGQRLQSRHFGRPRQAAGRCSDAAEDKCRIRQAGQSNWG

SEQ ID NO: 928387 - protein, 159 aa, Homo sapiens
MGGIGLGNSKLSFLPFRVFSINLSSIWSSCESEASFLSLTLFQFRGTCADLLTGISHDAEIRSTNDSITQKIMKIKYKNTLLISILAAVNRNLDVEGFQNNPYIFLLCLTVLPPHSKCESHGNSEINILNAELCLRVSLEDPHSFNIKHIACVLVIPLH

SEQ ID NO: 928388 - protein, 162 aa, Homo sapiens
MLALLIHPFLKIGISMDGEAGKRASFPMRSPEPPSPSRTWGTSFSIWDLKDVLLHPGLGRCLIHPGLEGDPIPFRSGGNSSSSGLGGHPSPFRTWGASFFIQDWGDWGASFSIQYWGSSSSIQDLRGVLFCASLDGRLSYAVIQKVRLTHVVVLNSGISSLF

SEQ ID NO: 928389 - protein, 141 aa, Homo sapiens
MAPVLATVRAGMGATESLPVRTQGSPGFSKLDCCLRCENTQAQRGMASSDPQAGSDIPTSKEPLCPACRSLAQANVAIMGITPGFPKALSVTAWEPILPGDAASRRQVITTQARYEYLTYLMLNDLTGASAVSEEMCSFRA

SEQ ID NO: 928390 - protein, 139 aa, Homo sapiens
MRHEGSAESWFSQAPGELDTAAFREVQGLRQGPQGCPGRTRREEKGRTTSGSGQTTRERRHTGKKEKAKEAQKENLKPRSVLWSPSNTTGLTTWTLRDKVPLSLHPSPAITGPRALHEASARQVIHHSWPMYGCADAPV

SEQ ID NO: 928391 - protein, 153 aa, Homo sapiens
MGVVTAPASQRRPPSVPVGDLGHFLSKQRHRLCKCIGSQGQTHVLEVQEQRRAWESRIWEQISYIFGGILPIPRAVQYSLHYLNLTMIYKINIIILIIKVKEMEKEPATVAHLDSKLCRMDSVNVRYLMAFPQFLRLSSDLKNNFPACSTGRV

SEQ ID NO: 928392 - protein, 151 aa, Homo sapiens
MGRKVQPSPPVSVASQALRQSAKSHEKQCATETMTGVGIFFLNIQALSMLQLEAQRDIKLSRFKTKRDEAKSRGEAGARMQRQQGAGTPTWCLVDQGFEEDGHEKENSKQRDACYHPAGGKRQCGNQGGSDRRCYVVKGPHDRVAGASPEQ

SEQ ID NO: 928393 - protein, 135 aa, Homo sapiens
MPLFYIKFFLLRRQELRLLQTHTDLPPVIISSVKNKRSSLAGIEECRTRELSWLLSKGILEEELDASWSSVRNINKGFNFMDRALAHPLRIHRIPPCMLPFLANAFPWDLLVHFLSPGVRLYPIMFGQAVRKSHH

SEQ ID NO: 928394 - protein, 147 aa, Homo sapiens
MVREFFKEAKTQRKLRLLLLLAGYVPGPEQELITQNTCFFKRQLEADYYRYPQHLLQIGRERGKEALLEVLPSLPVAGVAVTQALPWLSQLSHNHCTLSPPSLQILSPHNVAAARKWARAGVDNSRLSYPPQCLFPLYDVKNRYIIL

SEQ ID NO: 928395 - protein, 181 aa, Homo sapiens
MTAVWQVRTLLIVYQVKQNYKIELVLPDVTISRSLEGLSDNNKYKMNMKTARCMKRLGVWAFRWHFWCYLYQKANPEMQQGSDLPGHVMTLALAVAAVLREACKQEVGTVDWEDMASDHKENQECGVFRKTGEESVSDRSKQQTVLNAAGRSNKIKMGKWPPDLAIKRTLMTSRKTTSLEW

SEQ ID NO: 928396 - protein, 173 aa, Homo sapiens
MISDHKPGFSCFSFLSIISFHPQNNFMNKKTSQAQTSGAGALEMWKGRCPRGPDLTTAGFHLAFLSDACWLWGTLNYNAHALGSWMFVEERQGFAHPLEREKEEEDVLQFTCSQHYIVARSGEKNFWAILKNMSPLPKHYIVDILGFLLHSSSFSTTLFLVVVIHFDDFSSYP

SEQ ID NO: 928397 - protein, 139 aa, Homo sapiens
MCHHFPNAKFVERRWKRVDPLTACIVCLEKSQTLMGWKSQPMKAARREAVPCKATGVELPKTIGTYLLHQHDLDVRHGVKGDHFGTLRFDFPAGFQTCMGPVAPLFWPMSPIWNDYIYPMPILSLYLGNVVLFFKLLLF

SEQ ID NO: 928398 - protein, 156 aa, Homo sapiens
MQGFLRQEHNQSCLQEADPSPSSSMGLPAIQHQAHQVAEKPSASGFPFWMQPWTLSSFSRWYFQGQREFSDTHCKSHIKSLLSSQSTGAALRSLVLSFAQLTGGCHMAAAAEDCGEPVSDVPMQNGSIHTSNLSGKEVECRSSGYGKLSRPRGKCF

SEQ ID NO: 928399 - protein, 151 aa, Homo sapiens
MWTKEGQEVVPTVTGAQKDGLLVPGFSNLTTPCSNKCFHSPQAGDGSLEGLMLVLNPPPCVTPTPHSSLDQSHGTTQGLGRIIASWDQKVPEGKENRIWMSIRRLSYNSFSECRLLPHSSSLFLAYVPSLRPVPSVLTSLQLLPYILQSRG

SEQ ID NO: 928400 - protein, 170 aa, Homo sapiens
MGLSPPIQSLGGSVCLAALGQMFLPCQAPLLQVCWSLLEVHCRPSLPGYHQWRLQNRKDCCLFLPLDASSQRGTGQMPAGALLYEVSVDPCWEVSPCQDARGAGRQERLRLLKLHPQLPLPPGALSLGDGSFIYNPLSAFLSEMTCPERRNLERQSGYSGFVELQWAHPV

SEQ ID NO: 928401 - protein, 165 aa, Homo sapiens
MAWLACLAWLAGWFFWLGCLAGLAGLPGFACCLAWLAWLPGWLGWHACLGWLAGLTGLAGLAAWLAWLAWPAGWLAGGPGWLGGLAGLAGWEAWLAWLAGRLGWLGWLGGLAGLAGWEAWLAWLAGWLGWLGWLGGWLAWLAWLAWLAGLAGLAAWLAWLPGWLG

SEQ ID NO: 928402 - protein, 124 aa, Homo sapiens
MTAFSGQGTDFSNFLLIRDHPPWTGSGQFWRLCLYRGETGFIMSDLLTHTGGSTEHTPHNDHEKEYCERSPVSWKSFELVLSYTLYTSGMYNAQRLGDGIIHTPNLSIVQYPQDTKLPVDPLNL

SEQ ID NO: 928403 - protein, 224 aa, Homo sapiens
MTLRGLPVVAIGESARPDLGLAPWVQHDRGGQGLALGQRTLSDGLQLLAFQGRLINLTRVIRKTCRWEYQVETKDTFLEELLFEPALRTGGDRTGEEEGVPYEQRLATTPSNTPTGPLWHPCPVPVTTQFFPLDPGIQSKQGGPLLQLTANNYNLEPKQHFGSWFGTTKRLGSQKGLSSQHLGFGTPQEGGGSFRHLAPQVSAIQVLFRPAQKSSLDPARTGQN

SEQ ID NO: 928404 - protein, 147 aa, Homo sapiens
MGQVWVHSGSRAQPSLLSQGEQDTRLLLELSGMAKLEAELIPEQGTRASLRCWAGFWCGGWAQILLSLWLWEAFLGTLLTANTRRAYDMGPLPHDVCQVSARDCWERLALGWVDPHCLLAPAPRWCSPHPSDVHPCSALGLPSFHRV

SEQ ID NO: 928405 - protein, 130 aa, Homo sapiens
MAQITFLQGERKGQENLKKDLVRRIKMLEYALEQESIIVNEVKGVVDRTSIVETEKRTGRRSKSKTELLMLQKNYLPSSGFIKASLSGKTWASQTGLRIITRCSAHTTRGRCTLASEVAPENPLCLIPAS

SEQ ID NO: 928406 - protein, 137 aa, Homo sapiens
MRAPTQLLGLLVLWLPGARCDIQMTQSPSSLSASVGDRVTITCRASQGISNNLNWYQQKPGKTPKLLIYAASSLQSGIPSRFSDSGSGADYTLTIRSLQPEDFANYYCQQSDSTPPTAGKGIKYPQDSFEIIYSAVG

SEQ ID NO: 928407 - protein, 183 aa, Homo sapiens
MAGWLGWVAGLAGLADWLGWFGQLCWLAWVSWLALLGGWLGWVTGWLGWLAGFGWLTGWAGWARCLAWPARLAGWLAGLAWLAWLVNWLAWLAWLGSLGLLAWLPCLAGWLGLLGCLAGLAGLAALAGLAGWLAWLTWLFGLAGWLGLLGWLAGLAGWLAWLAWLAGRLGWLGWLAVLAGLAG

SEQ ID NO: 928408 - protein, 189 aa, Homo sapiens
MRIIESWGGREHGLSLITKDEIKQMWSFCIMEYYTATKKNNVMSFAATWTQLKDIMLSELMPGTENEILHVLNWIKQMWPFYTTEYYTVMKKIKSCLCSHMDAARGHYAYDSGAGELITSLSRESMELIYNRSRDPVQILLKYPRFTELLGVGKKNSLTFRPQGKRETPRWPYTSAVSQKTGGVSLFPK

SEQ ID NO: 928409 - protein, 223 aa, Homo sapiens
MTLRGLPVVAIGESARPDLGLAPWVQQDRGGQGLALGQRTLSDGLQLLAFQGRLINLTRVIRKTCRWEYQVETKNTFLEELLFEPALRTGGDRTGEEEGVPYEQRLATTPSNTPTGPLWHPCPFPVTTQFFPLDPGIQSKQGGPLLQLTANNSNLEPKQHFGSWFGTTKRLGSQKGLSSQHLGFGAQEGGGSFRHLAPQVSAIQVLFRPAQKSSLDPARTGQN

SEQ ID NO: 928410 - protein, 136 aa, Homo sapiens
MNLKLENLGSEKHTALRFRRWSHDLEAGKHFCDGWAAGPLRKYLCTPTKKTKALIADPKGNRKGCTTAYMTSGGTKEQHEQGAMVMGIDWVLAACKGSVLSTLGTLTHLLSQQIQDVAGFMNINTHLRLLRAFAWP

SEQ ID NO: 928411 - protein, 290 aa, Homo sapiens
MAEEGNKLASQPSQPNQPSQSASQASQACQPAKPAKPASQPNQPSKPSQPSQPASPGAPASQPTQTAKPAKPAKAAKPAKPARQPSKPSQPARQGSQASRPSEPSQASQASQLASQASQASQPAKPAQPASQPAEPAKPDSEPSQPSQSASQTSQPAKPASHPAKPATQQSQPRDPSQPAKLAKPAKPVSQASQAGHPTKPAKPANQPDSPARQPAQAAKRPKPASEAGQPSQASQPSQPSRPPSQASQASQPARQPAQAAKPDKPASQASQPAKPAKPASQPRQPSQPS

SEQ ID NO: 928412 - protein, 116 aa, Homo sapiens
MGVVLMHDYPWPDQGSAAYAQTSSCFSRGLDFWEMATEQAARIHISRFREIHLWIQMHFFFVHNFSSHCYYALGILDIILQLTLYGPFSPSLLYLNLGRQLRLQMRQTSWPGISIP

SEQ ID NO: 928413 - protein, 145 aa, Homo sapiens
MYSTKGPLKVTFLGVDGWWLKKLGSLGWLCWVAGLAGWLAGLAGLAGLAGWVAGWPGWLDGWLAWLAGWLAGWLAVLAGWVAGWLGCLAGLLAVWAGWVAWLAWLAGWLGWLGWLAGLAVWAGWLGCLGWLAGLAGLAGRVTWLA

SEQ ID NO: 928414 - protein, 174 aa, Homo sapiens
MDPLNCAILLGNPFGSPPIVCELCFHLLNLAAAHFSGPCLFLLELSFHSLSTTAVCRRRIPAIDFHPSGSGRVSAAFLIQRGTHCRFLANGGNERTSFCCVPKIHLQKEREEREKEKREKGKRERGKRERKRERGKKEEKRESKKEEREGRERGKRERGKRERGKRKAETERER

SEQ ID NO: 928415 - protein, 147 aa, Homo sapiens
MFLSSSYRDPLGHWQQQQEAALQKLCSQQQQQHTHKQPWWPRLRDPRPAPSTPSPLVSHTVGEVGPRQALRKAAWPPKGSWNIRSKNHLWRTAKLNDLPKLLDWEVMESELKHGTPSFEPCDFSTKPVGVLNKSHISSCECVVVKNT

SEQ ID NO: 928416 - protein, 145 aa, Homo sapiens
MGTHLLHQHDLDVRHEVKENHFGALRFDCPAGFWTCMGPGDGSFIYKPLTGAAAFLSEMPCPERRNLERQSGYSSFAELRWAPPSSNFPADCCACRENFKPVDLILLGSMGMGSAEIYHLAPWLQPPFQRNEQFCLAGIPGTTGV

SEQ ID NO: 928417 - protein, 141 aa, Homo sapiens
MADAPPPASLPPCSSISDCCPSSERGSVGVGPSEPCAGYNLLVCHLLRLFEKHSIRVGVFRFSSYLKECGYCNLSCICFKGNPKHHSAVVLTDSQMYHLHGLGQGLEEFSGLQGGGASPHGHCYLRPTKSTARPPLMFPKA

SEQ ID NO: 928418 - protein, 149 aa, Homo sapiens
MEAKKSHSLPSTSWETAESSGVIQSKSKGLRTKGPGVGSVNLASKALSGYYPLGLDDSVLPQILDLLAKHTHGERHGRMERGVPGRVRCQSAPTGLCLPIRLLGGHRSGTHLRRQSAGSQISSCMLGEPLLSLKLSDRDMNRLLQDQNC

SEQ ID NO: 928419 - protein, 185 aa, Homo sapiens
MNQIPHLEMQKSPVFCLAAEICISNKELNVNHQDNGENVSRAFQRPLWQPLPSQAQRPRRKNGFMGQGPFCFVQPRDLVPCDPAAPAVAKRGQGAAQAVASDGGSPTRWHLLSGVEPAGTQKSRIEVWEPAPRFQRMYVNAWMSRPKCAAGQNPHGEHLPGQCGREIWGGSTHTESPLGHFQVEL

SEQ ID NO: 928420 - protein, 134 aa, Homo sapiens
MNPYVDLSLAFSQSQVYLSLLEASCVPFPVTLSNFKTLKCRGLVLQTSLSYLSAFSAMSQRKLSAFACLCGSSRTKDCTLPFTCKYKQHTSFLSITAGGSTGDQALFNRHYIGYTLESNSALHGGCKGGRTNMG

SEQ ID NO: 928421 - protein, 160 aa, Homo sapiens
MIRQSVRCAPDSARSPLPLPIRLKACNCSCMAKCPEQFEPARGLSLTLLHYRGSRIKLSGLYTNCLAASLTSLSHPPCQLECPCGGQEVSHAHLPEASGKSRLLLASPTHRFPWSHRSGKQGFPELVVILGFPEECVFHITMVTACLTDIGKEICSQLNS

SEQ ID NO: 928422 - protein, 149 aa, Homo sapiens
MATKTHKLLTLRVHSLMGKDHINEGKIIPGIITTTTPAGDRSHSMTALCSTAMPPPTCTQDKLEMPSLYPCSPGPLLAQIPGFSGKETKHSKEAEVQLFSQVHHKQKIPVCERKKNEDRYALFMLMIKKEEIPMGPAVSISTGPGLGSA

SEQ ID NO: 928423 - protein, 142 aa, Homo sapiens
MVYLAVIFLLPGQLNLLNASHTLIFLLDPLTYSQYHIIQVLLYNCLMCVKFLEANASTGQFPSLGQFWLNFSLLTTLTTKRKEIMAFTATWMELETIMLNEVTQEWKTKHHVFLLISGSKAMRMQKHKNDTMDFEDFGGKGG

SEQ ID NO: 928424 - protein, 143 aa, Homo sapiens
MSSASIYEIQHQQGFLALLGIEITSNEEDQRSPPREAAFDLNLKYEEDFHQQVWGEEDGGILGERRVSKCLEAKEQQQNKTIRIIRSVSPARFPSCGFPEKGLQHWHSPCLSALCDNQCFSQGIRENRQTLDMAVPNDQYWKG

SEQ ID NO: 928425 - protein, 179 aa, Homo sapiens
MSWKADLYGLPQLGSPGFLPGGQWASCGSIQSLKARSPVGSLSLLLSQAHNSLIASSVLGVKKGHPMPCKSTCGSTRLAKHRQGQIKEYKLATPASPSNTLRSSSTLWKLCPFPLHNKSCCCPLFSSVPPLKAVTFTTKVRGFVLQVSETTNPLEETNSRHTKTFKMLLGCEGADFVQN

SEQ ID NO: 928426 - protein, 171 aa, Homo sapiens
MPIAAHSAPSWVLWFRASAPVVQPDTPEFRCLHLCSSISPDHLPVGSYGPLPSSLGSPGPLLNSSGSDSQKEVPLTLTIHLAVCLALTLTVSPEIILNFLLAPAQLWVGSVPAHPSPTLPSHQACTAASPIGLPCRLRSIRQFECSSKTEWCRLNLRGGFCLFYESQRALG

SEQ ID NO: 928427 - protein, 162 aa, Homo sapiens
MGSTKPDARYNLLVCHLLRPLEKHSIWVGVSHVSRYLLSQLPFARKGKSPDPLPFLVEEALNSLATQESLHDFPKFNFPAESLPLQKATTHIRQLIQPTHTCTSCVLPSPHLLNTHLVITPSPCSHSSPGVVKLLLLRATGTAPYLMVFPKLCPHLCKEFLY

SEQ ID NO: 928428 - protein, 185 aa, Homo sapiens
MKSRSARAGLDLGPQQSELMICGPLSQPCGTLILPPISNGNSAFPVHRPKHGVIFDSLFLVSHPTSSPSRIPVESVLKVDRESTPFASLPLLTSLVQATLVSHLESCHHLLSDCSSSALAVLDVDIHIWPQIFMRSTNSLKNVEKYEEEKLLLFYNNIVMFYKLTSVKRNEHRSYTDAQIPTEMV

SEQ ID NO: 928429 - protein, 249 aa, Homo sapiens
MHVECAITLGKRDSDLCELRISLMKYLRTVHTRKDKKQYLMAPTPDESTGGPGQLSETHRHWATEDWVKAKCTSQSLHHCVRDSCFRFIESPLRVTTSLAQMEQQLSLRDMGPTSGRGEACLLSYRIQEGEAAALGDNVMVTADVEVGELPTPKLTDSTFCEESTANKLVCHAKDKGRLPLGDAWEAANEKCPGGAMLACLNISSALTWQPLQQLPASGRDGIYILVLGMARHMASCMHAGKKQSPEEV

SEQ ID NO: 928430 - protein, 211 aa, Homo sapiens
MSVVESFERAAFYSVLGRKPNYVLENNAVYPGNTQQSQGTLNKEQLLVPLSLNAGILITIDGKAKVHKGCVFKAAVSLLQCEFSRRWTDSLLDVSPAPGMRSPEPGLLPHRDRQWNDSGTTRAQDSERPLRPDPDSPASEDEHGSNFLATEKMLANCLTHRGELQKTLYRPDALARRGAKAAPWRERGWSMSWGLQASPSLLRGHRTSEES

SEQ ID NO: 928431 - protein, 181 aa, Homo sapiens [sequence omitted]

SEQ ID NO: 928432 - protein, 137 aa, Homo sapiens
MENGKSTINLSPQITKKSGQNRGDTIYRHWQQAVQNLPPSVLSSSLFPRRKHLRMPGLTALVQFSDGGAGKNIIRTWPPYKGIGFLNISYIRLLHPCLPVESQALISCLGHCENSLPGLSSSVYPTLVPSPHCSKTT

SEQ ID NO: 928433 - protein, 147 aa, Homo sapiens
MLTADSEFPPALGSPDAIWELRPRVRNLRNLSCAYCTVAELAAEPQEKVLLTLPSPFQKQRNLSSWPPLLQAYGSGLFSGPGPHWYSLPSSANLALEMRKAVAQRGKDMRSSIQQSVRSGILLKMTQVSLDADSFIPLESGDNCSPG

SEQ ID NO: 928434 - protein, 160 aa, Homo sapiens
MWELTQGAALKISKASHSDWQAGGPFPLSIAGLRVTLWRRGATCLPSSSPVPPLLLSLAKFLPVPCLVEIFQCVLSLFPKKTMLAASCQEVGAGSWGLGEDLHPKPPPLATAFELKESGDAAGGTFAGLCSGKADLTEGDQQPHRRDSRPQRSFSVFLAP

SEQ ID NO: 928435 - protein, 146 aa, Homo sapiens
MRPPPSLCVPGVKGSSGQQEGLRRMAPLMPKPETRESSRADGCCHPCTCAWPSCQDACAMGHPYSPCPVLRPQGLMLSRLGHKSLAQKVLRDAVERQSTCHEAWQGLGEVLQAQGQNEAAVDCFLTALELEASSPVLPFSIIPREL

SEQ ID NO: 928436 - protein, 149 aa, Homo sapiens
MPEPPPPLWTPVWPQPPRRAQPPAPRHPVPSTTQGLRSAGAQRRTGRQLHLPPRCRIHWVKPAGFLTLVGTWRTFMVCECTNRHSVSSYSGGDLENLCVHTLYLANLVGTWRTFGSSSGIVNAPISALSKQTTRLSVKWTNQQDVGGAR

SEQ ID NO: 928437 - protein, 152 aa, Homo sapiens
MHGKIEQKAQRLPIYSLPHTPTASMLINIPHQSGTCCYRFQALDAGWKADATPCPTELIFSGCGQDKRISKEESLKDSAKKEITHREVSLSGAGGTKQGSGGCGWCNMILIHAQIQNRSPKEVRGSREPSQLRAFLPHCLHSWAKLFVWIVE

SEQ ID NO: 928438 - protein, 173 aa, Homo sapiens
MSRADPIGSWGSKSAHFTPWLQLSVQGWAQDSSIQEEPGQDFGGKGQTEAVSGGNFRFNMMLHPLLRPEELEPKQPSQMASPGGQTRPSLKRETSGAPPKPSSACSADSPIAVECCVKDQREPSKEATVAAEAKWKVCREPGSPSPSADTATNGLSTRCLNFYICEMGWPSDL

SEQ ID NO: 928439 - protein, 135 aa, Homo sapiens
MQEEAGAAKSQAQILAASSCLAVAPGSSVSPSRWCALLAPLQSSAPSAGPGLPLGKSYLVTVRRRHGRASLELQCNLAALLPGWGLQALNLHVIYGLEGPTQVCKEGESLAVESVSFPWAVVRWIPASKSLYLFG

SEQ ID NO: 928440 - protein, 139 aa, Homo sapiens
MYPVHIQFSLNVPRVSFMAVFVVLCFATHRLPCSAPPCQSKTGGLEQLGESPKPFAQPPRPCIHVLPPAPLTRAHWAFCKHLCCAVVLPPARPCTCSLPGTPFASLSLHSQLIVYCPLCSPEAIQILVQTGSSPIFQLP

SEQ ID NO: 928441 - protein, 168 aa, Homo sapiens
MREEGSPEVAQASAAYLSSILDSWASSDCFPSFFGKKTEKPAAVFPDSSGIHVQNVQVCYIENCDKIEKFIERTKLPKLDSRNNGTSITNNEIELVIKNVPPKKSSGPDGFTSEFYQPFKGKLTLIFHKVLKKNRRKGNTSQLIIKQDEDNIPKKTISYIDQKSPIKC

SEQ ID NO: 928442 - protein, 151 aa, Homo sapiens
MQLAVFGKRDPTCLCWAARPPRLLTLLQSWESNHLEVAFSSECPVRCLTGTNCTVVNINTFLSTHPPNKFTEVLTSSVPSWYPGSCPTSRKTGSHTDLKDGECGGLLSGGDGFQWDRWGAAKGMEREGDLTLEYGHPPANLPSNHPQLNSS

SEQ ID NO: 928443 - protein, 155 aa, Homo sapiens
MRQKVGTRVHVHNVQIYKVSPRGAESLVQIVEEDLEGLRKGRMKKVTKSLQATAAWCSQDRALHGLFWPPACPRADGQVALAWYLPIPSVSLRFSAVLQLEGRAMNIKAGLADVLLTGNLLRKKHFSMCGEDARDSPKGPSQFGPFSPLPQPSWH

SEQ ID NO: 928444 - protein, 155 aa, Homo sapiens
MVDEKQSCPWVLPLGIPTACSFLAKLSLLTDVTFTGNARWSILCFEFWDLDDQLEQIAVCGGGRCFLYESRMRKCQPGSRSMNMQVSGAMGRLSDVWSPDLLPRDMDEAGNHHSQQTNTGTENQTLHVLIYKWELNYENTWTQGGEHHTLGLVSG

SEQ ID NO: 928445 - protein, 146 aa, Homo sapiens
MGEEEELKGRPRRRRARLAYLQREPTLQMEQPVAPSHGPLVGAELCPRGVWTVDIVHRNQRHHSLGFYQQHLNWLDICGDASQGSSKSSVQQAALPAQPPSPPPDKHPLTQADTAPALPTGPKTTESITSTHPSLHQLSPNPGVQC

SEQ ID NO: 928446 - protein, 182 aa, Homo sapiens
MIGKIGSLCPTPEQAVGDWGPGHEMTSIGLLLGVSAAKLGTMDMSITRLLSIRIPALLPPTSTELDVPHNVQVAAVVGIGLVYQGTAHRHTAEVLLAEIGRPPGPEMEYCTDRKSYSLAAGLALGMVCLGHGSNLIGMSDLNVPEQLYQYMVGGHRRFQTGMHREKHKSPSYQIKHIAVRTG

SEQ ID NO: 928447 - protein, 350 aa, Homo sapiens
MVFNDYPKINDWEYLLNSDYHQSVESHLLNRSLCLSPSEASQMKDEDFSQNLSLDSSTLLFTHIPAIFFVLRLVYEELKLNTLMGEGICSLLNLSFSWQETTQRLSELLDKCAQLIQSIALYILGDESSVSDESSQYLTRITVGFTLRDLETLPFGIALPIRDAIYHCREQPASDWPEAVCLLTGRQDLSKQACEGNLPKGKSVLSSDVPSGTETEEEDDGMNDMNHEVMSLIWSEDLRVQDVRRLLQRRAPPRNTTVDLNSGNIDVPPNMTSWASFHNGVAAGLKIAPASQIDSAWIVYNKPKHAELANEYAGFLMALGLNGHLTKLATLNIHDYLTKERACQTGMRAL

SEQ ID NO: 928448 - protein, 123 aa, Homo sapiens
MAGEASQSWQKTKEEQRDFLHGSRQEACTGELPFIKPSDLMRLIHYYKNAMVKTCPQDSVTSHWVPPMTHGDYHNSRHSIKVRGDLYVSPDWLRSNSLYDYSTVCLVIHLLMAIWAISNFVVQ

SEQ ID NO: 928449 - protein, 146 aa, Homo sapiens
MLPAWHRQHSQPAPPSSRPPAPWARSAHPGARPGCTVEGFARIREWGRRKEEGGTGKKKKGGGGRRGYPVQSLSQLLLLGWGAPRGLPGIQLGRAGTRGKGFSPRHVHGRTVKICLGWPISSFAPIKRKSPRNSIKATLANALFEA

SEQ ID NO: 928450 - protein, 153 aa, Homo sapiens
MTWIIWHFSCLHSFSLLLSCEEVPSTKTLPIRLKATSTAQQNPPHSLLFNSFAQPDSSWMPDKALGAGARGCPIDPPLSCLTLKPSMNGKLKEHPLMQALWVSKCHGQPPDAAAGPERVLLLPVAKKPSYQPLYLLTCMLPLPQGVESYELSK

SEQ ID NO: 928451 - protein, 139 aa, Homo sapiens
MNYHIYHILKICGHHIMEAVECNIKKFMLNSESNLELLAFFKWVRNVDRIRFRKGTDLQQTSKDDDERKGDTRKLNVAANSWINWMGKKPEVRSVALKTSADSEEEMKGSCDLEIKQMHQRKSLIHSWSHCIKGIAFSI

SEQ ID NO: 928452 - protein, 186 aa, Homo sapiens
MNGIEWNHRTESNVIIIELNPMESLNGLEWNHRMDSNGIIIEWNRMESSNGIEWNHHRMKSNGMIIWTGMESSSNGIEWNHRMESNGIILEWNLMKSPNGHEWNHPMDLTNGIERNHHGIDSNGIIEWNGMESSKKGIEGIHRMESNGIIEWNGMESSSNGLKWNNLRKESNGIEWNNQMDSNGII

SEQ ID NO: 928453 - protein, 152 aa, Homo sapiens
MSSDCTPFLALLQQINLCHQFTKSTHERKNGISLNIEFFKDSINANGEKIEKIQINISRNDKGDVTTDPIERQILPRDYYEHLYARKLENLEEINKFLDSYNLPRLNQEEIESQNRLIMSSKTESSYKDYQPKKAQDQMDSELNSTRCKKKR

SEQ ID NO: 928454 - protein, 155 aa, Homo sapiens
MAGWTQSWCTSVLAYKRVKETLPSQLSPPSMYGFDDDRRRLGSISHKPTLCFQMTRVEIDGCSFQCCPLYKDIPPFMLLMVPPGLRFLILLIQKIVPFHTDASYISGQGMWLALILWPKSVQLGKYFIPISLISLESDTFCFLQVTSSGYLSFNV

SEQ ID NO: 928455 - protein, 143 aa, Homo sapiens
MFNVRYTAIVTGRIQSLIFFVLRLSCVCPYTFKSVSVICSFSTVSRHTQHYPQRLRELRGLRKRLTNPVSQKETFNRDLGTEAMSWQPREEVVDPSTVILQTQSLFLPQGRNVWDSRLFRERQGFTYRRDLCDQNSDHSTQVR

SEQ ID NO: 928456 - protein, 151 aa, Homo sapiens
MSEDAKGCHTDPLHWLAEGSRLTQKCRASTELLTLKPSTAKSTVTLFLGLQGSQASPDAATCICMEFAPASAQKRSPWLLHLSPVCSLPQGQHDLFNYRKDKKQTPHVVTRRWEWNNENTWTQEVGHNTLGTVVGWGEGGGIALGDIPNAK

SEQ ID NO: 928457 - protein, 201 aa, Homo sapiens
MKGSRKTLTSLVVPETPLWVIPDNRNLPKVLKCQKAALLSLMLYALREPIAGHIIMQAATCKLGMATKVSLLQDEAGLALWYVPAAGRSGLPSSQYFFRHHVSGKVTPFPGLIASWGVTGYELSKQQWEFVHLTDSVATVTYQGAQWNIAAFYPLNRTSLIKDRPQGPVHLAKLQAIILAQDAWASNEAIYTFRIDSQAIV

SEQ ID NO: 928458 - protein, 160 aa, Homo sapiens
MSSLDDLVKIGLYFVSSKSKTREAENIFALLIFHHRPTLPPNPGIQVTVTNRCHGPQEEPQKDSSAAALDTHRSVNLVANCICEGSRLCVSYENLMPDYLRWYSFIPKPSPTTLIHGKIIFHEINLWCHKVWGLLPWTIDRYFYFMKNPPLKQWAKVGVM

SEQ ID NO: 928459 - protein, 159 aa, Homo sapiens
MVAYACEEASRNFYSWLKAKREQAVYMVEEGAIESEGEGSGYGGEFRWLGVVQRLTSLFSKEGHGCPQPKAGWPAFSNWVQLHEKVGYYVVLKATVIFEDKKDKDITCILSCQPESETASAKLTETVKEIEPNQLHLASNLQVVLVHFGVYAELTLQGT

SEQ ID NO: 928460 - protein, 138 aa, Homo sapiens
MWQHITQTPPQLCFPRAIAAPAELSFGPHSNPTDEEGSVAQRGRHWTQASERLRGKVCIWCSFQRSPRLHCCFLYMLGCHAPGNPTSISVERLCTSAPPPLGGMFHPVLFRTKDLSGVFCLRSPRLHPAGKTHSKVKL

SEQ ID NO: 928461 - protein, 226 aa, Homo sapiens
MSYLSPECGQVSYKPATPTGKQTSPQLAPPCSTNRELSYVESGLLTCQPCPCKSVWLLRLGGWDEQTQLRLLVVNAPGTAQAASTRDRRVMCRCVCAGGDWGVHGRITAVSACIAIGPSSLCMRLCDLTPSVKKPATGHRVYLKSYLDDICTRPIPNKVALTGTKADPAWSAALRGPLLHILHLLLPQLNPSNGFPGNVAGPRAPLLCAAFGHDTLFPSHYSSSHG

SEQ ID NO: 928462 - protein, 200 aa, Homo sapiens
MSLLLLGLSTMQKGGPASVLTSVASAPTSTRAMGADTSSTGAEKTDGRCESIAGEKWRKCRFLFLRPTGIPISSCLINSPSTCRPPSDNHLLKEASLAALEPVVDEPPVYRVGAAGKLHLHGDFLDGFWFRIGVQMPIDVDQGTECRGPTGRSLGPLAHPSWSGDQGHGCQFPGSSNILDSQCCRLWHPKKEHTSYAFIL

SEQ ID NO: 928463 - protein, 314 aa, Homo sapiens
MLMNYSSATEFYLLGFPGSEELHHILFAIFFFFYLVTLMGNTVIIMIVCVDKRLQSPMYFFLGHLSALEILVTTIIVPVMLWGLLLPGMQTIYLSACVVQLFLYLAVGTTEFALLGAMAVDRYVAVCNPLRYNIIMNRHTCNFVVLVSWVFGFLFQIWPVYVMFQLTYCKSNVVNNFFCDRGQLLKLSCNNTLFTEFILFLMAVFVLFGSLIPTIVSNAYIISTILKIPSSSGRRKSFSTCASHFTCVVIGYGSCLFLYVKPKQTQAADYNWVVSLMVSVVTPFLNPFIFTLRNDKVIEALRDGVKRCCQLFRN

SEQ ID NO: 928464 - protein, 159 aa, Homo sapiens
MQKEAAAVCLDNTLVGNMTGVVFGSFLTTTSSQVLFYFLNTPATSASLLLPLSFSKPPSFQEKPTNSSLLPYSRPPQPSKRLTSITNNQLEQYNDSQSDDQDGYRVTEEWVAYTAGRHWTKDDSHTRWDRTGSWKVASRNLNFGSSLQNCESADSVSPI

SEQ ID NO: 928465 - protein, 188 aa, Homo sapiens
MDLWGLMVHPYLISLSTARIFPQMTEYEDSLPLDLLNFNMTFSCLTCGKLFKMGHKAAKTTRNINNAFGPGTTNKLTGQWLFKKFCKRDQSLEDEEHSGWPLEIDNNQLRAPASVNRGDPVLFHNDAQLYVAQPTLQKLNGLGFKVLSHPLHSPDLSPTNYHFFKHLNTFCGENAPTTSRIQKMISKS

SEQ ID NO: 928466 - protein, 315 aa, Homo sapiens
MPLFDKRFEIINAIYEPTEEECEWKPDEEGKISEELKEKAKIEEEKKDEEKEEPIGIPEFWLTIFKNVDLLSDMLQEHDEPILKHFKFIKVKFLDAGQPMSFVLEFHFEPSEYFTNEVPTKTYRMRNIKKQQKHKGHGTVCTVTKRVSNDSCFNFFAPPEVPESGYLDDAAEAIHAANFQISHFLPECIIPRSVLYFTGEAIEDDDDDYDEEGKEADEEGEEEDEENDPDYEPKKDQNAADKCGRRRGRRRREEEEEEEEEEEEEEEEEEEEEEEEEDLQLFDAFCKKKIKVHFLWSDAHSCPILLLPPLIFLGH

SEQ ID NO: 928467 - protein, 276 aa, Homo sapiens
MGREVSSPHGTCFVAYPIGLLLPFSVTGAWCGRSLSLASSHHLLGGSFLVVPSTPYRPLRQDCWAWSTAQAVRRPGEGWKGFVMRLVGCPVDPTVPDYERDKLLLANWGLPKAVLEKYHSFGVKKMFEWQAECLLLGQVLEGKNLVYSAPTSAGKTLVAELLILKRVLEMRKKALFILPFVSVAKEKKYYLQEVGIKVDGYMGSTSPSRHFSSLDIAVCTIERANGLINRLIEENKMDLLGMVVVDELHMLGDSHRGYLLELLLTKICYITRKSAS

SEQ ID NO: 928468 - protein, 144 aa, Homo sapiens
MSRPAQSSDDQMGKRLSWDCLRKHRWVLYEKRSWMSHVGGGTDSGAPGHSIRLVIHSLACDKWFQGGGLQRPGSPCMVGQAPFGFMDYLGLELPQDPDPRNGDDDEGRQIKMAARDVVANIGVAMTTVMPVIVELRKQAVRKGR

SEQ ID NO: 928469 - protein, 143 aa, Homo sapiens
MSQADWLKQQKCIFSQLWRLEIQGELATGVLSSQRSSPLTCAGSQRELLREDIKGSNLELLHIAEAETQDSFQTPLCAFCISPDPYPSLQDSSSLILPKYCSPISLLDYFFYFSSSKLKKKKKLKGCTATIINLSNSSLHCGK

SEQ ID NO: 928470 - protein, 127 aa, Homo sapiens
MQTKSQTTRNRLRFRSVWSTGVCFPLGPISIHDDGIKIVNGITPTKLLSYIHSFQEDIIFGGTTFNLMLFPEMTFFFLHLATVKPKVQGNQDTECATEMLLELATYIKELSVPQRDAVSHLFFQNLM

SEQ ID NO: 928471 - protein, 154 aa, Homo sapiens
MGRCGWVIHCGILGHLLALSEPPFSYPRNVDLDPVISNHPRVCDSATKKSKRQVQDSMCLVAGESSLSPQLTAQLRKFLPPTPLLTPFNIRTEFSHIVALTHFLYTCCFLSLECHLFLYLENPCPLKTQVRSHVVLLCYHLMQSVIIPSLLFCI

SEQ ID NO: 928472 - protein, 232 aa, Homo sapiens
MAAATESNPVHPSSRATAQPLLPQSEHFTRDPESPHPLPTTSQCLANTIGGLRTHPPGPAPYACSAQACSLGFWGSDSTIHHHWHLSMPPGRQKAGQPNLLSSPQLIPPHVQPVGLGTFLNNPSQPPPTPVQIVWEPEGCPTTATAMAYSMPAAKEPEDLPTCPACHCSYWLLSKPPGVQESAHLDPLKTVLVYVTLGPKDRHTQPANAPTRASGLAHLVSPTPTKLHHSLH

SEQ ID NO: 928473 - protein, 140 aa, Homo sapiens
MRTVWSLADHLKGENNGIYWEKRIKGKQRLSTKPEPLVVRFSPRSFKIPGSTQEEEGPGSSLLETVRTSVAPPQGALLPVHRRVAVLPGSPSHPAVSLSFAYFFYLCQTQPNRLRLLPHYLATFFASTFLSIYSVQRATR

SEQ ID NO: 928474 - protein, 127 aa, Homo sapiens
MSGGISYHPRLDNEADKLAIPVPVAVAIPNPITAYAAVLPSPSHFDGFGSVIVPLWLPKCVWNWWVLGLTDFKNEATDPRGLKLQTFAVSVTALKAAHLELFVPPGGFVVSLASGVKLQTFANTLYH

SEQ ID NO: 928475 - protein, 140 aa, Homo sapiens
MGEESPLLGCFSSTHWRPLKTLALSWAPGLQLTRTDTIYQHSSQEGMISNFGLTLCGSWPFPRVFGPIDETAGPHVPIPGLEARGLKSRCLQSHVLSEDSGGGLFPAFSGIWQPQVFLVLWQHKKLNWIKDCRGVWCGMS

SEQ ID NO: 928476 - protein, 338 aa, Homo sapiens
MGSFSLKSPVLTCDFWCGCYQGPMRDGIVSVPSHFSGPHSMQALTIIISSPSEPHFVRFSVYQCLSLCDTFFNKPSCIEKRAVGHCSLHFRALILSSVPKEHKNHTCLFSILSCKPSHTVLEQKCPGLSSPQHQQCSSIDQLEPQSGSLNSFPWAKGQLPQVSVLHRGLHTPARSYHLKSLHGVTAPGMLSTSTELGNGKHFLKITLLFHPGILRWISLVSLIHDVCKARPLPYDSKGLPGLLLLWPSPSNVQMWYMTQLPALRSCNDHLLCFFYKSCPPKFENDGLIVGIFWVGPYIWMLWNRSVVWSTRMYSCLVGGRGSTRKMGMVVAKGATGMV

SEQ ID NO: 928477 - protein, 178 aa, Homo sapiens
MIQTVSHPIQPHPHLDPFLTTQSVSMIQTVSHPIQPHPHLDPFLTTQSVSMIQTVSHPIQPHPHLDQFLTTQSVSMIQTVSHPIQPHPHLDQFLTTQSVSMIQTVSHPTQPHLDQFLTTQSVSMIQTVSHPIQPHPHLDPFLTNHPISFNDPDSQSPHPASASSSSGPVSDQPPNQFQ

SEQ ID NO: 928478 - protein, 171 aa, Homo sapiens
MMTMARPGRIPHHLIHVAAVLDCVIALILVHHLCSYFGEGTVQQVTKIFDSEINLLCVSASIKSLNMFSCFIHTGLDHLTFPWQTFVLQLIQNDKLKSKANVLKWTTEVTAAPVTTETQLQAVNKCQMAQSRSLKLLSPGLVCWYPYTSCVLERLYYILHLKMETRASVLS

SEQ ID NO: 928479 - protein, 195 aa, Homo sapiens
MEEIGFFKKPFNLWNFELERDDLGYLVEEISRQQSVQEEAEHKSLENLQPDAAIEKKKLFSGEKFKPAAEICISNEEPNVNHQDNGENVSRVCQKTSQQSFPSQARKARREKWFPGPDPGTHYCVQPQHCIPATAAMAKRGQGTAQDIASESGSPQHWQLPCGVGPVGVQKTRFEARYVAPAGLQSSRDLPASVP

SEQ ID NO: 928480 - protein, 186 aa, Homo sapiens
MQLFSSNFHDVTWAMSIFLPLASLKLPFSFCFPVGPPHSDLALRWSYQLQSAFSLVIHTWVKDNARHVLPLTCLAINLPCETETTAFRPCPSQSVCEVGASSSCAHDYNTLPTDPFVLAKEVCPNLKLHHESQELPSTCDHQLSSPTDFCEVPWEARDINSSCIVWKMRVWDGIRHSQVAAQGGCT

SEQ ID NO: 928481 - protein, 160 aa, Homo sapiens
MYGNAWMTRLKFAAGAGHSWGTSARIVQKANVGWEPPCRVHTGALPCGAVRRQPPSSRPQNGRSTNSLHCAPGKVADTQYQPVKAARREAVPCQAMGVELLMTMGTHHQFDSHLRCGVKGDHFGSLRFDCLAGFQTCMGPVAIANHEKREEYFWQKEQHV

SEQ ID NO: 928482 - protein, 268 aa, Homo sapiens
MGKKHSRKIGNSKKQSTSPPPKERSSSPAMEKSWVENDFDELREEGFRRSNYSELQEEIQTKGKEIKKNKKKRTNLQEIWDYVKRPNVRLIGVPETDGENGTKLENTLQDIIQENFPNLARQANIQIQEIQRMPQRYSSRRATPRHIIVRFTIGERKEKMLRAAREKGRVTHKGKPIRLTADLLAETLEARRERGPIFNILKEKNFQPRISYPAKLSFISEGEIKYFTDKQMLRDFVTTRPDLKELLKEALNMERNNQYQPLQNHAKM

SEQ ID NO: 928483 - protein, 140 aa, Homo sapiens
MNKYFWYIYFIISFPHFIISFHHFISSFHHFIISFHHFISTFHFIISLHLIISSFHFMISSHFITSFLHFISSEHFISSFHFISSFHHFISFHLIISSHLISSFHLVISFRHFIFSSHFIISSIQHFNYFIISSFDFIIS

SEQ ID NO: 928484 - protein, 181 aa, Homo sapiens
MAATTFLLCPHVVFPLDCEATGQRGRYGIGKEPVVAAYVQLHMQSGEQVEFMVDSFDGDFPALKGNNRTFSMWNKAEVLTAGLKEEGKMVCGSGPGPPCSVQPLDLMPCIPAAPAPAVAKRDPRMVGPPTTCTVCLEKPLALNGSHEGSQCGGLYKVTGVQLPKAMGASPLHQHALNGDKG

SEQ ID NO: 928485 - protein, 1169 aa, Homo sapiens
MSEKLSSSCSRPVLGHVQKAHLASLVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGIFDSTEIANPDYPDL

SEQ ID NO: 928486 - protein, 181 aa, Homo sapiens
MPYIHSVPTSGLPCVPVTVAAKTDSGVQVADEVCHIFCDIKVHKCSTSEEIKKRKKTVIFCLSADKKCIIVEEGKEISAGDIGVTITGPFKHFVGMLPEKDCCYALYDASFETKKSGRVLFVCLFLWAPELPPLKSKMIFTSCKDAIKKKFQANGPEDLNWACIAEKLDGYLIAAFEGCSV

SEQ ID NO: 928487 - protein, 212 aa, Homo sapiens
MSLHAWEWEEDPASIEPISSITSFYQSTSECDVEEHLKAKARAQESDSDRPCSSIESSSEPASTFSSDVPHVVPCKFTISLAFPVNMGVFQPALLLLLLFCWCTLLTRAGNVECSASHNIKLQGTGETGLLFHMRLKRDFFNLYLQGQKGKYASLIEKYKKHPKTDSSVTKMRRFYHIEYFLLPDDEEPKKVDILLFPMVAKVFLESGVKGL

SEQ ID NO: 928488 - protein, 144 aa, Homo sapiens
MKIAISTIIIANCGFKKGEEERYKEEEGKERDKEETEGKEEKQGFHNKVPQTGVAHTKEMYYPTVLEPGIPKSKCQQGWFRLRAAGEGSVLGLSPWFVDSHLLPASLPSASFPSFRKRVSVSKFPLFIRAPVLIRAHPNDLPLT

SEQ ID NO: 928489 - protein, 161 aa, Homo sapiens [sequence omitted]

SEQ ID NO: 928490 - protein, 182 aa, Homo sapiens
MMLVVDSLAWALTEHVVPGALSSASTEALSLKKAALPSPGVLQATRSFHTGQPCLAPLPPLPEYGGEVHLGLIPEEFFHFLYTKTGITGPYVFGTGLTLYALSKEIYDTIDLEKSQQAVGHKCHYLFDAKRNNIAMTLENTLQEWLHRVYKEELPERLQLLSIEVFYIHNADREMRKIQPQT

SEQ ID NO: 928491 - protein, 137 aa, Homo sapiens
MKLQSMNLFLCQFAEHSQEQKTKHCIFSLIKELNNENTWTQGGEQYTPGPVRGWCDYRGCWAESFGLASVALCTSVNRFCIGLYGPTYKPVDDTYGQWGDPWRAQWSELHAQPQGDKKKMGGARQGWPIYSFPDGGH

SEQ ID NO: 928492 - protein, 163 aa, Homo sapiens
MAGRRREVAWPQRDSLMMSRGYPARILLRTCTEFTPAGTSASVWFLYPLTYVLPPMKGGSQWVRVSGVRSCRHPSSQPLPALIHSFPHSFAHVLPSAEELRSVVSVVQGASKKSFLEVVLQMLANATFDYNLYERESTFFSQEAKASKTSLEEKLLCETLDRS

SEQ ID NO: 928493 - protein, 200 aa, Homo sapiens [sequence omitted]

SEQ ID NO: 928494 - protein, 137 aa, Homo sapiens
MTHNCCVLPPAVPERVSITRHCCRGCGGSSGFSDSRLYFLSLQCPFQGYEDKTRYPEKSLPVATTASGPQQVLTGYSQCSLKAKGLISQFVVNASRPESLSSGKGGLPPVPKQVQKCHPIAKGYPNQKLIGTLGNVV

SEQ ID NO: 928495 - protein, 152 aa, Homo sapiens
MDLRSMDVCTSWHMTCHWALGLLPEVRADFSGAMSPELRSEEEINYVKIREKSISGINMCQCLMARGNKTCVNMATFLEKALVQKCTHFLVVICGDQFNSMVKPELDDLKELLLYGILPIALEKSDFFFWSMFPTLQNEGYFPEGYCTGSDL

SEQ ID NO: 928496 - protein, 140 aa, Homo sapiens
MGDPCTVAQVSTRAHSCSIAQDPVCDSNCQVLTKVRGESMGQWQVAGKTLVEYFDMALLSLWAQIESFRRQPHDGAVVIDREMELNEGKEVVIDREMELNEGKEEEKLAKIGLNTVNEETNVRREDELLVTRYTPAEGKD

SEQ ID NO: 928497 - protein, 165 aa, Homo sapiens
MPRSYPLVGHKIMDEANSHTGPSAAGLLEFAGGPVQTLFAWVSAAEASEQRILVNSKCCCLIVPLEVLSQRSTQPYCCASNERGSVGVGPSEPGTGYNLLVCHLLRLLEKHNIRMGVTRFSRCRPSPLSLARKGNSPSPCAFQSLQRVVIFLLAEGLPLMFMASD

SEQ ID NO: 928498 - protein, 128 aa, Homo sapiens
MSVDWAALPSEVLEENPFPCLFQIPELNSLVNDAFLHFQTQQCNIFQILLSLLHCLLPSVLPPFSYKSLVMHLVLAWKLQKTLLFSRNLTTFAKIFLSYKVIFTVSRGQNLCIWRPLFSFPSFVWVLA

SEQ ID NO: 928499 - protein, 176 aa, Homo sapiens
MLIPKIMGKMSPGHVRDLHGSPSHHRPGGPARKKWFQVPFPAQSLCCVQSMDLVPCVPPSPTVAERGQHIAWAMASEVGGPKPWQLPCGVEPACAQKSGIEVWEPLSTFQKMYGNAWMLTQKFAIWVGPSWRTSARAVHKRNVGLEPPHIVPQWDTAYWSCEKRATILHTPEWEIH

SEQ ID NO: 928500 - protein, 134 aa, Homo sapiens
MPAVSSTYNHPKCLQIAPKACGEQNNHRNPSVATLYEICPPQCSRNLSCPASHPLSPRLTSAEAEVDLLCPQPCFVLAASCPKLAPPPPSFCVSAVSLTVCGPLILLGVNGPGVWMDEELESSPKPYLKIIPSK

SEQ ID NO: 928501 - protein, 138 aa, Homo sapiens
MKSVYYSTMEKSRKNTEAQIFGYKDSLKKLQNEFPVRGEEKVRERVMRTEILVGSRQMSSVHYDLGQSFRERVKIPNSFMGPESRKDLRLFLGRRYGPLLTFVLYADVMAEGQAAIFGLRGRKHTLRMMNKSGSLMNS

SEQ ID NO: 928502 - protein, 220 aa, Homo sapiens
MYPTYIIDTSTGKNISLWKLLYKIGKSDSYTSCGNINSCSSGKRLSSADVSKVNRWGPGRPPFRKAQSAACMEISLPVTTEENRENSYNRSRSSSISSIDKDSKEAITALYFMDSFARKNDSTISPCLFVGTSLGMVLIISLNLPLADEQRFTEPVMVLPSGSNPRGLTPPVKDEECTICVKKFQGGMNQTPHLSHCYPDASELPFLLTMGIALRVGIEQ

SEQ ID NO: 928503 - protein, 147 aa, Homo sapiens
MGKAWYMGQNALFLTAHEPFIIFSGGLSYDKACRRPSLTIMHGKAITVLEMDHPIVEFLTLCETPYPNEFQEPYAVVVLLEKDLIVVDLTQSNFPIFENPYPMDIHESPVTCTAYFADCPPDLILVLYSIGVKHKKQGYSNKVGIEQ

SEQ ID NO: 928504 - protein, 199 aa, Homo sapiens [sequence omitted]

SEQ ID NO: 928505 - protein, 486 aa, Homo sapiens
MTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDISEEAKTLTMDILTLAHTSTEAKGLSSESSASSDGPHPVITPSRASESSASSDGPHPVITPSRASESSASSDGPHPVITPSRASESSASSDGPHPVITPSRASESSASSDGLHPVITPSRASESSASSDGLHPVITPSRASESSASSDGPHPVITPSWSPGSDVTLLAEALVTVTNIEVINCSITEIETTTSSIPGASDTDLIPTEGVKASSTSDPPALPDSTNTKPHITEVTASAETLSTAGTTESAAPDATIGTPLPTNSTIEREVTAPGATTLSGALATGNPLEETSALSVETPSYVKVSGAAPVSIEAGSAVGKTTSFAGSSASSYSPLEAALKNFTPSETLTTDIATKGPFPTSRAPLPSVPPTTTNSS

SEQ ID NO: 928506 - protein, 129 aa, Homo sapiens
MLMEAQRGQITCTFTQLLALRCCDSLMRIQQAFFYPRAAFISAPALKFPSYLVWSLASGHNSSRPWHMEGPRAFGLANVPGFDWDAESQDDEDGRMLAIRVVPYWGAVSSPQRLRIRMDVGVLAHLLST

SEQ ID NO: 928507 - protein, 154 aa, Homo sapiens
MALKAKKEAPAPPQAKAKVKTLRAKKAVLKGVHRTKPPSHLPIPQRPVIHIWWPKTLRHHRIKEYKGAIGAAGEAAMLQGKTSRICQCLEPGLTLADFRCWISGAVYAKHLDAATVFLGGGGGHEKLPKLPHPQFSVYHRACFSSLATDSLIRL

SEQ ID NO: 928508 - protein, 161 aa, Homo sapiens
MLSMSRFRKGDIAEIEVCYLKCQGDSAFLSSPWLILKSSTGSHSAFTISTVLPSAEYHMVDSYSSPSPSTMSGNTMRPSPEAERFLEPGFLYSLQNQGKNESLFFINHQPQVFVYSNTNGQRHQGPILLPNVATKLKVPTRYPAGTLSKYLVDEIQCKFSD

SEQ ID NO: 928509 - protein, 222 aa, Homo sapiens
MLPWKKHKFELLAEAPPRQASKPKGYAVSLHYSALSSLARACPEGALSRVGSMFRSKRKKLHITSEDPTYTVLYLGNATTIQARGDGCTDLAVGKIWSKSEAGRQGTKMKLTVSAQGIRMVHAEERALRRPGHLYLLHRVTYCVADARLPKVFAWVYRHELKHKAVMLRCHAVLVSKPEKAQAMALLLYQTSANALAEFKRLKRRDDARHQPQELGANTPSR

SEQ ID NO: 928510 - protein, 586 aa, Homo sapiens
MGSGYVISALKDKMSPCESVVMACREQLSKNQVKWGFAGITCVSVVVIAAIVLAIALRWPGCELEACSSEADMLDYLLSLGQISCRDALEVTWYHAANSKKAVTAALNSNITVLEADVNVEGLGTADETGAPIVAHPPAIYSDDTLEQWLDGVLGSSQKGIKLDFKNIKALTEWGKVRRPMWINADILKGPDMPISAEVSATQFLALVQEKYPKATLSPGWTTLYVPMFPNRTYTRAMVEKMHELVGVVLQRVTFPVRSSTVRAAQAHSSWLLSQSERYSLTLWQAASDPMLAEDLPYVQDNTAVHHVYCDIFEPFLLQFKQVASTWQGAMRLREDGCRAVAYRRCFMNSSHLTLAIWGPTVNATWKQMYYTGGSLIPLLQLFEGDGLLNAAPGWQHPEVGVLPAAAGRTSQTLERPFANSGARSPLAVPGLAGIPVQPWLLASACVDGANISHGSFSVLGHMAGRELLTAVAEVFPHVTVAPGWTQEVLGSGYREQLLTDMLELCQGLSFQMQARPRGHSTPGAVARLLASSPGATVTVEHSPAGGNYACERTALLGARAVDRTRIYYTLPQGYHKDLLADVCRN

SEQ ID NO: 928511 - protein, 213 aa, Homo sapiens
MLRFPRHAPLFSQKPERRQIEPFPGFLVSFLVLSVLWHFPAQSGSHQAVSIQCGTFTSQVPRALPSSHNAPQLGSNYTWPVIVRGKRQSRFKGCCCFPTGRCQMGASDMLMSWTDVIPPPHSSITRYELCDLGWKPDAQNEKGLTWVTDEFVVVRILTARLSWVKWCPRNYPVPVNVALFGHRVFADVINKSRSYWITVGSEFNDWCPCKKAT

SEQ ID NO: 928512 - protein, 122 aa, Homo sapiens
MGEDGELCVTGMTKTGDRERVELKPRVGEERGEGFEWEAESDDISLLHVNAQRTSHTLRQRTPRCQSLKATEVAPSHLIQKFCHPMCLCHGLEEAAGAAAGMAPDPVDFPTWSWSKAYTGAI

SEQ ID NO: 928513 - protein, 154 aa, Homo sapiens
MPWAPVNSRAAEHLDRNPQEKAGAPQPPAASGQDSRATGPVGSEALRGALVTAVIVKAAVIVKAAVMKKVEPTGGKVVTLPANAFISFTSSRALQVGLWNKGSLQTMQAIFLVSVGTVLTATIPLHTTIQKSLNRAPPCGCLLTAGLGCMVTLA

SEQ ID NO: 928514 - protein, 139 aa, Homo sapiens
MRDSQLAAQLKGHAGWRANTVAGTGSGPGFSAHPLMGFLKQPPHSTVSLPPPCCPQKPQKPTLLQPEGPSKASMRSSLLCFNPRPPPWLPISSGSDAQHPHDETASPVSFKKTPMLKLHPDPKIRMQRGAGGWGTGRQA

SEQ ID NO: 928515 - protein, 142 aa, Homo sapiens
MNQESLSLQALASLTAQPLGRVLPLGGGPDAGPSVTALKAEGRPRVEIISKGVKKAYPLYRGSPGDYEVPRTSSNTVHTPYHSFYPEADAIPLREPADTEARETHHSLRHRRFGSVPAEVGVKPFKKTPEPLRVPAPHSTPQ

SEQ ID NO: 928516 - protein, 423 aa, Homo sapiens; identical to SEQ ID NO: 744021

SEQ ID NO: 928517 - protein, 230 aa, Homo sapiens
MTSAALVPQRHKHEEWMDAILMATCTITKLLCMQTRSDLLTNYILFSCSAFKEKRWLQQLEIARVLAKKSISNLTTRGGFCRIWIPRYGEIARPLYTLIKETQKANTRLVRWTPEAEVAFQALKKALTQSPMLSLPTGQDFSLYVTEKTGIALGVLTQEAIKRLSLAVQKPKEVTVLHCQGHQKEKERETEWNHQADIEAKRAARQDPPLKMLIEGPLVWDVKDKVDTEK

SEQ ID NO: 928518 - protein, 194 aa, Homo sapiens
MLPVLHKRRIKMCPSSLINTCRFEYSPEGKGNTGQWAVEKFAAATGATPVADGSISGTFTIQIQAAFWEPCLLVLTDPRADHQPLTEACYVNIPTIALCNTDSSLHCVDIAIQATTRELIEWEGQSASEKAVTKEEFQGERTAPAPEFTAPQPEVAVWFEGMQMPSVPIQQFPIEDHNTAYHGKLVCSCHCLGH

SEQ ID NO: 928519 - protein, 244 aa, Homo sapiens
MIVRLPQPHGTGSEEDRKMWDSLELPRDLSNGFDQNAHNDMDNEIQAEVVSDGDEELVGNQSKGDSCYVLSKRLVAFCPCPRDLWNFELEKDDLGHLVEENSKQQSIQEVTWVQLKAFSFIREAEHKSLKNVQPDNVIEKKIPFSEKKSKPAAEICISNEEPNVNLQDNGENVFRPCQRSSWQPLLLQAWKPRRKKWFHGVGPGSSCCVQPRDFVPCIPAALVMAERGQGRACLTCFDLEKHRK

SEQ ID NO: 928520 - protein, 168 aa, Homo sapiens
MRRLPDIDSSHWFLLIPTSVCVVQTSPAVPAFNVMATKWVCGPPVPVVSGDWGVISASTLAGTGVLSSSATVAAALADITCAYEPVIVIISHSGELNTSSVAGGSIEASLRTETTPEPMAIPGSWWSGNSTMPRATSSVNELQSCSCAGKAGTEMSLRLQIQTVDLTK

SEQ ID NO: 928521 - protein, 124 aa, Homo sapiens
MWDQVFCQAFLETDLWEICQKKSGSNVLQKAALLGGVGSEVGGDGEVHSDSLWKPDPLIQAQPVDAAMEDFDSWKSDAKSWGSQTSQGRGAARGCNSNEDLSSLFWWLVLGYLAIKCTPITTTS

SEQ ID NO: 928522 - protein, 159 aa, Homo sapiens
MLGTVDWSCSYSLILELPNTPSLSITQHSSIPHRKHPLHSDMHRKEAANWREDSLTLSPGSTPKVASAALSPPLPPSGAVTHSREDEVFTYGISALTERPKGACLPLPPYEDTQKPPFMRNRAVRFQSSVSVPPHACIREDHSSTGPAQPGKGPVGIEQ

SEQ ID NO: 928523 - protein, 137 aa, Homo sapiens
MSKSFLRPSPEAHASSVILVQPEKLNMYSKGQPDEVSDGNEEVMGNWSKDHPCYALAKNLAALYLCPRALWKAELKSNDLGYLVEEMSKQQSIQEMAWLLLIAYDQILEQRTDLNLELLNQTKIWPEKASSLPYLSP

SEQ ID NO: 928524 - protein, 311 aa, Homo sapiens
MGESLQCGQRGADEIIDESREKRWGTKSLRDLYPSPRSTVIKWQGSSSNPGGAQVYCRVSSPLGANLGTAVDVRGVVGEINMIHVEQLPYRLLQKAFSLGTQSQPNAYCSCLLAGSKDFGKGTSNEIGKGGKCVSGNFEETGNERLEIRQSFTFYFTTLCLCEYKAGSWQGCESELSSQELSREIPSICFLNYHPEDTGGKSQGIKIASERASCGRMNYGVDLKSYPTHGPWAACGQDGFECDPTQPAEPSVFWGRFVFFLPRDYGPEKVSSSSHQDQDRGPALGQKHGMWVSTQWGTGQYGLSHQTVPEP

SEQ ID NO: 928525 - protein, 177 aa, Homo sapiens
MLPAALRLGHITVLRGEVQPFLPCATGQMIPAFGEFGKSKQCFRPKGNFYISIGKKAAALACEIDHGEEKAYFWSGSRTQSESYGETRRYKPSIHTCKMYLGLVQKRGITGSGGSQVRGGFKDFSDWQLDEKTSFFQEAFPAAPWVSIASSVDQLEQDWRGNELDIAAEPLRRDCTH

SEQ ID NO: 928526 - protein, 161 aa, Homo sapiens
MSRHLTCLTATRETNPILCRQGFHAEEGNGLTHVYESDFGCCIANSLKVGKAEKREEAVAVILITKKKLQQTSGAQNQGCPYKKHSKHFTHIILSPSSSQLSTKMDPLGCDLLPVGKNRLEGFWQPLPPKTSAVLTTAANTCSFCHQGPPFSPVIANTGIS

SEQ ID NO: 928527 - protein, 163 aa, Homo sapiens
MAICKPGSVSSLDTRSASTFILDFPGSRTGSEEDKKTWESLELPGDLLNGFDKNADSDTNHNVQAEVVSDGNEELVGNRSKGDSCYVLAERLAAFCPCPKDLWNFELEIDDLGYLAEEMSKQQSIQEVTWMLLRAFSFIREAEHKSSENLQPDKAIEKKNPIF

SEQ ID NO: 928528 - protein, 124 aa, Homo sapiens
MFLLLNHLKSVLHPAAINKVMSPHIPCFVLHLERNPNFYKVLCYLSPTYLYPCFLPLALWSLVQPHLSFPQFLQDTHVASSAFHVFHSSPPSIGRSCYPPSHKSVTASITDWKCTHTHTHTFAH

SEQ ID NO: 928529 - protein, 156 aa, Homo sapiens
MSGWLQLHLGSSCPANSEGPGLLLVPGSCRLRGVCSPGHASLQPGAGAPGPSWPWAGIQGRGDIATSSFHGPGAQWWSWAPPHLAHSPTPCGASGSGLGTLGLTTGSIRLSSHPDVGQTLGTLPHAEPPPKAQEPSIISGVGVPDLLYLPVSIVYI

SEQ ID NO: 928530 - protein, 145 aa, Homo sapiens
MKCSEGGHQVFNAEEHNNNSDDGDSGDGHHLSNSNYRPAAGPGALCVKKALLMKMRKMTYLRECQMKRTVGRDNGFAVHGKQLQRHRSGGCKAKWKMRVMQVALGPEKAQDRLRPMRVELSRKSPSEAPEAGMSAKGTEWNFVQY

SEQ ID NO: 928531 - protein, 148 aa, Homo sapiens
MEVILLHLSVLGSKALKALSSDVPGQEKMDILAPEECALPRHIFVLLRPSLNWMIAVHIDEEPDFSWINLLCINKATDQWLFEGLWTPLRASQNEERCRLLNLKSLALELENGTMGQECKQLLEAGKGKKMDSCLDSPEKSAVLTLWL

SEQ ID NO: 928532 - protein, 139 aa, Homo sapiens
MAGCRSQALPHGEAAEACREFKCGAGGPAVLEDPAPPLQLLPWVLSPSLPRAGGAGWLLRVWSLQRLCTPRTCTGLRAHSPGSRPCLSLHTSTQAEGAGSSLGKPREGLPQCSGGLKSSSSAARVDAKAEEVPRASKSC

SEQ ID NO: 928533 - protein, 134 aa, Homo sapiens
MILWLYNPGVPNSRAVDQYDLLPFRNRLHSRRSTNPINSACEGSRLGAPYENPMPDDLRWNSFIPKPSALLLLVHGKILLELMPCIPWLVAPSSIFKGSSLAFCFKVTFPSSVSNLPLPPSLKSTCDDIQGPPR

SEQ ID NO: 928534 - protein, 155 aa, Homo sapiens
MYYQAQCQETDMDEAGNHHYQQSITRSENQTPHVLTHKWELNNENTRTQRGEHDTPGPVKMPENSQKEAKCEDAGQRIQITLERQQCCNTRWSLLEEEAKPTICALQSFLEKRESSLTALMMKILTLKGIFSKSLRSRSFLTIMIQRILYPSSRK

SEQ ID NO: 928535 - protein, 160 aa, Homo sapiens
MGGQLGQGGFGKGNIGLGKRGCKVLTLGHSSRLEGGALPGGKNQVHYYIRSSSKREMYLAVHYFDEHGYNSSKHTAHAHPPSTRKALRMQVVHPNGIMKGKGHKRPENHCMNIPGKPKEFTGLLKEATCFCKFRETAEKLSPRSVRGKCPPPNTHPHWGN

SEQ ID NO: 928536 - protein, 172 aa, Homo sapiens
MHKLLVYLHHHMEAEHESSENFQPDNAIEKKNPFSEEKFKLAAEICITNEELNVNPQDNGENVSRICQRSTWQPLSSQADVGEKNGFVGQAQGPLAVGFRQCVSIVEIQQVEVTQNTARRSMERHMEEVIVELRKSQTWKHSKSTPSRKNIMCHDPRIRMKFQELEVIPGTG

SEQ ID NO: 928537 - protein, 176 aa, Homo sapiens
MAPTYFLRNWKIKLRKVKLLVSQYDTGFFLVILPARDLWLAMHLPGSCLGTLPAAGGAPLTWFTQAESGLCTGPASNWARCAQLTCVIVSTCVWQFLSSCPTSKKNEAVLKNGDYFCEIPLLSGIWKILFGINEYHAGHAQSCKWETSSLLLSVNPSFVHEGVEDQGDEIVCLRLP

SEQ ID NO: 928538 - protein, 240 aa, Homo sapiens
MLGCSDGYLRRGYNHYKTLGMFRVTVKQTDFILSIKYRESTQCIVIRAEVLASAERVAVNAGVDVAMDVDVGVTVNVNEHVAVAVAVAVDKDKDVDVTANVDENDLDVDVAMDVDEDVAMDVNVAVAVDVAVDVGVDMDVTVDVDGDVDVAVDVNVAVDVKEDMDVDVETVDVNEDVAVAVAVDVAEDVDVDKDMNDVDVTVDMSVYVEEGVDVTVNVDVTLYVDVAMYVDEDVDVIVSS

SEQ ID NO: 928539 - protein, 154 aa, Homo sapiens
MPLLICTTLLLCHLSANGTWGFYGYSMCILPHEFNTFLTLYQGPEVRPLTTAWNGRKGQYKSQSSKLARQDIKWPLKECIYLSETVNFIYQGVRGLNIPFSLRALNGFLRKNVKQGLNTILYFCCDHPEHMTTSKPYDSSLLNIEVFMYIGPTS

SEQ ID NO: 928540 - protein, 137 aa, Homo sapiens
MELLLLGPPTDTCSNPLLLPCHLQEMLPGVGKEVGRPNGDFKSGFISYLEKLGKPHTHTQIHSKQDVLGSKEGQHMLTCSPCGLDCLSSLGLQGTVAHGGKACRNSSSNHWDLDSFLARAGLNAPPVGSCRLNLHPL

SEQ ID NO: 928541 - protein, 138 aa, Homo sapiens
MGQYGTRVHWGGPVNWVPRGVLDLGSTGVGLDLVSAGTDLEPESSGAGLANNRCVKDFSYWNCREEMIAPFLFKISLVKLVVSTDARSVFSGTSPIPHTANPNFIPMLQFSEQNSGKRESGIHRSQGPPTESGGIVTL

SEQ ID NO: 928542 - protein, 139 aa, Homo sapiens
MLQCKMFSVVILLKCINVSHQKHRTKDIRGKNQMEHVITVDTMLNYLNKPCSARKKEQLLRKEECPNSQRQECVITPNLQRVFSRVFNRACPVRYTNICSINLDAPVFGAYIFRIDVSIAGLIPLSLYSALICPFFNCS

SEQ ID NO: 928543 - protein, 130 aa, Homo sapiens
MGYVLKCVFVVAGSFGFNSIALCTSVSRFYIGLFSSTCKLVDGTYRQDSDVASVAGYILDPCLLEETLCCISQWVDLWNAQWSEFPVQLQGEEMGAIWKDCMVPPGVFGMLALEEICHHLGNLTTWNPPF

SEQ ID NO: 928544 - protein, 577 aa, Homo sapiens
MVLQTFCMEVTLLPLDWDLLAKAVLTPSQRLQFHTWWSEEARLQAQLNRSNGILITQAQLTGSNSFSDTYAQLNFDALTTEQVTKVCMRAWDKLRATDQAPVSFTMVKQGHSELYPDFLAKLQDAVEKPVSDEHAQGILLRMLAFENANHECKMAMRSVQRQNLPDHKVLPAYIKACEGIGSDTHKAILWARAMKDTNQTGPTNSSLGACYTCGQLGHTGKNCTVENLQAAKPAQHTWPNAAPTVCPRCRKGPNIKWDTSNSHQCCISTSGGPNATPSTNKSTSSQTKWVPASPSVSVQSLSTSTVGGGVVDLCSTILLNLLPDSLPLIVPTGVTGPLPQGSVGLVLGRASTSAKGITIHTGLINSDSVDEIKLIVSAKVPVSILAGESIAQLLLLPNIVLNKGDKARGPGMGSGGEKAAYWINVISKQRPTCTIHIRGKKSEGLVDTGADVSVISSSLWPSSWLKHPANMGLVGVGKAEEVYESTFILPCTGPDGQKGTIQPYIMPIPINLWGRDLLAQRGTEINIPHNSYSAPSQHMMENMGFVPGLGLSPKHEGITKPLPVTIKENRAGLGYPF

SEQ ID NO: 928545 - protein, 130 aa, Homo sapiens
MCQKFFQDSFKTQQLGFRVTCKGGFSPPQGSCMPAASPKLLNQTFLVPKSLPKDMENGYKICVQIQKKAPPLSPLNHGDFVKFIAHKGQKSKTDAQVAQRAKLAANECALVLCLGASLEMLEYEERRAVQ

SEQ ID NO: 928546 - protein, 147 aa, Homo sapiens
MRVNWLFLLPLRLLVNNILIQWLQSSFRAQPLGLSESVGKYRASVVLGITDSLCVECCLSSQELVVAGSPLMGTPVFLVGGGKSQACGGNEASARLVVAANIVLLSGIFLSFVQCINLPSSYQSRICVKDTIRIGYEYTRHGSCERE

SEQ ID NO: 928547 - protein, 168 aa, Homo sapiens
MTRNSGVPKSCPDNHPYSSGQHKWLMCPEEEDSQLSECSSLRLNGPTHGNYSLINVLDSDQITTLSFEGNGLMDAHDYVTTQCPEQAQGILKYEPSVQHGMQLASLVLGSGLGPGGTQVNEACSLISRKYFHHIINVSMEVSTGPPMRARGGAHGQPGGSESASWRKC

SEQ ID NO: 928548 - protein, 136 aa, Homo sapiens
MVITFSILLMFEGRGKGEQEWTTFRAPYVKYSEKHLLLSKGSPPAEKEEVEPCSFLRKATPTRNLAQTEEELSVFLLTVRPPASVLLEFAGGPLHSLFAWVSPAEAAEQQRLLPAPLSGSFVSEGHLPDASQSSPV

SEQ ID NO: 928549 - protein, 947 aa, Homo sapiens
MCLNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMGLHTLGHGSPEEGGSCVSPVTHSLPSQHLLQLAAQLTHGRTTYPGDPVGKGGTTHQACA

SEQ ID NO: 928550 - protein, 177 aa, Homo sapiens
MHLWEPGALFSCNPLDHHQHTKDGPAKCKGSLAACTGELLPWRNKPGPLPALSRPLPLVFGERGWTHIFLDSCLTPELVPCSHSLHGDEARTQDHPLPPGDTAPTTGSGTGLVPFSRLGVRHNFFLLIHPWSPALTQMSEAAQVSKEHMGLVKGQSPLTWPPVTTWVMRAMAAGFPE

SEQ ID NO: 928551 - protein, 151 aa, Homo sapiens
MKSSFRLENPRRELRLLFLGKWSQSFLIMGEKDFFPPLCQHCLRQTPGRAAPSAGMRWSSPGGQQGLGPPAFQLLGGGQGLHQGCAGLNRYLHRYSLPACPPAVWVARAARFLYVSVHLRVCFREINTLLRATSWPGRCPRPSQATALLPT

SEQ ID NO: 928552 - protein, 145 aa, Homo sapiens
MMLAWAQRPDTVSQQGAQHQELHGVSGVFRLFAVALNLPRTHRVTLEVSRKREETVFKQITLVATCLWLGNPSLAKDLKASPSSHLVGSGYTSQVHWVCFSLSSSATTGRSRHLDGTIYEEWALVRHQSWQCLDLGLPNSRTVKK

SEQ ID NO: 928553 - protein, 141 aa, Homo sapiens
MCTLHLQSGPSAAGLLEFAGGPLQTMFAWVSAAEAAEQRILVNSRCCCLIVPLEVLSQRGTRPFQAKYCLSKLGELKTQVSGARNLRENSPMTSSYNQETSESNGLSGYLTRSPGVPGGCQSFSSNPTSDTRSVKRKLQTS

SEQ ID NO: 928554 - protein, 154 aa, Homo sapiens
MLLSLTNPCPYVIEELKEITRKKLQTCNLPLRKGQFHTRELAELPSVHTRELADRLTGSCMFKFTLYFIGQKDLRSLLEIPTIMQMKKSKPKPVAPAPAEQLEQRWLHRAELGPDWKQRPLKCLLTLCLAERVEETPLENKLYLCQHRQMGVRG

SEQ ID NO: 928555 - protein, 142 aa, Homo sapiens
MHLNCALPGQPMPEDQALQLTLLLPAGHFDPVFLVLFEVSPQPGVDNWWKTMVIMISPLFIFSALLRSCLTCGPQPPCQVESAACSAAGPRSFTSQEHQTDDLLFTVVPGAPTPRMSYKQVSKEILGEAAKMVAKLFRNIEV

SEQ ID NO: 928556 - protein, 171 aa, Homo sapiens
MTCQQPQDLRLKAPLQAWLRVGLLVLSTLVKVRAGCALEAWSARAPSEERMNERVNTGLGACRRFFAGESSRRQLLPGVWREKTGAVGRSRTGPQAQQLYQVRQECGLVLTRFHSHGLPSLFSACFKTNHPGFKRSHMKVFSSFALFLLQHLSGQTGESGSLVWKNETGWA

SEQ ID NO: 928557 - protein, 163 aa, Homo sapiens
MGETVQWLWHGFDKDKNTGQPSSWAPGECLWVHNGSATEVVEVAGHGICKPQVGQPPGKLAQVCGGSTAGGGRVTGSWQWQAPRRDTGKQLEMMEDDDKQKFKQLYREPGCLGMLRISQRAEHRVQSEDLQVWESAAELQEVPETPLHWVLVLSTFTKGQGEG

SEQ ID NO: 928558 - protein, 148 aa, Homo sapiens [sequence omitted]

SEQ ID NO: 928559 - protein, 162 aa, Homo sapiens
MEMYRCQEGPGGLQCISALLLLCVQFIFPMLPLQTSSCPYRPAPTDPNPIVQSWTSGPQRGTNKSMWKIELTKQPPTMWEGHQRGMNTKQRELREGSNSLCPGQPHPESYPAGRPFLLIIREEKMHLTGSLIYEGFFLCDRGQYDYTLLNILKSIYLSFTKD

SEQ ID NO: 928560 - protein, 140 aa, Homo sapiens
MRNRPKPRAREGKGEDCFDIGTGLKSYESDYYISLTSYESDKEDENENVQMVYPETANTTRGMQLPYSPFGLATDSSFLEHELLKVFKVISGLSSRQCHDWSWVMVQRTGSSTHAIYLIHLEATTVLVRVLKRNSNNKID

SEQ ID NO: 928561 - protein, 171 aa, Homo sapiens
MGKKQSRKTGNSKNQSASTSPKERSSSPATEQSWMENDFDKPNLHLIGVPESDRENGTKLENTLQDIILENFPNLARQANIQIQEIQRMPQRYSLRRATPRHIIVRFTKVEMKEKMLRAAREKGRVTHKGKPIRLTLISRQKLYKPEESGGQYSTFLKKRIFNPEFHIQPN

SEQ ID NO: 928562 - protein, 152 aa, Homo sapiens
MPLCKGLRSHSSSFWAPLYPIVRQWPHFYFSNNAGNQCFPDHACGLASQSSGNVERANQTIKKYLMKETLTLILCLETGYVVPKDKKPLEPLWIRSYQVLLMTPTAVNLQGLSVDLPLQGQGGTSTQQRTLKPVNQLETFICCSEFSSFTFE

SEQ ID NO: 928563 - protein, 181 aa, Homo sapiens
MAHPCLLSDVASSPAGCCSSILRADLLHLVHLDSHTNLLWKYLTDTVPPPPTNDTLSVLGYGLEVDMWAAGVILYILLCGFPPFRSPERDQDELFNIIQLGHFEFLPPYWDNISDAAKDLVSRLLVVDPKKRYTAHQVLQHPWIETAGKTNTVKRQKQVSPSSEGHFRSQHKRVVEQRERH

SEQ ID NO: 928564 - protein, 375 aa, Homo sapiens
MLQGVDLLVDAVAITMGPKGRTVIIEQSWGSPKVTKDGVTVAKSIDLKNKYKNIEAKLVQDVANNTNEEAGDGPTTATVLACSIAKEGFEKISKGANPVEIRRGVMLAVDAVIAEPKKQSKPVTTPEEIAQVATISASGDKEIGHILSDAVKKVGRKGVITVKDGKTLNDGLEIIESLKFDRGYVSPYFINTSKGQKCEFQEAYVLLSEKKISSVQSIVPALETASAHRKPLVIITEDVGGEALSTLVLNSLKIDFQVVAVKAPGFCDKEPAQRYGSMTIAKNAGVEGSSIVEKIMQRSSEVGYDATRVGDFVNMVGKGIIDPRKVVRTALLDAAGVASLLTTAEVVVTEIPKEEKDPGMGAMGGMGCGMGGGML

SEQ ID NO: 928565 - protein, 161 aa, Homo sapiens
MLLIYSSFWWNTSYSGNPKRLQGGSVKTKRSEEAAEEKSEAGRGWCMRLKERSLLHNIKVQDDAANPDVEAAANSNKNICDSWKEVKISTLKGVWKKLIPTFMDDFEGFKTSDEEVTEAVVESVRIKVEPEDLNKEMWTLYYKKNEPYDDREEELGPSIIL

SEQ ID NO: 928566 - protein, 231 aa, Homo sapiens
MPNKDRLKKENGYIYTMEYYEAIKRNEIMSFCYGWIFVLRAPKVVAAAPKTAASLLFSHLGFLASQIPRNGTLGHAVSVIALLEAVGHGRELWNPATRVQLDEDEPGHLALQEQWRAFSVIRNCDGCLTGSEAQQTPCRIRSGGSQQQVCDGSEQQWWTTLATWQAYLTMGLLRSSRTETLSAQEIASADGSQFTSSRMPMTVLHPTWRVSQIMATLKPSTTCDDASWTTW

SEQ ID NO: 928567 - protein, 146 aa, Homo sapiens
MSILLGCHNNTMPQTGWLKLQKFIFSQFWDAKSPRSRCHWHWCRDLQNPSCKRPHKLHDTWVCKEGSLERQQGQDSSLKNQTELIELNNSLQEFCNTVASIDSRIDQPEERIPEVEDWFFESTESDKNKDKTRQRMNKASNKYKIM

SEQ ID NO: 928568 - protein, 134 aa, Homo sapiens
MEWSELQGCKSLFHFVDRQLLSIICEEANGFYGYITTVEPPLLVMVAVEIVDKCSDPGHSSVELTRFPDILIIGQKKGMLKGPYYQSPMELPLSYPFHPYLYFSFIKVKTDQKGNYSYNCLNVRAFDESRHCSS

SEQ ID NO: 928569 - protein, 182 aa, Homo sapiens
MSAPSLYLGKILCCMRRSWRFVNALGPWSVSLHQNPGAAFLDDLKNPCELKPEDLMQTSPLKQTMLGIKNLSWNSKSEHQLSLRLYYNYTILPPSNGCLWMNKGKVLDEEMQKKKHFDLFQDVFSIQSQSFPPIIQQNMLLEAVVLAFHFVHGATEKRLLVTHISSISRDLLDLTLAAGCFS

SEQ ID NO: 928570 - protein, 134 aa, Homo sapiens
MGKNQSRKAENSKNQSASSPLKDCSSLPATEHSWMENDFDELTEVGFRRSVITNFSEVKKHVLTHHKEVKNLEKRINSVEKILNDLMELKTMAQERCDTCTSFNSQFDQVEERVSVIENQINGIKRETSLEKKV

SEQ ID NO: 928571 - protein, 419 aa, Homo sapiens
MVRAAGSTGGTVTVRRIRAMVTVSFGGTWERTDIFIQDSPAQQTATLPSAKGMSTLSPTAEQRRPLIPTPNTEEFDPKDSALSSAEPVQIEAANRATGSDPQEVGEAFIVSRHVKDWDSGSVCGIIQIWCHIWYGKQEELEMLLRDQHDGDDINREIFEVLHEFDHGLRDYLRVRTKFFCSPCLSSTAFLAKSKSSYWELEENPTGLRCGVSLREEVCTTVEHGNMQQGCGNSANSTRICCPVQVNRPQTAQSGVGAAGRRAALHQTPLPDVLHILGQSDKGEEDHLTDGDNCLTHIRYSHWTLLRMAKFGTDIKIKCSYKIKDNTGDRKAEVRDDFIHTVPQTDCWGNISERKFHAGPALEGHACDKSLKDKHPNLQGPHRGQLEANKAIKEAQKAQREREKLMGKVSHLSPCLWDND

SEQ ID NO: 928572 - protein, 158 aa, Homo sapiens
MEGEVFGYRDHNVRKAFCLVASVLTCGGLLLVFYWRPQWRVWANCIPCPLQEADTVLLRTTVRAFLFSILKAMIVSSVLPLWHNSVAGIIFQKDEFQRYMRKKVFCLYLSTLKFPVSKKWEESLVADRHSVINQALIKPELKVSYLKGMVLCMFTEKA

SEQ ID NO: 928573 - protein, 117 aa, Homo sapiens
MAVYPVSTTWRLARAISLVALTSWLSSPVNTMRTHATPHLPKSLDAFCMGMSSTASNRNCVWLTGARIGEDVGSSQNQRKSAKSTHKSQRADSPLLGTEGHSSGSHGSSTADQNHCI

SEQ ID NO: 928574 - protein, 363 aa, Homo sapiens
MEDGGDGGGGEGEVGDGVDESVGTGNEAGGGGVGGNGGGGGGGGGGRSGGGSGGGGGRSGGGGKGGGGGSDEVEVVEVVVVVVEEEKVMVVVVMMEVVMEEEMMVEEEVMVEEKVMVEEEVMVEEEEEMMVEEEEEMMVEEEEEMMLEEEVTVEEEVMVEEEVMVEEEGDDGGGGRGDDGGGGGGDDGGGGGGGGKKVMVVEEKEVVEVEEKEVVEVEKEVVEKEEEEEVEKEEEVVEVEEEVMVVMVQLAAMHEEAVVLPAMMVTCGRRGSGRRGAGSGRTALAMVEVLLTQAEWHNDQLVFKEIIILLHDQALVLSGHADVATLLLLQRTMAIAMIVDQVVMPIAHVIWLVEQLSFIADRL

SEQ ID NO: 928575 - protein, 208 aa, Homo sapiens
MIKPSLIAEKTELKIAESREGYRPIAKHSSVLFFSIADLANIDPMYQYSLTWFVNLYINSIHDSKQDIGFIEDSFFKLLHSGVHVQVCYTDTETKYRETTVGPGDRYSAHQGPAPASTSEFPQFLLIITFIILAKRSVEGEQGDNKEKISKKHVSGWGTVRSFSSHKAIFQTITWGETLDNTQLSRAEAPAAFRSALCPWFAETRECR

SEQ ID NO: 928576 - protein, 139 aa, Homo sapiens
MVQASTPAALVAFLAPALQAASPVFSSYKHSFPSAMFLQQLAPAVHGSQKCPWPAASPGTPFEQFHSRVPPEKHLPMKAFPGTILGGFVTSSDTEASQQLLCHSVSLLRDKVGPLDHDAPQEGPGYGKKDLNLVIVVTS

SEQ ID NO: 928577 - protein, 317 aa, Homo sapiens
MYTPFDPDSPENQRMINMALVNQSAEDIRRKLQKQAGFVGMNTSQLLEIADQGFMNRDATSRRESHKEGERQARQNANLLAMAIRGIPPEGEGKGGSGKNTQEALARDLQKFPAKHLGCVLLLYVDDLLLGHSTAVWCAKGMDALLRHLEDYGYKVSKKKAHVCRQQPWASVDWELYVDWSSFINPQGERCAGYAVVTLDAVIEAKPLPQGTSAQKTELIALTRAQELSEAYKFMELLLLRIFTENAFEDFTEMLKCGGNTYLLVLVCTYSGWVEAYLTRTEKAYEVITCGSRTGTEPLCGHGGKDLRPLSGPPPRL

SEQ ID NO: 928578 - protein, 190 aa, Homo sapiens
MNCCHSLFALRITDLCPLGRKGTEKQPRGLQQYQLLCACSVPGLTWLYEWHLQVPDLHFIFSQGKFPHSHSSFPLLWLSRPSKLQMDLTEINMVVPHSNHKQVKKLQMDKHHLTEYILALQKLLSALAELWEWALGTQDSIVELVSSCVHKHFVIWAHATVHQTYVLGNWFHFVYTSLIIQNEFLFFLGC

SEQ ID NO: 928579 - protein, 144 aa, Homo sapiens
MQAGHSLSLGKSQIATDNVVLGHEGRGPPQQFGSLADCQQSKRSRAAVQSTLSVGLQVLWGQSLPDSLLFFSASQLLTVGTPTDPGSVPSVFHTELVHSLTRQQSSFDHGDEDNILAYVNAMRWARALIPPNDRIYQKSVGNEV

SEQ ID NO: 928580 - protein, 148 aa, Homo sapiens
MGMFTQCLYLRLYLEKISKKMNVRKYENTWKLNNMLLNDQMVNEEIKEIKKFLEINENGNITYQNLWDTAKVVLRGKFITIRSYIKNVERLQINKPTMHLMELEKQEQTKLRTSRKKEIIEIRAEINVTETKTKQNSSEAALWRGLCG

SEQ ID NO: 928581 - protein, 144 aa, Homo sapiens
MGRHIHSFNYFLKLTWSLRKAFHCWWWVCRTQKLITYVKERSNETNAKSALWLNGLQKSLFTSLIMGHGFCFGNCKENRLSVEIQSVGRAPCEGEGTEFHVGQIGYEISKSRCPMDFGTQERELGLVCGIGLSSIPELRIEEVS

SEQ ID NO: 928582 - protein, 121 aa, Homo sapiens
MRNIFLQRTMNKEQQDFLLKNASENELGVYLNTQEAELAYQCPRIGGCRRHHYGLNIGVSKAHVLETNTQCDSIKRWGLWEVNEIGAPEKRLEGVPLPFLPCEDTATRRHLRSRAGTLTRH

SEQ ID NO: 928583 - protein, 177 aa, Homo sapiens
MPVSTSLHHLLPRPSLLLPSLYLGLGREVSEVSNGASPDSHHTATHGENLRFGIAGATYSGCTTRWFKNQQSAVQPRRPNDSWLMKTTREKDSLLLGKLSISTGPARCQGLGYQLGARSNFDMITEDTHQLTQQQLCGCASKTPGSTCLQRCPRTERKLMPVTAVCKVNPSGSRMNH

SEQ ID NO: 928584 - protein, 156 aa, Homo sapiens
MNTTDLTFNWNEIEQKSTTWVTEEDSISKKKKTKLDKIIENLSEVIRELPRQCRLRGSRFGEAGPYRGIRGKSNQRVQANILCQFAFEVYADSKGEQRRLSNWSLMIIIGINKQNFNDQTLDPSSCLKHCHQKSRAQGIHRFILRVFLINLENICG

SEQ ID NO: 928585 - protein, 152 aa, Homo sapiens
MNGTMAKPGKLLQFGPHNSFSLAVLSVVRRLFSGVPGFYLLNSGSNPHSQLFTEQRTREAHEYGGSIAVKDGGVRCARRAFEAVRKTPGCEGCRYGLQMTKVARESKNLQARAKQPFAEKSLSSKCLAATSYSHGIDFRPLEKLFAVTYFFT

SEQ ID NO: 928586 - protein, 174 aa, Homo sapiens
MEQVQRVRETHSPFAPLPITAVASQEKFRPALQTQQLLDAGEPLVTTEQNRFPVKHQGDLSFPRGEDFSRQNRLRGRDGERKRLQDTESLHLLPPPTLLEIDNRCRKEKSVQRQKTSVRPSLLSAERVLNRRWNNGGSTLEQRKSRLIYPLCIWVVLTAVSCIHWLEQDLTILN

SEQ ID NO: 928587 - protein, 160 aa, Homo sapiens
MGFPAMAAVMPGSPAFQCIQSTILIVRGFPSCRWTQPKLPVPWGCPSSCLSAFQGWDFGYKDTFVGYQRDVCTPLFIAALFTIAQIWKQPKHQLMNELIKPNVMCMEYTFYSDLIRKEILPFVTTQINMEDIMLSKIRQTQKDQYFMISLLREIFKKSNS

SEQ ID NO: 928588 - protein, 137 aa, Homo sapiens
MSQAAARWWISAPALQKVSFIQQAFRIKHRQLLMSSDFLDKFTTTGKASKLFNGGKEQFYQNWRWENWIYTCKILMLDSYILTYAKINSKWIRDLNIRAKLIKPLEENIGEKLHDIGLGNNFLDMTPNAQATEENNI

SEQ ID NO: 928589 - protein, 150 aa, Homo sapiens
MSLGERGPERQCSLTSFEAFFKEVPLCPAPGSHKLRLHASGTEEHGPHTAHCRGIADESLGKAGATGRVAFWQMAGAWEMHIFSRLSYVVLLSSRSQSTGCTPQSHNWAQTGKAGCQHLAGHGRGPQSELTKQSVQAWLQERQKALGANT

SEQ ID NO: 928590 - protein, 134 aa, Homo sapiens
MRLYSPLPLTVGLISGKNDKSKVLTKCICISLSHFPVIAIKNKNQQQKENPPRPSPRECAWAGPLKGSGRHACLSSSWGGATLAQLRSIWTGLQPTDPQICERAQPKAVEVSIPPARVQTPAPANIYRISSLNS

SEQ ID NO: 928591 - protein, 145 aa, Homo sapiens
MLLVICFLGHSDFNPEDGGGMNTFQARPVGYKTLAEVLTVLQKLDGCVEKSQLEGNSTKHLTGVPQNCSGTWMKLETIILSKLTQEQKTKHRMFSLPIPRGDCQRLGDPRPDFIKHCFRVQSACIFSQREFLQVDFSLLKLLVFV

SEQ ID NO: 928592 - protein, 130 aa, Homo sapiens
MNWTILDSTYKSDHTVFIFLYEKLKNQKNDEIVPHSLLVTSYTLSVHKINYCRLESTEARNILSAKTGLRERRQTEGAVWPWAAAISLSSQKGRHLYFVCAFAFQVTTQAALHGLSAYKLNKQIGSQAPD

SEQ ID NO: 928593 - protein, 210 aa, Homo sapiens
MDTAINTQLPDLRFAGYVTRTSLVAYSVLRNGCHLEIHKSMKQHISDDDSDSDSSGSGGGSDNGRGHMVGSGSGGDNVDSSGGDGGCSNVVAGSGAGGSSGNVDVVAGGGGNVDVVVVLSVAMLLVMVVVGSNIGRGGGNVDVVVVVVAMLTWLLLVVAILMLTVVMMVAMLLLLVVGGGSVVSDGENGGGGSGGRNGDIHKLGNNLGPD

SEQ ID NO: 928594 - protein, 130 aa, Homo sapiens
MRLSGPVSTKAGSLQEATTDHGRHSLESDSLQEAGLEKHRSASLQESCPPPSPAHEIIESDSFGERKAYHRHTVSGVGSCQWVRGLANFKNKATGLEDLPVKCSTATLYSLSAATVLGQGTQSPVAAVHG

SEQ ID NO: 928595 - protein, 124 aa, Homo sapiens
METFKKWLTEEKDPLKWNYPGFSIESLISCPQTTMVGHSVSCAGYSTSIVKRRNMFSDPRNYGDLLSFFSQHLLSISWVRDFKEPQRLSYYFIRGFIAQNDAQDPSHQQKNKTVSEITQFLQNA

SEQ ID NO: 928596 - protein, 203 aa, Homo sapiens
MTLTAPYAGRIQVALGLQTWPQGRQREKSSPSVPGGAETRRLHPGPLGPAQWPDLTSVPSLNALSTNTVAWEVLSLGLQHVNFEGDTLQPMAASSTPAVIGPLVLPLDSTVCLRPLRSHFPAAIGAAHTTLMVLWTSRLHQDLLPQARLQLSLVELPWVGTCLLWIDYPTVANTLLHFQIGLVPGNFCSTASAYQACLIPPAV

SEQ ID NO: 928597 - protein, 160 aa, Homo sapiens
MLSSLEKDCVQVVYFRKSTRDASEVLVRVNREGGKANAINATHTIHCSYTPPPPPTPPALPPTLLPFLLHPSPSSYTSPLPPTPLSLLLHPSPSSYTSSLPSTPLPFLLHPSPFYYTPPPPPTLLLFLLQPSPSSYTPTPPSIPLPLQKPEGQKPTVAAR

SEQ ID NO: 928598 - protein, 143 aa, Homo sapiens
MLRNPELEEKTVLEAGACIWTGHCSHRRNTSKDQWARAHPQGQQHAPEEADVMRCQPDLLESPGSRPGKGPKCDGDEDSPALANRGREEKKHILWDQHNVFLPERVVPPYTGPLMTILHWAASPEVPGPMAMSSHNSNPHSMA

SEQ ID NO: 928599 - protein, 148 aa, Homo sapiens
MRAQMTKTLLLGIFLLDFHLQSLWTVGQVHPTVMDTSQNQPEKSKTCEWIAGPALCDSSNINHKYGLSANCTRIQETSFFSETGLESQFSRKTRKHGCCDQIKKLPEIQYGAGECSTVSYNTDLFHRVLPAACYHSFHEYLNPDFSGT

SEQ ID NO: 928600 - protein, 131 aa, Homo sapiens
MSLGQRIWVKCKQKCCETQDIRGIPGPEYSYSDQSRLRAAVSHALKIRRSLSADLAGPIMGRKNCQGGRVAGHTAPVTSRDSARGCEPGHRAELAAPGDPENSSRPAVTPAFPAAERSQVRLPDSQSTSSF

SEQ ID NO: 928601 - protein, 118 aa, Homo sapiens
MGYSTWVKVFFTLRKQLCSPLELTRVRCNATSYTRQGVALALFYRSPKYSCWNVSGPQQLLFTEEQNPGVMMANWLLGDGPVLGLGTLQECQRQDIPHVLEFGGSPLNPGEAVDREPV

SEQ ID NO: 928602 - protein, 215 aa, Homo sapiens
MGSFSSCQRSGLVQRQSNRRRGRCSSWPLGECSDDAHLLTTLDSSRGPTDQMDIRGTIPAGPRRQQGTPLAAPPEAFCTPARSCPVAWYLQSQLLPAWPSPRRWNIGEVITKSPTSPPAASSSRMTGAVSPGGQSLGSAKNTVNLNTTNLCGWLNHNRKAQCLHPGVCKFTQVCAFAVIFTRMIAPIFTHTIAPGGCCLSAFSNSDQGQASSKPS

SEQ ID NO: 928603 - protein, 115 aa, Homo sapiens
MCEHAHTHTHTQTDTHEAAMSTEDSWRRAEDILREADTAAAALIPRPTSSLDALIISIQALLLAQKPSTIQLGLQVTAPGGHLYFTQSCGTVKMTTEAETIQSDLMINGKVMTAS

SEQ ID NO: 928604 - protein, 134 aa, Homo sapiens [sequence omitted]

SEQ ID NO: 928605 - protein, 135 aa, Homo sapiens
METYRQRGPIWVLIQFQETAQPEKIRTTGVRSGFELPMKCVSFHFGNCFSDVPGCGVNPWTHPQWIPPSWICTARILLSPDSHSGLPWNGLPRVQTGFGSKDCRPQEAGSSACQLQPASLSGTFWVLCKFMEMVL

SEQ ID NO: 928606 - protein, 134 aa, Homo sapiens
MRTQYTRSDSRASGLCPGWIQSSISWRKMSLEKVLGGSDICPSPFLPSGKIRMAKGDGQREQPEALFVSFSSFGLFSIWSGRRILLTSYLCWQNSSGVWELEGRKVLMLTSGFCGYIGIKRENIPICGKYTQVF

SEQ ID NO: 928607 - protein, 144 aa, Homo sapiens
MRYLHTFKESSFKILINDIEKREWNSLTASSNHSKHHQSWDKLVLVTTGWVAMRTHPHFYDMHARNMCPGYESQGKTEKLGQTEGNCRDQQLKAPRDSEESFSRTDTLGIVVMQGRFLALLRKELNSQLVVEKSSFIESEVFNH

SEQ ID NO: 928608 - protein, 173 aa, Homo sapiens
MSLCMHTVTQPPARAPLAKECGWNLDMMTGVSYWCETQLGVGREGAAHKQGQLSPGSRVPGSQDSKEPYSKFKPGLSVPSQHCLIQETCLDKANLPPSLDFPGMLRSRTSERRENRKERLPSLHQASLSHGGACTLIKKWGFQGTATHTLLKELCSHLNLARDPAQRSPGTER

SEQ ID NO: 928609 - protein, 136 aa, Homo sapiens
MVMRSPHPCGTVSLLNLFPLYITQSQGWPHHPAWALILHASSSNSSLPPCVDSSSPPPWATILPAALSSWADISMPNLAPIIPLRATVIPSPSRDICSALILLCHSGWSASGTIIAHCSLELLGSSISPALASQCA

SEQ ID NO: 928610 - protein, 161 aa, Homo sapiens
MRPSAEGQVGRFHLLVTVNNTAVNMGGTFQKPPLWAGLLSLFSMSCCKPESPEPMGLCGGGPQPPGQGRKGRPCWAWVLTRQAPILSAPGNPVGIALSAPAVCLRPPWVSPFLNAPCTHPCPSSPGAGIRPVMDAVLLLREAVSVGIKKEKETHPAFFHSA

SEQ ID NO: 928611 - protein, 152 aa, Homo sapiens
MGILTQRPGLGLQITRKCFLALRRAGEKLISVKLYPNTDPCADWYPNSHPLNGPEIFQEQIQMKVILEWKCVERQNCHSLKLVGESGTIILGNHSAVCTEAKSMLHPEPSNFVPRCMPNKGGCVCTQMWGNIHRSQNSCEYKDLPAVNKGRN

SEQ ID NO: 928612 - protein, 137 aa, Homo sapiens
MLSVDLHFWGLEDGGPLLTIPLDSAPGNKTTTERPVEMKGSLDQWNSHITRLRHLTTEFFLLRRQEFRLLQTRPDLPLVAQITSAAGNKFIDASNSSKLQEVKCQEVDFTQKYQSEYILSPSSPRIHTLYRLKVAAN

SEQ ID NO: 928613 - protein, 126 aa, Homo sapiens
MRSVTIEAQHHREGFMPPDDCGQAWIISSLPQEAGGTECSLTPPRKGDSLSRSAKNMSAEESTYDISLTPFQSWEKISTSSSIPLGSMLPSPMLTMEFIQEGTENALFRSTQFPTCIESNSNRHPQ

SEQ ID NO: 928614 - protein, 376 aa, Homo sapiens
MLIGAQEVTLNAVFLKKREISERVKVRSSVVIEDKSTRDPEYIYSQPYEQGTLDLKDWKRIGKELKQAGRKGNIIPLTVWNDWAIIKAALEPFQTEEDSISVSDAPGSCLIDCNEKTRKKSQKETESLHCEYVAEPVMAQSTQNVDYNQLQEVIYPETLKLEGKGPELVGPSESKPRGPSPLPAGQVPVTLQPQKQIKENKTQPPVAYQYWPPAELQYRPPPESQYGYPGMPPAPQGRAPYPQPPTRRLNPTAPPSRQGSELHEIIDKSRKEGDTEAWQFPVTLEPMPPGEGAQEGEPPTVEARYKSFSIKILKDMKEGVKQYGPNSPYMRTLLDSIAHGHRLIPYDWEILAKSSLSPSQFLQFKTWWIDGVQEQV

SEQ ID NO: 928615 - protein, 161 aa, Homo sapiens
MGRNQSRKAENSKNQSASSPPKESSSLPATEQSWTENDFDELREEGFRRLKTLNDLMELKTMAQELRDTCTSFSSQFNQVEERVLVIEDQMNEMKREEKFGEKRVKRNEQSLQEIWNYVKRPNLRLIGVTESDGENETKLQNTLQGYYLGELPQLSKAGQH

SEQ ID NO: 928616 - protein, 154 aa, Homo sapiens
MRACMCTCVCDMVWICPHQISCGIIISDVGELRGGKAKSAGPQRLQLPLPLGAQAQGDKGSVPEPLAGVVRFLAGRSIPVWKDGSGSVLKRHSGHSLPQLVGCHTTLLFFPLCGSQQLPNHSCWENLDTLVDSAGFTQYYGSFQWEPLMVRGCF

SEQ ID NO: 928617 - protein, 141 aa, Homo sapiens
MSTCRCTDHTLLLINGLLYKEDVVHIHKYRTAIKMNGTMSFVTTWIQLEIVEISFSPVLKACSDVTLRNNSNCDSKRQTMEGLWLLLGEEKGNEIPEADWEINCLCLLNLLENPNVPEMRWPWICISPLRVLTIELENYKP

SEQ ID NO: 928618 - protein, 147 aa, Homo sapiens
MTRGHPKQFSMSDPFENSATLSGRIPAYGSILCPCRCGLRHGRNTESSSGPGHLFFTWTCVPHPFSRSSEVSLQRVASRGLWHLVAFQVQDVVGGVLEMRLSYSKANFVASVGIDEGWVSCWGESQSLAFLALGKLLWKREQNDSLP

SEQ ID NO: 928619 - protein, 142 aa, Homo sapiens [sequence omitted]

SEQ ID NO: 928620 - protein, 140 aa, Homo sapiens
MVFHISGLLYCGSKQGAWLTCDALLWYAESDVKVRAINVIQSTLRKCYLDWDGYISITDNFMGLLPQCFSGMGQFASIFLLLGTLSPEETLLEKVLLLYALSLFYYLILFLITGRIHASVAPLNSESPKNPKHTAFSSHH

SEQ ID NO: 928621 - protein, 147 aa, Homo sapiens
MRFDPTLPGVPGVSAELCSMAPQDLGMSKSSLWGATALLSGPKRGPCEDFTTLTPWFPTAMFLSEIAKFSKPNYIHFNFESKSKQMSCSLFPWERVLRSNKPRIFSSSREAGNHHRTKCSSASVRANSFGCTSRSPEAKVTREKQEL

SEQ ID NO: 928622 - protein, 190 aa, Homo sapiens
MSIIASSSSKVAAKTQYDEDKSTSHYANPNQEARGKEAQAQNKTKKCGEGMGMQELIMLSSISLGPMRSQVLVDTVHTKPKDRPGPYAAGFAGTWTHLLETWRFICDTCHHQCLHAPSRSLRTGLPCLPVPLYIFQGAAMPAIAGTHAHCLGPEGGLSHLLPLPMHTVQGSYKLTSSACHCWYTCKPSGA

SEQ ID NO: 928623 - protein, 135 aa, Homo sapiens
MNLIPELPGGEATSAGPQRLRPPLPLGAETQGDLNSVPEPLELLEILQQEALPTEEGWVKVRPEEALWLQTATVGVQLKFPVLAAATPTRSSNGLDSRQLQQLLVAPPPRSLVGLSRFQLKGCKNLHVLGHSLKC

SEQ ID NO: 928624 - protein, 259 aa, Homo sapiens
MTRQKIVGMTSFWGTVQVGLMSGMRLGLNKMERPYRSSNGLPGGTAINKPGVIRVRNREEGNVGKWGERQVDQRDAVMRVKCGIRNNVRGHIEVRARNNGNCGRLNKEASKSIRAAAAAAWRHDGQPKTVRSSYLDKKATGRDPGPCVRIPTSQPCPSAVCNEKGWDESGRARMGAASKAVFKEWKEEWGKDLGSMGSARFPFVSLYNGFVRMAKPGLPRQSGSVSLQPLSQEDLGRSQQRALGQSSRGSGSGCQGLGL

SEQ ID NO: 928625 - protein, 341 aa, Homo sapiens
MRIQIVWLFELFEIRCEFLDEFFYFCKKLLDFESNINLDKPLLATLQVAVQLLSDTGQAILHLQEKNEIGNTGICHLGMSRHPQLQNFMEGVVLVGGTAHQGTDPPVPVVAELLSVFWQAPFTRTFLWYVHHPLLMSLMLHHLLPKLLLNGHPYLVLILVHVGTVNMAVPDIDRHLHSLGYLARRGLPGAKPQDGHLGAVGEDKVARHGCRTPQTPARNHTLKCLISKLSGKPKRVPTGALPGGAVRRGPLSSRPQNGRSTDSLHPALEKAARTQGQPMKAAGREAVPCKATGAELPKTMGTYLLHQHDLDANSLGSPQGKVFNEPSLAGEGFKREDYAKF

SEQ ID NO: 928626 - protein, 149 aa, Homo sapiens
MRKSTSIQNIHFFVVLAKQLMKLAFDNYCRLMRHQKDVVTSKGGWPAQKARTGAKFEGSATGYIIFSNLLELVLAAEFERYGKYRKKKLILLVTTDTHQWLSAETEVLSGDLVRKRQCPAGELIWDILQGQLKSRGRGNFERALIASTI

SEQ ID NO: 928627 - protein, 353 aa, Homo sapiens
MDPHWDLDSNHADWSHKHLLTCVLEGLRIIRKKPMNYSVMASASSCITLTEPRVHLTIEGQEIDFLLDTGVVFSVLISCPGRLSSRSITIRGILGQPVTRLINEALIPPYPVVTHPYTLLSQIPEEAEWFTVLDLKDAFFCIPLHSYLQFLFAFEDPTDHTSQLTWMVLPNGFRDSPHLFGQALAQDLGHFSSPGTLVLQSKAQFCLQQVKYLGLILARGTRALSKERIQPMLAYPHPKTLKQLWGFLVITAFCQLWVPRYSEIARPLYTLITETQRANTHLAEWEPGAETAFKTLKQALVQAPALSLPTGQNFSLYVTERAGIALGVLTQIHGTTPQQVAYLSKEIDVVAKG

SEQ ID NO: 928628 - protein, 139 aa, Homo sapiens
MNGLGALNGGQKQKGSWVERGRSPVKPHLQARDDLKSGGQAASSVDWNENLTVFFLGLPMATHGPISTYFLTSEACVGSGLVVQAEHSPPGQVGRMSPVGPRKTQIKAPLATEVSCWQSDTPRIRCIIHETVIELPGLF

SEQ ID NO: 928629 - protein, 148 aa, Homo sapiens
MLCCLEILPPDTLSHHSSSVFCKVIGHWQMQRCSLLGHYKSNLRSSSQPLNLTPGPEGELHLPWESGLSGDDRGLPFQGEIAFGRKLDFNLQALLEQLSQDELSKFKSLIRTISLGKELQTVPQTEESQEAITGPGFELWQIAWKSQR

SEQ ID NO: 928630 - protein, 157 aa, Homo sapiens
MARKSGHSLAGASCFRVLPMVNWHGEWGKSVGKKCGSGFRTGQWMEIGKVLRQMLEKYYIAGNRMLRAILVMAQKRRAIRKTYFLRDFGGEFPQAPGSPEMQFFSLFPSLSKGKGVSPMATTTTALGEHCQTITDVPLRLEGSSIGLWKTTNVATII

SEQ ID NO: 928631 - protein, 140 aa, Homo sapiens
MSSVKAGTGHLDVLGLLGLSESYIFTCHKNKPCKGTMQTRYEASFPKGLLLDLATDRSTEVGPMQADKLLEKPLENSALRYSRNKKCMVSLKELARPEFQLVPFLEVCQQTGEGLEVSQADVDAYQEKWFEANILDMLLQ

SEQ ID NO: 928632 - protein, 144 aa, Homo sapiens
MVWTVETVMFSVPGLLEPQSEGRLKYTLGMVLLPLLMTQQSKTTGGNPLPSIGFPGNTIKDEKFGAEGLLGSTLGDEDECVGPGEQPMTEHHSVYSPPLKGLTLALSSLPLVPFEGSSEKEMHPLLKFYTIPILCFGLNNWLSH

SEQ ID NO: 928633 - protein, 145 aa, Homo sapiens
MLEMAVTSANHLCQRYSISLGCLLAKGELPSWASGKLPGEKSLSFPLHPEAPAWAKNVQECGIWRNYTSELPGYIQTAKNRSWPNWDASVEQQICTLLAVMQARWSTSDTQGWLEQCSLGKIHGQGSRNRRKTTHPNVLHTATTL

SEQ ID NO: 928634 - protein, 215 aa, Homo sapiens
MKKDYFIFTCIFPSWKQDVELQQKKIGRDRQKGNTERSTLWRVERSKYKKKRNVLGEERFRKFLLYKSMQINMQLSIAGDEDKNDEGDNDKLYFIVLQFDGITILQDVRSKCINSPMQRADAEFLERKDCQPHQGSVTWASLDIGVHILLCNLLVFKTDCRQAKCQRQALRFDPSALGKLTLWFSPMHLVFLICLQGLGGGGWVERSTGLGLKQV

SEQ ID NO: 928635 - protein, 150 aa, Homo sapiens
MALACSRKFISEVFFWPHFHPISFVSQTWKSGLNYILCLCHLFTSLRKLSSASIWRRRALLQHLFCIQVIFTTKTKDMEPLGNGPCQLGAKIVVRKRSTGVETQHVLKVVSVENLILLFPVVTDDLITLYKPEGRQDRTRSGSVLGERKD

SEQ ID NO: 928636 - protein, 186 aa, Homo sapiens
MRTSEGTNSGHAAFENCNTARVRGFLLEVSETKNPTNSRHNSKLFKLSSIIFHCFLHCCAIKYFIPKSTQYFIFLDIIFFMPEEVKLLKEKVQKITEEVEHELSPEKRMELQPVVEGWLAEAFSNGCLAKTMGFSISDEIGKLWELLCHGIGIVLPMVHRKVYFIMVDIKIKTRKLSYINLLLVSY

SEQ ID NO: 928637 - protein, 146 aa, Homo sapiens
MSFSELILNEINLNIKKLNYVAKKNQDLNENFFHFVNCTSKSTSPKQPHVTQGPTIFKISSLFAFWIVNLGRKGSHFCTTAFAIRAIATFLVLFSSVHTDLGKITPCQFSAWNSSMAYGCPWTIILSKLSQGQKTKHHMFPLIGGN

SEQ ID NO: 928638 - protein, 171 aa, Homo sapiens
MAFSQMRGSWTCLNTGWGQGRRDRKPVAFILKGSMRPLHIQHIVIDTMNQCSVLQDVQMAQSPSDCDDKGWERPSSKVQGYLCQQDSRSRTRAGWKTPTVVGRHVPVKIEKESIRVQRSSYVRLGHFLFTGDYKTFAASSLGADAILGLSPPAPRRSLKQHVAAGRGGSRL

SEQ ID NO: 928639 - protein, 175 aa, Homo sapiens
MRYSDKWRLLQLESWFKGLQVQLGPLLQRVQAIALVTSTWCVKSAGFQNATVKKAWQLPPRFQRMYQKAWVPKQKPTAGSPCMGVPLYGSPCREPLHGKYQGGNVGLEPLRRVPTGDYLVELWEGGYHPPDLKMLEPLAACTLSMEKPQILNSNSREKPWELYCTKPQGWSSPRP

SEQ ID NO: 928640 - protein, 154 aa, Homo sapiens [sequence omitted]

SEQ ID NO: 928641 - protein, 167 aa, Homo sapiens
MLLACAMGIPFIISDFRSYLVMPFVQMIKLKLRETKTSQTPEPCPGPAPQSLALPSPPPPGPPTEISLLTTISSAGVEGIYPLGWILLPATEDHGTFNYTRRPPEAACFIPISLSTFLSNKTLDGFKYPSCMLPASPDESKPAKTIPFLMLEIVEDANPATEMGGCF

SEQ ID NO: 928642 - protein, 145 aa, Homo sapiens
MKDNSRTLGAFFEGSCQGKMGQRAGWCSGQHKALSDAQACTLSSPLFSARPAWAQRWTTAGPARLSSLILGCSTHPEQIHTDSEEVQQGSDCPREKGVAGTQDAPKEGRLSKEPEDLRLQRDIMGPLRNSFLLVHKAQPEPTRAG

SEQ ID NO: 928643 - protein, 166 aa, Homo sapiens
MLLLVVLVVVVVMMVVVILMMMVVLMEVLVVVLVVLMVVLVVVMVVLVVVMVVLVVVMVVLVVVLVVVVLWSQQSLELLKQGRDIDQEFSNLGPGCYGFLKLFDGVYENKSAICPRWGRLAGWGRLGDRAYYVKKEGPKWSLADLFYGKAQAGTSPSQSNTAEQPH

SEQ ID NO: 928644 - protein, 155 aa, Homo sapiens
MAHLAATLRCFTALDPEGPEGRLILNMCFITQSAPDIRKKLQKLESSPQTPQQELINLAFKVYNNREEFARQQCISELQLLASAETTDNHVSNVQKIQNIQATAPRGSFKTSSRALFVWAPTGGRTVQLTLPPLLRTLEPKPNVPWLTPSQIPSA

SEQ ID NO: 928645 - protein, 127 aa, Homo sapiens
MWYQIILKIEEIQYVKLFVMIFSAGIFQWYIELLEYSMVQRKIYMATFTKQIHIGHKFCVPSTIIWLIFKCKLLASLITIYVQFSSISHPVYLLFIYTFNNYLLGAFKCQALRQTFLNLTVWLMKHD

SEQ ID NO: 928646 - protein, 130 aa, Homo sapiens
MTLESLEEIQDVTCAWKELNRKLSSNTASQITSVCLLKGNMGVCFDVPTTESERLQAVWHDSNWILSVPAKLPEIEEYYDGNKSSNPQRRNGWSSGWSGGSGQSGGPSGGLSGRQSRQGSHSGSRQDGRR

SEQ ID NO: 928647 - protein, 138 aa, Homo sapiens
MAAGFPQSKQVKEQERTLKAETTIFLKPNLKSSIPFLLLYSVIHKSKLKERIYTGHKYEEELYFTPTHRSKWYLQSLERPGVFCYFQSSCGYLHERYNHWSNARDHYCSRILTVKKPFFTGLLKSIIFRFLQNSQGRS

SEQ ID NO: 928648 - protein, 157 aa, Homo sapiens
MGSQRSGPSQPPQPPQPPQPPQPPQSRWPPGPTFLLKPSFSQSFDSARLRRPYGLVLLPGPVEKVHQVGVGIGVSELRLSLGRACFGCCGGWRSGSQANGVMFPGGLWLRLLCHAGHQEEQQLWSKTGWISFLDLLPISRVTLGTLLNLLGPYFSHL

SEQ ID NO: 928649 - protein, 159 aa, Homo sapiens
MCVSGYGSHLVTRRKLLRITEMQPLKLPNHCQQLPNHCQQLPISRHLGRGPTLNSARQAHFGGAKANMSWFGDKTIPCAHTMETFQSIVTTLESTLHHSLRSRRRWMMSKAVLFASGCEKPCVWSCCVTYQCPPHLKNWHPRVFGRSRHAMWFKMRVSD

SEQ ID NO: 928650 - protein, 234 aa, Homo sapiens
MHAVIVQVCVLVRFHAADKDIPETRQFTKERGLIVLTVPHGLGSLTVMAEGKQVPSYMDGSRQRENEEDAKVETPDKTIRSHRFSLDLIVHITISILGKPFNKSLGSSKLSHIFLSSEPFKLFQPLPITQFQSHFHIFRYLLSSAPLYSYQFTVLVHFHAADKDIHETWQFTKERSLIGVTVPCGWGSLTIMAEGKEEQVTSYMDGSRQRENEEDAKPETPDKTIKSRETYSLP

SEQ ID NO: 928651 - protein, 136 aa, Homo sapiens
MFNSYLTDCDEKKVKETSTDGEDSLEARFVDSDQGTKDAEVDSADLQVKSFLVDESCNLSVIKELKMLQWIQLTCRCSHFLVDKGVSLRAMSCGPLTVFNPGGNPLGLNVYPNLCIQVISQKPGQLAGCPVTQQKQ

SEQ ID NO: 928652 - protein, 138 aa, Homo sapiens
MVPVPAQPFAYSCKGWNAAGLSEWSLIPWALKGLVNSSACSRQFLHSFTHALPPEGIECGCPSYQSTPDVLRCGNWNAQVLGLAGRFGVSRGRLHSLCPTAFHSSQDGERRCLQSLKAQKECYSQCSFSFAVHGQLEC

SEQ ID NO: 928653 - protein, 167 aa, Homo sapiens
MIAEERDKFPTSQQAVPSMYPHWDLNSDHGDWSPIEIRRKFQKQALGPEQNLEALLNLATSVFYNRDQEEQTQKEKQDQRKAAALVMALRQTNLGGSERTENGAGQSPGRACYQCGLKGHFKKDCPMRNKLPPHPCHYAEESLESTLPPRTRVSGAEAPNQMIHQQD

SEQ ID NO: 928654 - protein, 146 aa, Homo sapiens
MGCTHCPTSPNCKIGPPILNSGSANLGNRCLQIIDSVVDYLYLDATENPRTLIKDIWENGMNVGLAIKLGTTVEYLALCTNKIDMALVMTVEPGFEEQKFMKDMMPKVHWLQTQLLSLDIEVMVEQPVMRAENLSQTTSLSIEKAN

SEQ ID NO: 928655 - protein, 141 aa, Homo sapiens [sequence omitted]

SEQ ID NO: 928656 - protein, 139 aa, Homo sapiens
MQPQPRLPAAAESDSGDTLTQWPVLYEIGETQPLGQSESVLQEEVGESEIIKAKNCKAMKGDLGTCGAGLGLSRQYFCLDTFFLLQSGNGDTRRTHKLEGEDGAFSFLQACICFLFLTDFKGLLRGHQNQPADTSSSEV

SEQ ID NO: 928657 - protein, 153 aa, Homo sapiens
MRLNSRGKLVQVNSRFNSPTTQDLVYIDPSPDYCVRNESTGSLGTQGRLCNKTSEGMDGCELMCCGRGYDQFKTVQTERCHCKFHWCCYVKCKKCTEIVDQFVCKDLFYVVFSSIPGLYPLDANNILPFVTIKNIYKHAKCALGSKITPSLKP

SEQ ID NO: 928658 - protein, 181 aa, Homo sapiens
MFQSLVAAHLCETPGKSGRSPPQPLPKHGIYSYPSEVGFVRGTQIGWPSGNFQGSRYHTLGTASLKESGSSKDKSSRATRSTWVSRPTFLCNRKQRAATGPANKNPKISNKCSLGYTVGQLRIAAETGAGLALSHYSECQPSSRSTPEEAGGSKHDVKGPGCALSCGPMEWEQDGPSSEEA

SEQ ID NO: 928659 - protein, 154 aa, Homo sapiens
MLPNLLEESQRKAESGPNPDPKRGFLDLTHERIQGKSIVQSKSKFTKKWTGSAKPKFTQAQSHWAGSFTTSTAAANEEACVVQVHCLLGLMPKAFGTGPLHSFVRYSDHLLGSLGVPWIPIRPAGVISLALKVGSHPWAFHRIWNLHPAAQSPH

SEQ ID NO: 928660 - protein, 287 aa, Homo sapiens
MSLQPVAYLSKEINVVAKGWPHCLWVVVAVAVLVSEAVKIIQGRDVTVWTSHDVNGILTAKGDLWLSDNHLLKYQALLLERPVLQLCTCATLNPATFLSDNEEKIEHTCQQVSAQTYTTRGDLLEIPLTDPDLNLYTDGSSCVEKELRKAGYTVVSDNGILESNSLTPGTSAQLAELIALTWALELGEGKRVNIYTDSTYACLHAHTTIWKEREFLTSEGTSIKYQEAIRRLLLVVQKSKEVTVLHCQGHQKEKEREIEGNRQVDIEATRATRQDPPLKMLIEGPLV

SEQ ID NO: 928661 - protein, 144 aa, Homo sapiens
MGSLDGKHDDNRGLSPQKMHKHKPILSLPPVGSPGFSVAHVLVPSLLIVNTLSSLASDIPPLQFSTWISKTHHHTLEIVLSLSIWGWDMLALLSLWMKEELGATGCYTGWASPQERDRKTGVNGHTCETTTGPGNGREVCDRAQ

SEQ ID NO: 928662 - protein, 186 aa, Homo sapiens
MPESPTPLLGRGILAKAGAIIHLNIGEGTPICCPLLEEGINPEVWATGGQYGRAKNAHLVQVELKDSASFPYQRQYPLRPEAQQGLQKIKDLKAQGLVKPCNSPCNTPILGVQKPNGQWRYGKITRPLYTLIKKTQKANTHLVRWTPEAEEAAFQALKKALTQAPVLNLPTRQDFFICHRKKQEYL

SEQ ID NO: 928663 - protein, 143 aa, Homo sapiens
MQEQWQAFSPIGSGNGRIAGSGAQRTPCRIQRGGSQRRLDEKHGLVSAQLLMRAFVLPQNTAEKVKGEAGIYEEEPNLRHTLPLAPEHQVHTWWEFINNSEINTKESNASFFHLSPGTFSNPSQLSLHSLQQDSGTQTSVFFL

SEQ ID NO: 928664 - protein, 149 aa, Homo sapiens
MLLKVCKVCVFVRHTTKNLWRSLACEKAWSTHAWWICGYTVKKHLNKIWKEIQEGKLCEVKGWEWEANDIAWTLQMDLSTPVYPELGTEASPRIGTNGQCHSHYILVKGSYKASADSRRGKIDSIPPIIMQNNVRKKVHVCYLEELGQM

SEQ ID NO: 928665 - protein, 150 aa, Homo sapiens
MEEATDCAGKRNRTYLMLRSSQPSGTPLQRFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 928666 - protein, 121 aa, Homo sapiens
MPLTLKVLLLIDLEPWYSKGGAVGPAAEALLRSLLEMQNWGSTPDLLHQNLHFKETPNLITGTLKFKKHDNIIEQSYYTIFNQEINIDIVKNNYLEMYPGFWMYQWFIPLYCWVVFYGIDV

SEQ ID NO: 928667 - protein, 178 aa, Homo sapiens
MPVLQDTLGQPRPSKGPTCPSWSPNGARLWCALIPEVVALKKLDPGGQRAASPPRHHLTFKFCLDRLLSSLPAPVHVQVLEINFSFLHAYIYADPLQRHLVTHKSQNPKELLHRILPGLSHQGILLMIPKLHCPMQVSIISRLSLFRITTLLILGLLVQTHGSRVMMSKSSGKVYNLP

SEQ ID NO: 928668 - protein, 164 aa, Homo sapiens
MAPLHPHFPRIGLGSGRCHTFSPAPPRRKPNPEVAYGFPKVPGLWTSVRSASPALIGCLRHRSLRPDLRRPGSSPLSLQGWCLAAPPTLGLVRGEIRPCALVGLRNSGRAVSGHGQGPQAGAGRGPGAGARLEACLLCAPARAGPWNSLWPPPSALRHTDADAL

SEQ ID NO: 928669 - protein, 146 aa, Homo sapiens
MKLVLGICKEIGGWNPMLLHRARPISKTESKKEGTSNFWHLPIGSEMSIQYPGLGNPEVKHYHFLEAFLKHAGTVGDPEQLFHLGTAGPRIGSLETADPLGMKGVHSGQKEKMRLSMLYKPFIHCYIKDSEKSCRKVPVCVACDTD

SEQ ID NO: 928670 - protein, 140 aa, Homo sapiens
MLQVWNLRYAQRASWGCVTAQRLHNFQSCMEDVSGYCPNKHQEEGLAGLFPWFRDPIKYLSFFSQNEPLFLSYIFIWYPEAPGFPGICVKNSSYSIHSFHTQPLPTDRPSERQPATVARACAPELWRSGKDSGFPTDPLS

SEQ ID NO: 928671 - protein, 132 aa, Homo sapiens
MYAPCWVTTLVCPRLISGHRVFLQWLQLLTQCISCIASSLIIFTPVYLHACVFITCCPQGQEPCLPCSLPQHHPLEHNELSPTSAGATPCGQGWRRVLERFHAQSEELISLRIKWVLWTVKEFLVYFQGRYL

SEQ ID NO: 928672 - protein, 228 aa, Homo sapiens
MAKGDPKKPKGKMSAYAFFVQMCREEHKKKTPEVPVNFAEFSRKCPEKRKIMSGKEKSKFDEMAKVDKLVPNPSFGSHCLDSSCSVPNSALISNPQTLVSLLEMSQKGWVRCRLTCNSEKPPYITKATKLKKTCSNALVGLGHSRQQRCPHKDIGQKGQQCWGQRWHCWSLNNVSGVSSNPRGPACALLCLCLYLTPTVPPGAKGCAYRDTHLGYQSWNGTLGVSTPA

SEQ ID NO: 928673 - protein, 166 aa, Homo sapiens
MLCLVEAGPLPHPTEGWVSPQVHDRLDRYCCGFEPEPSDPCVEERLREKCQNPAELRLVHILVRSSDPSHLVYIDNAGNLQHPEDKLNFRLLEGIDGFPESAVKVLASGCLQNMLLKSLQMDPVFWESQGGAQGLKQVLQTLEQRGQVLLGHIQKHNLTLFRDEDP

SEQ ID NO: 928674 - protein, 148 aa, Homo sapiens
MRPTARPGSASLEEGWRCLGNRSKRRPPADAVKRGAAAVSTFGWTSVIAFVLPAVAQQTFEATSILRLGARHCVHGSCLQDPVSLTGRKPARQQEHSLDPAKSEQQRVSWEGAGAPRSSETPALRSAGCDAWHAGPSALRLPHLQKER

SEQ ID NO: 928675 - protein, 358 aa, Homo sapiens
MSSEDDQRLPFILPDGTEKGYAYVDFNYSGNLLASVGSNPDYTLTIWNWKEEQPILRTKAFSQEVFKVTFNPDKEEQLTTSGSGHIKFWEMAFTFTGLKLQGSLGRFGKTITTDIEGYMELPDGKVLSGSEWGNMLLWEGGLIKVELCRGTSKSCHNGPINQIMLYEGEVITVGSDGYVRTQDPECLFSFHSGAIEAVAVSPLTYLMATTALDCLYSSNDHMDFKLQLKCPFSIPPCLSGRLHISFYDSAQVNFTGAQIIVGFEDGVVRILELYDPKGLTIFAGRKKILDADIQLKQVFKPHTACVTALAYERDGEILATGSKDQTVFFFEVERDYKPIGYINTPGPVCQLMWSPMSH

SEQ ID NO: 928676 - protein, 142 aa, Homo sapiens
MGRNQSRKAENSKNQSASSPLKKYSSSLATERSWMENDFDELREEGFRRSVITNFSELKEDVRTHRKEAKNLEKRLDKWLTRINSVETLNDQMELKTMAQELRDTCTSFSSRFDQLEERVSVIEDQINEMKREVQRKTSKKK

SEQ ID NO: 928677 - protein, 145 aa, Homo sapiens
MAASAESSRFSGKWGKAGSHRPHPAVMQTKGPVSLSPSPAKSPKSVSRWRASGLENLPRLPAFQLRKKRTWFVPCLWSLHTGFVPSSDYPSSQKVGGTVPEKRVLMWDVRESRREYKGPIITGLPIHAKETGLYFNVEEKPLEGF

SEQ ID NO: 928678 - protein, 203 aa, Homo sapiens
MSYVCEMWEFGEVVSNILSFHKHMDTVTNFFSMFFSQDSHLPLSIPETLATKSSYKTVEYDDDLDNNPFKASLFPETEQYSRTLKNYAKSILPVLYKWNNKAWMTAHLFTAQFTEYFKPTVKTYCSEKKISFKMFLLTDNAPGHLKALTDTYNEIEAFMPANTTHILQPMDQGIILTFKSSYLRNTFHKTVVAIDSDSSHGSE

SEQ ID NO: 928679 - protein, 157 aa, Homo sapiens [sequence omitted]

SEQ ID NO: 928680 - protein, 151 aa, Homo sapiens
MSSLTTILEGARLPLVHGSHWLHGVHSPGHIFPTATAGEVQVMPHPGQPHTNKFDALSAGSVSPGCAFSRVLEGSQDTARSEVEAAAEAPGLEWVLPSHVRVAEVHGQAALLSSSSLINIHVYQAPVPHNSTPLVPHTPIAGQTRQATEGE

SEQ ID NO: 928681 - protein, 158 aa, Homo sapiens
MWYSSYGIYECSCHNHLCVGFCVDVNFQLNWVNTKEYNCWIIWNLWIHKVLCCYQGGDITPISKSPQLAENCSGLDHSVEKLVTNAIEEKYETKSQTLPFNQYLLYTQFVSLINVAGVPAMDRPCTRHWVDKGGQERPGPPHLDWIFCFGRSAVDVCS

SEQ ID NO: 928682 - protein, 136 aa, Homo sapiens
MPEPPPSPPPAMGSCAAQASPTSAAPCSTAPSPIDRPRAEECGRTARDWHAAPPAAPVRDPLGEANWAPDFTPEASETTNPPGGMNNSRRAALRAVTLTAKVCSFTPEPARPRTHQKEETPNTSEHQKEETPDMPP

SEQ ID NO: 928683 - protein, 141 aa, Homo sapiens
MDLGKRAVWALDVDLESASRRLQDPGYSECDLQVVMGSKWAPFLVMQKPHPTVRGQRREDQGSLQQCSPVQPKNQCQSKSRSEKAQHFSFCAEKTGYYCLVLNKELLYEKDYSGAIMRETEGSKGGIRRPIKRHCNHPNKS

SEQ ID NO: 928684 - protein, 135 aa, Homo sapiens
MFSEQKCRRSFFQSTHAFVPCFGSLKAGLSSLLIGLFCGWFIPPLGARVVFFLPPQPDLWDLFYSPGKLHNLDKHKAIKRFLAPAAAAAAAAAAAAASTIHWAATEEGTRTNQSDDRLLCCFDTPHSSLGDILYD

SEQ ID NO: 928685 - protein, 149 aa, Homo sapiens
MNAFALQSRKAFLLAVGCGGASVLSVPGGPESRPGSLRGEEAPLHHPAYFLQALAYLLAALLAVVNNAITQLQRLSTQSQSCCSGRELLLSLGATSFPLKPSPRVLEAGKTPKIPDHCNHPSFRVPSFRALPRDIANISLARTMSHGHP

SEQ ID NO: 928686 - protein, 140 aa, Homo sapiens
MALWYVAEEISKQQSIQDVTRVLLKAFSFIREVEHKSSENLQPDNVIEKKNPFSEEKFKLAAESNEELNINPQDNGENVSRAFRIKHIEPQLYKKRYMKMESLQISSYFNENNFAEKVTLFPHLRIEEVEIDLLFQYDSY

SEQ ID NO: 928687 - protein, 127 aa, Homo sapiens
MVGPCSKILEASSVTHLSGPAKGSKQQPHLPLTPQAPLDLLGHMAQVAEQLAQQPGPVAEPSVLEPTKNWQPFGSLAEGKLLLVGLMDRNGVKGICQVNGCILGTRKCGANMEVLPAAKYVYANYAF

SEQ ID NO: 928688 - protein, 162 aa, Homo sapiens
MVERPFEVTTTMPTRIHGSRNQGVEVEVSPLTNIPSDPLAKFLFPAPSTLCSAGLELLVPEGGTLLPGNTTMIPLNWKLRLVPGYFGLLLALSPQAKNGVTVLAEVIDPDYQDEITLLFHNGGGEEYARNTGDPLRHLLVLPSPMIKVNGKTTTPQSRQDYK

SEQ ID NO: 928689 - protein, 139 aa, Homo sapiens
MPEPPTPSVGSCAASGASQTSAAPCSLAPSPIDHPRAEECGHTARDCQAAPPAAPVQDPLGEATWAPESAVTLTAKVCSFTPEPARPRTHQKEETPNTSEYQKEETLDTQPFKNCNTHRKDYDADLIPVKGNEERGKIG

SEQ ID NO: 928690 - protein, 818 aa, Homo sapiens
MVLRARCGGATHPFIWCPTWVLFSRVKVRSSVVIEDKSTRDPEYVYSQPCDLKDWKKIGKELKQASREGKIIPLTVWNDWAIIKAALEPFQTEEDSVSVSDAPEGCVIDCKEEAGRKSRKEMESLHCEYAVELVMAQSMQNVDYNQLQQVIYPETLKLEEKGPELVGPSESKPRGTSPLPAGQMPVTLQPQTQVRENKTQPPVAYQYWLPAEFQYRPPPESQYGHPGMLPAPQGRAPYPQPPTMRLNPTAPPNRQGSALHKIIDKSRKQGDIEAWPFPLMLELIPPGEGAQEGEPPTVEARYKSFSIKMLKDMKEGIKQYGPNSPYMRTLLDSIAHGHRLIPYDWEILAKSSLSPSQFLQFKIWWINGAQEQVRKNRAANPPVNIDADQLLGTGQNWSTISQQALMQNEAIEQVRAICLRAWEKIQDPGTACPSFNTRQGSKEPYPDFVARLQDVAQKSIADENARKVIVELMAYENANPECQSAIKPLKGKFPAGSDVISEYVKACDGIGGAMHKAMLMAQALMGAALGGQVRTFGGKCYNCGQSGHLKKNCPASNKQNITIQVTTTTGKEPPDLCPRCQKGKHWASQCRSKFDRNGQPLSGNEQRGQPQSGPTTNWGIPSSALCSSGFSGKTTPTVPSASGNEPVTTIQQLSPATSGSAAVDLCTIQAVSLLPGEPPQKIPTGVYGPLPEGTVGLILGRSSLNRKGVQIHTGVVDSDYKGEIQLVISSSIPWSASPGDRIAQLLLLPYIKVGNSEIKRTGGFGSTDPTGKAAYWASQVSENRPVCKSIIQGKQFEGLVDTGADVSHCFKSVAKKLA

SEQ ID NO: 928691 - protein, 193 aa, Homo sapiens
MAAEDELLLPRLPMLLETGKQLLDEVELAAETTGYQIVQEKVFKGLGLLEKERPPVKSFILTRNTAQAKLFGASYPSLATMTVSDWYEQHRKYGALPDQGIATATPEKFRKAAQQQKYQEVKEGEDDEHSTEFGSGITGRTPILGAMATDRTWADLPPTRQDCRVHTSPTKENHAVFPSLGSRFSCVQRRQRC

SEQ ID NO: 928692 - protein, 135 aa, Homo sapiens
MAAKDRREIKHSAGGPALLGDPAHPPQPLAQVLSPSLPGQQGRPAAPSAGPAKPTPTRNSSWPASAARSPGSRSRLSLHTSLQAEGASSGLGQPRRGLLQCSGGLKGSSSATKVGVQAEEVPRASESCQHAVTSH

SEQ ID NO: 928693 - protein, 190 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKALCLSSIYEDLKMYQVEFKTMNAKLLMDPKRQIFLDQNMLAVIDELMQAPGRAPGFACKGPVCISANIAGKQARLVPDYDPLIRAVTIDRVMSYLNAS

SEQ ID NO: 928694 - protein, 149 aa, Homo sapiens
MGCTHCPTSPNEMNQVPQLEMQKSPVFFVNHAAICRPELKIAWKKRTLTCIFENGNKFNLDTLRIEFNNSDPQNDSVEFPGFSVCLIHFRLGAEEAGNQKPPMAGKGALSPNPEHKKTQKTEKKHVSENDMVIASKYEPLLHNLSPSKA

SEQ ID NO: 928695 - protein, 155 aa, Homo sapiens
MSTWTPSRHQMCRPKPNIVACRIQLTVNKLTYILKLLLDYSSPHIDLTTGPSAASLLEFARGPLQTLFAWVSAAVAAEQQILVNHKCCCLIVPLEVLSQRSTWPCEVSQAVFWENHYSLQSCQIGTLKSAEVTAVFLFVCALPPEVEPTKAGRPS

SEQ ID NO: 928696 - protein, 269 aa, Homo sapiens
MAVARVDAALPPGEGSVVNWSGQGLQKLGPNLPCEADIHTLILDKNQIIKLENLEKCKRLIQLSVANNRLVRMMGVAKLTLLRVLNLPHNSIGCVEGLKELVHLEWLNLAGNNLKAMEQINSCTALQHLDLSDNNISQIGDLSKLVSLKTLLLHGNIITSLRMAPAYLPRSLAILSLAENEIRDLNEISFLASLTELEQLSIMNNPCVMATPSIPGFDYRPYIVSWCLNLRVLDGYVISQKERGSMVMWAEIKVWCKERPTKRDETCLR

SEQ ID NO: 928697 - protein, 184 aa, Homo sapiens
MWESLELPGNIFNGFDQNADNDMDDEIQAEVISDGDEEFVGNWNKNFEIEGDDLGYLAEEISKQQSLQDVTYVLLKAFNFKRETEHESLDNLQPDDVIEKKNPFSEEKFKPAAEICIKGARPKHWQLPGGVGPVGAQKSRIEVWEPLPIFRRMYGKASDGEKGSSQTTRAFSNKSIVRRSKFES

SEQ ID NO: 928698 - protein, 153 aa, Homo sapiens
MSGSGQGHIVEYGRRKNFHNYDTIRCSRLISHTDTVLALKSAMSLSETKKEWCGRRPVMKKHLGKVRKAAGGDRTNVQLPLGWKGQHMEVHIVNFCSNNCHRNIPGKPKEFTEPLKEEACWKAIPGLILQASLEKGRQPVKLGRGHRVKEVPS

SEQ ID NO: 928699 - protein, 143 aa, Homo sapiens
MSCQPMKAAGGKALPCKATRAELPKTMGTHLLHQHDLVVRPGVKGNHFGALRFDCPAGFPTCMGPEGTEAACKVITQLFPWNHKPYCGMKRKVPRAPWLRRLSILNKLGELVILTQDDRMCKVKRSLARWAEGICHAELRKLG

SEQ ID NO: 928700 - protein, 171 aa, Homo sapiens
MLNSQNVIVTLGPERVGSLPGKRHGQEAMGSEVGSCLRLNNIRQQGGRAPPGGACELLVSLLPPWSGTMTAAICGYPISRLSRWCLAEAFLGLDACGNPCGLLFWKQRFCAIFQQLCDTKNEIPRIDRTTGSDERDPMQGYAICIRCYKCTFVCARKNNQQHEVESLGSYK

SEQ ID NO: 928701 - protein, 143 aa, Homo sapiens
MAVSESAGVFPNPSPPLESRSKGKLVSQKEITFSPATRGPHHQQEGSKELGAIRKEEVEEPSDILKWLWLRGSLILFPFTKSRAVMLSRLKCKGTLVQDAGALSLKWKQSGKDQKTVEGRPGLNRLEEPLGKDMDEIGNHHSQ

SEQ ID NO: 928702 - protein, 190 aa, Homo sapiens
MGGCGTLIHMYREILGRAFLPFPLPQLSPLITHRRDKQIENNYITISCTHFHYPCDTDRAIQGIRRTMHSLNNVLNTTFQLFSPKFSGKLDELDVIRYSSVRAIPTDENIMTMFYGHLLSPMFHYHSFLLSCYRSPRTYISHKHILISFTYAHYSDTSQYAHLLNFLSDPPTPHSARHQITPPTAIYQSQ

SEQ ID NO: 928703 - protein, 148 aa, Homo sapiens
MTGPGARWFPSCMQAPFCISLMANGDEKLVGNWSKGDSCYVLAKRLAAFCPCPRDMWKCVLERDDLRYLAEEISKQPLNGRSTSSLHCVPGKATDTEHQPLKAARRETVSCKATGVELPKTLGTTSCISVTWISNCEWLLNAEDNKSG

SEQ ID NO: 928704 - protein, 135 aa, Homo sapiens
MHTLPPLPRWRMCACALQHATAAAMNGPYPPTVTPLSMGNAQKETSSPISCPELPLLLVQLHAQRTSALCLPKPHLHTDTAAGHIDAGSSCTPCHATTTTTTVNAHTEASTSVAISALPQSMSMYTRGHRTKPGA

SEQ ID NO: 928705 - protein, 171 aa, Homo sapiens
MILHLKDAFFCIPLHSDSQFLFAFEDPTDHTSQLTWTVLPQGFRDSPHLFGQALAQDLGHFSSPGTLVLQYVDDLLLATSSEASCQQATVDLLNFLANQGYKVSSEIARPLYTLIKETQRANTHLVEWEPVAETAFKTLKQALVQAPATTLTGKVHSFTPEASETSLLEKV

SEQ ID NO: 928706 - protein, 139 aa, Homo sapiens
MSQMANWKDCGWVLKQGFECFLRLCEQLGFLLLVTLKLNIKLSFKEKVLEHLFPSRLYLGSIDPSTEKSPLKPISLMNIDVRILNKILANRIQQHIKTLIHHDQVVFIPGMQGWFNLCKSINVIHHIHRTNDINTLLSQ

SEQ ID NO: 928707 - protein, 130 aa, Homo sapiens
MERLIRPGSNHQGLECNSEKCELGPTGAIKISCLQKEIYNHINMSSYWIGVVPNPLIGVLKSSAEIYRDTSREEGNAMMEAEIGVMQLEAKECRGCSNHQQRGEISVTISSRPSRRNQACKTLDFALLAS

SEQ ID NO: 928708 - protein, 163 aa, Homo sapiens
MIRHYVSILLESDKKLTQEQVSDRGANHLVVSMQGTRHPQSLSHKPAKKIDVARVTFDLYKLNPQDFIGCLNMKATFYDTYSLSYDLHCCGAKRIMKEALHWALFSMQATGHVLLHLLLPAAAPRCHRGRASPQGQGLIPHPDLSEDTAVKAQALAFPSEGLD

SEQ ID NO: 928709 - protein, 720 aa, Homo sapiens
MVLRARCGGATHPFIWCPTWVLFSRVKVRSSVVIEDKSTRDPEYVYSQPCDLKDWKKIGKELKQASREGKIIPLTVWNDWAIIKAALEPFQTEEDSVSVSDAPEGCVIDCKEEAGRKSRKEMESLHCEYAVELVMAQSMQNVDYNQLQQVIYPETLKLEEKGPELVGPSESKPRGTSPLPAGQMPVTLQPQTQVRENKTQPPVAYQYWLPAEFQYRPPPESQYGHPGMLPAPQGRAPYPQPPTMRLNPTAPPNRQGSALHKIIDKSRKQGDIEAWPFPLMLELIPPGEGAQEGEPPTVEARYKSFSIKMLKDMKEGIKQYGPNSPYMRTLLDSIAHGHRLIPYDWEILAKSSLSPSQFLQFKIWWINGAQEQVRKNRAANPPVNIDADQLLGTGQNWSTISQQALMQNEAIEQVRAICLRAWEKIQDPGTACPSFNTRQGSKEPYPDFVARLQDVAQKSIADENARKVIVELMAYENANPECQSAIKPLKGKFPAGSDVISEYVKACDGIGGAMHKAMLMAQALMGAALGGQVRTFGGKCYNCGQSGHLKKNCPASNKQNITIQVTTTTGKEPPDLCPRCQKGKHWASQCRSKFDRNGQPLSGNEQRGQPQSGPTTNWGIPSSALCSSGFSGKTTPTVPSASGNEPVTTIQQLSPATSGSAAVDICTIQAVSLVPGEPPQKIPTGVYGPLPEGTVGLILGRSSLNRKGVQIHTGVVDSAL

SEQ ID NO: 928710 - protein, 134 aa, Homo sapiens
MGDDQCSFVGISKTGRPLRCKDWKPFPPAERARVRHLEALNGAGSRGTRRGRLSVWAQQRLEGGGPGSPQGERPPLNQLTWDPWVNAGQEMRLTSKTLGPWAPYNPGHDSPPHGASLAPGQPPAITAKEQESPE

SEQ ID NO: 928711 - protein, 154 aa, Homo sapiens
MIIKHNDEITSIEQSWKEQRGEEGSDSTPNTLTPTRPHPYPQLRPEEKTIMTERSAAVFIQGLVAGHAGATHTAACSPQGLDHSVLVEAGAVEAAGKEAEDGVGVYWRWHSCHSRVFIEGHYELKENQLNIQLEISLGLQACKVQQCIPLPLKE

SEQ ID NO: 928712 - protein, 172 aa, Homo sapiens
MMTMAVLWNRKGGKTKGNLILVIIEDVEESIEWKTLQKKKQQKIKEKLRIRTKAAVKIQAWWRGTLVRRTLLHAALRAWIIQCWWRMTLSRVLEKKRQAALIAYATRERAVIKLQSLVRMWRVRWRYCQVLNAIYIIQGHWQCHNCQTCALLQGHCVVTATHLQFHIEIINS

SEQ ID NO: 928713 - protein, 138 aa, Homo sapiens
MPAHVSRRSSTSNFTKIINLTMPKPHPKPINLEALEVGPWYHCYGRYGIFTDRFSTSPGTWYAVIDLANTFFSIPNSHTGLLLAPQSHKVILCGAHGLCICCSVLHILTHIFTWWPLLNIQTCPKCLFLRETLLHHPD

SEQ ID NO: 928714 - protein, 181 aa, Homo sapiens
MGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAVAL

SEQ ID NO: 928715 - protein, 120 aa, Homo sapiens
MPKRKAEGDAKGDKAKVKDEPQRRSARLSAKPAPPKPEPKPKKASAKKGEKVPKGKKGKADAGKEGNNPAENGDAKTDQSQKAEGAGDANIDLTPLSPDICWDLTPSRWLPVCQAIWTFQ

SEQ ID NO: 928716 - protein, 134 aa, Homo sapiens
MIVDLSVIARFMGVEAQAPHNVSTDIIGGEPYPNEDESSGSLVGHHPGRDIGVSLLQPHEGGNSVKVPYKPTCMTLDLSAIYHYLCYCLEASYKDYPSCDPHHSECLALYAFIYCCYLNYKTINNWILDHYRWK

SEQ ID NO: 928717 - protein, 151 aa, Homo sapiens
MASNLRLLGNLQVCCSLLGVYSRPCYTWYHQWRLQNSKDCCLLLPLESSSQGGTGLMPARAVLYEESWCTVLGESSLSGSAALFSAGRQERLNLLKLCPQQSFPPGAVSQGDGHFFCKLLTGAAAFPSEMPSPVKRNLEKQSGHSLFAALW

SEQ ID NO: 928718 - protein, 163 aa, Homo sapiens
MNQGPCLVKSSGWALCAGGLDQPLVLTEDFSEPGDSKGKGCKTANITPPTLSPPNPQTLGALSQRVMELLLAQYPWQGVGGDPGQEDSSSEEKQSSLSGMCNAATSSWLEFQASGSYPVTSEVLWKKPGYLRLLGLRVYLSGCSAKTPHSSVYLTEGPSGVGS

SEQ ID NO: 928719 - protein, 216 aa, Homo sapiens
MRIAANQSRAFNGNFLKWLDLTWEESSADSQLFLEKMDHSHHTGMSCMDSNSTMQRPHHHPTTSASHSRGGGDSNMMMMMPMTFYFGFKNVELLFSSLVINTAGEMAGAFVAVIILAVFYEGLDSPREPAVTKWNHPYVDTQNCWAADAELSSPPANSAAHHPGGHKLPPHAHLHDLQWVPLHCSNSRGRYKILPLQLEEGSDWLPKDEASEGEKA

SEQ ID NO: 928720 - protein, 150 aa, Homo sapiens
MAAARLHDRLVPRRRERTAEREKEKRKRKRRNKKKKEEKEKERKRKRRKKKKKEEKEKEKEKRKKKERERERKRKRKKRKKKKKRKKKKKKKKKKIIPHIFLNLKPPRFVLCRVGSISLLALAQSCGGESMVVHIHVDGTILHIKNKEYS

SEQ ID NO: 928721 - protein, 169 aa, Homo sapiens
MADEWSSLWGHYHPKKRAANGRFFCSFNQATPLIGIITETMCHGYQQGFCYFADPKESIPEEVIVIIGDDSSMCVTDPEDHSVGKHVEVEDSDIDDSDPAGASAAGLLEFAGSPLQTLFAWVSPAGAAEQQILQNSKCCCLILPLEPLSQRGTWLYEVSVGPYWEVSPN

SEQ ID NO: 928722 - protein, 179 aa, Homo sapiens
MGQRAINNEREEGEQSHQKGPCSIAKAISVALNNLGHIGGNQQRRDVIWEMIPLMPMPLHVLNDSHLEAPREEWKAVPDILNITATCFSTLTENNSLTFSTYNSVISKHKKPIQVMPEKGIVCFQASRTQDLGITYVDTSNCWYNVTRLNPVESLFTRYGYTSLQHAIKGPQKALNIEV

SEQ ID NO: 928723 - protein, 200 aa, Homo sapiens
MAKATLSCPSHKPRSLSLWLPLPQAHRKCAPLWPRAGPERPSKNQGLELGTPRAWCSTPLWLSWYLSCPNWCLIRICDPNIHCLHAQDSARTYLRTVVRVTYTAFQVCLETQSTLAHGGEACWSSIADCWDWQFYSGWGWSKCSLHEWASTEFRLGLLSAVTGQQGVQCTVSQALRLPFLKYTDSPCHTVIVVRMEEGWH

SEQ ID NO: 928724 - protein, 162 aa, Homo sapiens
MTINFTFRLQAHWTKIFLVLGAWQNRGRDITDMQVTFFYCLPGVFSLLRGPGKCLIFIFELSNIASDDFGAEFGLQSSRLLLSLGENEMEEPEGRWNGKVVFLSEVGPLSGLGSPSTALAKLRINPPVDGLPACRCLLVCSCTGLLQAGLGRRGNLEWERLS

SEQ ID NO: 928725 - protein, 150 aa, Homo sapiens
MYPDWKTSPSRGLQTPHTGELWLASGRCPSGTKLPEKGTGSNLCCSASSAGDTQAIRLWSGTPANSSRPAGEEPDPREQNWTENDFDELTEEGFRRWVITSSSELKEHDLTQCKEAKKLEKRLDKLLTRITSLEKNINDLMELKNSMRTS

SEQ ID NO: 928726 - protein, 137 aa, Homo sapiens
MLSPLNIIAGEKEAESEDEEEEDMKLLGTPEGGSKFTQKKVKLAADEDDDMMMQMMMMMMMMMMILMMRKLKKKLQSLLQHMRILGDTIQVEIWVGTQPNHIIPPLAPPNLMSSHFKTNHAFSIVPSTYEPVKSKAS

SEQ ID NO: 928727 - protein, 153 aa, Homo sapiens
MQKSPIFCITHAGSLQPYLLLMNKTSDLCQYGSAFLCLLGFWNKELKVTYLKYNGTHASSDRTATPAYAFYLLGAQYNIMVIDLGVNRVYILIFWRDAEYEMTNGSHGRVPPCFSSFAVNGSLSLVQCCAGSCAGGLNAPWITSWIMVLAKAL

SEQ ID NO: 928728 - protein, 142 aa, Homo sapiens
MRGSSIINASLIKTLLKAALLPKEAGVIHCKGHQKASDPITQRNGYADKTLCLAFSFSIHTKLYPGHHQPFYTTNVSSNNPTISPLITKYSFSLISPTLGSHADPNPSRSSPEKHHPLSLHTTPRKFLLPQHFNTILRYFSY

SEQ ID NO: 928729 - protein, 156 aa, Homo sapiens
MAAETGSLGYTAASWAPGYVTQWQLRSQGGTRAARALGKRHSSSMTLGVVEHTGKSGTGTRVWHAAQQQLQPHGWCSITVAQILGLKHVWDGYNSILDQEDKGPNLEMVEEKASVSLGSRGWYGLYTSSGMLPYGLLQERKITVTNFCVFVIPGTT

SEQ ID NO: 928730 - protein, 173 aa, Homo sapiens
MWVCWPTCALILACFSEVLARLCAAVAEIPTKRFFSPGAVQQVPEGPRRNQHKHCDRYLPYLGLQQLGCLHDMQMGTSFKEERMNALALAGQTLTAMGRGPAKEEPDRSEWVVRGRTRNIFQRSKMQKADTAYWEPFSLLSLGKQQMGVCCSPFSCRNSEFPLYPISSFGSNL

SEQ ID NO: 928731 - protein, 171 aa, Homo sapiens
MCVLDFPHPVDSSCKKKQACSNRILQGQFVSQMSAEALGDPIKLDPNPNAKPYESLESTEQLLSVPTPYIIMPHSAFMPSYLRVLSGSVLHHPFQEQSPFPSLGLHKNPLAFRRFGIIGLTKEAPESSLTPSHHMRTQGAVGSLQLGRSPSPEAAHAGTWSWTSSLHICEK

SEQ ID NO: 928732 - protein, 135 aa, Homo sapiens
MLCSSVSVGRGVKVPPVSVWSRGHAARVDLGGSTDEAFVSLLQFRPQANVHVMWYSPHTAGGVLLCVFDEQEDVLHFKSELSRGKNIHPSEDKKHGSGVTKDLLIIPWSTVKTLDSIYETNIRRLRKMENSRKIS

SEQ ID NO: 928733 - protein, 172 aa, Homo sapiens
MPGPGQLALFQRQFVQKAASSLVLEGTEKDLPPCPCDWGAGRGCVWPCQHLPWAKSNRRPVGYEPSEVHSVHLPKSTDLGRDWIQVGAGWKQRVASRKWAVGMAGMVEMGNIPGTCCQPTAHQAGAGRASTQRGGEGVNSPVFLGHIAYPIFWEARPRVWRHGSSYGNYSYI

SEQ ID NO: 928734 - protein, 174 aa, Homo sapiens
MVTSPPILPSNKLQRERRTRGPSDSSSLYQLTLRICQLLQCPVRLLVGTCCVLVTPWWQALYGFQGWHLERDEGQPRLQEASGKLDKWTVTGQCTVEVAETQSVNEESTVSKGTISIGVPSLPTPKSQLFPLGCIISLISLMLWQNLVEYADFRPKHLQLQGAEPPADWQIRPA

SEQ ID NO: 928735 - protein, 130 aa, Homo sapiens
MSLAREWLIHLILQNGKWKNCNVDSPAAFGRSCCCQGEEALLGAAHRSKKQAGKSFNKGTKRRGDVIRVQVPVPSEENRNQDRSCPRETETIEKGVPGVSGRHKGIFSLWAEQTKIFPHRICEEILNTVD

SEQ ID NO: 928736 - protein, 164 aa, Homo sapiens
MKEKAVLSEIEGTRSSLKHLNHQLQKLDFETLKQQEIMYSQDFHIQQVERRMSRLKGEINSEEKQALEAKIVELRKSLEEKKSTCGLLETQIKKLHAKTFEKCGPYKQGKEDRLRGEKRKELWHGKFYLGQKGDRPTLFGLGGEVSKRLTENGFPVGSFSCGDF

SEQ ID NO: 928737 - protein, 157 aa, Homo sapiens
MQQKGVVYEPGSKLSPDTKSASSWYSDEVMSNGATGPVPGESQNLFGFSRCLDCCLCSEFIWRSYLGSAIQRDNWLNSAISLSFWVGTAITSDWTKPQEDHSLARTSSNSTESTSSEKHNWEMLTVLIRIYTITNGNIFKLTNARKKFKGKIHEYLP

SEQ ID NO: 928738 - protein, 131 aa, Homo sapiens
MSLWYMFNFTATVTFIVKVAPASDFSPVFKAAHYSFSVPETLGGKENHHFGFDPTRGSNTPKLIVKNPFNFECRAEVQQQYHLVVHIIDDNLKYGKSTKPRTGTAVIDIYVRRANMPPPPTTSCEVKSYRI

SEQ ID NO: 928739 - protein, 156 aa, Homo sapiens
MCYFVTERGTVFTATRLDVERAGFASVQSFSIKARDCDWQCAAILVTAYTHGINDNSPFCDQYLIRHTLKEEIAKDTVVAKLLCRDLDEPPDTIHYAPSSGPVGSGQLFEQVPNAENVIQPEDMAETTGNISLSLALTPDFCDKLHKLQAGLLHIL

SEQ ID NO: 928740 - protein, 150 aa, Homo sapiens
MATPARAALQTPPQQTLWATHQLACCPNTSLSSPPCHLKCPWWSRGPPPSRVPKACDKSRLLLASSTHPFPLSCCCSKVSPAAGLYDYSHFTDEGTEHKRVQACLRRHSFKGQNWKVNSKANAFTSLPIVITNTEFFSSTQSRSSLYSLP

SEQ ID NO: 928741 - protein, 306 aa, Homo sapiens
MYLGTLFARSERLQLCLSADGGAKRQEHLSRFSMPDLSKDSGMNVSEKLSNMGTLNSSMQFRSAESVRSLLSAQQYQEMEGNLHQLSNPIGYRDLQSHGRMHQSFDFDGGMAGSKLPGQEGVRIQPMSERTRRRATSRDDNRRFRPHRSRRSRRSRSDNALHLASEREAISRLKDRPPLRAREDYDQFMRQRSFQESMGHGSRRDLYGQCPRTVSDLALQNAFGDRWGPYFAEYDWCSTCSSSSESDNEGYFLGEPIPQPARLRYVTSDELLHKYSSYGLPKSSTLGGRGQLHSRKRQKSKNCIIS

SEQ ID NO: 928742 - protein, 146 aa, Homo sapiens
MCTGSILSTAGTWEGSAWSGPPLARVHPGDSCAMVQPDLVSMHSSHEFLLHETVSELSLALAPPVPSAITLHLLITVLNDFYHLSGSKIEESFTFFFNVFKMPPTKAMATHEGDIALTTCSSTDWACEAQGKNPVMDNAGNAESHP

SEQ ID NO: 928743 - protein, 144 aa, Homo sapiens
MSTRVHQKTRTIMFTAALFELALIESLGKSLELNSLGLGPRQDQGKKDKILAPWQVTQLAELGILLWERVGKFILARKSLGTQKPNQMLDNPFVQTHGESCQGHRLQIRLRHFKKDTKNLQLKQLRWGQGKGKSWCSNSHKLKR

SEQ ID NO: 928744 - protein, 155 aa, Homo sapiens
MEILFCLLLAGHYFMPFLTISTPDPASYSKVLGFSLMETEREHQKRSDAIYKERGLIGLTVPCGWGSLAIMAEGKEEQVLSYMDDSRQKDNEEDAKVETSDKPIRSLTLATFQVLSKHMWLADIQVSSPRKFFWIAVGAEFQMSFSILIWGVGIT

SEQ ID NO: 928745 - protein, 149 aa, Homo sapiens
MFGKPDTRVTCPHSQISSSQFGASSGFHNLYPRSKSSHKGTLACEWLPDCCLCGRCEQETNYSIMLTSKENGKNATFQTTSQETPAAFVIYSQTLIAVNLDRGAKSGLDGFGMRNKGLRSTTKRVCHLERGSFSSRQTFTAAAPDNICL

SEQ ID NO: 928746 - protein, 141 aa, Homo sapiens
MCWMRPHEMEIRLPDLALKRIFSFLDLFGLLQVSQVNKVAAHLKCPIWMGASDGYMIVFTSGPYLLLFSITGFLLQRFEDHQAAINNFWVDPCYVLTTSENSVHVYMWEEGGRHPYLRSCCHLENTWHDHTTDRFSEDRYQ

SEQ ID NO: 928747 - protein, 148 aa, Homo sapiens
MLADAAGAWEPANLAPPPMLHPVQAVTGGGRALVTLRASRACGQELALHAKVPGLTLVKSDPTGRLPEASEEDKEKGSPRLQSKIQAPHNARGPASIFSLASGPIANPTHEGYCFGIIVYGTPGSHCSMLCRLHLPPCRSLRGPQSTS

SEQ ID NO: 928748 - protein, 176 aa, Homo sapiens
MAPGTDPPAALEGTSYKPWQLPHSIMMSVDTWNARVKETWQLSLRFQRMYSKAWIPMRKPATVAGPPQRASPMAMLGRNVELEPPHRAATGALPTGAVEMALLPSRPQDSRTTSGLHPELGKAAGTQLQPMRAALGLYPGKPQGSSCPRPQGFTPYLSVPWVQGYDTRKEDETYLK

SEQ ID NO: 928749 - protein, 155 aa, Homo sapiens
MKQSQIPDDYLWQSEKRGRGRSAKCDKQLKDGAEMREVQGEREHIDYYVASKVSFSSDSTPKGFVTPHLLQLLCCVYTPGSPSPLDSVQETSHKVEIVTEFSWSFPSPCGLSPAPPAALPKDSCETKTEMASLRTESGYRALPAASSTPVFHLAL

SEQ ID NO: 928750 - protein, 160 aa, Homo sapiens [sequence omitted]

SEQ ID NO: 928751 - protein, 144 aa, Homo sapiens
MEIFYNAFTYANEADAVTIDGGLVFEAGLAPYSLKPIVVEIYGSKDAVPTFPEGISHELPQPLDTQGEVEGKVFPEVKKDYLGLADVQVFLLSCVPCEDMKNFPRLCQLCAGKGTDKCACSSQESYFGYAGALIIEISNLITFS

SEQ ID NO: 928752 - protein, 158 aa, Homo sapiens
MAGYSSETKLPEERSGSNICCLPISAVLQPPLLIPRQTGSGVDLQQTPTDLQLRVLTVRRKTNKQKGHPHQKPICMSPSSKTKAMEQSWTENDFDELREEGFRRSNYPELKEKVRTHGKKVKNLEKKLDKWLTRISNAEKCLKDLMELKTKARELHDK

SEQ ID NO: 928753 - protein, 307 aa, Homo sapiens
MTDQTLVNLTVCLLEFAGVHSRPYLPGYHQQRLQNSKDCCFFFLWKLQPRGAPRRCQLELCCGFVYTVRGKPPTQPSVMADAPPLTRLQCPWSTSDCRAGSENFKPVELSLLGSVGLGSAELDHLAPWLQPLSRGVNGSVLLPFQVPLGYERKLLQLAQSLFKGLPNFVVETQGPGGIGTQGNLLVCELQRPWEKPSIWAGMHGTSWHSPSGLPLARRGSSLTPCASQASLSPDNVESQHTAGNSASQKEFPLLISCGATLSGTVMLQLPNSGWCQLYLTESFINQTTDTDPGRPFPVSARAVALQH

SEQ ID NO: 928754 - protein, 141 aa, Homo sapiens
MIAPLHSSLRPCIKKQRRRRGGEGGGGGGERGGGGERGGGERGGGGEIGGGGGGGEIGGGEGGGGGIKTKAGKQKEVKKGETMRKQTQVTRPCQGSGKSGSSTLPIHSTRPCIHFDVYYLQNRSSEGTVPDLKGNAFNILT

SEQ ID NO: 928755 - protein, 256 aa, Homo sapiens
MDPRKVNKLRAFVKMCKEDPSVLHTEEMRFLREWVESMGGKVPPATQKAKSEENTKEEKPDSKKVEEDLKAEEPSSEESDLEIDKEEAAHDLALACKLDYDEDASAMLKEVQPRAQKIAEHRRKYERKREEREIKERTERVKKAQEEHERAQREEEARRQSGAQYGSFPGGFPGRMPGNFPGGMPGMGGGMPGMAGMPGLNEILSDPEVLAAMQDPEVMVAFQDVAQNPASMSKYQSNSKVMNLISKLSAKFGGQA

SEQ ID NO: 928756 - protein, 134 aa, Homo sapiens
MKVAKQALEGPLKGILGIVSTRLSPLTLTVTLILPLLMLGLALLSMTTLLSSFPDMTMNLATATGLKLDGGGEGDKEAKHTAKGVAFQIKETQSVVKYSYQKPGPYGKRGSSQAESESLIQIQTNGDTKLNLPY

SEQ ID NO: 928757 - protein, 143 aa, Homo sapiens
MQTCPKDTWLTVQFSQAVGRATELQRDYDLSLPLPWLVEKDHQTCARDLRTQAVDQSSCGHWQLMQWEDYGNSDPTGFLLCPACTWGILNPEEIAVPRPIKIMQQLGNQAIRPVTSTGDPRLTRFRWLYRPESVQEHSTKGKR

SEQ ID NO: 928758 - protein, 203 aa, Homo sapiens
MSTTTTGPWEVLPGYHQCSLTSQRLFSQLVVDFAGLGLTLQGSSLPSGPGPTVCTTGPGMGASRLCLVPYPTVAKLVFKLENKVLFTPFSSFLKQIEEASLGVTSCTAWGWGRDDTRTPLVTPAGVSLGHVPPKATGSKPIIALGLALELQSLWPRLPLKFIEDPRALYPIVVRLAETQVPTTGMGNSPLSRAHLNAPSVGMG

SEQ ID NO: 928759 - protein, 139 aa, Homo sapiens
MSFLMLRLCVDQSASGCDWSRACRLLQSHFAGKSKPGHNQNQSIKQSKSSQKQKPKCRYGHTMGDQAMLPLKWSRQIPKTNPVKQFKPSQNQNQSADKGMPCVIRPHFHLNGVGKFPRPVLSSNSNQVKTKTKIKPKCR

SEQ ID NO: 928760 - protein, 148 aa, Homo sapiens
MERALGIWTSEIWVERRKTRASLGRTLPCAANHQDCCSYSKKGWTHHTRVKKAPPPPESWAIVPGENPTKLKLKKFNSFRLFCYSFFIPRPIADHLVINITKSILPPTIAFNACLVIPCGDLPSQRQFSTSQKYFFPSRLSSDSTLVN

SEQ ID NO: 928761 - protein, 170 aa, Homo sapiens
MDEAGNHHSQQTIARTKNQTPHVLTHRWELNNENTWTQEGEHRTLGPVVGLFSHCYEEIPEVECGRAWSACCGAEWAGKSDTDALELLPSALCKMNENKPGDSQNLEQAGFKPTPSIECLHVDFPVGNKCDNCLAIPITNTYKEFQENMDFTIRNTLRLEKEESSHYIGH

SEQ ID NO: 928762 - protein, 150 aa, Homo sapiens
MRPLTEEETHVMFEKIVKYIRENLQLLLDRPDRTYCFWLHNDRVDYVSEKIVKLDANISGDKLVSLGTCFGKVTKTHKFRRASVLLLFAGLTKMKSRLSLNSLPNVESTAQLLQQLALMTLDSFYLNHILGHKEEIDKQVFDILVGSLKS

SEQ ID NO: 928763 - protein, 192 aa, Homo sapiens
MGLQASTEKCLQRVLLCDPSSGLAAVDTRTCSGGGSGGGKWTLPHNSTKSICRQPVTRAENLPQTMSLPIEKASRLRGFRHLREPIEVIQFFKGSVDSLGFPVGEKGWHVFTPSYLEPELWTSVFVTQNFLPPCNGPSTFPRQNLFLPFIQGTSRRVGPTYDSEWRKYFRLKTIHSMHFLEQIDLIVNIRLT

SEQ ID NO: 928764 - protein, 305 aa, Homo sapiens
MGQVWALVHSTLEPFHPNDEEEGKYNELTEDMTEQVCLPAKAKAAKEEEVPPYPSAPPHYFEEKEGHWVKSSCPSDRAVPRVTALSSIQAGIQQARREDGSSNGKASYSGSKGKVFQTPYTSAQKAELVAIIEVLTAFDIPINVISDSSYVVHSTQLIENAQLRFHTDEQLMTLFTQLQTAIRSRMHPFYITHIRAHTPLPGPLTPGNQMADRLVATAISNARHFHNLTHVNASGLKRRYSITWTEAKAIIHHVETDAEGDPNCHEQHPSNAATYLGTDQEAVTDGRRKPKESGTTSHNESAFSP

SEQ ID NO: 928765 - protein, 140 aa, Homo sapiens
MAQATYPLSALLSSVANGSVNRPHCLGFFYGNTLFEEPKKQCQAGVRTSSDFFEEESPFLHSQAMSEWIKKNRVPFYEILSAKLMELALPGPLESASSESEGEGTRMGQSIEIHRPDTGRAENGSGGQMEDIPKAKPVSS

SEQ ID NO: 928766 - protein, 174 aa, Homo sapiens
MDSETDMVQQIRALDSDMQTLVYENYDKLPSAKCISVSGIGGFLVSLTSRMKPQTLLMYSKLIPSGGVRGLAGSGVKPQTFTCGATKPTPTRNSSRQASSTHSPGSSSHLSLHTSLQAEGASSDLGQPRKGLPPCTRGLKGSSSAAKVGAQTEEVPRVSEGCEGCQHAVTSHKE

SEQ ID NO: 928767 - protein, 135 aa, Homo sapiens
MQLTCGNMSQNCSWISYKRLPHFNRTIQMGNSTLSILSRSIHLRRFYLVLSFVFLISQLSQLSLQLSFICGRCEVLLDMISSLSYKRERRCWLSMEEQVNCDQADLEQDFGKVQSLTLTSGSIPVPNVHGNEFTL

SEQ ID NO: 928768 - protein, 140 aa, Homo sapiens
MVEGKGGVSLLIWLEKEEDSKSPLAKAGYSLPVELIPSPRVVRGQECVLVHSCSVQDSQLPIPSAQLLFLPSIHFQCLASEDLLGVSPSSRSLSGSCSTWSTNRVVIKKPKLLSQTSFVNSSKLLTSLYLYFSMHEMGFQ

SEQ ID NO: 928769 - protein, 143 aa, Homo sapiens
MPLYLLVPLHLLLGVKSAGLTIKKERCIRNGYSKEKMKLIVVSHGLHVNDLQHKLTLFTKETYTYLARDSEKQKQGYLAGLEGAHANRVNQQISDNLGNYLIMYGCLLNQTESKEFFLFTTVYQKHIAVEKVQQKDKRRKDFT

SEQ ID NO: 928770 - protein, 130 aa, Homo sapiens
MHVTAFRAWVTSTLNSGEFSLRSREKEDSSQEGFPGPITERMRRQRSRSGTQLRWHFYGNTLFEEPMKQCQAGVRTSSDFFEEESPFLHSQAMSEWIKKNRVPFYEILSAYGYPRCLQMLSNAVGQGSGT

SEQ ID NO: 928771 - protein, 331 aa, Homo sapiens
MLKLYNGLSEGEAVRLLAGTDPLDPTDLNGAHFNPEVYLDKLPRECPLAQLMDSETDMVQQIRALDSDMQTLVYENYDKFIPATEIDKQHKTTSQCQVCKCVQNWWVLGLTDFKNEAADPPGVKLQTFSVLQLIKAVWTQRVSSNKIYCKEQKNKASTLDIKVLQVPSRLRSTAGFTQWIPHRSCRWSCRPVPLRVPTLFIPWVVDGTGCHGAGGGARRGGSGRTGAHGGGRLRNGGLQCGAAKPTPTRNSSRQTSSAHSPGSGSRLSLHTSLRAEGASSDLGQPRKGLPPCSCGLKGSSSAAKVGAQVEEASRANEGCEGCQHAVTSHKE

SEQ ID NO: 928772 - protein, 344 aa, Homo sapiens
MSSSPNLDVSNEITEGVYTPCDIGSNMILSPPGLPTWILGKISQRGYTFPTLLGVISFFSFLDIRKNITGVLHDYFDIGSNIILYFPGYWAQKHKRVYNPFDIGSNSILSFQDPELQPVLALLSLSLSMYLVTVLRNLLSIPAVSSDSHLHTPTYFFLSILCWADIGFTSATVPKMIVDMQWYSRVISHAGCLTQMSFLVLFACIEGMLLTVMAYDCFVGIYRPLHYPVIVNPHLCVFFVLVSFFLSLLDSQLHSWIVLQFTIIKNVEISNFVCDPSQLLKLASYDSVINSIFIYFDSTMFGFLPISGILSSYYKIVPSILRMSSSDGKYKTFSTYGSHLAFVC

SEQ ID NO: 928773 - protein, 158 aa, Homo sapiens
MGVTTAYITDTTTPFLGLGIQQAKEKGHQNKEDTEMRIHDDWVVQRAIDAYKAVIGHYSQEHAFYTCKKDQERLLCQAARMRDDSAIPLHVHNHLGNRGRGETDVSPAQDGEEEVRGGVEVGVRADSRDAEQVPQHCDQIHGQGQGQQSEDRLQFWIL

SEQ ID NO: 928774 - protein, 422 aa, Homo sapiens
MRVSAKQAFCLSRTCTVGGHKVIHQFWYMPDCPLTFLGRNLLSKLRATMSLTKHGSLLLKLPGTGVIMTLTVDDLLLGHPTAVGCATGTDAPHRHLEDCGYKVSKKKAQICQQQEALECGSQQQQLFHELKEKLLAAPALGLPDLTKPFPLYASEREKMALAATALLVQEANKLTFGQNLNIKASRAVVTLMNTKGHHWLTDARLIKYQTLLCENPRITIEVCNTLHPATLLPVSESTVEPDCVEVLDSVDFSRPDLWDQPWASGDWELYVYGSRFFNPQGEREVQEAQKAASAPFRASVLPQAPDLGPTSSKEEKDFLQVDFREMPKCGGNKYVLVLGRTYSGWVEAYPTRTEKTREVTPVLLRDLIRRFRPPLWIGSDNGPAFLAALVQKTAKISETISQGCVNNPCDIWSNIIVSPHEY

SEQ ID NO: 928775 - protein, 334 aa, Homo sapiens
MRSCKYPGPQLTPGSRWNTQAPGEHQAPGRCWTPVDIRPQVNTHDSGEQKAPGEHQTLGGYQTPGGNQALGGHLSSGPKVDTLSPGAIRLKANARTLVDNRPQVNIRLQTQGPMFIPSLQMYVRPQVDTRPKVYTSPEVDIRSQPSMDLSKHDKSQRHDSSSPAEDRAPIPTASAAWPEPPCASSTGQPIQYARSTCEAGVGELHIQDALPEDHGTYTCLAENALGQVSCSARVTVRGKPDPTITLSLRPRLLCMTGSSGASTECSVTGLPSDKQEDTSLHSLGLRPVRNISLSRSSPLLPLVWHQAMVGSMDVEPAAWVFLLCEMEMLTVTVL

SEQ ID NO: 928776 - protein, 223 aa, Homo sapiens
MGRNQCKKAENTKNQNASSPPKDHNFSPAREQNWMENEFDKLTEVGFRRWVITNSSELKDHVLTQCKEAKNLEKRLDELLTRITSLEKNISDLMELKNTAQELPEAYTSVNSRINQVEERISEIEDQLNEIKLPTKGSPSDQQWISLQEPYKPEESGGQCSTFLKNFQPRISYPAKLSFINVEEIKFFTDKQMLRDFVTTRPALQELLKGALNMVRNNRYQSL

SEQ ID NO: 928777 - protein, 136 aa, Homo sapiens
MERYHVASCEKESALAAVQQFGDLWYLSEVNDGMTLEGKGKILHRQQAVPTVDPHWDSDSDHGNWSHRHLLTCILEGLRKTRKKPMNYSILSTITQGKEENPSTFLERLRKALRKHTSLTPDSVEGQLILKDKFIT

SEQ ID NO: 928778 - protein, 207 aa, Homo sapiens
MASPSGSSEATGKPRGRDGGPRREEDDVPPEEKRLRLLLERGSAQPEDCEDGEDAPRPGRKKTGTQTGGDGRGVSDVGAGVRGCQGRGVGAAGGSVAGPGLKLVIERQLRRARSDSSLAAPRKEGIWIFKLKIWPKAHCCPQWPPDTFLFPFSFYGNTLFEEPMKQCQAGVRTSSDFFEEESPFLHSQAMSEWIKKNRVPFYEILSA

SEQ ID NO: 928779 - protein, 218 aa, Homo sapiens
MSPQLLSLYGLCLGKALEGFEQASAGSKPSSSCVEERLRGWKRGDQLRSYGKSRWEIMAASTSILAVGRRKVAGFRMYFGDTSSTATHIDDHQKYLQTLPDVPGCGGEWYTKSPQENRPIMKSLTLPALSLPMKLVSLEEAQARSLATNHPARKERRENSLPEIVPPMGTLFHTVLELPDNKSDFSSNPFQSVKVFTSPLFACGCPSSVAVVQEPNRT

SEQ ID NO: 928780 - protein, 136 aa, Homo sapiens
MNHPFPWGKCPQDVTESASPRIDPSVILGPPDKIFMEDILLICVNAAPVAQRRFSEKDCWCQPLKLKHKKGGRQVHRTSKKCPRASGWSNYHVDGNSSCIIHCADFLVNLYYNLSWSYLFIPIHNGAFSDEVVYEH

SEQ ID NO: 928781 - protein, 153 aa, Homo sapiens
MSMDKDIEDDGIGNGRRRCMRGWILEAEPTGLGNGMWAEGGCVVWMELRSLSFHWAKSDADADSTTPNVELICRMSPSGSDLKCVVTNGQMGGGCEGIFWAAELCTVKELQAPYQKTQGRGPSFPPSSVVKEDCEVRESWPGSQETPDLETWK

SEQ ID NO: 928782 - protein, 148 aa, Homo sapiens
MRAHLIFCSYEEGANPKPRWPPKGVGPVGAQKTRVEAWKPSPRFQRMYGNAWTSRQKSAAEAEPSWRTSTRTVQRRNVRLETPHRDPTGALPSGAVRREPPSYRPQNSRSSVEATGTQCQLMKATKGAIPFRATEVELPKSLGAHPLH

SEQ ID NO: 928783 - protein, 152 aa, Homo sapiens
MKSFSFCLSGKVFIFPSCLKDIFARYTILGFQRMYGNAWKSRKQFAAGMGPSWRTFARAMQKGNVGSEPPHRVPTGALPSGAVRRGPPSSRPQNARSTNTLHCAPGKATDIQCQPVKAAGKEAIPWKATRAELSKTMGTHLLHQCDPDPVEL

SEQ ID NO: 928784 - protein, 143 aa, Homo sapiens
MGARLASPTLWELDEDFHYELIPTPLANSTAQQKQPYSPLEHNPIGLRSTPPIPQQAMAGLAQGESELRPAQPCPDLMNTSPRQLRPSSNVTATTTAGALLQVSPPGWKPANSGHYSNSWQNNASSRKEKTTANTTHCNTLAN

SEQ ID NO: 928785 - protein, 138 aa, Homo sapiens
MLGYFKNRMPFLILRDRTPINCFTCQHTCNKIFPKKTGFPNPKLLTISLAMGSSFSLRLTLMDSCACPGYWPGTSQDFYQFALLEASNPGASELERWQGSDYTISKSRICVVNTLWNGQICFGWADREPTSVNMQRLK

SEQ ID NO: 928786 - protein, 143 aa, Homo sapiens
MNFMNLFQVDLSSDVAWDPDYGDSGSTRWPPSSRQEVTSFLLIDENCHVAPPITREPRSSHFPVAKGRGKLASVSNINDNHDFQHCHTCVICGHPEELQDLVWLHSAGILVLGIFSGSYPKYKFPTCLQLSDIFKTLTPIKIT

SEQ ID NO: 928787 - protein, 145 aa, Homo sapiens
MQALGLSTLGSVHRSLKCYIFFGEMPVQDVAGGTDISEKMGASKDISEPMRGLVGAVKKEKPNDALATEMLSHAQIQGKHHFSNLSDDSPGPTGPEIVRVMMGQKKVQGTKMVGKDSMDERVVLEQKGETDLGALGCLRIENKKL

SEQ ID NO: 928788 - protein, 146 aa, Homo sapiens
MKGVIGCVIGREKQASSPPLSAPNSGERGMDASQQANSSRASHPVTSYYICKCIFHSWYPPPDTLALPTSFYFQCKVSFWWLLLFKKKKSKKKGSFMLLSACERETFYLCFIMGPSKFGQDGTLNVMASCCVSISLKKREPACACT

SEQ ID NO: 928789 - protein, 156 aa, Homo sapiens
MVFSTIQDVQTLSGLLVENVDDDDDAGFAKIVVSPLAHQCQAYPAESNRSRGLSPGLGPKRRYRELRERLLLREVFSADSSSSASMSPGAPPIQGGAKLADVPAWPQRDRAPSRLLESLIPELNSWMAYLDLLWAKGEPTALKGESQPRQHLPQLT

SEQ ID NO: 928790 - protein, 154 aa, Homo sapiens
MCQVINDPVSFVQCTFVAKLLASVPFLQEQFGHSQHLGCLLGPAGAVHFPQRVCGSSRDSRNKLSPKHSSLKLQTQSHTASGNGLAGWFCLGVSKRSQSNCQLGLLSLKTTWGWRVHYTWTWLLAVGFISSAYSLFYRLMMWLTSRVSDARHTQ

SEQ ID NO: 928791 - protein, 185 aa, Homo sapiens
MGPARNLNPYPRLRGGMARAACTSMEQVGDSPSQAQDLGIRTVHPREPDLRVGLEPKLGIVTAQQGELNTYRNTLAAERRYSLQVSSELFYHSIKLLFILLILHLSTYFILPGHRTRTQDPPNAVEAACMHAWSSCSLAESPHPCQHLELPTPLQQLVQLIQEEEITRAHEYQVAIFEETVLEVC

SEQ ID NO: 928792 - protein, 143 aa, Homo sapiens
MKSASYVSPLDYGSHHALLILFSLVPEPRCLRAAKLLGAMLLKHQRIPWGSWSNADAGSVDADQGIISWQEASCAESGSIPTSYFSCKMGNSNTIFWTPVPTSPAAFHPVPPKLEDFWAPQTAARDFWKVSQSYDCIFRKHRL

SEQ ID NO: 928793 - protein, 203 aa, Homo sapiens
MDPIKHQRGGVNLQLIGTSFSPSTSEDLEDNCSGKEKIEEAILKISGPGRWGPVLAFGVSSEYLGLPELGNGPLGSVVFLVCLGLDEKPVSVPVQPTARMEWTSFPSNMTLKVWMHIGKGMEVIQEMEENVYVDSVRIQLEDTQLVSAAEVIACFVVERNPQEMQKSSVLIVVFYEPCLNALIGNIRVCCMLLRASHSKILEA

SEQ ID NO: 928794 - protein, 141 aa, Homo sapiens
MGYLIDILIFIGFLCHEQRDLDETPGISVTDFGSLTSNVLPQLLIAQLPWARSLKSPPKQLPTQFWLEISFSLSLAPLQLVSTVFLIAYEELSLKFDICIPIGIFVCRLIKPNQWREEGPRLFQFGHSWGFVIAAVELSEC

SEQ ID NO: 928795 - protein, 245 aa, Homo sapiens
MVSALKSYWEQCLKVVLGMGSFLNQGNMGQNWSVEEKHYVQLLKVLLKQTGAQAESKNLKESVVPPTAPIENKKQEREDKNWPIPPPPVAETSVPPPSVAETETPIQRILRSAAMAGEPLGPRAFPISIPHTLAAEMLTFTLAFENANADYERALAPVRCTKNLGNFLRACQDVRTELHCSSMLAEVIANLVVDKSKRSQGEVKRALVKWNLKIAPEKVQTTSPYQYLGSIVNGEECTASESSSL

SEQ ID NO: 928796 - protein, 140 aa, Homo sapiens
MVNTVAHTHFPKRKPGLRGGEVVAQSHELGKVELDFEFKVKERGPIVGKHPPLPFLSSQALLKPLIGVCGFKCSLTSGHSSRLRCPQGRKEEDCPGVFFCRGGTWSTEVCDSPVSGDSLGCWGCLVQPRRMETPSLTKIL

SEQ ID NO: 928797 - protein, 134 aa, Homo sapiens [sequence omitted]

SEQ ID NO: 928798 - protein, 281 aa, Homo sapiens
MSGAATGSWQISATYSRLVEHSGFLAWPQESQAVHKHSLFLHPLIPVTLPFPLPSQMPIEKLQGKVYVTGMEEFLWKRCVRKCRKKETSGNDSYFELRIAPGDVETVLEEGKNGGEPLGGGLAMLSPEYSRGLFQEKHNFCPQALGSPERTGPASEVEGPGSAPKPWALLRGQDQPLKLKVLVYQIGKGPFPRPFPEGVAEMGTVDSVQIVNEICRKFRTFHLYSGYCETLPRCPLQANASLHAPTPIDGNRGAGTQIYSPFWELELPAQAMPPSQGWLSQ

SEQ ID NO: 928799 - protein, 142 aa, Homo sapiens
MPQGQIPQSTISAAAGCCEAEVPTLTAMTTTAGTHPHVPPAGLGTGPLSQSHLNMDQEHLGPRGLSHHCYCHNPHFLLPRGPKNLPNHPNYCCHSWHPSKAPGGPRINPSGLTNTSTAAANNGAKGLAMAFQSPAKLHHNLH

SEQ ID NO: 928800 - protein, 135 aa, Homo sapiens
MNPGKTGSFSSWQQHFLGPECVQKHCPGARAKNRRLTTLPSALAYCGLAGNQDTRQSFIYSSLSSYGRKKSFGALLISSERCVAFPSTGALGGHSRFIIWFNFNIFVSQGIRRTGGEIGKGRVGGAVRTHTTFIG

SEQ ID NO: 928801 - protein, 156 aa, Homo sapiens
MACRNLSVPVGVLLRGCVPLNFQPLVSSTIGVFLLMSSCLCVTKKPVVSTIPVAFGCSQNNVEKLVWAQGSFKPLLSSLDYLGGKMSVLTGEQGRRMNAWIPVLAHTSDSDRVEERTNRRSSRALTWNSLFHEDVSSCQCSPGAGLPSIRPRQVLF

SEQ ID NO: 928802 - protein, 236 aa, Homo sapiens [sequence omitted]

SEQ ID NO: 928803 - protein, 134 aa, Homo sapiens
MSFAAIWMELVTNILSEDKGLNENMFKVLLLAMAEAQRRENRPKENGLTMRQAWKGRRGNGKDQEVFAQQADQDGPLANFSHPFQTHLPTHMHSSFPYREPYCMAKPITGQLLVASNSSKEHGIFESRNSTSPG

SEQ ID NO: 928804 - protein, 147 aa, Homo sapiens
MVMSSVQPEDLTMLNIHVPNTGAPRFIKHVLSDLQRDLDSHTIIVEDFNTTTLTILDRSLRKKINKDIQNLNSTLDQMYLIDIYRTLYPKTTQYTFFSAPYDTHTQKQYFVSFNPIKLTFNINHHSSVKAEMYITKPPHQKIRKISN

SEQ ID NO: 928805 - protein, 192 aa, Homo sapiens
MKMLASSDPPAVACQNTESFAGRLTAGSRSFAGRLIAGSRSFAGRLIAGSRSFAGRLIAGSRSFAGRLIAGSRSFAGRLIAGSRSFAGRLIAGSRSFAGRLIAGSRSFAGRLIAGSRSFAGRLIAGSRSFAGRLIAGSRSFAGRLIAGSRSFTGRLIAGSLELIEERTIKLGPLMLSEVLMANCLSSFQCES

SEQ ID NO: 928806 - protein, 154 aa, Homo sapiens
MVNEEDFIADESHSQREGERDGAGFGEHGLWLPVAAVERASSHGVCRYVVALLLGSLGSLPVTPVLVPGSSSSSCYGYGWGEPVLKVCASLLLAGRGHRQRHMFWPPLVAATVAAARMKVLDPYWPSLPPPHWKDWDVVSCSHFVVTFDLSSSS

SEQ ID NO: 928807 - protein, 185 aa, Homo sapiens
MDTGKTSIQAPLLLLAWLCLIIFTEVPANSGPFKHSLLIHVMVVWREGPEFIILMKLDISLFCSLASVGLPRSCENSSKALISSCSCYPLWVAVLNVHHSSEIPVTTTLLSADDLACNCVESIEVLRQKLFSLPHHPGKVYWFQKNIFEILLDHGSKQKDDQSQGAAKSQIAIILLSVTVYDFKN

SEQ ID NO: 928808 - protein, 138 aa, Homo sapiens
MVRRWGPVKIQGMESQQIFLRMLQLNCYYYLHCYEIIILLPYTNFQNILATFRDYTCFVETKECYVCVWVSAVCHRGIMSPDGKGGYEKQACGNLQKFWRALSEHSRYQHSRTHLCPWISQSGSGWWEETRGKSCVLL

SEQ ID NO: 928809 - protein, 206 aa, Homo sapiens [sequence omitted]

SEQ ID NO: 928810 - protein, 256 aa, Homo sapiens
MSSPSLSPGDPADHTAQLMWTVLPQGFRDSSHLFGQALAQDLGHFSSSGTLVLQYVDDLHLATSSEASCQQATLDLFNFLANQGALNKEQIQPILGYPYPKTLKQLQGFLGITGFCRLWIPGYSEKARPLYTLIKETQMADTYLVEWEPEAETVFKTLKQALVQAPALSLPTRQNLSLYVTERESRFVENGTQRAGYAIVSDVTVLENSVAPTFPGPLQPWPPLFNSAKDPRHFARAPLTSIRGPPLQTKAINYLG

SEQ ID NO: 928811 - protein, 152 aa, Homo sapiens
MKPLKSKLGKLCKSNSLCSSTNYIHASKNDIPVMYSIDLTEQKIILEIPSRLQPNTKGTQLPHGFSEKEQRADIPPHPFPSKIGGGTQTSGIGKKNKELTFHPHLGGAGSIPDHGNKAGRLIGAAVAEHSLSSGKAALHEIEHAKGLAGVMN

SEQ ID NO: 928812 - protein, 351 aa, Homo sapiens
MVNSSWGVGDLIHNRLPDEYLRGKDRQRALIAAVRHHLKKVNYQKFDTLLAAFRHYDKASNGGELFGNAWAYRSQQFGVDQGSANYSLWAKSSPLFVCVNKDELQEACDQANLSLDDKLLDQLFDYCDVDNDGFINYLEFANFLNWKDKMLLKEYEERVIIKGRKPDCVNPTEANVEEPEQTLLIKPEDIVLKEAGSTEKTLRTLLRPSDKVSNYYKTTSSEINAIVGAIPSTCYPICGVPTIRSDIPAPRIRRISDRTNYGEEGSAYSLLYPTIFARKGVFERDFFKTRSKEEIAEILCNIGVKLSDEEFENVWNLASKKHHRGEVCVENIRNVLDELRHADRIKCKTLM

SEQ ID NO: 928813 - protein, 135 aa, Homo sapiens
MVYNHIIGKQQQFDFLFTGNDDVDDDNDNDDDDYYYYYYLRQDLTLSLRPEYRGDQHQKPKVDKSTKMRKNQRKKAENSKNQNASSLPKDNISSPAREQNWMESDFDKLTALGFRGGITSLEKNINDLMELQNTA

SEQ ID NO: 928814 - protein, 135 aa, Homo sapiens
MLQLYLLLSRLNPCAPTATECMHTCGPTGQGFCYNPVCAHEPGKPNPCMSLELMSPDTDPDLEPLCTLPSWHSHSYPWEEVFPYLGQSLKFGRASGNRYSTLHLQVSEHGPWTSIISIIWELVRNVEYEALLQNF

SEQ ID NO: 928815 - protein, 167 aa, Homo sapiens
MSPGEIKRRVQVLSLDQYNIGKSLPHVTRLWQNNQGFKTGKTEASLLGSLLAKLQTNFAIQKGWMHKASPSLSWVKLGAWESPSHYMALHWGHGLWQFQCPNLSTDFSESGFIFFWDAGASQLVSDVLQRKYAYELCLNQYVRGRSVQGFPFHHLADIISPQNFLCF

SEQ ID NO: 928816 - protein, 137 aa, Homo sapiens
MLNHGDDNGHPFHFPDLRKGRSTDSLHCAPGKAVGTQSQPVKKAMGPVPCRVTGVDLPKALGAYPLNQHALVVEAIKVVAFNVWTNSFQEGLVELASWGELGGKAWEVPICISAASRLFAPLTLQCDEAPRCTCMPT

SEQ ID NO: 928817 - protein, 144 aa, Homo sapiens
MDNEVQAKLVSDGDEELVRNWNKGYFYYALPKRLAAFCPCPVELWNVELQRDDLRVPSGALPSGALRRGPLSFRPQNGRYDNSLHCAPGKATDTQCQLMKATGREAVLCKATGVKLPKPVEAHLLHQCDLEIAPATLTFSSYSP

SEQ ID NO: 928818 - protein, 143 aa, Homo sapiens
MSCIYQYSLIQNDFASGIGSFRWVLGLADFKNEVTDPHIQMCPVFLPSGAFVVSLTLRVKLQTFRSVLQLMKAAPQLFVPPGGFMASLASGVKLQTFPVSVTAHKRGADPKSEQQQDSLLRVKKQSFYSAEGDPTDILRATNH

SEQ ID NO: 928819 - protein, 715 aa, Homo sapiens
MEWNALEWNGVEMNGIEWNGIEWNRKEENGMERNGKNGMDCNGKISNGMEWNKMDSNRMDWNGMDSKGMDSNGLDWNGMDSKGMDSNGMEWNKMEWNGLESKRTECNGMEWNALEWNGVESNGIEWNGIEWNGIEWNRKEENGIQIEWKRMKWNGMERKNGMESDGTQWNGMDSNSIELNGLAMNGVEWNGMDSNRLYLNGRESNGMASNGMEWNGLKLQWNGTEWNGPEWNGTEWNGEEWNGMEWKGIDQNGMEQNGMEWKGMECNGMEWNRMEWNGKEWNGMEWNGMEWNGLKWNGIEWNGMYWNGMEWSRMERNALEWKAMQWNALNRNRMEWNGMEGTRMKWNGMDSNGMEWTQMEWNGMEWNELKWIGIEWTRLELNGKEWNRMEWNAMEWNGHEWNGMEWTKERKRMEWIQNGMEWNGFRMECNGMEWSGVDWSGMEWNGIEWSGVEWNGMKYNGVKWSGVEWNGMEWSGKDLSGVEWNGAESNGMEWNVMECNGMETNGIKWNLIEFETTRIKLNRMQWNGVEWNRMECNGKDLERMEWNGMEWNGFRKMEWNGMEWNGFRKTEWNGMEWSGVEWNVMEWNRMESNRIEWNRVEWNRMESNEKMDSNGIESNGIKWHQWNRMECGEEEWSAVEWSGMEWGGMEFNGVEWSGMESNRTEWEGMELTGVEWSGVEWNAMEWNGMHWNRMEWNGMEWNGMEWNGMEWGNEI

SEQ ID NO: 928820 - protein, 145 aa, Homo sapiens
MVEWISRFRPTHRCWEGPEDIPLTNALQNRFARAAPASLKIPVIALFFMSDLTVGTTVPQLQNLNTMRIIGSQGGRGQVAALNCQRQGDLQPFTRVTVHWEKGNDQTFWRLLDTGSELTLIPGYPKCHCGLPVKVSLQTAYCGTL

SEQ ID NO: 928821 - protein, 168 aa, Homo sapiens
MLLPFIHLKGEIEVLVCWAAGPDLSLAVELEKTPQFLFEIIQLDDVSLGFNYKSWCPEPIFGKTEKYEGFFLRTFPASFFSTFYLDPPPTSPRLVSSFTSSTCEQQRLRNILSLSTLKSLQMELILESRKNPAHKPDLGPKPQSSVTQIGPHPSRTDSIMLSQGEKSL

SEQ ID NO: 928822 - protein, 162 aa, Homo sapiens
MLLPFIHLKGEIEVLVCWAAGPDLSLAVELEKTPQFLFEIIQLDDVSLGFNYKSWCPEPIFGKTEKYEGFFLRTFPASFFSTFYLDPPPTSPRLVSSFTSSTCEQQRLRNILSLSMELILESRKNPAHKPDLGPKPQSSVTQIGPHPSRTDSIMLSQGEKSL

SEQ ID NO: 928823 - protein, 140 aa, Homo sapiens [sequence omitted]

SEQ ID NO: 928824 - protein, 160 aa, Homo sapiens
MGNGASRTPRVLCSWSYPTGGFAPPEEALSQPQAPRGPPHPGKIREDRDTQHDRLLGPCMVGQPGPTQVGPQGQGVLAPPTSQGSPWWGWGRGPQVAGVAWEPQAGAAPPRQPVPPEACARQGQMKGIPAPSQELQKPGRSSALPSGLLLDDLLVSPEFL

SEQ ID NO: 928825 - protein, 120 aa, Homo sapiens
MGTLQCGRFGNWQGERRHHLGLPPFPACFRVPAELWEQTVTGPCLRSVYEGIVTYLCTDHSCDVTVFKLRLKGNCDRYLHCSPRGFVTYLCSDQPREETLDCTLHRGDFTTYHCVDYKVM

SEQ ID NO: 928826 - protein, 202 aa, Homo sapiens
MAAWEPQAGAAQPRQPALPETSMRQVQMKGIPAPSQALQVSGRSSALPFGLLLDELLSTPEFLQQAQPFLETEAPGELEALEEGASLEAPLNEEEYRALLEEISDAGFGQDRVVAERWPLFRGEHLAGYGGACLPPAPSTGLTGLGFLPYSSRPGEKLHTMENCHSFLGILGMAEPAQACAHCAPQLMCKGASWPLSALVRP

SEQ ID NO: 928827 - protein, 146 aa, Homo sapiens
MERLMVERRHLALFAGLLARPALIAHPGQNLDKSPITWVISAELCQNAAFWQSLDNGYITWVISAGIHILDKSDNSWVTSEEICPNVSSSQSLDKSYITWMIRQRYVTMPPVSISQTRVASPRWSVQRYVSMSPVGEAYTRVTSSR

SEQ ID NO: 928828 - protein, 699 aa, Homo sapiens
MPPRRDVLTMDSSALPTGGIVKYFCTNNPESNGIIIEWTKMESTSNGIKRNYRMQSKRIIEWPRMESSNGMEWNNPWTRMQSSSNRIEWNHRMDSNGIIIEWNRMESSSNRNEWNHHRMEMKGRIIEWTRMESSNEIEWNNPWTRMQSSSNGIEWNRKRMELSSKGIEWNHQMESDGIIIKWNRIELWNEIQCGHHRMDSNGIIIQWKLMESTSNGIEWKHHRIETNGIIMKLKWMDSSSNGFAWNHRMKLIEIIIIWNRMESLNGIEWNHHQMEMNGIIREWNRMDSLKGIRWNHRMDLNGIIEWTRMESLFNGIEWNHRMVSNGIIIKWNRMESPNRIEWNNHRMNSNGIILKRNRMELSNAIEWNYRMQSNRIIEWTRMESSKGMEWNKSNGIIIEWTKMESTSIGIKRNYRMESKRIIEWPRMESSNGMEWNNPWTRVQSLSNRIEWNNRMDSNGIIIERNQMKSSSNGNEWNHHLMESHGVIIKWNRMESSNGLECNKHRTELNGNIIGGKRMQLSWNGIEWYHQMESDRIIIKWNRIELWNEIQCDHHRMDSNGIIIQWKLMESTSNGIEWKHHRIETNGIIMKLKWMDSSWNGFEWNHRMKFIEIIIKWNRMESLNGIEWNQHQMEMNGIIREWNRMDSLNGIRWNHRMDLNGIIERTRMESLLNGIEWNHRMVSNGIIINGIEWNHRIESN

SEQ ID NO: 928829 - protein, 278 aa, Homo sapiens
MDSNAIIIKWNRMESSNGLEWNKHSTESNGIVTGWKRMESSSNGIEWNHQMESDGIIIKWNRIELWNEIQCDHHRIYSNRISIQWKLMESTSNGIEWKQYRIEKNGIIMKWKWIDSSSNGFEWNHRMKLIEIFIKWNQMESLNGIEWNHRQMEMNGIITEWNRMDSLKGIRCNHRMELNGIIEWTRMESLLNGIERNHRMVPNGDIIKWNRMESPNRIEWNNHRMDSNGIILKWNRMELSNAIEWNYRMQSNRIIKWTRMESSNGKEWNSQELEWSRH

SEQ ID NO: 928830 - protein, 159 aa, Homo sapiens
MESKRIFEWTRMESSNEIEWNNPWTRMQSSTNGIEWNRRMDSNGIIIKWNQIELWNEIQCDHHRMDSNGIIIQWKLMESTSNGIEWKRHRIETNGIIMKLKWMDSSSNGFEWNHRMKLIEIIIKWNRMESLNGIEWNHHQMEMNGIIIEWNRMDSLNGI

SEQ ID NO: 928831 - protein, 170 aa, Homo sapiens [sequence omitted]

SEQ ID NO: 928832 - protein, 140 aa, Homo sapiens
MESKRIIEWPRMESSNGMEWNNPWTRMQSSSNRIEWNHRMDSNGIIIERNRMESSSGIEWNHDQMESNVIIIKWNPKSPSSIGTEWNCHQMEFKGIIIKWNRMESSLNGNERSHHLKESHGIIIKWNRMESSSNGIEWNH

SEQ ID NO: 928833 - protein, 144 aa, Homo sapiens
MFKSAEAAPTATPSPGALSQGDGSFIYKPLTGAAAFLSEIPCPERRNLERQSGYSGFAELQCAPSSSNFLGALFTLYEREAGESTSELYDVRKTHQPLVALRVEEEATSQGMWAASRIWKSQGNGFTPEPPDRNMALLHLDFSF

SEQ ID NO: 928834 - protein, 190 aa, Homo sapiens
MGLLLVLHSSLQMAGLLPGAWISVAASSPKWAPAGSLDKQHYICTMTKWDKLQPNGAKSKSIGGWSGFQSAPGPTFGKPATRNNQDLAKQDSVGRWVWLAVNPGNFGFIGLQEISINSQDRAGYVHIRGATQPCAHFSAATSLSLSRMHFPYSVCLSHIQAPHRYSILKRLFYMYKVKIHLSLSSFPVEL

SEQ ID NO: 928835 - protein, 398 aa, Homo sapiens
MGLQLQGPQTGTSAPPPDLQLHGPQTGTSAPRRVSRCTACKLEHELPAGSPAAWPSNWNISSPPDRQLHDPQTGISAPPRGSKVHSPQLATSAPHRVSSCTALKQEHLLPTGSPAARLSNRNISSPQGLQLHGPQPATLAPHQVSRCTALKLQHQFPPGLQLHRVNLEHQLPAGSPAPRPSNCNTGSSPGLQMHGPQTGTSTPHRVYSCMALNWNISSPPRSPDARPSNWNISSPPGLQLHGPQTGTSASRRVSRCTALKLEHQLPARSPGARASNWNISSLPGHQLHGPQTGTSPPRQVSSCMALKLQHQLPSESPAAWPSNWNISSPAGLQLHRPQTWTSAPRRVINCTALKLEHQLHPWVSSSTALQLDHQLPPGSPAAQPYNRNISYLTGLQLR

SEQ ID NO: 928836 - protein, 642 aa, Homo sapiens
MGLQLQGPQTGTSAPHQISSCMDLKLEHQQPAGSPAALPANWNMSSLPGLQLLGPQTGASAPHQISRCMALKLEYQFHPGAPGAQPSTCNISSPLGLQMHGPQTGTSAPCRVSRCTACKLEHQLPSGLQLHGPQTGISAPPRGSSFTALKLEHQLPNQVSSSTALNLQHQLPTRSPDARPSNWNIGSPQGLQLHGLKLEHQLPGPQTGTSAPRPSNRNISSPQAAPLQTATSAPRWVSSSMALNLEHQLPRTRVSSSTALNLEHQLPPTRVSSSTALKLEHQLPAGYPVARPSNWNISSPPGLQLHGPHTGTSAPHQISSCTALKQEHQLPTGSPAARPSNCNIGSPLGLQLHRVNLELQLPPGSPAPWPSTCNTGSPPGLQMHSPQTGTSTPHRVYSCMALNWNISSLPRSPHAQPSNWNISSPPGLQEHGPQTGTSAPCQVTSCMALKLGHHLPTRSPAAWPSNCNISSHQSLQLHGHQTGTSAPPWVSSCTDLKLEHQLPAGSSTAWPSNWNISSTPGSPAAQPYNRNISSLPGLQLHSPTTRTSAPCRVSSCTAVNISSSPSPQLHDPQVRTSASPQVFSCVTLNLEHQFFSGVCSCKTLKLHQLLSSSAAARPSNYNISFPPGLQFHDPKSRTSAPS

SEQ ID NO: 928837 - protein, 152 aa, Homo sapiens
MSYKCWAVRKGNVGSEPPRRVPPGAPPSGAVRRGPPSSRPQNGRSTYSLHCAPGKAADTQCQPMKAARRETVPFKATGAELPKTMGTHRLHLCDLDVRPGIKGDHFGALKFDCPIGFQTFMGLEESRSRDETVIENRPLIPDLSAELKDFLH

SEQ ID NO: 928838 - protein, 140 aa, Homo sapiens
MSKELILSIPLKGFKIPNRRVKHDGHFTVIQLVGMLRGIASGMKYLSDMGYVHRDLAARNILVNSNLVCKVSDFGLSRVLEDDPEAAYTTTKYQKAEAEEGVTKSQNVNQILGEFITLTVGGKVVQMEKKKEKRHGNAKK

SEQ ID NO: 928839 - protein, 196 aa, Homo sapiens
MCTQRDGLKLELMFKREAECKSLENLKPDLLVEKKIPFWGKKFKLPAAEMCLSKERSNVNRQDNGENVSRAFQRSSWQFFPTQAWRPRSEKWFHWLGPGPHCSVQPEDLVPSVPAVPAPVMAKRGQGTARAIASEGASVRPWWLPCDIGPAGVQKTRIELWGHLPRFQRTYGNAWMSRQKSVAGAEPSWRTSTSAM

SEQ ID NO: 928840 - protein, 153 aa, Homo sapiens
MVPLVGHSFLNGAHSLDFHSITFLIDSHTRGQRNNSMFSKRPGEHVSRVSPLSLGVRHFGKLLEDGDSLVVKLNSLRGNTRSVKYINGLYKNMMLIHDCETCIRVCLAHIVTGRTYPYLYRSAATSILASSEERISLRGIMQKERLGQVSEQE

SEQ ID NO: 928841 - protein, 215 aa, Homo sapiens
MGKKQSRETENSENQRASPPPKECSSSPAMEQSWTENDFDKLREEGFRRSNFSELKEKVRTHGREVKNLEKRLDEWLTRIITNAEKSLKDLMELKTMARELRDECTSFRRSRISLNRPITGTEIEAIINSLATKKSTGPDGFTAEFYQRYKEELVPFLLKLFQSIEKERILTNSFYEASIILIPKPGRHTTKKENFRPISLMNNNAKILNKILAN

SEQ ID NO: 928842 - protein, 138 aa, Homo sapiens
MDRPGKGTTSSHSGLWEWDWKPSPQPSGIPGLKVGPHQAPTPFCSGTCLPPAAIDGIKAWPQLCSKVAWVLTAGELERVLSSSSREPYLFPITEIILLHYLIPFVLQNVVLYILFICFGNFRPEDKYFHVSLSWSKVT

SEQ ID NO: 928843 - protein, 142 aa, Homo sapiens
MTNPSINPMGFNFKLYTQSKILSSTYLKYTMHYCYCHHTMQEYQKLFLLSHCNIVPIDQPPLISPYPTLLSSRNHCSTLNFNEMKIFYSKYGEWANPRSAQQSDLYLIKSINASREKESICVRNSNVQDKAKQQVVILMGAK

SEQ ID NO: 928844 - protein, 188 aa, Homo sapiens
MEEVPKRDHQCGSIGKGLVLRSPVWNVPANMFCHMSATFISNNTAIHELFRCILGPFMAMFRCKDFLQWYLGEGKDEIEFTEAESSMNNLVSKYQEHQDAMAKEEEIWEDWAERERHGRFRRQEDVGRFGTCWRLVDGFDQNADSDMGNEVQAEVVSDGDEELVGNWNETLDLDETVDLDILVNAGMN

SEQ ID NO: 928845 - protein, 197 aa, Homo sapiens
MNVGNKLPICCPLLEEGINSEVWNLEGQFGRAKTPHPVQIRLKDPIAFPYQRQYPLRPEAHKGLQDIVRHLKAQGLVRRCSSPCNTSILGIQKPNGQWRLVQDLRIINEAIIPLYPAVPNPYTLLSQIPEEAEWFTVLDLKDAFFCIPLHSDSQFLFAFEDPTDHTSQLMWMVLPQGFRDSPHLNHCFLPTVNSWTQ

SEQ ID NO: 928846 - protein, 146 aa, Homo sapiens
MLAWPPAAPARALGSLSSLMPSFRRSPAALTPGLLRPLAKVCSPMDAGRGLSLSALTQLRLKPQSSHLLPPVYPPAPLPPPKDVPLHSRSDSDASAASVALGAPASPAPGKRPLSRGWSLENCERAAENQILKCRSRWAAFLRGPV

SEQ ID NO: 928847 - protein, 135 aa, Homo sapiens
MEFQEWKEHQRKCKHRNKNDRMVETKPNQDVDLGHINVIELLHSLFNLVLVGFNIHNEHKCVVVFYLLHGRLSGYLGCLRSRSVFGRRKVGDVRIFFFLWLWTPFNTAFLAFKAFALASALGGAGASFFAFGAML

SEQ ID NO: 928848 - protein, 207 aa, Homo sapiens
MLATGPQLVMLLCNDVALLTSQAPDSPATEVLPCFGVHGRLTGGVGGPSDKQTTHFTASKEHLTIFRAPKGKEVSFAVHYHTEFNSTGHFGNGLAFIPCLCQAVDSICLVTTTQLCHLVLPKCEQGAGFCQGQCVVLPTCCRQDHFMAKTFDESGSFLSLGVVMSQMPLLLSTAAPQLPFYGDEEAVSSTLTRNHCPHLGTTRYPHI

SEQ ID NO: 928849 - protein, 135 aa, Homo sapiens
MPLSGILSSEEAKIEVVVDAYRFVTSNLGRAPHRIERAELYYWHHVWSSADMDSVADLKIWQLKTVISNTFPTSRTSINLGPNNEQALTNSDQALRNWQFLLPVSSDTLETTMLFVTLVYMCHVCLLHPSTRHLH

SEQ ID NO: 928850 - protein, 139 aa, Homo sapiens
MIKIDVFVKEEETPEKFVSMHAQRKGCMRSREKAATCKPRREASPETNPFGMLILDFRIPERVALVATCPWFGSPHTVTDPEASPSGHLVLLDWGLTLVQCLLARRCPPNVHGLNCNREMDLGRHPTTVVPWSHAAEIC

SEQ ID NO: 928851 - protein, 145 aa, Homo sapiens
MAVVGWACGHVLQPLGSWCDVADGSGTVGATYRNPCSPCYVGGDCDRLGRPVLMGFSCGDIGRLSQPDLRPQQEGSGANGGRLSWVIFRLMGWMLEYLGDGTRLINLSSGPLVVHSGAGYGRKRWSGPKVTGGMLRCEPLSASSA

SEQ ID NO: 928852 - protein, 155 aa, Homo sapiens
MGRNQSRKAENSKNQSASSPPKERNSSPATEQSWMEDDFDKLTEVDFRRSVITNFSKLKEDLRTHHKEAKNLEKRLDKRLTRINSAEKTLNDLMELKTMARELHDACTSFSSRLDQVEERVSVNEDQMNEMKREKKFREKRIKTNEQTSKKYGTM

SEQ ID NO: 928853 - protein, 139 aa, Homo sapiens
MVIFFTHSILYLENFQSVQDPQLQVKWTLLEVHSRPVCLGLSSRGCRTVNIVEQQMLLPDRSSGSFVSEGYPAVCHLSQLPLARKGNSLTPCASQVRQCLALLQLMLGGLHPLSCTHCPTSPGFIFHNPFSPNGVSSHS

SEQ ID NO: 928854 - protein, 138 aa, Homo sapiens
MSFNTHREVRPRTHQKAETPNTSEHQKEQTPDTPPLRTVTLTARVHGFILEVSETKNPPIPDTKLPSVYIFDTCYRASFIPYLSDASYNSHTLILYPRAAIPGWAFVHFTKNLSQTGNSVPVTNLAPQDPLKEILFPN

SEQ ID NO: 928855 - protein, 236 aa, Homo sapiens
MQKVGSYGLWQLHPCGSAGYSPHLRCFHGLALSVGFPGTQCKLSVDLPFRGLEDGGPLLTAPLDGAPVGSLCGGSNPTFPFCTALAEVLMRALPLQQTCAWASRRFHMSSEIKVEVPKPQFLTSVHLQAQHYVEAAMALGLHPLKPWPKLYSGVTGSGTHLEKQSGCFLVVQLCCVVGDPSLSRLSGLSRAGRLELLSCLNHRDVGHPSHWGLGPSQADSSLLLLTGWNLPLGLNL

SEQ ID NO: 928856 - protein, 347 aa, Homo sapiens
MEWNGMEWNGMESTRVEWNGMEFNGMEWNGMEWNGMEWNQPEWNGMEWKRMNGMEWNGMEWNGMEWIGTERNGMEWNGMDWSGMEWNQHEWNGTEWNGMEWKGTEWNQPEWNGMEWNGIHLIGMKWNVIQWNGVESTRVEWSGMERNRIQWIQLESNAMNLNGMEWNGMESSEWNGMEWNGIELNGMESTRLKWNGMEWIGTEWNRMEWNRMEWNHPSGKEWNRKEWNVIETNGMQWNAMAWNVVNPSGMEWNGMEGKTGMEWNRMKLTLVEKNGMEWNVMEWNQLEWKEMQCNGMEWNAMEWNGINPSGTQWKVIEWNGMEWNQPKWNGFEWSGMEWNSTECNGIK

SEQ ID NO: 928857 - protein, 143 aa, Homo sapiens
MRDKHSDPRGSVLESYVREKHSEHSRSALESYVRDKHSEPRNIVRETCVRDRHLDPRNSVLESHVRVKHSDPHSSVLEFYVSDNHSDSSSRVLYSYVKDKHSESRSSVLKSYVKGKHTDPSINVLESYVRDRHSDPRSSVLES

SEQ ID NO: 928858 - protein, 1971 aa, Homo sapiens
MERNQPEWNGTEWNRMVWNGIEWKGINPKGMEWNGMEWNGMEWNGINPSGMQWNEMEWNGMERKGTELNGMESTRVERNGKNGKEWNTMEWNGMEWNRMKWKGMEWKQPEWNGMEWNGMEWNRMEWNQPEWNGMEWNGMEWNGTEYNGMQWNHPEWNGMVWNAMEWNGTERNEIQWNRLNASGFEWNGMHWCGMEWNQQEWNGTERNGMEWNGMEWNGMEWNGMERNGMESTGVEWNGMEWKPPDRKEMECNPKERSGINTSGMEWNGTESNPMDSTGMQCNEFHWNGMEWNGIIRVEWNEMEWNRIEWNGIHPIEMEWNGMELNGMEWNGMVRNGIERNGINSSGKEWNGKKWNVIERNGMQWKAMAWNIVNQSGMEWNGMEWNGMEWNGMEWNQLGVQWKGMEMNGMEWNGTEWNEHECEGMEWNGIEWKGTGQNGLEWNGMNTSGMEWSGMEWNCIQRNGMQWNGMGWKGMERNQPEWNGMEWNGMEWNGMERNGLESTGWNGMEWNGIEWKGTGQNGLEWNGMNTSGMEWSGMEWNCIQRNGMQWNGMGWKGMERNQPEWNGMEWNAMEWNGMEWNGTERIGINRMEWNGMERNRIQWIQLECNAMNFNGMEWNGMESSVWNGMKWNGIELNGMESTRLKWNGMEWNGMEWNGMEWNGMVRNGIERNGINSSGKEWNGKKWNVIERNGMQWKAIAWNVVNQSGMEWNGMNCNGRKCNGIEWNGLQWNGMESTRNGMECNGMERNQPEWNGMEWNEWNGIYWKLMEWKGNKPSGMKCNEFQWNGMEWNGMEWNAIQLEWNGVEWNGIAFNGMECSGMEWDGKEWKGINLNGMEWNGMQWNGMEWNGINPCGMESEMEWKGMEWNQHEWNGMEWNGMEWNGINQSGMEWNGMQWNGRHWNQLEWNGTECNGIEWNQSGWNGMEWNGVEWNGMECNGIEWNGMKWNGMERNQPERNGMEWNGMEWKAMEWNQHEWNGMEWKGIMEWNGMEWSGMEWIGMERNSTEWNQQEWNGMEWNGVERYGKEWNGKESTRRVWNGIWNGMEWNGMEWNGNNPSGMQWNEMEWNGMEWNGMEWNGMERIGTERNGTELNGVESTQVERNGMEWNGMEWNGRACNQLSWKVEWNGKEWNGMETNGTEWKQTEWNGMQWNGMEWNGMEWNGIQPNGNNPSGMAWNGKDWNIIEWIGINRLETNGKEWNGMEWNGMEWNLHEWNGMEWNLMEWNGLEWNQPEGGMEWNGMEWNGMESTRVEWNGMEFNGMEWIGMESTRVEWNGMERNECNGMEWDGIEWNGKERNGMEWNGMEWTPMKWNGMEWNGLEWNGTELTRVEWNVMEWSGMKRNGMESNRVEWNGMECNGKEWYGINPSGMNGMEWNGMEWNGKEWNGNITSGMEWNGMECNGMEWNAITCNQHWWNGMEGNGMEWNGMEWNGMEWNKRAWNGTESTRLEWNGMEWNGMEWNGMERNHPEGNGMEWNGMEWNGMERNGTELNGMESTREWNGMEWNAVEWNEMKWNGMESNGMECNGMNPNGMEWNGLEWNGKESTRVEWNGMEWSGMEWNAMDWNGMEWNKPEWNGIEWNGMEWNGTEWNKPEWNCMEWNGKEWNGMETNGTEWKQPVWNRMQWNGMECNRMEWNGMEWNGMQWNGLAWNGTESTRMEWNGMQWNGTEWNRMEWNQPEGYGMECNGMEWNGINLSGMQWNEMEWNGMVWNGMEWNGMETMQCNGIKWNGMHWNGMEWNLPEWKEMEWNGMEWNGMESNGKEWNGMETNGSEWKQPVWNGMQRNAMEWNGMEWNGMEWNGIEYKKMERTRNEMERNEMETTRVEWNGTQWNGMESTIVEWNGMEWNGTEYNGMERNHPEWNGQIWNAVEWNGTKRNEIQWNRLNWNGMESTRIEWNGMEWNGKERNGINPSGKEWSGMYWSGMEWNQHELNGTEWNGTEWNGMEWKGTKWNQPEWNGMEWIGMEWNGMQWNGME

SEQ ID NO: 928859 - protein, 658 aa, Homo sapiens
MEWNGMKWNGMERNQPKWNGMEWNGMEWNGMEWNQHEWNGMEWKGTECNGMECYGIHPSGMVWNGMEWKGIKWIGMEWYQPEWNGMEWNGMEWNGMESTRVERNGMEWNGMESTRWNRMEWNGMELNGMDWNRKKFKGMESTRMEWNGMEWNGMEWSGMVWKGMEWKGINPKGMEWNGMEWNGMERNGTEQNGTEWNGINPSGKEWNGMEWNGMEWNGIACNQLWWNGMEWNGMEWNGMEWNKREWNGMESSRDEWNGMEWNGMEWNGMEWNGMEMNKTEWNGMEWNGMETMQCNGINWNGKNWNGKEWNHLEMEWIGTERNGMEWNGMDPNGMEWIGMEWNGINWSGMECNGMQWNGMERNGMEWNQPERNGMEWNAMEWNGMESTLVEWYGMEWNRMERNGLNPNGMERNGVEWYGMEWNGKESTRMVWNRMEWNGINGHGMERNQPEWDGTEWIGMVWNGMEWKGINSKGMEWNGMECNAMEWNGINTSGMQWNEMEWNGTEWNGTELNGMKSTRVERNGMEWNGMEWNGMEWDQPEWNGMEWNAMEWNGMESTIVEWYGMEWNGMERNGINPNGMERNGVEWYGMEWNGKESTRSVWNRMEWNGMESTRVECHGMKWNGMERNGTEWNGIERNGINRVERNGMEWNGMEWNGME

SEQ ID NO: 928860 - protein, 207 aa, Homo sapiens
MERNGVEWYGMEWNGMESTRRVRNGMEWNGMQWNGMEWNGINTSGMQWNKIQWNATEWNGAELNGMKSTRVERNGMEWNGMEWNGMEWNNMQSTLVEWYGREWNGMEWNKRAWNGTESSRMEWNGMGWNGMQWNGMERNQPEGNRMEWYGMEWNGTEWNGINPSGMQWNELEWNGMERNGTELNGMESTRVERKGMEWNGMELNGME

SEQ ID NO: 928861 - protein, 136 aa, Homo sapiens
MVMNNATPNHRLLSRGNSVSPFHRPPPSPKSPIQAQIPAPTPNPRSNPPSAIPNLRSSPESAIQPGPPQPSAATLPASDLLDPLSLARALAAPLHGGGRPPPRSRSQAARRQVGLQPGAVAAGLAGSPELKQIWAH

SEQ ID NO: 928862 - protein, 130 aa, Homo sapiens
MSTVCQCVSTAQINPTQPPSVILECASSCPAVHTHSSNGLTQLKPCLPHEGASLQAAELACLQRHGPGLRLSGFTVLHCSHFLYPPGLRTVTAHLAEQGQRSADDPYVSTDSSFASTHLTLHRPGPGAGD

SEQ ID NO: 928863 - protein, 138 aa, Homo sapiens
MGHGTSSPVLLLSSASLMSWTCGETPDLAHGWFCSVPAQTGDALGDAVCSSRAFRHRGLEPLHLGCDRGLRSSTVGEGLLNKKGTATPCGADEQIDDSAFSWSVMEEEARTHASISNSAAPHLPLGENALKAQTATYH

SEQ ID NO: 928864 - protein, 168 aa, Homo sapiens
MSSPAQATISLGNPSVDRALRVPKAAACPQGRPPWGMVWLQDRLLTGACAQRGLSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEGNG

SEQ ID NO: 928865 - protein, 603 aa, Homo sapiens
MCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSGASVSQRTLPCRPLFVSNPTWPHGAQRLRVQGPAWGTRGGESQHLPPAQPGTGHRGLGRMGLGVQGGSGKLPGGAGGFRGSPCRLWVGEVAFWEGARPRKEASVVPRLLRRPPGGRALAAGGCLQGGWAVISGSCGFSAVSLNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSRHCHCLALLCGQLWALQDFQASAVMDLGFGEQMRCPVLDFHGACGICDCPVPNTYTNVIENGNSNKAQFKLRIFSFINDSIVYLHCKLRVCMESPGATCKICLFLLSSELFSWVTKL

SEQ ID NO: 928866 - protein, 188 aa, Homo sapiens
MKRWAKNGWTASNRNEAGFISLMSGKAEFREKHTNEDQNRFFRIIKNAIDNRYVPTTNIYVPKRCFTMHRVKIVGDTVRGKRKSWTIKECLKENRLLKVTNRTQVDPKFGCLPGAAERGPVGCVIVSGGLGCVCIVNKCDCGRCPAPSDSKFCLLWASAKHGHLIKRCLNVGHVLDARVAMRVRVSER

SEQ ID NO: 928867 - protein, 131 aa, Homo sapiens
MCLMLVDAINQFSKFLPTYTLACNDSSHTCVGIDYINIIIFTSITSQSLAAHFLLWSMAPEHTAVSRGEELLALSAGISMKPIIGVIRPCSCSACPWLAPVASPAGAAEAASASNESKDSEHRAQCFTALP

SEQ ID NO: 928868 - protein, 260 aa, Homo sapiens
MKHAAPPRQSAPESMKCAAPLNRSALEPVQRAAPHTRSAPESMKPAAPHTRSAPESTQHVASPRHSVLESMQRAVPHTGSAPESTQQAFLEPQAEGYPKCKNGGACNPTEHPPLSRCPGRPTQHGHSASSPGASRLYPKEVTLGDVRCVGCHEPSQGCSLLGKESTVLLPAKLAAPLHEGADLPHTTTVAGIAVGQQGQRQLHSEKQQMIPVPECGLGMAERTLEPGSHLEGNKAVWQPPGRTHGIEDQMCQPHLGARNH

SEQ ID NO: 928869 - protein, 244 aa, Homo sapiens
MNARTELTDPVSYNCFSSHLCYLDQPGRDLEERREPGGQAVDLRAAAAVLVRSMATGPSRQASPALPSMRSLPALDRDYWSLCREREQKGREPGASRGDEKQQETPGGRGREAMIGGENGKEGEGKRKPCFTQGVGSNVTSCCSRAPGGTPQRRRKGVAHSELSCGGTWLINSLIVLEPAGAVLSVTDQSGPRTPKPRPMANTTEVASECLLKDPKGNVGTGSETGAFMDQRISEGGNGIGVPA

SEQ ID NO: 928870 - protein, 143 aa, Homo sapiens
MDMRPGDEDADVLREESREYDQEEFRYDMDEEATVHMAFLLSWRVAFVLLERVRPFPAVYKPQVWGVTVQRATCPVAAQGHASMSPPCINAFLRGGFGTSTLEKPFNSTCSSPSWELLLLLSEIMVEPWFRVKNSSGQKYRYN

SEQ ID NO: 928871 - protein, 172 aa, Homo sapiens
MLWLTRVRTQTNEATDDPTGHVTWHSAALRIRVLSEPSGDAGYCRGNEKYMPPNYMKGKKTTQVPVTHRSWGGFNQDRELLEGLQLGGKLMALLSPCRKDPALFQSLPSHLQAQRGKQAGLSTSRAPKLRWSQNPGLPPELGSLERGAGGNAAASQVCDRVHAKACCMQPVS

SEQ ID NO: 928872 - protein, 259 aa, Homo sapiens
MVYRGCPVRLRAAAPSGPSMAPIAPSSAVCCRALAGISTCMGGSLGCSPDASWDRCAFTGLRLCTCLFTSRAGRGGGEVPRGHRTAKHVPSSTCRQQQPPSPCDRDAHPCQRARARVRGSKRCCHWPLSLGPHHPIVPMAAWEPRTARAPPPAPSHGGPWHSQVEPFMGARRGHLEKSITSNCDKDFGTVALCAHRGSFKSMKELCKGGADSTELPASQRAWTSLEIPRMQMKRTVQHRLSLSGAKIEKNFGAFPPQVA

SEQ ID NO: 928873 - protein, 143 aa, Homo sapiens
MAAVLKHTQIYLIFQGLFLKGWQSQLSPFAGECHCVHSNLGASQWEALAPPANAFAIARESVNTQLYFQPTLLSCEAFRGILPPGGFSFCIVFEGHLLGGSTLAPTSHLCSLQPDPLLTGPALPFSICWPEKPLWPQVWWREG

SEQ ID NO: 928874 - protein, 172 aa, Homo sapiens
MADSTIGAGNIQDEPGMPCKCQNKKKCSKTQEGKQAHLWGVSQGHRIQPKELPMANAGTLGATFSKVVWNCSPQYESIQNKQKWWKRQIRGGEETNVPCQIPNDVGRRPLEEVLWTPHPKRGLCTVTPFQSTRPGDREREGDLTVGKPDSQHLSQVAKVNVNRKDSFGSVCL

SEQ ID NO: 928875 - protein, 145 aa, Homo sapiens
MGGRVGAATGSIDGGEERGAKQLSSSKGREGATCPVSRRDDPGQALQPLAKQVPRQHWTWGSPLGELSLMPTALDVDQSGVMKSDLSVTQRQATWDEALGRGHSVPQWLFDRSPAPHCVALRGHFHQPLSSSTCDQVQEVPEPAS

SEQ ID NO: 928876 - protein, 160 aa, Homo sapiens
MTQWAFPFLSLAIRPSILIAWGSPGPKSDCSEVHAVGGDRAALEVAKEKQAEEASPSRLGKKFPHITYVTLATRRTIFTVEILRLLKTFARILLLKAAPFDSQLLKKLWDIFKAFYIKKRHNILLWVCVQGPGRAQLPRFCVADAVGSALTHTDVLHATG

SEQ ID NO: 928877 - protein, 176 aa, Homo sapiens
MELAGQASPVIPPGPHLHIVLFQPEPLELIETQAHAPASGAEIQLFPVPAVEPVPAPGADSPPGTALELEEAPEPSFCCPGTAQDQPSEELPDFMAPPVEPRASALELKVWLELEVVERGDQHSSSQKLPHCSQSWAQAAALLLKSLLLLLLGVFACLQEVLESKKRSLFAERGIM

SEQ ID NO: 928878 - protein, 303 aa, Homo sapiens
MLFSLYPQGLVSTLGALDSGASLSKLWRVAWHESRQIWEGTWQDSPWKLCPRVHRDLAPAVMFIHSITPCSPSLWKVQEEGLQMWGLALVAEGSKVMGIEKTGWQEQGQNGSGVLGVLLGPEEDCRGVGTRQGGGGGGECDCSFTVIRVDVEMQAESSKLAQGSVWGGGTPSRGLRVRLIHPEVPDTLVGTGRLILELLLEGPCGSRPLALCSDHRAQDTCPAFAATVLLALGAAAAGPLEEEEGWPGWDPAPVPSLLEGESLSMRCPPPCSLTVRSHLPMLSSRLSPVSYPLQNLIAVVPYA

SEQ ID NO: 928879 - protein, 149 aa, Homo sapiens
MSCSSASALSTRTLCGAQEQGVTPLGPTTSSCAPDSCPEKIVLRALLKRGAGMPEQDKDPRVQENPDDQRRVPEGTGDAQSAFRPLWDNGGLSPFVPRPGPLQRDLHAQRQGEPLMLPPPLQLGSGVTAEDLDLEKKVALWCKSALRVL

SEQ ID NO: 928880 - protein, 139 aa, Homo sapiens [sequence omitted]

SEQ ID NO: 928881 - protein, 326 aa, Homo sapiens
MAPHEDTVHNITNEDASHDITNEDAVHGIANEAAAQGIANEDAAQGIANEDAAHGIASEDAAQGIANEVAAQGIANEDAAQGIANEDAVHGIANEDAAHGIANEDAVHGIANEDSVYDIANEDAIYDIANDTVQGTLTRMLYTTSLMRTPYKASVMRTLYMTSLTRTLYKPSLTRTLYTTSLMTAPYKTSPMRALYTTLLMIPTRHANADTVHDIANEDSVYDIANEGAVYDIANDTVQGTLTRTLYTTSLMRTPYKASVMRTLYTTSLTRTPYKPSLTRTLYTTSLMTAPYKTSPMRALYTTLLMIPTRHANVDAVHDIANEDTV

SEQ ID NO: 928882 - protein, 191 aa, Homo sapiens
MSPPSPLVAPQEAAPDLHLPQGSGGWGGRRAEADPAVGKGAAQVLLTQEEKGGKEGLIQGYSTFSLEMDEMSVCSLKESSWLCPPTGRQWRPPSVKAVPLVLWFGKPASSTASGTSAPFAAEQIFTWVSFPPSLSELLSVRKRTLAVREENYELTYSFMLPSPVCFLLQKQQLIPCYSRLSKSASSGKEPH

SEQ ID NO: 928883 - protein, 166 aa, Homo sapiens
MQGGLKQHEADHGPDLHWLVLAAAADGGYKHSCAKLKPCDPESTTLKASGCAKRRAHRNLINPYLNAFKIPESRRPIPDHTGSPTPDENGHGGAACAQLVYIPLLPQNHAVPRATPLTLLEPIPFPRGLVPSVQRQTETRSAPVHLGSSANTTCRSLLERQAEDRT

SEQ ID NO: 928884 - protein, 170 aa, Homo sapiens
MERLSAEGKFFHRSCFKCEYCATTLRLSAYAYDIEDGGVCRVALVSDEPETVSIPAAASKPAMHLPLGPLVSLPLLHPSLFPQSNRRDFKRCDLDLTSVLAAAVQTEPTTLSQVERALRVHPSLCRQLPPACCTLCSSVFPSHKHDEATAPLGRGSAVSSPGAHPLVSTG

SEQ ID NO: 928885 - protein, 209 aa, Homo sapiens
MLSLPLPPNPNRPHCVMLPSLCPYVLIVQLPLMSENMAVFGFLFQWNPFPIASFCQGQGKAENSENQSASSPPKESSSSTATEQSWTENDFDELTEEGFRRSNYMTHAQASVANLIKRKKASVIEDQMNEMKREEKFREKRVKRNKQSIQETWDYVKRPNLRLIGVPESDGQNGTKLENTLQDIIQENFPNLARQAKIQIQEIQRMLQR

SEQ ID NO: 928886 - protein, 134 aa, Homo sapiens
MRAMKSGGVKGMRKDKLRSDPSAAALLEFAGGPLQTLYHRQISPVEYHQWRLQNSKDGCLFLALEASSQSSTCQMPAGALLYEVSQGSGVVLGDMLLSSEPQAERFVSLLKLRPQLPLPPGALSQADGVLSINP

SEQ ID NO: 928887 - protein, 145 aa, Homo sapiens
MPLLTYLMDIPSKVKNKLLHLAPPTTKKEAQHLVQAAVQATLLLGTYDPPDPMVLEVSVADRNAVLSLWQTPICESPWGPLGFWSKTLPSSADNCSPFERQLLACYWALMETDHLTMGQQVTMRPELPIMKWVLSDPSSHRVGHA

SEQ ID NO: 928888 - protein, 149 aa, Homo sapiens
MVLSSDSLDSRLDSLVSWFCPKQGSHNEFKLHGIGAIVYYLHCCIPVYWEYLANTIQERKQPLECSRIQLKKCRNTTGEKRRVTMQEGWLGDGTSESFETARGKEAGGKCYQLGGRATAVPMACSVEDPAALAAEDLSIPQGSSTLQLS

SEQ ID NO: 928889 - protein, 396 aa, Homo sapiens
MSQQVTMRPELPIMNWVLSDSSSHNVGHAQQHSIITWKWCISDWAQAGPGGHNGHGGRDGGYAWIQQCGLPLTKAELSVATAECPICQQQQRLTVNPLYGIIPWGDRPATQWQVDYIGPLPPWKGERFVLIGTGTYSGYGFAYLHAMLLPRLPFMDSRNALSTITVFHTALPLTKHSLYSSWIDRMVGRPFEVAITTSTRLQYFAGPGHHTPEDHVCSESAPNVWYCFSHSQDSQIQDSRGGCESGTTHYDALAKCLLSVPTTLGSALLVILAPEGRTLLPGDTIMIPLNWKLRWPLGRFGVLLPLSQQAKNGVTVLAAVIDPDYQDEVSPLLHNGSEEEYAWNIGDPLGCLLVLSCTLIKVNGKLYPIQVGLQMVQILSGSRPAEVLAEGKGNTE

SEQ ID NO: 928890 - protein, 775 aa, Homo sapiens
MLLIGDLSNFLITKKAASDSSKEQVANSRESSPSPKEVNDSPRAATKSPESQNLIDGTKKPSLKQPDSPRNISSDNSSKGTPSSPAGSTTAIPKVRIKTIKTSSGEIKRTETRVLPEVDLDSGKKPSEQMVSVMASVTSLLSSPASAAALSSPPRVPLQSAVVTNAVFPAEPTPKQVTIKPVATAFLPVSAVKTAGSQVINLKLANNTTVKATVIPAASVQSASGIIIKAANAIQEQAVMMPASSLANAKLVPKTVVSSLQNSVVETFNKVLSSVNPVPVYILNLSPPANAGITLLMHGYKCLECRDSFALEESDPALQQMEHVHRSNVQPLYKEPHCLQQMQPPFPSPNSSSSSSTLQSPVGTGIHTVTKIQSGITGTVISAPSSTPSTTAMPLDEDPSKLCRHNLKCLKCNEIFQDKRSLATHFQQAADMSGQKTCTICQMLLPNQCRESISTNLPTPALSAGPSAEKRGQQIHEWERETGKEISISFEKKSMETKKVASPGWTCWECDHLFMQRDVYISHLRKEHGKQMKKHPCRQCDKPFSSSHRLCWHNRIKHKGIRKVYACSHCPDSTGTFTKGLMLEKHVQLMHGIKDLDLKEMTDATNEEETEIKVDVKVRSPKWKLKEPVLEYRPPRGAITQPLKKLKINVFKVHKCALCCFTTENLLQHLFVVHKLKEPQPVPKQNGAGEDNQQENKPSHEDESPNGVMSDRKCKVCAKTFETKAALNTHMQTHGMAFIKSKRMSSDEKYWDARRQPPTYQCSRLCIAIGRYLKH

SEQ ID NO: 928891 - protein, 165 aa, Homo sapiens
MHTYIQNTGHMKGAVKSSTARAAGQRPGPLRQMQNSGSHVPRQPGGALSGHHVAPFPSPAHLPGVLLAVGLATVLLMGLGLLLSPSLPHACPMQAWKTQWRRLGQPQVPAEYVILRDSLLFYEDLGPWGSGEGADSKKAMSRGTGTMLVCSQPLLNNTCYFPFTR

SEQ ID NO: 928892 - protein, 169 aa, Homo sapiens
MLNLLYPCSINGFTIVDATKNIHDSPEEVKIAALMGVWKKLILTLINDFEGFKTLAEEVTTDMVKTARELVLKVEHEDIAAILTDEELLIMNEQRKWFLGMESTPGEDAVNIVERTTKDLEYATNLVDRGVAGTKPAISPRCACTPESRAGVKTWVWMVYLGSDSKKQE

SEQ ID NO: 928893 - protein, 142 aa, Homo sapiens
MVKLDLDDVLYKSILLSRKGEEHGVIGQEEKKTEERRGLSHKQAEEKAAVVCDGHGSSGVQCGVSPRGETERETEKSITSSCTAIFESDAPEPHDPVKFDVPLSQIQCWESSVICLDLAALRTGQILTPIQGLDMNRQQLGF

SEQ ID NO: 928894 - protein, 152 aa, Homo sapiens
MSQPGPSPCPTIFLTPAWSCPALAVPWPQPCLLPGLALSLPWPDPRPTESVKRPWTCLAVICPGPVLSPPCSGPTLAMLGPGPSFGPALALCYLSPALALNSPWPYPHPTLALPYPGLALPWPCLWPALALVLPWPYPCPGPSLAMFLLCLQ

SEQ ID NO: 928895 - protein, 158 aa, Homo sapiens
MEVCKHVPASRRQPDSTEKLSSSPTSPLTLASSQSPRTDFHWIRLRHIPLPEPITTSSLARPGFHEAPSGSGWGHLLQKDMGKTRKWEEGCFLLKNRDAITTRALMIEANIHESLTTCQWLPIYPGLWPFPPFLKHTTPISAQCYGLNVSPKVHVLEI

SEQ ID NO: 928896 - protein, 139 aa, Homo sapiens
MNTLLLTLISAFICIAGTSRKRRGMSTGPCQEVVGSGSKGTFYDRRSLKTPWLQDEDMKRKFQDLLSEENESTALSQVLAQGPLESSRERSIARLGVEFVETGWLAADIFMRTAGTLVHNNRPGYILILALIKIQVYSL

SEQ ID NO: 928897 - protein, 166 aa, Homo sapiens
MGGNQSRQAENSKNQSAASLPKDCSSLPAMEQSWIENDFDELTEVGFRRSVITNLSELKEDVRTHCKEAKNLEQRLDEWLTRINSIEKTLNDLTELKTMARELHDACTSFCSRFNQVEERVSVMEDQMNEMKRATPRHIIVRLTKVEMKGKILRAAREKEFHIQPN

SEQ ID NO: 928898 - protein, 164 aa, Homo sapiens
MSFVFGLQDRDAGLRGGQVGGQVGGVHHSQAVSIQASMTTGLPADPCPTEEPQALNQLPTHHPLGLHLLPRPSPPLELPLSTKGAVAHLTFQPELSGTLLPPPLPEEAAPMPVKFFQLLEPSGTPGLSMSCLGGCNGYACFSVSLHQSVNQSIDQSSINQLSTY

SEQ ID NO: 928899 - protein, 265 aa, Homo sapiens
MPLPCGAGEAGRAPSLWLAGQGTCSSSSHGGFPQSEDLDRGRCVLNPARPYSRSPKGTELTQGKVSVVYTVIYPGSWGSQALQEYAQNSHNSTMKRKGPIKQGAFEHFSREEPHTASELMPGRRAPGKREPQLSETRTRLAPTATESKHHELLGRGESDPPRRWRERVGSERCPHTDLGTDVHGNTIPSLTDGTRNQPSTAGGRDKTGFTRQHRFVQPNSETRCPAGKPRKHAQPVTETCRHNSVPRGCRGGARQGSGPVERCHG

SEQ ID NO: 928900 - protein, 155 aa, Homo sapiens
MPVIKLEEAATDFIFHRHPSHLCSRSVWPQPPWPCGNPAAPCGSGPGGLRWPCLQEPGLSRHSRAETTNEQLPWLPQSPPQGPWLLTLQTQLFPGALLLPRPPPRLHSSLRCAHRGQLNATKNNAKFWRAGREVRVDLGAGLQQEGWAHPPLAAH

SEQ ID NO: 928901 - protein, 122 aa, Homo sapiens
MAPDGPHLQASPASAPALQRDLQLMQSSRHGSRDFCGSHPGSQSSDTPAAVRELPTWRGAAIGTQRGSPTTDEKQNPSDGHMGVPGRGTFPSRAKRTVACEVSEQRASSATLGFLTPEAMSH

SEQ ID NO: 928902 - protein, 149 aa, Homo sapiens
MMNSYTALNALLRCPSTSLEGLDPSSLWMPSSSSDTLSCPTLRLVLWKPANVQLVLEKGPCHPEAPEPRPPYSGCRPFPHLWQPRHPWAQQEQPQCPGMKHLLCFRPSWSPSSLTNSDLLGQSCFYPHLVGGKTGSEGPGPQVSQLPGA

SEQ ID NO: 928903 - protein, 280 aa, Homo sapiens
MPYSLVLTWWKGLLPDSAGCRVPWKPAHPAGVTQCPVCIQTLALSSWGWARKGEQVAGGGWAAGSQSCRRCWDQDATLATLGVVCSTGAAGGGGRVLHGQVLLTGYGGVLGRQEGANADTQEPQEEEEEEEQSTGYPDGLGQTEGTAVASNQPPEPCCLGPQSAQPDLQSRFDQLPDLPIVSCNVNLFKRAPEAIFKLGGWSPMLMEPAPSSQLCLLPPQPWFWEPVAPTLQAGQQQDYFLSLGEAGLCQLRSVPTAAPTREPQEGGEGPNPEREWISIC

SEQ ID NO: 928904 - protein, 148 aa, Homo sapiens
MALLVVVLVVVVVVMMEVMVVGHGGDDCSHGDDSDCHGDGPRPQPWTPKPCRCSLGCSGQFIVSLGVRSLFSAMESRVGLSTEGAESHWLRPGFVEGAAQPQASGSLGWHPVETWEPSRLSQEGVHRGEWTVRLEQVWVRELFLLLRT

SEQ ID NO: 928905 - protein, 246 aa, Homo sapiens
MLLRPGLALLPSFNDIGQGWRLRHFVSWLWYEREVTLLERWIQDLCTRVVLRIGSAHFYAIVWVNGVDTVEHEGGYLPFEADISSLFQVEPLPSHLCITIAINNTLTPQPCHQGPSVHDRHLQVGTILPPLHAPTFPPHPVVFLPGTGWPSQRGGPGSGEACELRSKDPWQGPSEPQFSRPRYPKGYFVQNTDFDFFSYAGLLWSLLLYTTPPTYIDDVTVTTGVKRDSGEGFCCEPPHMAGIPCL

SEQ ID NO: 928906 - protein, 157 aa, Homo sapiens
MFIKVMFGAGCSVLVNTSCRLVNLTAHLRQKAGLPPDATIALLAEDGNLVSLEEDLKEGASRAQTMGNSLLKERAIYVLVRIISKRERTWPPPAMSPYWRTWMTITQSWQRNCAGCQASPLWATTGGSVWALGEAAMSKAPLQGPERALIKGMDCTL

SEQ ID NO: 928907 - protein, 148 aa, Homo sapiens
MWMSASFTRGVPEALEAGPSVGDIPGIPSPGGDFPSPRGMNGLTAPGSRPRSASSPQAFRDFPDAAQTGSGREGATEPGLCGTQHQRLPPTREGSVVAVTQRRPAPRRRWELSCPTAALDHSPVHFHSLLALQASLAVPDHRPMKAPG

SEQ ID NO: 928908 - protein, 178 aa, Homo sapiens
MAPYPSRDEAQFIPLHALSPCTSCLWATCPQGLQSRMRCWEAPKGRRRGPEQVQWFKRAQLPFSGPLGNFSSSGKPHPSQVHRVWPLIEPLVNFLNVFSTNVYTTCIPFGLDHCDFPMVDCCSSREESVSSPRQQSRRLKSQGLVDLCPVNLNDKVQPRQQAHELPLEPPKSSPKISA

SEQ ID NO: 928909 - protein, 207 aa, Homo sapiens
MKLRTFAPPPDSGVQLASPRGSHTRATRAELPASPVRVHAPLSPWAVDGTGHRRAGGVACRGSLGREGAHSAGEHALGMVGCRSRALPCGEVAEAWQEFECAGLGAKPLTATLSVGPTEPTPTQNACWPVSTASSSGSRPRLSLHTSPQAEGVSSSLGQPREGLTQCSSGLKGSSSVVRVGAKAKEVPRVSEGCQHAVISQCDRFLN

SEQ ID NO: 928910 - protein, 129 aa, Homo sapiens
MKGGVLTARSPLVLLHAVGAKPGGGVVWKSFRNRKSVLLSSVPIGVIRTNTRSWGATKSRGDKGMRKRQFERQSGTRGRHEGGGCEGLELWESTLFIGVQTNKQVEASYCDQPNDQEGQRNGYRNRDGQ

SEQ ID NO: 928911 - protein, 136 aa, Homo sapiens
MNRCMYDRKLPEAREEESESNRPNNWSRSIAILDKHRHSKVPLDQKPPKSKGLQPNGSMVTLQTRSFVVSVFVKTSSLAATGGNRPGSQALGDPGSVPEPLAGVIEVPAGKPCPGSFCDTTVELNSCDRNYMVCKT

SEQ ID NO: 928912 - protein, 138 aa, Homo sapiens
MVELVCLIHNHADFELQFPVTANTFIHNTLSRRQEHPLKTADLNLQVQKCYSDKDGGLDKKMTHMLPDLAHQNLTEPTVFQCVAAYAPAPPDSFLTWCTTLQLKIPAACNLSLANELCQGLALNVYPVQSLLQNLLMN

SEQ ID NO: 928913 - protein, 184 aa, Homo sapiens
MKAAGREAVPCRATGAELPKTMGTHLLHQRDPDARYRVKGDHFGPFRFDCPAGFWTCMGTLAPFSVKNDGGILMGIGKTVWRFPKELKEGLPFDSGVPLLCIYPEEKKSLHEKDTCTCMFIAAQFAIAKMQNQPKCPSINGWIKKLWYIYMMEYYSVIKMNELMAFLATWMGLEIIILSEGTQD

SEQ ID NO: 928914 - protein, 144 aa, Homo sapiens [sequence omitted]

SEQ ID NO: 928915 - protein, 140 aa, Homo sapiens
MRKNQQQKNAENPKGQSASSSPSDSNISSSRVQNWMEDQMDELTEVGFRRWVIKNSAELKEHVLTQCKEDKNLDKSLEELLTRMTNSERNTRDLMELKNTAQELCEVYTSINSQIDKTGQHANSRNAENTIKIRHKKINS

SEQ ID NO: 928916 - protein, 237 aa, Homo sapiens
MWTRTGCFVRSEEDSMEEFTESEGLDIIILHGSEQHAWTFSICKGTMQQRLTVESAVHIKTRQCLRCANGDYGIAMADVRLLAESARHDGNTIGHKSTEVLALTWMLPLKLVVANAVAALSEIAESHPSNNLLHLNPQFINKLLTALIECTEWGQIFILDCLTNYTPKDDREAQSYGHTHGLAWELTEAQGTSVEFREIFELKAELNSDKKEKEEEAVKKVIASMTVGKDVRCAGGV

SEQ ID NO: 928917 - protein, 167 aa, Homo sapiens
MVWLCPNPNLILNSHMLWETRCRRDLLNGFDQNAKNDMDNEIQVEVVSDGDEELLGNWSKGGPCYVLIKRLESFCPCPRDLWNFELERDDLGYLAEKTSKQQSIKEMTWVLLKAFSFKRETEHKSLENLQLDNAIEKKISFSEEKFKPVAEICVSKEELNVNHQDSD

SEQ ID NO: 928918 - protein, 143 aa, Homo sapiens
MQKAIVPARHTHVKDSETVKRRHRGRNAEEGGQRDQETTENRMTNASAVIQTEEESWLCKKQMIRCSLWTRGKSGAPGTPKWDQNRNLSRKTSVTRTEVETEAIRGVEALRDSTCGWFSTSKSLRASMMVNSLVKPGVPFPNL

SEQ ID NO: 928919 - protein, 143 aa, Homo sapiens
MVGGKTKPKTPMSSRDPAAGHRMSLVPLSVGVLAWKCSGGEWGKSSLKPWDSIWVGWFPDTMKVRAILCQPCCWGWDVGLLSVAAATGRWLSGSCTWVSFVMELASLVHCIAHSLGCRTLVWARVLETRSNRWSSRHHAAVAL

SEQ ID NO: 928920 - protein, 137 aa, Homo sapiens
MYIKQIYMYIKQIFTEHVLDPWPSAKHSSDADPSSRSPESTQRAPFPSWRPTSQSKQKVTRNAAGTQHPVSQSLKKGQSAGPPLMPVLLDTKDWKHQCVSGVQHGASSENCCQGVFMDVPTGLSLLSALLQLLPAIK

SEQ ID NO: 928921 - protein, 171 aa, Homo sapiens
MGYVKVVANIVHPMGFSDRGHKLQYSSFCSCNTTPAAIWRFLLIAILGHSMFISHMDAIPHNTHICTALKQLKFKTKVVHTRDGTGESFTREMEMELSIIKGFLEDNGLEGHWEGGDIKEKMTSCGEDVEKSKPSYVAGGNVKWGSHFGNYFGSSSESSAGSYYVIQQFHS

SEQ ID NO: 928922 - protein, 138 aa, Homo sapiens
MLDTEESSWALLLPSYSLSTHLMCSHTIFQGTLRTSPSFHIYGNHACQLRSRLAFWDSLLTALLKSIFAPIRSILHQPEARKRIFLESRKLGKVPGGKVHKCGRPCKNVAPRSFSLTAVYTQAPAICQNSHLSLPTSL

SEQ ID NO: 928923 - protein, 143 aa, Homo sapiens
MRNKSITYVIQCVVFCSSSLSRLRQAAKANWIVGSMRLTSNINLKSFRTANEKINRVNRKPAEWEKIFANYVTSRGLILGIYKEFRQLNNNNKINLIKKIHVLNVQVCYIGIHVPWWFAAPINLSSTLGICPNAIPPLAPHPL

SEQ ID NO: 928924 - protein, 154 aa, Homo sapiens
MSSTEMAKECNGLRHKTPIPGKALPYSQKDAMHGQQSQGESRQTGLSGSDSSKLTFHNHHPAQQTENPVFTRFCLSQTAKCGFRSPKMASTQAAVEVQRKSVQKWVQGGFGLEVKKVDSYTVCKKKLGIEKVPDWLPSACPPLSMAPAMSPCAK

SEQ ID NO: 928925 - protein, 141 aa, Homo sapiens
MFLDDLAPEFSFAAAHSKAEAAAEPRGRIWEDLQRGVTGKVDLGEEVDENIPEEVALGISGFETKDEGSYKQECNMHDKEWPSQLQLEVGIQDARAQEGSGGTIGALSASLFLEPVAFRTALRLLKLLGTIDKILNMEIGN

SEQ ID NO: 928926 - protein, 153 aa, Homo sapiens
MAFTVHISIGFWSRALNHSLTSFKHSFVFLSSSEPSKFFQLLLITQFQSHFHIFSHTQVTGIASRQPFKRERLDQNIDFRSFVFLSSSSVDVGHEFLRYRCLLEAMRQLEDAESHENAETQSRHPCIFYSTPATTYCRFLALQGKLTFQCVYS

SEQ ID NO: 928927 - protein, 321 aa, Homo sapiens
MCILIKAVPSTKRPKSSGNSKPSPALTASRQLVRKECDLGALGPVAAVQSEDSFVEGSAEGTAGPEPLDLRLVEGVVQEVDFLGCLTMYFRGLPASSPSGSEWSACPQGESCCQLGKGPNSWVTASCTELALPFSMLMAPLSKLLEMVSKCPRNLSQGPAAEMWSVVPHAGVLVGVLPWAKLCLGKLICIRSLQLELLAILACQVVGLWVELEGSHNGQGCDSLWGCDEGMGLGVRVIVAHEVPVVGGDNYVLLLLVDVLSVQLTNAGATSIGQDDATHIPQGLCIAILLNGGTDLLGAWSNSELGLALEAMGQCLLGHTC

SEQ ID NO: 928928 - protein, 155 aa, Homo sapiens
MDMRSDTRVKAMPVKLNKMKTSYPQLYEPISSAQQSHVGSSYYMGQCRYKTFPSSQKVLSDSITLELLQGVKEIREEKEFLRSIASHYKSDFLYPSKRDADKKLFFSVIKILLTVDLYCFLYGTSHVSVRQQKDGALPSCMSNRLPSPGLQCTEV

SEQ ID NO: 928929 - protein, 163 aa, Homo sapiens
MKLFLKCDFVQGLGHWEHWDLYSLEQCLLTLLVTTYGNLPPDSRSVCLPPLVHQRMSAVSVSALPRLLNEPPQLGDLDGPCLFTGCKAKQDAGCVDEEPPETLPHDLGLYSDSHGSVFPWVLDKAVVSLHLTATDHSEIKASACPPCLEWRRREGFSGSPNVS

SEQ ID NO: 928930 - protein, 147 aa, Homo sapiens
MEVLTSSLIKSSLCPNGRTYPSLRPLDQSCKDEKQKYHWWIASCPGSQPATTLPKSQPFLGNGHWPRAPTESLMIQTGNLGFEQSYLLLPERRGQIASSRGTADKRHRLTWAALARQPSYEITAHWHQPKPLSSPGLMTRGWFPVGN

SEQ ID NO: 928931 - protein, 149 aa, Homo sapiens
MSLEFNVILLVYFCFCCPSFLCHIQKFIAKTNIQKLFSYGFSRRFMVSGPMFKYLINFEGFLYGMRARVFMGKPGAWIYEGRPTTSLERQQQQKEEEKEEEEEEEEEEEEMEEEEMEEEEEEEGEEEEEEEEEEEEEEEEEKEEGEKEK

SEQ ID NO: 928932 - protein, 167 aa, Homo sapiens
MGYHCRNVKHCLFSAKSKLHPFFPEPEQYSPHWPWHIQFASFPFDSNTVRFYKCQPHDGASLLRALYWSSLSIFLTITYRALLLSLSTVALAVLTPATLAFRSMLLPASGPSSRTLPSSWNSYSTSALNSPYFLRKAFSALPEQGWAVIESWQQAHISLPLIFSRIS

SEQ ID NO: 928933 - protein, 155 aa, Homo sapiens
MTNVSSNNPTISPFTTKSSFSLISPTLGSHAAPNPARSSPEKHRPLSLHTTPKNLRHPNTLLLFHFIFLNIRRQECQASEPKLSHHIPCDLHVHIQMAARLHPGEINSHVAQTKPIWWSLHTDVHESNNTRSRDFKISRVFRVFGGAVERHTSQT

SEQ ID NO: 928934 - protein, 390 aa, Homo sapiens
MCELLYQPLPKERPKGYLWRSGENTCVNTHGDTSEKTHENTSVNTNENTCGDACENAFGNAYGNACRNTFGKTYGNTSGNTCRNACGNICEKACGDTSENTCGDTCGKACRSTFGNTYGNTYGNICRNTCGNIKNTCVNTSKNTCGNTCGDTCGKAYRNTFGNTYRNTYGNICGNAYGNAENTCVNTSKNTCGNTCADTCGKACRNTFGNTYGNTYGNICKNTCGNIGGNACENTCAITKNACENARVITSENTYENACGDTSENTCENACGDTCGKAYRNTFGNTYGNTYGNICRNTCGNTCGNASENTCVNTKNACENARGITREYTYENACGDTSENTCENACENPCGDTCENTMGMPVAIPMGCLWKAVFLEKMAMDLLPHKKKMS

SEQ ID NO: 928935 - protein, 245 aa, Homo sapiens
MCAEVGPALCRGMERNSLGCCEAPKKLSLSFSIEAILKRPARRSDMDRPEGPGEEGPGEAAASGSGLEKPPKDQPQEGRKSKRRVRTTFTTEQLHELEKIFHFTHYPDVHIRSQLAARINLPEARVQIWFQNQRAKWRKQEKIGNLGAPQQLSEASVALPTNLDVAGPTWTSTALRRLAPPTSCCPSAQDQLASAWFPAWITLLPAHPWETQPVPGLPIHQTCIPVLCILPPPHPKWGSICATST

SEQ ID NO: 928936 - protein, 195 aa, Homo sapiens
MTGLLLGNPNDAIALIFANDFLEVGLGGSQGRTAGNEKTQRSPHISNTPLSTDGIGEVLTEELTLAELNFRGGTGRWHERSCWKTFPVPRDWGSLTIMVEGKEEQVPSYMDGSSRQREHEEDAKVETPDKTIRSPETYSLPREEYGGNCPMIQLSPTGSLPQHMGIMGVQFKMRFGWGHSQTISLTKMAISYDLI

SEQ ID NO: 928937 - protein, 161 aa, Homo sapiens
MCSLPQMCSLPRMCPLPRMCPLPRMCSLPRMCSLPRMCPLPRMCSLPRMCPLPRMCSLPRMCSLPRMCPLPRMCSLPRMCPLPRMCSLPRMCPLPRMCSLPRMCSLPRMCPLPRMCPLPRMCPLPQMCPLPRMCSLPRMCSLPRMCSLPQRCSLSQVCSLS

SEQ ID NO: 928938 - protein, 149 aa, Homo sapiens
MLTMHQANGDTAANRTKSLTSRCLHFSTERQTPNKLPGEHIVQGLVDQNKDLELATGWEAKEVCTKARHNPIEQAVERTNFGDGELTCQLGVGGGGEVLAHFGLSQSNTQGKQPWEHSAVKQVNRGASVHCHPQGLLPGTGGRRQAATG

SEQ ID NO: 928939 - protein, 205 aa, Homo sapiens
MLKGACLLISRRQLRTMCINMVHHKMHIILLSPDVDILPHGQALKGACPKPPNCKQPIDCFVVTPILSIWCQYPFAPSALTITGDGLKETHPQDCWIPSRLTPIPGTHNDPECHCDCSRRPTDDDYFSDRRRWKPLVLHTCLNILIRVNSKFMEELERLLPSSRFKGSRSSDSCDSPVHLFNAASRQQGNNCLSSNSRTKQEAHQ

SEQ ID NO: 928940 - protein, 145 aa, Homo sapiens
MVNLQGLGLNRGIPGRQAAPQEPEWSEGSEERHEEGGRWEGCERGTGGRGKVSQPRAELSQQEFAAQPGLGASLQLRAFGTAWPPPPVPTLALPFGTPEVLALGFHLPLLCDPATGKRPQVSFCSSAAYGVHSDPPKRQLCCRGW

SEQ ID NO: 928941 - protein, 358 aa, Homo sapiens
MPSDKTIGGGDDSFNMFFSEIGAGKHVPRAVFVDLEPTVVDRSSGTGWQLSWESGRALVKPHVRSCEVHTGTYRQLFHPEQLISGKEDAANNYSRGHYTIGKETLSWTGSTNCFGGGTVSGFMSLLMERLSVDYGKKSKLEFAICPAPHVSMAVMEPCNSILTTYTTLEHSDCAFMVDMSVQPGHRKAYHEQLSVAEIASAHFEPANQMVKCDPHHGKYIACCMLYRGDVVPKDVSGAIATIKSKRTIYFTDRFLALLWQVGINYQPLTVVPGGNLTKLQWAMWMLSNITAITKAWACLDHKFDLMYAKQAFVQWYMGEGMEEGESSEARKDLAALEKDYEEVGMDSVEAEAEEGKEY

SEQ ID NO: 928942 - protein, 137 aa, Homo sapiens
MYNIVYDITDVLDGIDLVEKKSKNHIRWIGSDLSNFGAVPQQKKLQEELADLPAMEDALDELIKDCAQQLFELTDDKENERLAYVTYQDIHSIQAFHEQIVIAVKAPAETRLDVPAPREDSITVHIRSTNGPIDVYL

SEQ ID NO: 928943 - protein, 547 aa, Homo sapiens
MGNLCGCIQGDSKKPSKKHVKRKPYSTTKVTSGSTFNENTRRYAVHTNQCRRPHGSRVKKKRYPQEDDFHHTVFSNLERLDKLQPTLEASEESLVHKDRGDGERPVNARVVQVAPLRLESTPHEDTVHDITNEDATHDIANEDTVHDIANEAADKGIANEDAAHGIANEYAAHGIASEDAAHGIASEDAAQGIASEDAAQGIANEDTIQGIAKEYAVHGIANEDAAQGIANEDAAQGIANEDAAQGIAKEDAAQGIANEGAAQGIAKEDAAQGIANEAADKGIANEDAAHGIANEDAAHGIASEDAAHGIASEDAAHGIASEDAAQGIANEDAIQGIAKEYAVHGIANEDAAQGIANEDAAQGIANEDAAQGIAKEDAAQGIAKEDAAQGIANEGAAQGIAKEDAAHGIANEDAAQGIANEDAAHGIASEDAAHGIASEDAVQGIDKEDAAQGIANEDAAQGIANEDAAQGIAKEDAAHGIANELYTTSLTRTPYKPSLTSTLYTTSLMRALYKTSPMRALYTTLLMAPTRHANVDAVHDIANEDSV

SEQ ID NO: 928944 - protein, 137 aa, Homo sapiens
MQTGHEPVLVHGLGVGDHWPTVFSTVTCCTENLQSPQAHKIQPSQYFSSMPAALPNKRILNFLQKHLLGFLWDTVRNCRHRSIIITAATTGDGYRHQKRKSTSPLLRQCDFQSAPLVARCDTPLNNGKKWKHQEIDP

SEQ ID NO: 928945 - protein, 796 aa, Homo sapiens
MHKELPALAACGLVADFDPVGEEETADFGPLVLDSDSDDSVDRDIEEAIQEYLKRGPAMHSLPGLQAEAVDVSGNWLTAVPNCPVFPKTCTWLRWCGPGSQVGSSKDQGSASPVSMSRADSFEQSIRAEIEQFLNEKRQHETQKCDGSVEKKPDTHENSAKSLSKSHQEPATKVVHRQGLMGVQKEFAFCRPPPVSKDKRAAQKPQVQGHDHDHAGEGGQHKASNPHRPSEAVQNKSGIKRNASTARRGKRVTSAVQAPEASDSSSDDGIEEAIQLYQVQKTHKEADGDPPQRVQLQEERAPAPPAHSTSSATKSALPETHRKTPSKKKPVPTKTTDPGPGDLDADHSPKIPKETKAPPPTSPASRSKFVEWSSCQADTSAELIPLFYSPNVPSRSDGDSSSVDSDDSIEQEIWTFLALKVQSRSLLARGESCPQAAQGPLSPPGLSSQTGSPKAPLSKTLDPLLAAKGSIEAAAKAQPARPRDGRAPLGWDLSIQGTASEAPGGEGAARVPGDTRTSQGQGPGHSHQGLVKVQVKAQEEVQGAQGCVQEEGQVQHLPDALPGAAGQAPERVEKQAPAGAEELPKSKRDSCEGSRKKPPSVFGSRAERTKPRPSCLGSLSDNSSSVDSDDSIELEIRKFLVEKAKESGSEGPTRGLPSLPLAGFSPLLSTQLFHFGKGVSWGGRETGLFSPYLGLPLQGLSFSAFRESQARPSPVFGSPHLLAKKDCGHRPSRKDQDTLGRDTSDFSNTSAEVLLLQWRQLSSEGIRPRAVGSRPGFHAFVESGIADVTGSPSQNN

SEQ ID NO: 928946 - protein, 159 aa, Homo sapiens
MAPDISGNLSNTEWLMWNGADAVPTLSENSPSGQRDVSLDKRSDGIFTNTVTENLLETPLEKQSAAEGLKTLTILPACWSSKEEFISPDLRVSKSDSTFHNQASVETLCLSPSFKIFDRVKEIVINKAYQKPAQSSIQMDDKILKTTTRVGKVPLLLKG

SEQ ID NO: 928947 - protein, 136 aa, Homo sapiens
MRECTDASYDGQGKIIPRPLGGVSGPWRSLVLGHAGLFSGPLVLYSGTGCSGVISRLPAVECSGGYSSGGSGWWEPVPNSIPPLLLMFLLSSELSLNLPTRLPLPTCHCPCLSFSDLSHHHPLVCYVLATTASLQF

SEQ ID NO: 928948 - protein, 146 aa, Homo sapiens
MKSSCLLQGTVIWYPQFWLLRQVKNFVKNYSDAEIKVREATSNDPWGPSSSLMLDISDLTFNTISLSEIMNMLWHRLNDHGKNWRHVYKSLTLMDYLIKNGSKKVIQHCREGFCNLQTLKDFQHIDEAGKDQAIALNMGVCRVFLS

SEQ ID NO: 928949 - protein, 136 aa, Homo sapiens
MVSFNVRFMFYISPQSYTNGRRQVKNFVKNYSDAEIKVREATSNDPWGPSSSLMLDISDLTFNTISLSEIMNMLWHRLNDHGKNWRHVYKSLTLMDYLIKNGSKKVIQHCREGFCNLQTLKDFQHIDEAGKDQGQF

SEQ ID NO: 928950 - protein, 292 aa, Homo sapiens
MGKLVLEEVAGVQLTMDDDIAALVVDNSSGMCKAGFAGDDVPWAIFPSIVGCTRHQLHVAPEEHPVLLTEAPLNPKANCEKMTQIMFETFNTPAMYVAIQAMLSLYASVRTAHVQGLHTTAEREIVRDIKKLCYVALDFEREMAMVASSSSLEKSYKLLDGQVITIGNERFHCPEALFQPSFLGMESCGIHKTTFNYIMKCDVDICKDLYTNTVLSGGTTMYPGITNRMQKKITALAPSMMKIKIIAPPERKYSVWISGSILASLSTFQQMWISKQKYDQSGPSIVHATKPS

SEQ ID NO: 928951 - protein, 776 aa, Homo sapiens
MPQWVMPRALERKASWRRCQGSDEEKYGKGDRRKECSGEEAALAKAGSLPGSAPLSPRCPQLTQRLDLQGNLLKVIPAAAFQGVPHLTHLDLRHCEVELVAEGAFRGLGRLLLLNLASNHLRELPQEALDGLGSLRRLELEGNALEELRPGTFGALGALATLNLAHNALVYLPAMAFQGLLRVRWLRLSHNALSVLAPEALAGLPALRRLSLHHNELQALPGPVLSQARGLARLELGHNPLTYAGEEDGLALPGLRELLLDGGALQALGPRAFAHCPRLHTLDLRGNQLDTLPPLQGPGQLRRLRLQGNPLWCGCQARPLLEWLARARVRSDGACQGPRRLRGEALDALRPWDLRCPGDAAQEEEELEERAVAGPRAPPRGPPRGPGEERAVAPCPRACVCVPESRHSSCEGCGLQAVPRGFPSDTQLLDLRRNHFPSVPRAAFPGLGHLVSLHLQHCGIAELEAGALAGLGRLIYLYLSDNQLAGLSAAALEGAPRLGYLYLERNRFLQVPGAALRALPSLFSLHLQDNAVDRLAPGDLGRTRALRWVYLSGNRITEVSLGALGPARELEKLHLDRNQLREVPTGALEGLPALLELQLSGNPLRALRDGAFQPVGRSLQHLFLNSSGLEQELTLGPGNSLQICPGAFSGLGPGLQSLHLQKNQLRALPALPSLSQLELIDLSSNPFHCDCQLLPLHRWLTGLNLRVGATCATPPNARGQRVKAAAAVFEDCPGWAARKAKRTPASRPSARRTPIKGRQCGADKVGHGAGGTRNYR

SEQ ID NO: 928952 - protein, 242 aa, Homo sapiens
MRLASGAPGLLVRSEQAGFGSWEPLAKSLEDRARGHSEGGDSVLIFGRGQSVTHTGLPIMASLANTAISFSCRITYPYTPQFKVFTVSYFHEDLQGQRSPKKPTNCHPGLGTENQSHTLDCQVTLVLPGASATGTYYCSVHWPHSTVRGSGTFILVRDAGYREPPQSPQKLLLFGFTGLLSVLSVVGTALLLWNKVRDQCSQPCSPSTRHATGCPPALCRAFGGPWLLLHPPGTFGAKPGGS

SEQ ID NO: 928953 - protein, 132 aa, Homo sapiens
MFSSARWQAQYLTGSFSILTLLPPSTLKSHMAKIHDVPNGSYRQCHYCRNGDWFFEMFFTLLHSDNLLTPPGSMTTHDSTSPCPPPRGGLRAQGLFPPTSECIPNQSAAPIPYYTLLTPLHSHPPTANQIIH

SEQ ID NO: 928954 - protein, 223 aa, Homo sapiens
MSRIISLPILRNQEFGPNEGPGSHDVGSKTRVGLTPTAFDPNRSKHLSPRGAGSPLRPRAFPSQAQPKATALVIGSRAGPQIREGPSVPRNTAQPLWEVSQSDVTATWYPDGLPLDLQRVCVFRPEREGQQTQGDQSESRSGILLPCTQLIGSRRTNQNPELGFCKQNAEENFVFPVPRRASLSRTEMRSGQEESSGGIGALGLGSSCLSEYSVWNLGNSTSQ

SEQ ID NO: 928955 - protein, 193 aa, Homo sapiens
MELAGALPLLSCKSVTSAATQVVAADLSLPVLLRGKQGAKNFIASGSSGKTCIHTAGEGTWLTISTFHIVFIASHLHLAVIDLVHAKPIKKPAGQQQASTICSSIICRANLHTVFWQFVCICRADYHIPLYTGISNLTNDISVINNICQRGGPASSANLKDLENHELEEQLAELQSGFKELVLSPTWGASPSP

SEQ ID NO: 928956 - protein, 155 aa, Homo sapiens
MSVRVARVAWVRGLGASYRRGASSFPVPPPGAQGVAELLRDATGAEEEAPWAATERRMPGQCSVLLFPGQGSQVVGMGRGLLNYPRVRELYAAARRVLGYDLLELSLHGPQETLDRTVHCQPAIFVASLAAVEKLHHLQPSGHGKGIQSPGLASV

SEQ ID NO: 928957 - protein, 168 aa, Homo sapiens
MAQSQIQLYIKRGCGPVPSSLNHAGSGHTSLLSSKQLVLRLFQEASHLCALAQCPGAWCPWQLRGSVAQSRCLVFTEDAGHGLKPPKRFGSHDFLPSSGAGDVDECQDNNGGCQQICVNAMGSYECQCHSGFFLSDNQHTCIHRSNAGPCVNPAPPLPRWKPSHGRLY

SEQ ID NO: 928958 - protein, 187 aa, Homo sapiens
MGGVGSIPGGSVDVDECSEGTDDCHIDAICQNTPKSYKCLCKPGYKGEGKQCEEASGLPSIITLLTLGHNYLSWSPTELWQSLHHDPVIIIICIITIIIIIIITIIIITIIIIIFITIIITTIITIIIIITTNITITIITITIITTIIIIIITIIITIIIIITIIITITITIIITIIIIIIIITCSH

SEQ ID NO: 928959 - protein, 153 aa, Homo sapiens
MGCLNCYLGFQLGLLPKSLFWGECLPAASEHSSNTLTTNDDDNGRTWVLRAYYVPGLGYSTFLNSYCFLLTQVYKGGGFCHDGHFTDGETEAQKKGPLGQVHIGAYSRVRDGLNSRVWALDHYPAAGWLWELGPPKTGQGRRLQGSGVLASFF

SEQ ID NO: 928960 - protein, 134 aa, Homo sapiens [sequence omitted]

SEQ ID NO: 928961 - protein, 211 aa, Homo sapiens
MVGLVLLGLGLALAVIVLAVVLSRHQAPFDPRPLPTPLLLLTPRSARILDISVASYELTQPSSVSVSPGQTARITCSGDVLAKKYARWFQQKPGQAPVLVIYKDSERPSGIPERFSGSSSGTTVTLTISGAQVEDEADYYCYSAADNNLTVTQADGEMRHKPLAICVTFFLQPQEDCGQSHEQVWPSTPRSETLRPPSFQISTEALQKVDQ

SEQ ID NO: 928962 - protein, 210 aa, Homo sapiens
MVQVPAIAGPENRTEGWKMCSLSPVHKTVPCVHATALTPDLSMLSDRTITRNLAGVTRDHPSSGAHMLCRDHDPGTLGPWDPGTLEPCCPQALLQALLQSYSPQIPSSEASYELTQPPSVSVSPGQTARITCSGDALPKQYAYWYQQKPGQAPVLVIYKDSERPSGIPERFSGSSSGTTVTLTISGVQAEDEADYYCQSADSSDHAHDLV

SEQ ID NO: 928963 - protein, 175 aa, Homo sapiens
MAWALLLLTLLTQGTGSWAQSALTQPPSVSGSPGQSVTISCTGTSSDVGSYNRVSWYQQPPGTAPKLMIYEVSNRPSGVPDRFSGSKSGNTASLTISGLQAEDEADYYCSLYTSSSTFHRGPSSWGTETKTCPGLSGPLLALKMLPRPVQAASCSFVASRKLTPEPAVSVDSQQG

SEQ ID NO: 928964 - protein, 133 aa, Homo sapiens
MAWIPLLLPLLTLCTGSEASYELTQPPSVSVSLGQMARITCSGEALPKKYAYWYQQKPGQFPVLVIYKDSERPSGIPERFSGSSSGTIVTLTISGVQAEDEADYYCLSADSSETAALSLGGPETDNHDHMLWR

SEQ ID NO: 928965 - protein, 140 aa, Homo sapiens
MHPQGELQDGHCPQGSWAQSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTFHSGPSSWGTETKTHPGLSGSLLL

SEQ ID NO: 928966 - protein, 195 aa, Homo sapiens
MSTSPQGHSFQFFCAFSIIHDILFTGLCALPVLTQPPSASALLGASIKLTCTLSSEHSTYTIEWYQQRPGRSPQYIMKVKSDGSHSKGDGIPDRFMGSSSGADRYLTFSNLQSDDEAEYHCGESHTIDGQLIIAMSVNFKNILDVINNRLDYVKQKISKLDHVALENIQNAAHKEKTMTKMKKHYRIFIKKMKYV

SEQ ID NO: 928967 - protein, 146 aa, Homo sapiens
MVGGKTKSTVLQEPGFLGILLVTGCHLSPSLCGGGHQDSDLLPLIHSAGPLKATPLVTLFPPSSEELQANKAMLKENGTLVTKGIETTTPSTQSNNNYAASSYLSLTPEQWKSHRSYSCQGPGAAGSQGRGVPSHPKSSSPSADTQ

SEQ ID NO: 928968 - protein, 166 aa, Homo sapiens
MSTREVCTVILLLLARCSVWHPQSLHRYWISLNVPDYKVQVEETPALELRLAAETSHCLFPFSTGHLVCDLGDAHKGPPGFVFMAGGVTCSHSSFTGCTSVAIVIVPSHYPERCYISFQISLVEMIGPEIGPRWGDPYTRGLGPGSCCISPEFCQEDWYSYVDIKF

SEQ ID NO: 928969 - protein, 157 aa, Homo sapiens
MTLTAKVCSQRDHEPSRRNNNCRRATLRAVTLTAKVCSFTPEPARPRTHQKEETPNTSEHQKEQPADTPLLRTVTLAARVHGFILEVSETKNPPIPDTSDIRAETALVVTCLDDATRPAQNLLLAERSDWRFQHLFILVPAHSRLHAVSCEEWPTPG

SEQ ID NO: 928970 - protein, 116 aa, Homo sapiens
MTLTLNVIMTALRIGPECRGQSTEEVFADITRGFCRSWLFSRQIHRAYPNVVCVCEPNKYPGCSLQIHRAYPNVMCVCAPNKYHLLNLEKSLQNFPVISLKNLEGLKYTVIFSSSY

SEQ ID NO: 928971 - protein, 164 aa, Homo sapiens
MMSMTQNPGAPPALSAYDVACCHSTRRYNSVRTQQVGPHQTPDAGALIRVRTQQEGPHQTPDAGALIRVRAQQEGPHQTPDSGALIHVRAQQEGPHQTPDAGALIRVRAQQEGPHQTPDASALILDFPASRLVHTYSGILFSPKKEGNSDPCYNMGEPRGHDAP

SEQ ID NO: 928972 - protein, 285 aa, Homo sapiens
MAVDALLKREVSRMVEWRVSPFPQRLSLHLDIDYLPDRCTWLSKRRLQLGVAKQNINVRTQQVGPHQTPDAGALIRVRTQQEGPHQTPDAGALIRVRAQQEGPHQTPDSGALIHVRAQQEGPHQTPDAGALIRVRAQQEGPHQTPDASALILDFPASRLGEGPQLLSTCSDEEGVSPQPCSCPAHIWVTLGMTDVQCGWPRMNAGGQEENMNACGWWQGDSSRAFGHSLKFLCQSLALLSLVLRLVMQCRRDGWVQEARGSDPSCPLQKPQFRRSPEREVGVEGS

SEQ ID NO: 928973 - protein, 148 aa, Homo sapiens
MVILVMCFTLSTLIALMFRLHDWILQHNVATKKQDDEFSQIEHNHKTKIQIKKQNTASISESNFIHFWSLAKIKQCFCARCKLSVDPPFWDLEKGVSLLTAPLRSAPVGNLCGGSDPTIPFCTALAEVLPNILGTYIGHIFQEKGVEK

SEQ ID NO: 928974 - protein, 146 aa, Homo sapiens
MASMALEAVSPHPEGCQQREEPPFEESAQGSGLQCAGQNGVLLMGWVPHPGPVPCSGHPGHRPYALSCLLWLSKSGLWWSDRAHQLMSIHHLGDPGDRQDVIGTKDYAAPLPKPCRGSSFSPEMQASVLPGLCKAPDNLTGSLHLL

SEQ ID NO: 928975 - protein, 140 aa, Homo sapiens
MEGRKERIKGGGVSRKRREEMKKGKERDEKKERRGEEKKGEEERRGEDRTGKERKGKERKGKREGRKGGKGKKKERKKMKERKERKKERKKKKKKERKRKKERKRISISDSYITPSPRESINGSSLKKKLIMICDLAETA

SEQ ID NO: 928976 - protein, 126 aa, Homo sapiens
MSLRPSQTTFHSLEVQADNCEHSLQVFTSIRVAPTNPSSRFPRAALDTTHAPASRLPSTPSHQYQASLPKDFSNKPACKPYQTGHRQSLDELTGEELCCRDHSVNAGIVPATSNAQTLINGHKDYE

SEQ ID NO: 928977 - protein, 144 aa, Homo sapiens [sequence omitted]

SEQ ID NO: 928978 - protein, 134 aa, Homo sapiens
MGPTGPLPPAEGLAEDPVTPLCLCDGGQGRELDTRLAAFKASCAIRCRWLWTCALASQSLTVLLESGNASALPGCCREGGDGLCRGPELRGTGTTISCIPITWVMRPPRTPGDGSGRDSCCPVPLRPGGPKVQV

SEQ ID NO: 928979 - protein, 139 aa, Homo sapiens
MPCLLESAFLQGVLVSLFEKDIRNSDFSIQCAHFHWGIITSRTSKLTGIGDEFLNTTPCSGKNTEQQVFTFLAGGNAKWHSHLGRQFGSFLQSQTQAYHTIQQLPSWAHSRDLKTYVNVKTCMQQFIAALLIIVKNMKQ

SEQ ID NO: 928980 - protein, 293 aa, Homo sapiens
MGRNQRRKAENLKNQSSSSPPKECSSSPATEQSWKENDFDELREEGFRRLVITNFSVLKDDVRTHHKEAKNLEERLDEWLTRINSVEKPLNDLMELKTMVQELHDACTSFSSPFDQVEERVSVIEDQMNEMKQEEKFREKRVKRNEQSLQEICDYVKRPNLHLIGVPESDGVNGTKLENTLQDIIQENFPNLARQASIQIQKIQRMPQRYSSRRATPRYIIFRFTKVEMKEKYPGQPERKVRLPKKGSPSDLQWISRQKFYKPAESGGQYSTFLREREFSTQNFISTQTKLHK

SEQ ID NO: 928981 - protein, 133 aa, Homo sapiens
MLLDSGTFLEKGTVSYGGKTGLEKGLCLGHHPPGPLRVEPWRQTEAAPRSSESIRLGWDANSVPLQPVENKAIHIFLNTNDSCRNSKMKNVCASKDTIKKVERQLTESEKIFAHHLYDKRFVSRTYKKTLATQ

SEQ ID NO: 928982 - protein, 120 aa, Homo sapiens
MGKKTPTQLLESERTGESRGGEVAAEEVVKATPKLVPNVMLGEKTKGPAESSIKWHSGILSDSTDVECGRAIPGYVPVSGHFSLPRKTSAAKRVNQVLTAPSLGYMMQKKTRGTHHSVIP

SEQ ID NO: 928983 - protein, 143 aa, Homo sapiens
MPESLTLLLGRDILVHTGASILIAPGQTLCPLLMEANINPEMWATQGRIGQAITARPVQIHLKNPTSFPNQRQYPLKPELGKDTFLRKETREPEYDCEQVIIRTYAAREDLRETPLENPDWTLFTDESSFVEQGIHKAGYAVL

SEQ ID NO: 928984 - protein, 133 aa, Homo sapiens
MRLVLVSSLTEEETKAQRNRVISGRRRFSWGIWQCLGNTLGCLWVKARDATAHPAVHRTVPATKSDVAPNVHSAVLGNPGPRSHRLSSQSLDLNLELSATLFCDHYPRFTCERKRRLQQAPIPPDKAEYWGSF

SEQ ID NO: 928985 - protein, 232 aa, Homo sapiens
MPADHGEALASASVGSHHQKGKPLKKVPTFCRICDLLRFRPETEPPQLTHISRGIKGWALGIRLSKDNEHSPRLVASFSLVAWGCLQVNLEPDIQPSSAPRWPRRLHTELAVLTGSWDPVLDTCWWSRHCAWDVRGQQPRTSGSCRLAGEGWGHFDEVKCEMDKMLRRMREQPRCPQAVGHPAGIRRSPKQEPAVSGFMPPCESHTVQGPGRAWKLSDLATSGQTHLGPPHA

SEQ ID NO: 928986 - protein, 301 aa, Homo sapiens
MFVRSQCLEFLIVHTLAFAAVSYLNFGLSKWVFPSGYEVMVIAIFVGICLTLTDQGLQAYQPNASTLINLMLPYHSLSACDPLHRVFDVLAACEFLGWQLAFGMWTSCLFLWAFSSLERISDMSGSNNAIYDPDSEAISCHFHNIQLATCAITLAMGGGSTEDTSDNGLGPTLLHSDLVLTNDTVSSDQFLTWLVFAAKNFHRDSSVGCLTGDFHPGSAWAPQEDSEIHNNKLSGIWPGPDVGSWLTSPDSGFTWVGEGRAPGNAEMVATEVKAPWVIPGPPPGICKDSRPLWLSGPLLLP

SEQ ID NO: 928987 - protein, 153 aa, Homo sapiens
MRLCCFTPPSWWSLGVGEKIHPQITLSFNYFKFQNEFVFLLEIFETTNIQFSPNIPTSFSIAKASPAMCRTSVSPNLEKYLSLCLSFMTLTFSLEFCRMPLFLSLFDVSSVFNSDYAILVEIPKSHAVFFSVPHGRRPMASTCPVVKLLRITR

SEQ ID NO: 928988 - protein, 174 aa, Homo sapiens
MRFNILHALIKPVTSWFLPCSLQMCLQPSLLCGFAISIRELQILLGMQRKLAQQSLLPSPPSWAASQLAWAKSTCRSDFVQVPGLSLPVSYPHSCLPQLLLPLKTQSQPRYQRREGHGQDTVSLHTVHGFLWRDRKKMLTHARPFQTVAQAPGLCCPPQGHPPCMAQVPEMWPV

SEQ ID NO: 928989 - protein, 137 aa, Homo sapiens [sequence omitted]

SEQ ID NO: 928990 - protein, 188 aa, Homo sapiens
MKIKFMYFNKILKVELLADSLAHNKNSLILAIIINITNTIIITIITITTIITTMITITIVITTIITTTTIIITTMIITTITIITITIIITKIIITIIAIITITIIIITTIIVAIITTITIIITTIIVTIITNITIIVTIITIITITIIITITTITIIIIITIITTIMITIIITNIMIITTLTIITIIS

SEQ ID NO: 928991 - protein, 143 aa, Homo sapiens
MVRAGLAARGCVRDTGGPMDPREATSAVRSFVDEVECFLNPEHCAGHGSFVNYHRRISGNFRRCKMLGAECESPSPAGRGLLGCGKFIARKNDLVKVGSGHSGHLGHNAVAAAFGESYDPRWVSCPTAWHAGSQGFAEGLRRA

SEQ ID NO: 928992 - protein, 241 aa, Homo sapiens
MPCVGKKAQWAEAGRWVRGSECHGGSEGHRGILSQRGQARSHGLEAFRGQPLPVVLLAGGHALGLSFQILIPAKDPWLLLIEEHQSVGIYQFTYKWGAGVTYFNPVNWLSPTATAVTTMKLPWNARASTFIAPLPSKVDEQYSDCGPDHPQAPLHLSAHARALSSFSPGHLQKPQLAQPSPAHGYHSPVCLPHNISPNPRGLFLVVLASLNVSSAGAARGGWSPDLSPCLATVPGPWKSPW

SEQ ID NO: 928993 - protein, 246 aa, Homo sapiens
MKAKLGASPRGEGVGVDFSLVQVQLSGFPPPSWVPTAEVKEVAVDFSWVQVQLSGFPPAKLGTSPRGEGGSWVLTPEAKEAGFDLSWVQVQLSGALPAPRTLTGQPAVSFSSVSCVPTSPGDSHLFGNARPLISHVFVLGCQYTLIKHSRRAAGIQEPPLPIPCARTVPTSCEQRWVTEASLHDFQPRFFICNVVTVPGSVIIHAGARRTVRQQKKGSRYHQQPSEQVLKRSGTLTSLSKDADMFS

SEQ ID NO: 928994 - protein, 251 aa, Homo sapiens
MSVEVPPPVCSCCGVCSNGTLQDTSDLYDALSGSAASVMKTCKTEAPFGQLLVLRHHRESGIHTPILGKEAKELALQLLWAHLSFRRNNACVESSLKNTGFNSWDTMAKFNDLLILDMMVRGEGREGPGPADIGGDGIKGQSIWLHWRLFEEIRHVTPGFPSAISAKARNRDDYLGKICRGAHCLMELIPMESYKGLKNILLAGKLPASLYQRVKRKKAIGPQRFHRHKTSSKCYPAANICFLLFKKKDGF

SEQ ID NO: 928995 - protein, 168 aa, Homo sapiens [sequence omitted]

SEQ ID NO: 928996 - protein, 135 aa, Homo sapiens
MNAQGGGCNVELCSSISQARVDLMNGFEKMQNFLYESTYILTPFAQPDVPVRTQFGKPTLRHSGLGGLIDSCHNLFPGASLSLQPLELSGMLKVYNPGEVIPKQWMVHKSRAPSMHTSGRGKRAQSSYHWTNMMA

SEQ ID NO: 928997 - protein, 136 aa, Homo sapiens
MHLDIKEASEAKLLSFHLIDNSHRAGIIPGLALFLNLISSPSLTSTAYVHVLGQPSSTKQHPPSIWNLMKVAAHSFAVLKNHLGAPDKTFTLWALTGTMGCEPESTSPQRKNDPLNLIKIKNVCFMNKTVNGDKTS

SEQ ID NO: 928998 - protein, 158 aa, Homo sapiens
MSWRYCLFSSCLTNVYRTSATGFRAHQKPRRPSLNYICQDPFPDKDTRHEQICLTRPTLMRIPGSCSGKAELDLLEPGLAPEEVERCVCSHTEPNLSEPRKWAEEQERRFFKPTIPKPLSHGYFSRAAPPEAHGAGDEVLTPSKKLMKVAGESSGAKS

SEQ ID NO: 928999 - protein, 355 aa, Homo sapiens
MAADGTGLCPGTVPGKEDMAADGAGLCSGTVPGKEDAAADGAGLCPGTVPGKEDMAADGAGLCPGTVPGKEDMAADGAGLCSGKGDMAADGTGLCPGTVPGKEDMAADGAGLCSGTVPGKEDAAADGAGLCPGTVPGKEDMAADGAGLCSGAVPGKEDMAADAQALSQARRTQLLMEQVSALLGGVHIPTRGPVSIINKEDTNQIDLPACNKSQRMGFHLVNVGGEWERRTIWITAFPSALVRKGILSTAFGNKHTCHLQVKSATDVVFPGSGGEEDLDSGFILWTTEFCKFVDWEELGHICFAKDRGGRLGEKQLSVDWPGSVGGWRQGCQRPCRFPWEICMALALLPVPLIPP

SEQ ID NO: 929000 - protein, 240 aa, Homo sapiens
MSAGRGGREDRQPWRGSSTLEDNHEDDDGDEDEDDGGDGEDDNNDDDDDDYDNDGEEDEENDGDSGDDENDNEENEDDMVVMDGDGNDGDDDDGDENDDDGDDGEDDNDDDNDDDYDNDDEEDEENEDDMVTMDGDDGDEDDDVGDEDDDDEEEVGDGDDGVNGDGSDGDEDDDVGDEDDDDEEEVGDGDDGDNGDGSDGNDDNEEEDGDDGDDEEVDSLYVTGSENISENADKMVHGCP

SEQ ID NO: 929001 - protein, 154 aa, Homo sapiens
MLQVLGLWGTAGCLILPGKSERRLESSWNLEKHFPFSSIVHLPRVSEEPLLFVLSGKRIFFHIHVHFITVLGTLKGDKGHWDIETSIWEVKLKGFNETIEYPYPTIKYPYLTIKYPYPTVEYPYSTIDYVCPGDIHNSSDQLNSCQVSFMRISC

SEQ ID NO: 929002 - protein, 175 aa, Homo sapiens
MRFLLQNAIAKKNVPNTTHWLTTGFRARGGLSGITNIGMASPVWGSCKGLGGCGLGHHSIRLGEPGDESLSEKCDLFPGAVGAPSLPDEGGDRQEEQDGQEEQDRQKEQDGQKEQDGQKEQDGQKEQDGREEQDRQKEQDQQEEQDREKEQDSQTGGAAFWDPNKQSCPKYPQGS

SEQ ID NO: 929003 - protein, 140 aa, Homo sapiens
MGTSLWRIFENNLSKISGCEHTAETPFDLTFCNCGTTLGSQQEWPSDPWGQCELFPRQVFYRPLQLALETSGCARRNKKHNRPQLLGGSGQIHEKPAGKTWLSVALRLPAGSPQRLLQHRPPAIPILANFSLCPSVSACN

SEQ ID NO: 929004 - protein, 138 aa, Homo sapiens
MHQLRRNARCGEGQNKPQTELTNRSGMARAAEKAGGGRVLPGVLSSLAGLCSPLKGEPLQAEKEQLPPAPAVSLQGWPRLYRDCQSLAAANSRPGSSWSPEDALKTVALAPVLRGLGSKANCALYCPQGTVQPLYPIS

SEQ ID NO: 929005 - protein, 214 aa, Homo sapiens
MERPGSVVLPGGLGPFFSESVGFRPYFPSFQICLHLVFHAVSALQGWKASGSLPVGSNRYIEGQSHSGRRPFQLSGKRAKLPHYILKAECCAAATDFMLNAGMRRPSQGTPSLLPAPLSSVCFGELLFTNTTWLLGPGRLIPLFWDFRMANGSLDGCKTEGPGGRPLLHRKPSKYNEPRVASVKHNAGILGANSLVLGGGPHMLAEGMNEQMNE

SEQ ID NO: 929006 - protein, 165 aa, Homo sapiens
MDRRGSTQGTIDPGDNRPRVQQTQDAIDPGYNRPRTQETQGTTNPGDNRPRVQQTQDAIDPGYNRPRTQETQGTTNPGDNRPRVQHTQDAIDPGYNRPRTQETQGTTNPGDNRPTVQQTQDAIDPGYNRPRTQETQGTTNPGDNQPRVPQTQETTDLGHSRTRMQ

SEQ ID NO: 929007 - protein, 182 aa, Homo sapiens
MVSAHHCRQQYACAGLMDREGEAWKAEPGSGAWRLGDDINGQWKMRLEKDDIRGKITTLRWSQGPQGEGEAQGTPSMSLDTQASEPSNFLRDRKWDSEKSQCHLWPPPRQLYSFFVLQLESTRACSDMHTSMPSMPNTLIISENHLQSSPYLIVLPSLTLVILQTVGSPNPDEVHTFGFYAS

SEQ ID NO: 929008 - protein, 133 aa, Homo sapiens
MEMTAVSSGPEVSCSVMAGGFHEQQRGSPQILIFNRAGGDKRPPAPQEMFRDADARGGRGGLQVGWGMCLGSSHLGQGKQQPAEAELGFPGFHPGDPPPPTALVLGSRLQPTGPFYFPPAPVLQWEMNSNTPL

SEQ ID NO: 929009 - protein, 152 aa, Homo sapiens
MAAGDRVLRGISGEGGCSLMEDVGSQLIPVAFPDSHSDNVVDLEAAKDMGSVAATIKAHGVHSIPVSTMVPPHQSNLSAPDLGCVHGARGSHCALPWAQSAVVALLILADTGAGLVKWALPCCICPAFRSTLDGFCLLVKANIMTSSLPRGL

SEQ ID NO: 929010 - protein, 320 aa, Homo sapiens
MLGPGCFSLRQIATAANSSAATNSYGKYQTHRRVCQSLRVPASCKVEDLSKEERSKEECEGHSTLAAAGQRGSPGPSAGPAGGLLKEGTHQTGALGPQRLPSSFTQNKSGNNSNILIDVRSQRYRQQSAFTPVVMRRPCQPELCRYPCWSRICNEIPHPRSGQLAAGTCEIVTLDRDSSQPRRTIARQTARCACRKGQIAGTTRARPACVDGAWTCRLPSGGSGRSQHFWRLPEAMGDWVYSHILSQVVGPGHPGPLMAWGSTAQGEGEETPAFTGTTPAQTPWLLLEQTVSEGAGRMQSGQQPSLFCGKSFCVLQSLEK

SEQ ID NO: 929011 - protein, 242 aa, Homo sapiens
MPHIFLRRKMKEAGERRPGEKNQNCRLFLGPAGPACASARRDFLDLVTRRQRTSQNAGTQAWGEGPSTGLKSGAREEAASVPDSPLGQASCLRRAGLQPSVAAGAASSSSSSEDSRANATVGGGWARPGSHRLRIADARCRPPPMCLSPASSGRLDRPKLRMPRPEAVLHGPQGNGVGGRQRTGEVRGEWRTVAETWALQGAKATPGAPQGLCLSGDLRSKERERPRLPNGAVGLEPTLNRT

SEQ ID NO: 929012 - protein, 197 aa, Homo sapiens
MHSFWIRVVPKSKDWCRYTKRKIWKISLLEGGVMTETEIGVVQPHAKKGLQPPGAVRGRKILPTAFSESKALPVAGHRTSGVRSSGLWKAEAFDKPTSWRGECPTIPTLVPKSGIIVLFNLCQFAKQRKTGLPLGYTVLRMQDGGSARSQLQEICISKGNSAPDQIIKDCNLNSWELSAGAFKAKPTINKYGGQQLG

SEQ ID NO: 929013 - protein, 178 aa, Homo sapiens
MVVPKILLTALGPSQHPHPKGETKATHPVPCVAPSPGSPPWPSPSKGKSLEVGRPDEQVLAKAWEEMVSPDYDQNLQVGGTARQLIIALTCRDEEEGRAAGYKLISFAPQQLQIIPGASAQIPSLGLMMPVLDTQVPVATCGTRHKEWTLNHNECKGQRHLTLHPARILWWPWVLLGL

SEQ ID NO: 929014 - protein, 443 aa, Homo sapiens
MRQLSGLKDVNIPNQVCREGLRTPGSRDSRSEKTQVSGLGDVNNPNQVCREGLWTPGAGTGGLRRDREGLRTPGPRDRRSEKRQVSGLGDVNIPNQVCSQGLRTPDHRDRRSEMGQVSGLKDVNIPNQVCREGLRTPDPRDRRSEQRHVRGLKDVNIPNQVCREGLRTPGPRDRRSEKRQVSGLGDVNIPNQVCREGLRTPGPRDRSSEKRQVSGLGDVNIPNQVCREGLRTPGPRDRRSKMRQVSGLGDVNIPNQVCREGLQTPDRRDRRSEKRQAPGSRDTRSEKREVSGLKDVNIPNQVCREGLWTPGPRDRRFNKRQACPCGSRFLDLMARLLLADLVLGTPEVQEAARHRGGCSSHGAGWRAWGWAVSTGAELHTGGPEPHLWVSFCVSLGSTDSAVSPRDIGKGSISSWGPIHRFQATVMGIGSRHGGMAPTLAVSP

SEQ ID NO: 929015 - protein, 136 aa, Homo sapiens
MPPPSGTVVLSGAFTAESPTILALGIGFLEDDISTDGRPRLCCAHEFPGDATTKYNKLGWAQAGVKSILSLSWGLKPETKVGCTPCRGSREDLSCPLALLAVAVTLGANLSTSIFTVPRCLLLCVHRSSKDTSHWT

SEQ ID NO: 929016 - protein, 291 aa, Homo sapiens
MLLQPETEARGNVFAHLPQLPGADLRQSSRLLVADGDQVSALSLRDLLSTCEARTGNLGVPVIFRFEPESQLAEQSPRPTYQQQSQVGGKAKAKAADPEALVPSIHAVNRQPASGAPTLSTGSQPLGHPHCQQAASLWGTGREAVGAPACAPPWQAPEGTHCTPGWRKGTLGKPMSPAVSGSLSPVYFPILCGAQRKTQVKASATWQDTAELVPTVGRDWHNTSPLCRVPMEHPHHRRKSPLFSPRGKVENSSSPTGLSLSGQLQHPQSGRAQLFPAHRLHPTVCQQTPSC

SEQ ID NO: 929017 - protein, 232 aa, Homo sapiens
MALGSAFHSILDNEFFFQCGLALVVNVVAPAAKTEGANAGTRKQGGRPGSRPPSCESSEDSRFFPLHISQDLAKGSEWKTGKCHIGRMSDMGISPSLGKVANVTILHIGEKCRFCGADGAVNSGRCRVTTEFRNTDGDGVRAMENQLMGARLSVTSAGNGKWEKGSAFHLAPGADGSCGSPAPSCGGRILPGNNKMQPDLIPQPNIKAPARKHYQEIRGETLGSGHFSFQGT

SEQ ID NO: 929018 - protein, 131 aa, Homo sapiens
MISIIITIIIITTTIIITVTMITITTTIITMITITITIIITIIILTMIITIITVITIIITITITMITITITIIITTISSSTIITMITIIITIITVIITITITFITVTTTIITITINTNNIIIVFQLGSSDH

SEQ ID NO: 929019 - protein, 325 aa, Homo sapiens
MKGRYAARPPPALSSLHLFQRTMCSAVCQSWQRTLLLCKPPNPEPTVHLPPVAEPTPGPCPHHQGQEATGKVLPQLPQLPLPVATPEPPDVALPGVGASFSGSGSVGRGFPGLLTSGSSVVDITWGLRPRCAVMLALPGDTGMSLPLQASPPGSVLLGCGPDTPHPAPELSGKPGGLRTGSAVAEHRQVSKLPVGLTRTLPGSGPHVAPCAPSLGSKAWTTDAEQFDCLIMPRASISPAADMTTSAQYFSEKGKLKPKPGFVVSLTHPTRGLPGKPDAFVSLGRGEDFSSMVTEDECLCYEVLGTCTNSGSELSPPGPHGQAGPW

SEQ ID NO: 929020 - protein, 125 aa, Homo sapiens
MWVPQPIWSSERGRRRDVCSRLREKGKTQAGASGNCDTPARACGRPCTDAVSVKFECESWGPPHQASIRVAGAAALRGIVRVDRGKQHSLRGPSRLEDAKVTTTSGETATAVGAAKRGAGDRRVP

SEQ ID NO: 929021 - protein, 234 aa, Homo sapiens
MKGDVRETFVATEGLPCILMVWLLKTHNRTYMKKAAACDHGGKKCWEKPSSVARGGTGMEWMALKGGQDAWYCSMDGMDGTGVCMGWMELGCGRDGLHWGVDGMDGTGVWTRWMELECGREGWNWNVDEGMELECGRDGLHWGVDGMDRTGLWKGWIALECGRNGWNWSADGMDGTGMWTNGWNWSVDRMDCTGVWMGWMELGCGRDGWNWSVDSMDGTGALPWMMRNLSRYRG

SEQ ID NO: 929022 - protein, 165 aa, Homo sapiens
MKISFKFNKNLSSPSESVQEVWMPTLHGLPCVRSQAGLWLQGPLLITQMSPNQFSVAPQMGPWSPALSRGPASPTLSPARHQESWKATHPQIMAATAMRAVGFPGLEETMPLQALAHKPQSEEEPMDFTTSGSPGLMSTTTDTEWQMASMEAQPQDPTGDSWTLV

SEQ ID NO: 929023 - protein, 157 aa, Homo sapiens
MGQGCLLPRAPSWNPALASPRWSIAAPLWPPLTLIGHPHPAILLPRCLARIGDLYQNLDKRVLWSLLPWPWGLTHTSILLTQRCCSLNSSYCMPGAAWLLNKATNRRDEEWNCWSHFNAMFNILKTCRIVFQSGFTLLHLTNSVRGFPFLYILTKRY

SEQ ID NO: 929024 - protein, 247 aa, Homo sapiens
MFPVLRPQGYSSSWSPVSLTLCLVHSGLNPPGIHVNVLDQLAFTPIPQPQLKCVHQIPGKAWLDWAQSGTEPGGLQTGLAPCTHYIHPSRVFLQVPGYICAAAVSGPPPSCLASPLCACAHGLSRDRDSQPDFLESTSLLDFLEGQVLALVACMLPGPGSSEAGEQLEYKLNPECSGNRGEFQAAVTLQPRLLCVSRTFHTSCVLGCHLRWEPRKPGSVYRCPFHGALSCRRVRVKQPQSITVYEIE

SEQ ID NO: 929025 - protein, 139 aa, Homo sapiens
MAFSATSLVEVLPKAASVSDFWNGGYLERKSTVLQHQEEQKSSLIIMSWRLNMKLDENQSWGVVVSSNTERGKHSRGKSLLQLRKASVVETCLLMRKLIPEEAQCRAPRHRGTQTDKQMVRDKPGGNSWIKEMLAPGGS

SEQ ID NO: 929026 - protein, 148 aa, Homo sapiens
MCSGLTQGASPTVPPLLISWASFWFFGTWTLASLPVSTLQPQSQPCSLPLASLCLHRSPMDWFCFLCASPSVGKGVLPQRELGTKWTWRRTSFTEATFLSPEGAQHRHSGSYILGVGSKDFTDRTPLSNQARMLRWSHAITLTPYLYF

SEQ ID NO: 929027 - protein, 238 aa, Homo sapiens
MSAVLEKWAEQAKGTGEGDSGSADASRVQRGPCELLHYTDASRVQRGPCELLHYTDASRVQRAPCKLLHYTNASRVQRAPCEILHYINASRVQRRPCELLHYTDASRVQRGPCEILYDTNASRVQRGLCEILHYTNASRVQREPCEILHYTGCRQVPCELLYDTNASRVQRGLCEILHYTNASRMQRRPWSFSIILMPPGPREGPAISSIIPMPPGVSLSMWSGEDSRGRIAETLYHS

SEQ ID NO: 929028 - protein, 144 aa, Homo sapiens
MWQMLHQIHRWWVCAGFTASAIGRVFLLLVSLCFHGKQAKEAAITWPGGSECQEGEGGEGLMTWPGGSESQEGEGGEGRNRALSPNHPFEEQVVESTKVRVDSAPPKTFRLWHLSPAHDSQVPVHGLRPLREAPLQQASDVPLS

SEQ ID NO: 929029 - protein, 137 aa, Homo sapiens
MTSHWVALLEAAPAYDQTASALEGSCPECRLPGRPRAGKGRAVGRVQKSQTQPKEGGPECLSDDHVGIARRNTQGGGSWQVGSGDGSFICRQRERPGARSPSTPGLQRPGTLKTGSHEEGYQLPGRGVLFPYGLPFS

SEQ ID NO: 929030 - protein, 176 aa, Homo sapiens
MHLTFSTQYAKIPASDMHRMHLTFSIRYAKIPASDMHRMHLTFSIRYAKIPASNTHRMHLTFSTQYAKILASNTHRMHLAFASSESLGVSSPSLESSLHLVKSESPLTPPPSTSLYPTWSQSKICSHFRKPNHLDTWGVDGDDLQGVDSPGRLRAVLSQHQMQQAPRSELGYGSAL

SEQ ID NO: 929031 - protein, 250 aa, Homo sapiens
MIHSCEDAILDPPFLPLLPISVGTFLGLAVRHVASIGTGHRLLSHAGLSGECDTVFTPMTVKTSGAEDLFCARCTSDTLSVKCLFQISQFSVDPSFFVSLVCMSLLCVGCNLLDEQVLFIILFSSTSTVGYKWHREDRFSRGFVPGRCHGSETARKERQALQRQRPAPDRTWEEGAQTRCWWEKETVLARWKTCGSYPATLTYVLYDSAQSWGAQPTERPAHSLKDAHRDVTALLFLTTEKGNGRNTRLW

SEQ ID NO: 929032 - protein, 157 aa, Homo sapiens [sequence omitted]

SEQ ID NO: 929033 - protein, 129 aa, Homo sapiens
MVSNSGEGTGSPPSPAWQVCRRARAHISLWCPGRLSSASPAFPLRPPSLLNLSRRHIELRGPWKLLGLCSVCYYLETFHNRLLLNKQEDLAIFHPHSHRDTGLKLSCSRSSGQGHAEENVFQVPSTSYK

SEQ ID NO: 929034 - protein, 221 aa, Homo sapiens
MIITTIMTITTIIFTITTIIITIITLIITTITIIIPITIITTIASVITIIIITIITSIITLTIITIIITTITIITITITITMIITITITITTMNHHHHDHHHNHITIIITIITITIITIIITIITIIIITFIIIITVIITTITITIIIIPIIITTITIVIIITITIIITITIIIITITMTIITVMIITIIYHHYHQIMNYLLLSVDNYHRTRFLYLGTIDI

SEQ ID NO: 929035 - protein, 157 aa, Homo sapiens
MVKQRPEKTLHKSNENIDKICPSQLFQNIGGSPKACSCSGSIQEKQLNLENCHSVTCPAALWEGLAGRACPDSICSELVVPRACADDGMRPHWELLGIGGVPIHNHTSIGPSIQNMSRALIDPVMYVESTSRKLFCKYDSSAVADVCSHMGWLTLSP

SEQ ID NO: 929036 - protein, 144 aa, Homo sapiens
MTKWGFSQENEAPRTCRVGYMFLQAGLPQSCSVGYMFLQAGLPQSCSVRYMFLQAGLPQSCSVGYMFLQAGLPQSCSVGYMFLQAGLPQSCSVGYMFLQAGLPQSCSVGYMFLQAGLPQSCSVEPLQGLVPNAVVETESLHPVR

SEQ ID NO: 929037 - protein, 145 aa, Homo sapiens
MPCMFFCSGVPLENAGSVYVQVSFFLVTGVPRLRRLTTCVLQKLLCGDSDQRRCHSDPAMMLQDRTHGANAWAPGTGQRPQAGCPRGAPGLPEQRPQCPQQPLHRSGLCICLHKAIFPGTCFLSVSPPLPIWTRVIGLRAYPAPV

SEQ ID NO: 929038 - protein, 215 aa, Homo sapiens
MLPLLRDGSERDSECLPVYLEMRAGEDSQVLGLSNRPPMAPPRASQCPEPQQCPSDSRLVACPHLGGGLPGLPRAPPMEQLRHPACDPRSSAFLELSVGPRGWRLRPAAPTLLTALHGEPLAYLGDAQPSGPGVRTAALTEKWIPEEACKGPWGVGVQPLATLIGFECVELPVLDISCEWNHTVPVLLYLTSHTWCNGLQRVGCIRCQSFTSPRG

SEQ ID NO: 929039 - protein, 154 aa, Homo sapiens
MSCFRHLCEEADTRCGVDEVSRRMSHVSGGGPIDLSDTDSLQAWINMTSFLCALGGVCLQQRRNSGLATYSPPMGPVSEHKGSMISVMSSEGNADTPVSKYMDQLLSLMVCKLEKVGLQIRTNGKDLVGLELSPALYLMLFNKLKRRISKFFDS

SEQ ID NO: 929040 - protein, 143 aa, Homo sapiens
MMPTDFSKLCLGSAVNGVVHFWTLGPTPGVCQGLSGLWPQTEGCPYNGFIFDWLHLAINPEEEEEEEEEEEEEEEGKGKRKKMKKEEGEGGQGGETTSESNWARRTLIWKQNTESSLGVISSITASSNHVKSSQSEKNSSSIC

SEQ ID NO: 929041 - protein, 2994 aa, Homo sapiens
MKQTVLDIPYSKGSKLTQQPCSGIRCEGQTLRNQQQRSGILENSSSVMESSVRDKHSEPSSSVLESFVIDKHSETRSSVVESYVRDRQNVAAVFSNPISSDLESYMKDKHSETSSTVLESHVREKHSQSSSSVLESYVRDKHSEPISSVLESFLRHKHSEISSSVVESYVRDKHSEPSSSVLESHVRNKHSEARSSVLESYVSDKHSEPSSSVLESFVRHKHSETSSSVLESYVRDKHSEPSSSVLESHVRNKHSEPSSSVLESHVRDKHSEARSSVAESYVSDKHSKSKSSVLESFVRDKPSDPQSTVLEYYVREKHSETSGKPSSSVLEYHVRYKHAEPSSRVRESFVRDKPSDPQRSDLESHMRAKHFEPSRRVLQCIVMEKHSDQSFVRDKDSEPISSVLESCVRDKHSEPSHCVLESHLRDKHSDTRRSVLEYYVRDKHTEHSSSLLESHVRDKHAEPSSRVLKSYVSEKQSEPRSSFLESFERDKPSDPRRSDLESEGQNLRTQQQCSGIPRERKTLTTQQQCSGSLYEGQILKLTKSVLEYYVMEKHSESSNSVLESLVMGRHSDPRSRVLDSYEQCCGVLCEDKHSEPSGSDLEIYVRDKHSETSHCVLVSYMRDKHSDTRRGVLESYVRDKDSETNSCALETFVRDKHTDLSSSILESFVREKHCDPPSSVLESYVRDKNSGPSSSVPDSYVRDKHSETSSSAQESFVRNKHTELSSSVLESYVRDKHSVHLKSILKSYVRDKHSQPSNSFLESYVSDIHSDPSSSVLESYVRNKHSEPSSSVLEYFVRDKCSEPSSSVLESFVRDKRSEPSSSVLESFVRDKHTEAISSVLESFVRDKHSEPSSSVLESHVRDKHSEPSSRVLESYVGEKQSDPKPNSRVLESYVRDKHSEPRNSVPESSVREKHSEPSSSVLETYVSDKNLEHSSSVLESFGKTLRPSNSVLESCVRDKHSEPCSSVLETHVTDKHSGPSSSVPESFVRNKHTETSSSVLEPWVRDKHSERRSSVLESFVREKLSESSSSVLEYFLRDKHSEVRSSVLESYKCCGIVCEGQHSEPSSSVLETYVSDKHLEHSSSVLESFFEGQTFVPSKQCSGILSEGHTLRNEEQSSGIPCEGQTLRTQQKQVSGILCEGQTPRPSSSVLESYVRDKHSEPSSSALESYVSDKHSEPSSSVLKSFVRDKHSEPNISVLESYVREKHSEPSSSVLESFVRDKHSELSSSVLESFVRDKHSEPNSSILESYGQHSEPNSSVLESLVRDKHSEPRSFVLVSQVRDKHSHPSSSVLESLVMDKHSEPRRSVLESYVRYKPSDPRSSVLECYVTDKQSEPSSRVLYVMESYVRDQPSEPSSSVLDSFLRHKHSEPRSSVLESYMRDKHPEPSSGVLESFVREKLSDPQSSVLESYVTEKHSKPSSRVLVSYMRGKHSDHHSSVLESYVRDKHSDPRSCVLQSYEREKHSEPSSSVLESFVTDKHSDPCSSVLESYVRDKYSNLHISVLDFYVRVIHSEPSSSVLESYLRDVLESYERDKQSEPSSSIPEYFLRDKHSEPSSSVLESYVWDKLSYPSSSVPDCYQCSGIRCEAHSEPRKIVLESYVSDRNSEPSSSVLESFVRDKHSEPRRSFLEYYVRVNTKNPGADKHSEPSSSVLESYLIGKDTEPISSVLENQQQSSGILCEGEILRIHQCVLESIVKDTHSDPPRSVLESYGQTETNRSVLESFVKDKHAEPRSSVLEFYVRDKHSVSSHSVLESYLRANIPNLVTVFWNPIEKHSEPRSSVLESYVREKHSDPRSCDLESYLRDKHSEPSSSVLESFRRENIHTLITVFWNPMDKHSEPSSSVLESYESDKHSEPISSVLESFVRDKHSEPSIIVLESFVRVKHSEPGNSVLESYNAAAVFWNPMCVTNFQNIVAVLWISMSWTNTQMAVRDKHSETNSSVLESYVMDKHTESSSSVLESFVRDKHSELSRSVLEYFVRDKHSEPRNTVLESYVRGKHSKSNHCVLECYLRLNIQNLGEVFWNPNVLQCFVREKHSDSRSSVLESFLRNKHSQPSSSVPVSFGWEKHSQAHNSVLESYLRNKNSEPSSSALESYMGDRHSESNSSLVESHVRDKLSELHSSVLEFYVTDKHSESSSSVLESNVRDKHSEPSSSVLESFKQCSGVIWKGKISHPRNHVLESHAREKHSDPRSIVLESNMREKHSEPSSSVLEAFVRDKLSDPRSTVLESHVRDKHSEPSSSDLESYMRENHSEHSSSVLESYVSDKLSELRSSILEFYVRDKHSEASSKHSSSVLESYVSDKLSELRSSILEFYVRDKHSEASSSVLEYYVCYKHSEPTSSVLESYMRDTPSEPSSSILESFVRDKHSEPSSSVLESFCSGIPCEGQVLRTQQQCSGILCEVQQSEPSSCALESYVRDKHSKPSSRVLVSHVRDKHSESSSSVLESFVIDKHSDSRRCVLDSYVRDKPSETSSSVLESYVSEKQSEPSSSVLVSFMRNKISDPRRSVLESYVREKHSDPSSSVLQSFWVLECYLRDKLSDNRRRVLESYVWDKNSEPNSSARESFVRDKHTEPRSRLLESYVSDKLSETSNSVLECYVTDKHSDPAAVFWNPVDKPADPRSSVLESYVRDNHSEHSGWVRESNVRDKSSKPSSSVPESCVRDKHSEPSHCVLEYYLRNKFQTLVEVFWNPISVLKSYVRDKHSEPSSSVLESFVMDKHSDRPRSVLKSYVRDKHSEPSSSVLESFVMDKHSDRPRSVLESYVRDKLSEPSSSVLESYVRDKHSENGSSVLESCVIEKDSEIRNSVLESHVRAKHSEPCSSVLESYVREKHSQPSSSVLKSSVLDSYVREKHSEPNISILEFHVSDKHSEPSISVLESYVGDKHSEPSSSVLEPYMRIRSSVLESHVRDKHSEPSRSVLESYVRDKQSETSSSVLESYVRDKHSDTHRIVLESYVIEKHAEASSCALESFQRKNKQNQPQCCAIICVGKTFRHS

SEQ ID NO: 929042 - protein, 2979 aa, Homo sapiens
MDKHSEPTSSVLESHVRDKHSEPSSRGLESYVRDKHSEPSSSVLESCVSDKDSELSSSVLESQVRDKHSEPSGSVVESYVGDKHSEPSRSVLESYRRDKQSEPSRCFLESYQRDKHSGTHISVPESYVLEKHPETSSCVLESFVRINKQSQQQCSGIVYPRSSVLESYVRDKLSKPSNSVLESYVRNKSTEHSSSVLQSYVSDKYSKLNSSVLESYVKDKHSKHSHCVLESYLRDKHSDTRRSVLESYPCSGSYVSDKHSEPNSSVLESYVSDKHSEPSSSLLEYHVRDKHSETSSSFPESYVSDKHSEGSSSCLESFESFVREKHTESSSCVLETYVREKHSVPPRSVRESYVRDRQSEPSSRVLEFYMRDKHSECNSSVLESYVLDKYSEDSTIFLESYVRYKHSEHSSILPEYYVGDKHSEPISRILESYVRDNTQNPAAVFWNSKTQSSVPESYVRDTPSEPSNSVLKSYVRDKHSERRSSIWESHVENKHSEPSHCVQESFLRDKQSETSSSAQESFVRYKHTEPSSSVLESYVRDKHTEPPSSVLESYVVLESYVSDKHSEPSSSVLESHVRDNHADPSSSFLESYVRVKHSEASSSALESFVRDKQTGSSVLESSMRNKYSEHGSKIVESYVREKHSDTSSSVVESFGMDKHSDSHIHSSILESYVGDKHAEPSHCVLESYPRDIHSETCRSVLESNVRDKHSEPSSRFLESYESDKHKPAVVLQKSLDKNSEPNSTVLESFGMDKHSERRCSVLESYVRDKHSEPSSSVLEYFMMDKHSDPRSRVLESYVRDKHSEPSSSVLEKHSEPSKSVLESYEKEKHSEPNSNVLESYVINKDSEVHSSVLESHVRKKHSETSSSVLESYVSDKHSETSSSVLESFVRHRRSDARSSVLESYKHSEPLSSVLESYVRDKYSEPSSSVLESHVRGKHSEPSSSVLESYVRGKDSEPSSCFLEFLVRDKLSEPRSSVLESHVRDKHSDPSSSVLESFGMDKHSDARSIVLESYKLSVILSEGQTLRNQQQFSGILCEGHSETSGSSLESFVRDKHSETSGSSLESFVRDKHSEPHRSVLESFVMGKHSEPRSSVLESYVRNKHSEPSSNLLEYNVRDKRSEPSSSVLESGMIDIDSELLSIVLESHVRIKHSEPSSSVLKSYVREKHSEPSSSVLESYVSDKPSETSSSALESSVWDKYPETRNRVLESYETFVRENHSDTRSSVLESYMRENTQNTAAVFRTPNVLESHVSDKQSELSSSVLESYVRDKHSESSSSCLQSYKYSGILCGRQTLRNLQQCSGILCEGQTEPSNTVLESFVREKHSELSSSVLESNMRKNHTDPLSSVLASYVSHKHSEHRSSVLESSLRDKHAYPQNSVLESYVRDNHSEPSSSVGQSFVMDKHSDRCSSVLESYVRDKHSEPCSRVLESFMRDKTSDPRRSVLESDMRDKHSEHSSSVLESSVRDKHSEPSSSVLESFVMDKHSDPRDSVLESYVKGKHSEISSSVLESSMRDKHSEPSSRVLHSFVRDKHSEPSSRVQECYVREKQSEPSSSVLVSYMRDKHSEPSRNVLESYMRDIHSQTSSSVLDSYGRDKHSDPRSSVLESYVKGKHSEPSSSVLESYVRDKNSDTHSSDTESFVRDKHLDPRSSVLESFQYSGILREGQPSSSVLESNVRDKHIQPSNNVLVSYVRNKHSEYSSCDLDKESELRSSVHETHVGDKRSEPSSSVLQSCGRDKYSEPSSSVMGSYARDKHSEPRSSVLESYVSTNTQNPTAGISNSGCRTNTQNPAAVFWNPINSSSVLESFVREKHSDPRNSALESYVMDKYSQPSSSVLESNVRDKHSEPSSSVLEFFVRDKHSDNRSRVLESYVRDNHSETSRSALDKHSETSSSVLDSFLRDKHSGPCSSVVESHLRDKYTEPSSSVLESHVRDKHSETSSGVLESYVKDKLSEPSSSVLGSCVSEKDSEFHSSVLESHAVTSNSALESFVREKHSDPRNSVLESYVTENLSTPSSCVLESYLRDKHSNPSHCVLEYYLRDKHSDTHRNFVESYVRANTQKPVAVLWSSLEKHSESSSRVLESCVRDKYSEFRGSVHESDECFGILCEGQKTEHRSSVLESYVSDKHSELRSSVLESYGYSDTRNSVLESYVRDTHSVTSSSVLESFVKEKDLDPRSSVLGSYVRDKHSEPISSVLESYERDKHSETSNSVLESYVRDKHSEPISSVLESYERDKHSEPSSSVLESYVRDKHSEHRNSVLEFYVRDRHSETSSCVLEWYVRDKHSESSSSVLESYVIILESYVRDKHSETNSSTVESFVRDKQRDPNSSVLESFLRQKHSDTCSSVLESYVRDKHSEPSSSVLESYVREKHSDIRSSVLESYVRYTHSDPSSSVLESFVMEKDLDTRSSVLGSCVRDKHSETGISVLEPYVRDKHSEPSGSVLESYVRDKHSEPSSRVLEFYGQTFRQSQKCSGILCEGQTLRNHQRRYGILCEGQTESSSRVLETFVREKHSDTQSSVPESHVRGKHSEPSSSVLESFVRDKPSDTRSSVLESYVKDQHSETSSSALSVLESYVRYKLSEPRSSVVESIVRDKHSESCNSVLESYVRDKHCEPSSSVLVSYVRNKHPEHSSRVLESYVRDTHSESSSSALEKHSDPRSCVLESYVRDKLSEPNSSVLETYVRDKHSEHSSSAVESFMREKHSEPDPRNSVLGSYVRDEHSGPCSTVLESCVSDQDSEIRSSVHEFHVRDKHSEPSCSVLESFVREKYSEPRSSVLESYVSDKHSEACNSVLESFVRDKHSEPHSSVLEKQTEPSSSALQSFVREKHSDPSSSVLESYVREKHSDPRSSVLESYMRDKHSEPSSSILKSFGREKHSHHRNSVLESYVREKYSDYRSVVLKSSIRNKHSEPSSSVLEPFVMDKHSDPRSSVLESYVRDKHSEPSSTVLECYVRDKHSERSSSVPESYVSNKLSELRSSVLES

SEQ ID NO: 929043 - protein, 1193 aa, Homo sapiens
MRDKQSERNNSVSEPFVRDKYSAPRSSVLESYVRDKHSEPNSSVLESFGREKHLQPRNSVLESYGQRLRPSSSVLESCVRDKPSETSSSVLESYVSDKQSEPRSSVLESYVRDKHSESSSSVLESYVRDKHSESSSSVLESYVRDKHSESSSSVLESFLRDKNSEPSRSVLESYVREKHSNPLSIVLESNMRDKQSERNNSVSEPFVRDKYSAPRSSVLESYVRDKHSEPNSSVLESFGKEKHLQPRNSVLESYGQRLRPSSSVLESCVRDKPSETSSSVLESYVSDKQSEPRSSVLESYVRDKHSESSSSVLESYVRDKHSESSSSVLESLLRDKHSEPSRSVLESSVRKKHSEAHSSVVESFLRDKHSERGSSVLESFVSDKHSDSCGSVLVSYVRDKHSDPAAFFLESYVRDKHSEPSSSVLESYVRDKLSEPSSRVLESYVRDKLLEPRGSVLESFVWDKHSETLSSVLEAHKHSEPSSSVLEFYVSDKHSEPSSTVLDSFVRDKSSDPRNSVLKSYVREQHSEPSHCVLESCLRDKHSNTRRSVLESYVSDKQSETSSGALSVLGSYVREKHSDPHSSVLESYMSDKHSEPTSSVLNLFIVLESNMRDKHSEASSCILECHVREKDSEPNSSVLESCLRNNPWEPRHCVLESYIRDTYSDTRRSVLEYYVRDKHTEPSSIVLESHVRQKHSELSSSVLESYVSEKHSEPSSSVLESFVGKKPSDPRISVLESYVMNKHSEPSSSVFDSFVLEKHSDHCSTVPLSYVRDKLSEPSSSALESYVRDKHSEPSSRVLESYVRVKHSEGSSSVLESYVREKHSEPSHCVLESYVREKHSEPSHCVLESYLKDKHSDHCSTVPLSYVRDKLSEPSSSALESYVRDKHSEPSSRALESYVRVKHSEGSSSILESYVREKHSEPSHCVLESYVREKHSQLSHCVLESYLRDKHSDMCRSVLESYKCSAILCEGQHSEPSSNVFESHERDKHSELGSIFLESYVSDKLSEHSSGVLESFVGDKHSDDHSSVLVSHVRDKHSETSSSALDSFLGDKQTEKEDSFVRNKHSDPRSSVLECYVRDKPSEPSSRVLESEVSDKHSKPSSSVPESFVRDKLSNPRSIVMESYVRNTHSESSSSVLESFVMDKHPDTLSSVLERYVMDKPTEPRSSVLESSVRDKHSEPSSSVLESNVRDKH

SEQ ID NO: 929044 - protein, 1563 aa, Homo sapiens
MGGTTIPNPAAVLCNPMEKYSNTRRRVLESYVREKPSEASSSALESFVRGKQSEPRSSVLESFVREKHSDPRNSILESYLRDKHSEPSSCVLESYVWDKHLEPSTIFWNTTVLESHVREKPSYPRSIVLESNMRDKHSEPSSSVLEPLLRDKHSDRHSSVLESYVRDKCSEPSSSGLESYVRDKHSEPSSSVLESSVRDKLSQLRSSVLEFYVRYKHSEPSSSVLESFVRNKHSEPHSNVQESDKDSETSSTVQESFLCDKHSEPQSSVLESYVRDKHHNPCSSFLESFVMDKHSDPRSSFSESYVWDKHSEHSNSGLESFVWDKDSEPSSSVLESYVRYKHSETVAVYWIPLCTGILSEGKTFRTSEKLSHPYSSVLETYVRERNSDPRSSALESYMRDKHSEPSSSLLESFGREKHSHPRKSVLESYVKEKHSDPRSIVLESNMRDKQSEPSCSVLEYYVSDNTQNPGTGFWNCLCGPVIQNLVAVFWNPISPVLESYVRYKLSEPSSSVMESFVRDKHSDPRSSVLESYVRHKHSQPSSSVLDSYVGEKHSEPNSSVLESFVMDIHSDPQPSSSVLESFVGYKHSEPRSSVLESYLRDKLTEPSSSILESQVRDKHSETSSSVLECFLRDKHSDLRSSVLQSYVWEKHSESSSSVVESSVREKHSELSSSVLESYVMDKHSDHCSRGLKSYVKDKHSEPSSSVLESFLRDKHSEPRSSVLESYMWDKHSEPGSNVLESHVRDKHSEPNSSILESYVSDKHSESSSSVLEFFVWDKHSCPQSSALESYVREEQSQPSSSVQESFVMDKHSDHTRGGVLESYVRDKHSENSSGAMETFVRATNTSQSFILDKHSEPSSSVLESYVRDKPSEPNSSVLESHVRDKHSVPNHCVLESYMRDKHSDNRRSVLESYVRDNTQKPPAVLWNLLDKSPERSSSVLESCVSDKHSEPRRNVLESFVRDKHSNPRSSVLESYVRNQQLFSGILSSDKYSDTRGSVLESYVRDKHSETSSGDLESFVKHKQTEPSSCVLESFRVLESYVSDKHSETSSSVLESFLWDKLSDAQSSVLESYVMDKHSDPISNVLQSFVMGKHSDPQTSSSVLESLEREKHLHLHNSVLESLLWEKYSDPRNSVLESYMRDKHSKTSSSVLESYVREKHSEPNCSVLESCGSDKLSEIRSSILESYVRDKHTEPSSSVLESYVSDKHSESSNSVLESYVRDKHSEPSSSVLEYFVRKNTQNTAVVDKHSENCSSVLESYVGDKHSDPDSTVVECSVRNKQSDPRSSVLKSCVRYKPSQLSSSFLEFYVRDKPSEPNSSVLESYVRTQKQLSGILCDGKHSDPSSSVLESYVTDKPSESSNSVLESSVRDIHSEPSSSVLESFVRDKPSESSSSVLESSVRDIHSEPSSIVLESYVRDKHSETSSSFLESYVRDKHSETSSSVLQSYVRDKHSEPSSSVLESYVSDKHSEFCSNVLPFYVSDKHSEASNSLLESYVREKHSETNSNVLASLVRDKHSESRRSALESQVREKHTEPSSNVLESCLSDKDTELRCNVLESHVRDKH

SEQ ID NO: 929045 - protein, 1303 aa, Homo sapiens
MRDKHSDLRSSVLESYVKDKHSERNSSVLESYVKDKHSGPSSSGRECFLMDKHSEPCSNFLESYVRDKRSEHSSSVLEYFGQTLRTQQQWSGILYEGQTLRTQQQSSGLLKPRSSVLGSYVRYKPSEPSSIVLEFYMTDKPSEPSCSVLESYVRDEHSEPSSSVLHSYVRDKHSETCSSVWESHIPAAMFRNPSGGTIIQTLRALLCNVMDKPSEPSSSLLESYVRDEHREPSSSVLDSYVRDKHSEPCSSFLESKVRDNHSEPSSYVPETYVRDKHSDPRVSVLESYATIKHSENGTSVPESFVRDKHSEPCSSVLESYVRCKHSDPHSTVLECYVRDKHSDPSSSVLESYVRYNPSEPSSSVLEFYVKDTHSEHSSSVLDCYVKDKHSEPCSSALESYSYVRDKHSEPSSSVREFYVRDKPSEPSSSVLESFLRDKLSDTQSSVLESYVRDKHSEPCSRVLESYVWDKHSDPHSTVLECSVRDKHSDPCSSVLESCVRYKPSELRSSVLEFYVKEKPSEPCSSVLESDNHSDTRSSALGLYVRDKHSEPSSSVLVSLVRNKLSEPPSSILESRVWNKHSEPSSSVREFYVRNKPSEPSSSVLESFLRDKLSDTQSSVLESYVRDKHSEPCSRVLESYVWDKHSDPHSTVLECSVRDKHSDPCSSVLESCVRYKPSELRSSVLQFYVKDKPSEPCSSVLESSSVLETYVRGQHSEPSSSVLECYVRDKHSDPHSSVLESYVRDNHSDRRGTVLESYVMEKHSEPCSSVLKYDVVDKQRTQQQWRITQNPASVFWNPMGLTNPQNPAAMFWNPMGGTNTQKPAAVFWNPFVMESYVRDQPSEPSSSVLVSFLRHKHSEPRNSVLESYMRDKHPEPSSSVLESFVREKHSDPQSSVLESYVTEKHPKPSSCVLVSYMRGKHSDHHSSVLESYVRDKHSDPHSCVLQSCEREKHSEPSSSVLESYVKDKHSEPSNSILESHRDKQSEPSSSILESFVRDKHQEPSSSVLESYVWDKLSDPSSSVPDCYGQTFRTLEKFSGILCEGKTPRTQEQFLENVVREKLSDICTSVLESDDKHSEPSSSVLESYLIGKDTEPISSVLENQQQSSGILCEGEILRTHQCVLKSIVKDTHSYPPRSVLESYDKHSDPSSSVLESYVSDKPLKPSSSVLEYYVRDKPSELGNSILESYVRVKHSEPNCKVLESYCSGVQSEDKHSENSSSVLESFVRDKHSDPQSSVVESYVRGKHTERGSSVLVFSLWDKHSEPSHGVPEFYMRDKPSKTRIIVVESFVWDKHSDTHSSVLES

SEQ ID NO: 929046 - protein, 540 aa, Homo sapiens
MFIPHKGFQNNATGICPSYWIPEQYQEGPNVFPSHRFPEHCFDSLNVFPYQRIPEDCCWVLSVCPTYRIPNHCNEEQCYECLNVFPSHRIPEHCYEGVNIFPPKGFQNTAAGIPEHCCCVLSVCPSLWIPEHCYEGLNVYPSQMFPEHYYWILRVCPSYWIPEQCCECLKVFPSRRIPELSYEGVNVFPSQRIPEHCCSVLSVYCKTLLRGSECLSLIKVSRKLLLGSEWLPSYCLPKQWYECLNVFPSPRIPEHCYEEHSYEVLNVYSSQRFTEHCYGVLSVFPSYWIPEQCCEFLNVFPSYRIREHCYEGVNIFPSQIIPEHCCCVLSVFPSYRIPEQCYKVLNVFPSHRIPEDCYEEHCCWVLSVCPTHRIPEHCYEGLNVYAQQRVPEHCYWVLSVHTSYWIPKQCYQDLNLFPSHRIPEYFNEGVNIFPSQMFPEHCCWVRSVCHSYRTPKHCYKGLNIFPSHRIPEPCYKGLNVFPSQRTDQHCYRVLFACPSKGFQSTVADFLVFVPHRIPEPFSEVLNICPQIGFQCTVAGF

SEQ ID NO: 929047 - protein, 2206 aa, Homo sapiens
MDNHSEPSGSVLESHVRDKHSEPSSSVLESFVQDKHSEPSQCVLESYQRDKHSDTCRSVLESYVRKKHSETSNGALELFVRKKQNPAAAVLESYERAKHSEPSSSVLESHVRDKYSESSSSVLESFVRDKPSDTRRSVLESHVRDKHSVTSSSALGKHSESCSSVLESYVKDKHSETSSSVLVSCVRDKYSEPSNCVLESHVRDKHSNLETLFWNPMDKHTEPSSSVLESFVREKHSDLRSSVLESYVREKHSEPSNIVLESYVRDKHSEPSSNVLESYVRDKHSEVLRSVLESNVRDKHSEPSCSVLQSYVKDKHSEPSSSVLECYVSVKHSEPSSSVLESFVRDKHSEPHSSVQQSYVRDNCEPSSSSVFESHVRDKHSEIRSCVLESYVRDKHSEPCNSVLDSFVTDKHSDCRSSVVVSYLKDKPSETRSSALDCLVRYKQAEPSSRFLESFVKDNHSNPRSIVVESNVRDKSSETCSSVLESYVRDKLSDPHSTVLECSVKDRYSDPQLSSSVLEFYVRDKPSETSSSILESHVRDQYSEPCSSVLECYVRDKHKKPSSSVLASYMRDKHSEPSRIVLESYVRDKHSQTSSSVLESYVRDKHSDSRSSVLESYVKDKHSEPSISALESYVRDKDSDTRSKTSSSILQSYVRDKRSEHSSSVLELVDRDKLSDPSTSFLESYVRENHSELSSKSSVRDKYSEKRRRVVESYVRDNHSDPSSSVLESFVMDKHSDPSSSFLESYVSRKPSEASSSVLKSYVSNKLSDISSSILESYVGDKLSEPSQCVLESYLRDKHSDSRRSILESKLRDKHSETRSSAQESFVRNKHTKLSSCVLEFYVSLKHSENSSIVSDKHSEPNSSVLESYLRDKHSEPNSSVLESYVRDKHSEPSRSVLESFVRHKHSEPSSSVLESFMRDKCSEPHGSVLESYVSEKHSEPSSSVLESVESFVMGKHSDPRSRVLESYVREKQQELSSSVVESYVRKKHSEHSSSVLEYQPRSSVLESFMRDKVSDPRSSVLESYLSDKHSESSSWVLESYQCSGMLCEKHTLRDDSSVPDYYVRDRPSIPSSSDVKSYESFVMDKHTELSSSVFESYVSDKHSETCSSVLYPIEGKHSDTQSSVLQSYVRDKHRESSSSVLESFVRDKHSEHHRSVLESYVRDKYCEANGIVLESDVRDKHSEPSSSVLESYVSDKHSEPSSKPSSSVLESHVREKHSDPRSIVLESKMRDKHSEPKSCILESHVRDTDSDPSSSVLESYLRDNPSEHSNCELESNLRDKHSDIRRSVLESYKQCSRIIVREKHSNTRSSVLESYVRDKHSEPSSSVLESYVSNKHSKLCSNVLIFYVRANTQNTAAVLWNQPSSRVLESYVRDKLSESISSVLVSYVSDKHSEHSSSVPVSFVLESYVWDKPSEPSRNFLESFVSDKHSDRCSSVLVSYVRDKHSECRSSVLESYVSEKHSEPRSSVLESYVSEKHSEPRSRVLESYVREKHSEPRSRVLESYERNKYSECSSSVLESYMREKHSEPSYSVLESYLRYKHSDTGKSVLETCMRDKHSENSSSALESFVRDKQTVHSSSSLESYVRENLSGPRSSVMKSLGQTLTPSSSVLESYVRDKHSEPSSSVLESFLKDKHSEPRSSVLESYVRDKHSEPNSSVFKSHDKHTEPCSSVLESYVRDKRSEPHSTALEFYVRDKNSDPPSSVLESYVRYKSSEWSSSVLEFDVKDKPQNLAAEFWNTNCVLEFYMRDKPSEPSSIVLEFYMRDKHSEPSSSVLESYLRDKHSECSSSVLKSYVRKNTENPVEVFWNPMGELSFQTLIGVTESYVRDNDSDPHCSILESYLRDKHSDLRSSFVESYVRDKHSECSSNLLESYVRDKHSEHSSSVPEYFVRDKHSDNLNSVLKSYVRDKQSEPSSSVLESYSSALESYETDKHSEPCSSVLHSNVRDKHSDPHSTVLEFSVRDKHSDPRRIVLEYYVRYKPSEISSSILLFLNPAAIFLESYVSDKHSEQSSSVLESFVRKKHSEPHRIVLESYMRDKYCEANDIVLESDVRDKHSEPSSSVLESYVSDKHSKTSSSVLESFVRDKHSDPRSCVLESNVRDKHSYHNRSVLQFFLTDKHSHPLSISRESYVKPSSSVLESYVRDKHSGNSSSALESFVRDKHSECSSSVLESFVRYKHSETCRRVLECDVRDKHSESSHCVLESY

SEQ ID NO: 929048 - protein, 234 aa, Homo sapiens
MNVCPLDRNTEHSGWFLSVCPSQRIPELCCWVLRVCASHRIPQHCCWIRSVCPLHRIPEHCWWVLSVCPSHRIPEHCCWVLSVCPTQRIPGYCYCVMSACPSNRVAEHCYEGLNVCPSAKITEHCCWVLSVCPSHRIPEHCFECLNVCSSQRILDNSCWFLSVCHSHRIPKHSCWILFVFPSQRNPEKYCCFRSVCPSDWIPEHFFVCLNVSPSDRTPEHRGWVLIICPPRRIP

SEQ ID NO: 929049 - protein, 1589 aa, Homo sapiens
MRKHSNPCSSALESYVRDNHSEPRRSVLESSVREKHSEQSSSVLEPYEKHSDPCSSVLESYLRDRHSEPSSSVLESYVRDKHSEPGSSALESCAIAKDPELHRSVLESYVRDKHSETSSSALESYLRDKHTEASSSVLESYVRDKHSETPSCVLESSVSGKHSEPSSSFLDSYMSDKHSEVSIKPSSSVLESFVMDKHSDPRSNVLESYVRDKHSKLSSSVLEYYERSKHSECGSSVRESHVRDKHAEPGSCVLDLYVTEKHSEPSHCVLESYLSDKYSDTHRSVLESYVRDKHPESSSGALESFVRENHSDERSSVLDKQTESSSSNLESFVTEKHSDPRSSVLESCVWNKHSEPSSSVLESYVRDKHSELSSSVLESCVSDKDAELRSSVLESHVRDKQSEPSISVLESYVRDKHSETTSSVFESYVREKLSEPSSSVLESLVREKHSEPRSSVLESNSALESFVMDKHSDPRASFLESYVTDQHSEPSSSVLESNVRDKHSEPSSSVLESYVREKHSEPSSKPSSGVLESFVTDKHSDRRSSVLVSYVRDIYSEHSSSVLESYVRDKYTEPSSSLVESYVRNKHSEKRSSVLQSYESDKHSETSHCVLESFLRDKHSDTHRSVLESYVRDKLSETRSSSLESFVSYKQTEPSSSVLEAFLTEKHTDPCSTVLESYVRDKPSEPSSRVLESFLRDKHSESRICVLDSYVRVKHSEPSRRVQESHVMDRHSDPGNSVMESLCEGQTLRTQQQCSGILCEGQTLRTQQQCSGILFRDKHSVPGSSDMESYVKYKDTEPSSSVLESYLGDKHSELPSSVLESFVRKKHSEPHNSVLESYVRHKHTEPSSSVLESYVRDKHSEPSSSVLEYYVRDKHSDTHPHSSALESYVRDKHTEASSGVLESYVRDKHAEPSSYVVETYVRDKHPKPSSRFLESVKDKHSDRRSRVLESYVRDKHSEPSSSVLESYVRDKPSYPHCSVLESYVGNKHSERSSSILESFLRDKYSDPRSNVLESYVRVKHSETRSSVLETFVRDKYSVPHSSVLESYASDKYSYPRSSDKDSEPNCRVPESYRRVKHSEPSSSAQESHVTDRYSDPQNNSSALESCVRDKHSEHRSNILDSYVRDDHTEPSSSVVESYVRAKHSEPRRSVQESYIRHKHSENSSHVLESYVRDKHSEPSSKVPETFGEILKPSSSVLESYVRDKHSEPSSSILESFVRARHSESRSCVLDSYVRDKHSEPSSSVLESYLKTSSSALETFVRYKYKDPHSTVLESYVTDKHSEPYSNVMESYVRGKHSEASSSVLESFVTDKLSDPFSSVPESYVRGKHSETSSSVLDSFGHSDPRNSVLEPYVKDKHSETHSSALESFVKDKPSESSCNVPEFLDRHSDHCSSVLEFYVRDRHSETSSTDLEFFVRDNHSHQFSSVPESYIKEKHSDPRSNVLESYVRDKLSNLRSSVPESYVRDKHSEPSSSVLEYYVTDKQSEPRNSVLECYVRDKHSDPRSSVLESYLRDKHSEPSSSVLQSIVRHKYSDPHSSVLESYLREKHSDPHSSVLESYVRVKHTDPSSSVVETFVRDKHSDTVCSVQEF

SEQ ID NO: 929050 - protein, 444 aa, Homo sapiens
MEYEAPRFSHLRQHQIIHTEEKPYQCEECGKDFKQSSDLTIHERIHTKERPYKCEECDKAFKQSSKLNKHKKIYTGDTTYKCEECGKAFSYSSTLTQHNIVHTEDKPYKCEECLTQHNIVHTGDNPYKCKDCGKIFKWSSDLTIHQIIHSGEKPYKCEECGKAFKQSSKLNEHMRAHTGEKSYKCKECGKAFKQPSGLTLHKRIHTGENPYKFEECVVFKPYYTQDNSYKRIHTGEKPYKCEECGKACKQSLGLTIQKRIHTEEKPYKCEECGKAFYCSSNLIQNDIVHTEEKHYKCQECGKAFKKSLDLNVHKIIHSGEKPYRYQEYGKVFKLSSKLNEHKITHSGEVSYECEECGKGFYCSSSLTKHTIVHTEKKLYKCEECGKAFKWSSELPIHRRIHTEEKPYKCEEYVRVFKHSSKLNEHNRNHTGEKPYKYEACGKAF

SEQ ID NO: 929051 - protein, 134 aa, Homo sapiens
MQSFPLFPLLSKEREASPHDHWHHRTMGTTARLLLMFPEVPGALQSACKRLGTGSDLSFFQVREPSSSDGLDSVPQISLPQAFLLMVHFEMLVVSAIDRGGFSSCIPPVNQNGLEDFLSLATNNLLFECVFKAS

SEQ ID NO: 929052 - protein, 139 aa, Homo sapiens
MPAVKAAGMGAVFCKATGVEMPKAAFTFTHDSLTHLERLPVLQASFMLMLETWLAEFGTMMEVLNIENWSHEEAPVFTKHVTQCREDMDEAGNHHSQQTITRTKNQTPHVLTHRWELNNENTWTQEGEHHTLGPVVEGE

SEQ ID NO: 929053 - protein, 153 aa, Homo sapiens
MAERGQCTARAVVQLAPPQGASHKPWQLACGVKPACPRKSRIEKGNMGSESPHGVPTWALPSGTVRGEPPTSSRPQNGGSSNSLHRLPGKATDIQWQPTKAARRKAILCKATAVELPKAMGTHLLHQCDLDLRHGVTPDVIETTLAIDRNCII

SEQ ID NO: 929054 - protein, 194 aa, Homo sapiens
MSLHYIDSEENPHWALPSGAARRGPPFSRPWNAGSTDSLHCALGKAADTQCPPMKAAGRRAIPAKTQGQRYQRPIRTHLLHQCDLDMRHGVKGDYFEDKTCEVNVLQDTDIRLQKTEVEQAMQEQWRASSLIQSGNGQLTGSEVQQTPCRIWKGGSQWQVCYGSDRQWLTASKSSPGSGTNTDQKSAQLQDLIE

SEQ ID NO: 929055 - protein, 142 aa, Homo sapiens
MENFPNGEFPKWREADPTVWYPQVTFTRPDADDKFQRLFLLGNQELGWGWEWQDKKEIKIHLQPKKGQVAAQEGFSISCPMAAKLQATCSQSRNQNLLPKHQLFELSVSTFHLFCPGSCSVTQGEMQWNHHDSLQLQPPRLK

SEQ ID NO: 929056 - protein, 135 aa, Homo sapiens
MNNSSMKLEYKEITGEEGQRVTKGHYLYQRVKDTWNSIASGHGVEDQAGQRGHPSECGKAWGLTAQAEWGGHPYRESAWCQSPYKRGDGSMGSKSLGGEFSKCGPWTSITWKLSEMQILDSHSRPTESRTWTWAE

SEQ ID NO: 929057 - protein, 226 aa, Homo sapiens
MLALPVEYLLSTTVKSSGAYLSTQPPLGDDPTEGFSRLYPVKAIFSSGIQRDVGPKPNNTVVFADLREPKDHCVFPGYHWWLFRAQGLFSQSMMNPAGTGSFPQGSSHLKLSNGDTSTSVAITTGCTVSDLNPAQDWALPKILPFRSGPSAAGLLEFAGGPLQTLFAWVSAAEAAEQQILVNSKCCCLIVPLEVLSQRSTRPVLIAFVDKQIFRGPCSSLIWKFFA

SEQ ID NO: 929058 - protein, 149 aa, Homo sapiens
MTKRKREEGEGISLVSLLANPIKSFLKVNSKSYKCTRFPKVDEKMLENYAELRRNRVLAEEQLTTEEQKIQKDDVIMASKDNYLTIQGLTETLRKAIRPSNSFSQLLAHFMKQIAMWETTTCQGTEGGCGPIANKELRASMNWILPTVM

SEQ ID NO: 929059 - protein, 137 aa, Homo sapiens
MHSKSCGELHGKAAAVCKGGSGRCGHIRRCLGSSGSVTCEHSKTAILLLCAHSCAEGLRCSHTSEQECFVSWKPTLILCVKHRLSAFACSPHGPDCHTPGCLEEFGTKHEKSFSTIEGTLLCPFTHQSFLVNGFPAF

SEQ ID NO: 929060 - protein, 145 aa, Homo sapiens [sequence omitted]

SEQ ID NO: 929061 - protein, 164 aa, Homo sapiens
MICGKVWGPGVAHSLTISLGGGGSHGSMSLPGVLWNIKVGIAVGRPLQSLPDHSAEQGQSFLTAPHRGSSRGQPKSSGSIWKLKEALSEVSHYNLRWGQIPFFRARAGESEKRAMSAGVASAGAVGERSTGTGSAGERSWYLALQQQGEVCPERHDYNFHGQSL

SEQ ID NO: 929062 - protein, 146 aa, Homo sapiens
MARNVGFRQDRLGIPHSRLGGVLEALLSTQDLGSVQSSSSWSRREDFRSHGGGERVKENGPRKGTATKPAHLSFAIIGGLTTLLQPCFFFHVKLCFKCLSLRIRCRRRFNRPLWEDFISPFFPFLFIFSNLTLFIVISVRPTDITA

SEQ ID NO: 929063 - protein, 144 aa, Homo sapiens
MPRQLLECPESCECLLARSRNKALLMREGRMAFTHIRGSCSELQICTCTNQIRKLWKLVDPLGTMLLYNDAKTLKNKQKNNLHELYQRSVEWTRWLSYKEDCCSLHHPLNVQVGKVQGLFSGSSFNKFPQVEIIKGPLRSQAVT

SEQ ID NO: 929064 - protein, 147 aa, Homo sapiens
MVFRPEEALWNYNEVMGFEEEDHSEGVSGRATSNSVDGVRMSRPINQPGRLHPHCKSEGDFQPHFLLAVESKQGINLAEEEGFYPATCKHPSSLEDSRLTPSSTQNTAPSSGPGTLCSSIAGSGPPGAPHLQWLFVKEVSLRYIEIR

SEQ ID NO: 929065 - protein, 135 aa, Homo sapiens
MITIALLSSLGCGKDMGGNLWKDYSMVQGCANKTICLLIDFENSASCSWRPGHRYPCSSLLHLNGTSNMQWPHTYKFQGGHQRIRPETKWCAKRKDRIHQAPGPQLEGIKGKEKGQHHSDLQGPLQKVLPGNSGL

SEQ ID NO: 929066 - protein, 144 aa, Homo sapiens
MFSTPFSASFLTMMLKTDIRYSLITKKALTCLCGNREWNGPQAYYSSSMEKWPDCYMGAPNSNLTTPQIESLQGQLKAWQWNCPCHPCTNEGPKTLSALSIPPTSCSQPKEKCPVSLPRVPPAPYCSSQDRKPLAWAHRTDPPS

SEQ ID NO: 929067 - protein, 128 aa, Homo sapiens
MNKDDGPETTEIYPKRIKIPFHSGSVQLFYEFRRDLKSPTRELGTWLLVFFALARAQTVRSSVESESHHSSDQNPRRAPMFLGKKNTVLLTACKVLCDLSHSMEESLKGVVLKQLDIYMQISKPKPRP

SEQ ID NO: 929068 - protein, 159 aa, Homo sapiens
MDVSIFVAFSVFPESKRWTALLDWGSSPGEYPAECFPTWFHSPHHFQNEWYHLLLVPLVEFGCESVWSWTFFGDVITDTVEIPRIIRGNNEQVYDNKLENLEEMDNFLEAYSFPRLKNEEIKNLNRPITTNMIEAIIKGLPAKKSPGPDGFTVEFYQTF

SEQ ID NO: 929069 - protein, 175 aa, Homo sapiens
MLPAVGGRRLRQEMPPSVPQGPLQRPDALDEAWRHFEAGPDSGTLAWFWGWWPGIWGLLCHLPGQAWVLVPAMAPALMPPGLCVKELSYSCQAPDGCLTHSSLRAFCFSSLSLTLLTWRMRTITISGLEGAQRSGHRALWARCVFLLPSPNFPPLSYLQRILCETHGDRRVVTPR

SEQ ID NO: 929070 - protein, 136 aa, Homo sapiens [sequence omitted]

SEQ ID NO: 929071 - protein, 144 aa, Homo sapiens [sequence omitted]

SEQ ID NO: 929072 - protein, 139 aa, Homo sapiens
MSLTSSELLLPVATAKRREQQLQLLLFLDSGEESGLGARPTVQGSQWKMLEEGSAHSLTVISRLPSAVEPSLASSFQVIRWRARCREDCSHAQERLASELRVITHWQNAVQGAGVTVSEERGTMMLWSGSELSNLSSPE

SEQ ID NO: 929073 - protein, 210 aa, Homo sapiens
MPLPRGPQPAWALRRGQRTEARQGLVTIVLVDQLAVYAITTTLIDQLTVYPVMTALIDQLAVYAIRTVPIDQLTVYPVTTAPVDQLTVCPVTTVLIDQLAVFAITTGLNDQLTVYPVTTALIDQQTVYPVTTVLIDQLTVYAVMDALIDQLAVYPIMTVLIDQLAVYPVTTAPIDQNAMKHRARDSNHAEESDAQLKTSLPSLLPRKNGC

SEQ ID NO: 929074 - protein, 166 aa, Homo sapiens
MLPDDTPRKWMPAALGQLHSGQPGGRWGSFSSLWKYLGAVHLVFHFFWEERDAEIWTDVDSGNWKGHHFGICTQQGLYEKGNLQAHVTPKREHQNCTEIICKSMYTKIANTNIQVYPLSLLLGITILVTAEFWRGHIQTTGDIYQDSTAKSCISVKKVEISPFTGR

SEQ ID NO: 929075 - protein, 162 aa, Homo sapiens
MCSHCSDPTYKREVILFLRWIGLRKKEMWEPGWVPFRGQVIPDYKLCRQYPQRQGPRVLAKLNISSHPKGLRDGGAAGRGNMPFAEKMHSASCGVGDSMGLGQDFIQKKEVTLHLYELGAGVRTRGHGRLRGYMGKKTRDSRKPTGYLEKSPDVRECLVGFF

SEQ ID NO: 929076 - protein, 138 aa, Homo sapiens
MVGSQEGTYGSCNVFVDKPAFPEYKVSDAKKSKFILLHFSTFKAGWDWLILLATFYVAVTVPYNVCFIGNDDLSTTRSTTVSDIAVEILFIIEGYILTVKMRGCLETFSSSEAVKSLRLECVFWLNVSTFALDEFVCS

SEQ ID NO: 929077 - protein, 149 aa, Homo sapiens
MAGKCHSSYNPIALEKAEVNFDDIILNFRTTYVSKSGQVIFEARSICIHYVTTWFIIDLIAALPFDLLYAFNVTVTVRLLRLLRLLQKLDRYSQHSTIVLTLLMSMFALLAHWMACIWYVIGKMEREDNSLLKWEVVVNENYITAAITH

SEQ ID NO: 929078 - protein, 200 aa, Homo sapiens
MRKNQCKKAENSKNQNASSPPKDHNALTAREQNWMENEFDELTEVGFRRWVMTNSSELKEHVLTRYKEAKTLEKRLEELLTRLTSLENNINDLMELKNTARELHEAYTSINSQADQAEERISEIEDQLNEIKCEDKIREKRMKKKAKSLQEIWDYVKRPNLLLTDVPESDGESGTKLENTLQDIMPENFPNLARQANIQI

SEQ ID NO: 929079 - protein, 211 aa, Homo sapiens
MLLNEWPCGIWIQYCKYEAFPGSCSAWQSAAPSSQQLPLEHRFPPLARFRNICSFFSVWLLQCVVPSSNQQRAASPGATSDSFVARSQRHWGEDVCRVPGTERPNHGIPVGPSEDQRLWYREQGLDFLGICLLACQVPYPAPIETPNLRLQRRPAEQQSSRPADQQQQNNQAEKGRRGGTSGCRGEFGQGPIGRLGCFQLLATISSVVMSL

SEQ ID NO: 929080 - protein, 858 aa, Homo sapiens
MEWNNPWTGRQSSSNGIERNHRMDSNGIIIERNRMESSSHGNEWNHHRMEMKGNRMELSSNGIEWNQHQTEKNGIIEWNRRESSNGPEWNHLMEWNGIIHGLECNHHRMESNGIIEMESPNRIEWNNHRMDPNGIILQWNRMELSNAIEWNYRMQSNRIIEWTRMESSNGMEWYHRIESNGIIIEWNRMESTSNGKKRNYRMESKRIIEWTRMESSNGMEWNNPWTRMQSSSNGIEWNHRMEMNGIVIEWNRMDSLNGIRWNHRMDWNGIIEWTRKGSLLNGIEWNHRMVSIGIIIKWNRMESPNRIEWNNHRMDSNGIILQWNRMELSNAIEWNYRMQSNRIIEWTRMESSNGMEWNKLWNEIQCDHHRMDPNGIIIQRKLTVSTSNESNGNTIELKRMLESLSNGIEWNHRIESNGTIIEWTQMELSSNGIEWNYRMQSNGIIECNRIESSNGLEWNHRIKLIEIIIECNRMVSLNGIEWNHHQMEMNGINHRMDSNGIIEWNGMEQSMNSNGIIIEWNRMESSSGIEWNYDQMESNNRMELSSNGIEWYQHQTEKNGIIEWNRRESSNGFEWNHRIKLIEIIIEWNRMVSLNGIEWNHHQMEMNGINHRMDSNGIIEWNGMEQSMNSNGIIIEWNRMESSKSNGIIIEWNRMESTSNGKKRNYRMESKRIIEWTRMESSNRMEWNNPWTRIQSSSNGIEWNHRMDSNGIIIERNRMESSSDGNERSHHLMELHGIIIKWNRMESTSNGIKWNHGTELNESNGIIIEWNRMESTSNGKKRNYRMESKRIIEWTRMESSNGMEWNNPWTRMQSSSNGIEWNHRMDSNGIIIERNRMESSSDGNEWNHHRMESNRIME

SEQ ID NO: 929081 - protein, 207 aa, Homo sapiens
MEWNNPWTRMQSSSNGIEWNHRMDSNGIIIERNRMESSSDGNEWNHHRIEMKGRIIEWTRMESSNGMEWNNPWTRMQSSSNGIDWNHRMDSNGIIIERNRMESSSDGNERKSNGIIIEWNRMESTSNGKKRNYRMESKRIIEWTRMESSTGMEWNNPWTRMQSSSNGIEWNHRMDSNGIIIERNRMESSSDGNEWNHHRMESNRIME

SEQ ID NO: 929082 - protein, 722 aa, Homo sapiens
MEWNGMKWNGMEWNEMEWNGMEWNGMESTRLEWNGMESNGVEWNEMEWNGMEWNGMEWNEMEWNGMEWNGMEWKLPELNGMEWNGMEWNEMERNGMESTRWNGMDWNGMNEMKWKGINMNGMEGNGMEGMEGNGMEWNGMDRMERNGMEWIGMECNVMEWNQPQWNGREWNGMEWNGFYPNGMEWNEGNEMEWNQHEWNGIEWNGMEWNGMEWNGMDLEWNGMEWNGMEWKGMETKGITWIHPEWNGMEWNGMSKLNGTLRSGMEWIWNGMEWNGMERNGNEGNNMDSPRMEWNGMEWDEQTEWNAKEWNGMEWNGMESTHGMECNGIGMEWNGIELNGMEWSGMESTRVEWNEMEWNGMEWNGMEWNGMERNGKEWNGIKPMEWNGLEWNGMVWKGMESKRVEWNGMVWKGMESKRVEWNGMEWYRHERNLMEWNGKEWNGINTSGMEWNGMEWNGMGQNGMESTRVQWNGKEWNGINAINPNGMEWNGMECNGMKWNEMEWIGIKWNGMEWNGIEWNGIFPNGMEWNGMEWSGMEWNGVKQSGKQWNGQEWKGMELNGMESTRLEWNGMEWNGMQWNGIKPSGMEWNGIERNGLEWNGLEWNQPEWNGMEWYKPECNGMEWNAMEWNGMEWNGMEWNCVEWNGMEWSVKELNRINQNGMEWNGMEWNGMEWNAMEWNGMESTRMEWNGIEWNRMEFTHMEWNGMEWNGMEWNAMEWNLPE

SEQ ID NO: 929083 - protein, 2812 aa, Homo sapiens
MERNGINPSGMEGNAMEWNGMERCQTEWNGMERNGMEWNGMEGIGINTSAMEWNGMEWNGMEWNGIYQNGMEWNGMEWNGKEWNGIYPNGMEWYNGMQRNQPECNGMEWNGMEWNGMEWNGINPSGMEWNGMEWNGMEWNGMDWNGIEWNGINWKGMKRNGIKRSGMELNGMETTRNQPERNGMERNGMKSNRVEWNGKKWIGMECNGMEWNGVESLRVEWKGMQWSGMERNGINVSGMEWNGRESIGMETTRVKWHRMEWIRMEWNQLEWNGVNTSGMEWNGMEWNGMEDNAMESTRVQWNGKEWNGIVWNGMEWNGMEWNGMEWNGKQRNGIEWNQPKWNGMEWNAMERKGMKWNEMELNGMEWNGMEWNGMEWNGIEWNGIYPRGMECNGMEWIGMEWKGMEWNGVKQSNGIDWNGTNPSGMEWNGINPNVMAWNGIEWNGMEWNGMELCGMEWSVKELNRINPNGMEFSGMERNGMEWNGMEWNGMESIHMEWNGMEWIGMEYNGMEWNGIIPSGMGGNGMDWNGIEWNGTEWNGTERNGMEWSGMEWNGMDWNGIEWNGINWKGMERNGIKWSGMELNGMETTRGMQWSGMERNGINVSGMEWNGRESIGMETTRVKWHGMEWIRMEWNQLEWNGINTSGMEWNGMEWNGMEENAMESTRVQWNGKEWNGIVWNGMEWNGMEWNGMESNGMESNGNGMDWNGTNPSGMEWNGINPNVMAWNGMEWNGMELCGMEWSVKELKRINPNGMEFNSMERNGMEWNGMEWNGMEWNGINSHGMEWNGMDWNGMQWNGMEWNHSEWNGREWNVLEWNGMEWNGTERNGMEWKKHEWNGMEWNGLEWNAMEWIGMECNGMEWNGMEWNGIELNGKEWNQPECNGMEWNGMELNGIYQNGIEWNGIEWNGMEWKVPEWNGMERNSMAVEWNGMEWNHPEWNGMEWNGMEWNGMEWNGKEWNGIITNGMEWNGMEWNGMEWNQPEWNGRKWNQTEWSGVEWNGIEWNGMESNEMELNEMDWNVMEWNQTKRNGLAWNGMEWNGMEWNGMEWNGMETTRVEWNGMEWNGMEWNGLEWNGMEWQEPECNGMEWNGIQRNGINWIGMETKGMEWNRVNLSGMEWNGMEWNRMEWNGMEWKLPNGMERNGIESSGLERIGLEWNKINSSGMEWNEMEWKVMESNAVEWKEMDWNGIKSTPVEWNGMKWNGMEWIGINPSGMAWNGMEWHGMEWNGMKWNGMERNRMEWNEMKWNLFNTLGMEWKGMDWNGMESTLVEWNRMEWNQWNLLEWNIMNWNGNGMQWNQPEWSGMEWNAMEWNGVEWNGMESTEWNEMEWIGMEWNQPVWNVEWNGMEWNGMELYGINASGMQWNGTEWNKRNEMEWNQHEWNGMEWNGMEWNGMDGNGMEWNGVEWNGVERGGMELNGSTRMQWNRMKWYGIEWNAMELNQHDSNGTEWNGVEWNGINPSGMERNGMEWNEWNGTKWNEMDSTQLEWNGMKWNCVEWNGTEYNVKELNRINPNGMEWKGMEWNGMEWNGMEWNGMEWNQLEWNGMDWNGMQRNVIGREGNVIEWNGMEWNQPECNGMECNGMEWNGNYQNGMEWNGMAWNGMECTRVEWNSATEWNGIEWNGMEWIETEWSGKEWNQPEWNGMEWNGMQWNGMEWNGMNGINSTALEWKAMEWHGINSRELEWNEIEWNGIEWNGINLNGMEGNEMEWNGNESTLVEWNGMEWNGMELYGINASGMQWNGTEWNKRNEMEWNRMECNGIESTRLKWNGLEWSGMEWNQPKWNGKEWNGMEWYGIECSGTKWNGMDSTQLEWNGMEWNCEERNGMECSVKELNRINPNGMEWNGMEWNGMEWNGNVIEWNGMEWNQPECNGMECNGMEWNGNYQNGMEWNGMAWNGMECTRVEWNSGMQWNGMESPRMEWSGMEWNGIECSGMEWNQPECNGMEWNGMEWNGMEWNGINQSATEWNGMEWIETEWSGKEWNQPEWNGMEWNRMQWNGMEWNGTEYNGMERNGMEWNGMEWNGKEWNAIIPKWKVMEWKGMERNGMEWNGMEWNGMESTRVEWNGMEWIGMECNGIEWNHSEWNGRECNPVEWKGMESTRVEWKGIEWNGKEWNRINPSGMEWNAMEWNGLESSQMEWSGMEWNGMECMEWHGMEWNGMEWNGTEWYGIECNGTKWNGMDSTQSEWNRMEWNGLEWNGMQWNGMEWYQLEWNGMVWNGLEWNAMEWKEIIPSGKEGNELNTINPNGMEWNGMEWKGMEWNGMEWNGMESTRVEWNGLEWNAMEWKVMEWNHSEWNGRECNRVEWKGMESNRVQSIIMEWNGMEWNGMEWNLPLWNEMEWNGVEWNGMEWNGMEWTVPEWNGIGMERNGITPSGMEGNRMEWNGMEWNGMECNGINPTAMEWNGMEWNQPEWNGMEWNQHEWNGMEWNAMKWNGTKLEWSGMEWNGMESNGMEWNQSECNGMEWQGMEWNGMEWNGFNPNGMERKGVNPSGMARNGMEWNGMECNGMEWNGMELNRINPNEMEWNGAKWNGMEWNRMESFRVEYNGMERNGMEWNGMEWNGMEWNGINSRAMEWNGMEWNGMEWNGINPSGMAWNGMEWKGMVPNRMEWNEIDWNGFNPIGTEWNGMELCGMEWNGKELEWKGMEWNGNEWNGINTRGMEWNGTEWNGMEWNGMEWNGMEWNGINPGGMEWNGMDWNGMEWNGMESTRMEWNGMDWNGMEWNKGMESNRVEWNGMELNQTEWNGMEWIGIEWNGIIPNGMERNGMEWNGVEWNGMEWNQPECNGMEWNGMEWNGMDSTRMEWKGMESTRVEWHGME

SEQ ID NO: 929084 - protein, 2937 aa, Homo sapiens
MEWNGMEWIQPEWNGKEGMQWNGMEWNGMEWNGMESTRVEWHGMERNVMESTRMEWNGVESTRVEWHGMEWSGREWYRIEWNGTKCTGMDSTQLEWNGMEWNCVEWNGMERSVKELNKINPNGMEWSGTERNGMERNGKEWNGMESTRVECGMEENVIEWNNGTEWNGMEWNQVGWNGMEWNGMEWNGMEWNQPEWNGMDCNGMERNGMESTRVEWNGMEWNGMEWNGINPGRMAWNGIECNGMEWYRIEMNGTKWKRMHSTHLEWNGMEWNCVEWNGMEWSEMNGMEWYGIECNGTKWNEMDSTQLEWNGMEWNCVEWNGMEWSVKELNRINPNGMEWNGMQWNGVEWNVEWNGLEWNAMEWNVTEWNHSEWNGRECNRVEWKGMESTRVEWKGMEWNGKEWNGINRSGMEWKGIKWYGMEWNGINSSAMEWNGMEWNLPEWNGMEWNGMECTRMECNGMQSMEWNGIVPNGMDQNGMDQNGMEWNGMEWNGMELNGKESTRVQWNGMECNGMEWIQPEWNGKEWNQPEWNGMEWNRMERNGMEWYRIEWNGTKWNGMEWNAMEWNGVESFRVEWKGIQPKCNGMESNGMEWNAMDSTPMEWKGMESTRVKWHGMELNGKEWNGMVWNRMEWNEMEWNGMEWNGMEWNGMEWSGIIPSGIEGNVFEWNGKEWNQPEWNGREWNGMEKNRMESNRVEWNGKEWNGMEWNGMERNGIEWNGMEWNGINSSAMEWNGKERNCVEMNRMEWSVKELKRINPNGMEWNGTEWNGMEWNGMEWNGMEWNQLEWNGMEWNGLEWNAMKGNGREWNGTESFRVEWKGMNGMESTRVEWNRKEWKGMEWNGMEWNGMEWNQPESNAMEWNGMEWNQPEWNGVEWNQPEWNGVEWNQPEWNGMEWNGMEWKGIEWYGIECNGTKWNGMDSTQLQWNGMERNHSDGMEWKGMGWNGMEWNGMELNSINPNGMEWYGAKWNGMEWNRMESFRVEWNGMEWKGIEWNGMEWNGMQWNGMESTRVQWNGMEWNGMQWNQPEWNEWNGTKWTGMDSTQLEWNGMEWNCVEWNGMERSVKELNKINPNGIEWSGTERNWNGRECNRVECKWNQHEWNGREWNGMERNGMESTRGEWNGMERNGMEWNGMEWNGMEWNQPGWNGMEWNGLEWNAMEWNGIIPSGMEVNVTEWNGKEWNQPECNGIEWNGMEWNGMEWNGINQNAMEWNGVELNGMEWNGMYPNGMEWNGIIWLEWNGMEWNRMEWNHPEWNGEEWNGMEWNGMEWNGMEWNGMEWNGMESTRVRWNGMEWNGMEWIQPEWNGKEWNQPEWNGMEWNRMEKNGMEWNGMEWNGMEWNQTESNAMEWNGMEWNQPEWNGVEWNQPEWNGVEWNQPEWNGMEWNGMEWKGMEWYGIECNGTKWNGMDSTQLQWNGMERNHSDGMERNGINPSGMEGNGMEWKRIEWNQPEWNGMERNGMEWNGMEWNGMELNSINTNGMEWYGAKWNGMEWNRMESFRVEWNGMEWKGIEWNGMEWNAMEWNGINSSAMEWNGMEWNAMESTRVEWYGMERNVMESTRMEWNVVESTRVQWHGMEWIGREWYRIEWNGTKCTGMDSTQLEWNGMEWNCVEWNGMERSWNGTECNGTEWNGMEWNGINSGGMVWNGMNWNGMQWNGMEWNGFIPIGMEGNVIEWNVNGINTSGMEGNGMEWKGKEWNQHERNGMEWNGTEWNGMEWNGMESTRVEWNGMEWIGMECNGMEWNHSKWNGSECNRVEWKGMESTRKGMESNRVEWNGMELNKTEWNGMEWNGIEWNGIIPNGMERNGMEWNGMEWNGINPSAMEWNGMEWNGFNPNGMERNGINPSGMAWNGIEWKGMEWNGMIWNRMEWTEMEWNGMEWNGMEWNGMECNGMEWNGMQWSGYILRGIEGNVFEWNGKEWNQPEMEWNGNEWNGMEWNGMEWNGMENNRMESIRVEWNVNEWNGMERNGMEWNEINSRGMEWNGMNWNGVKWKRMEGNGMEGNHSEWNGRELEWRGMEWNGKEWNGINTSGMEWKRMEWNGINTRAMEWNGMELNGINPNGMEWNEINPSGMAWNGKEWNVRRNGMEWNGMEWNGMEWNGINPSGMEWNAMEWKVMEWNQPEWNECNGMEWNGINPGRMAWNGIECNGMEWYRIEMNGTKWNRMHSTHLEWNGMEWNCAEWNGMEWSNQPEWNGMERNTMEWSGKEWYGTEWNGSKCNEMDSTQLEWNGMEWNCVEWNGMEWSVKELNRINQNGMRWNGTERMGMEWNRMEWNGMEWNGMEWNGITRMEWSGMEWNGMEWNGMESTRVMDWKEMEWNGFNPIEMEWNGMELCEMEWNGMEGKGIEKIQPEWNGLEWNVMEWNGMEWNGMEWNGITRMEWSGMEWNGMEWNGRESTRVGKEWNGMEWNGMEWNGKEWNGITPNGMEWNRMDWNGMERNGMEWNGMERNGMEWNGMESTGVQRNGMEWNQPEWNGVEWNQPEWSGMEWNGMERKGTVRIRMDWNEMELNGFNPIEMEWNGMELCGMEWNGMEDSTLMEWTVMEGNGMEWNGMEWNGMEFNEINSGGMEWNGMDWNGMQWNGMEWNGMEWNHSEWNGRECNRGEWKGIEIEWNGLEWNGTEWNGMEWNQPEWKGVEWNQPEWNGMEWNGMERNGMKGKYSSGMERNGINPSGMEGYGMEWKEIECNQPEWNGMEWNGMEWNGTESPRVQRNGMEWNGMEWNGMESTRIEWNGMEWNGMESTRVEWHGMERNGMEWNGTEWNGMVRNRMEWNEMERNGFNPIGMEWNGMELCGMEWNGGINPNGMEWNGMQWNGMERNGMEWYGIEWNGTKWNGMDSNQLEWNGMEWNGIVWNGMEWSVKELNRINPNGMDWNGIKPSAMEWNGMEWNGFIPNGMERNGINPSGMAWNGIEWKGMEWNGMIWNRMEWTEMEWNGMECNGVDSF

SEQ ID NO: 929085 - protein, 1269 aa, Homo sapiens
MAWNAKEMNGMEWYGIEWNGTKWNEMDSTQLEWNGMEWKCVERNNQPEWNGMERNTMEWSGKEWYGIEWNGSKCNEIDSTQLEWNGMEWNCVEWNGMEWTNGMEWNGMEWNGMEWNHPNGMEWNGMEWNGMEWNGINSSGMEWNGMDSTLMEWNGMEWNGMECNRMEWNGMVWNRMEWNEMEWNGMEWNGMDCTRVEWNNQPEWNGVEWNQPEWSGMEWNGMERKGTVRIRMDWKKMEWNGFNPVEMEWNRMELCGMEWNGMEWRVKELNKFNRNGMEWNGMEWNGMEWNGMKSTRVEWNGMEWIGMECNGMEGNGMEWNHSEWNGRECNRGEWKGTIEWNGIKSCGTEWNGTESNRVKLNGMDWNGMEWNWIKQSKIEWNGLEWNGMEWNGMEWNQPEWNGVEWNQPEWNGMEWNGMEWKGMECGMERNGINPSGMEWYGMEWKEIECNQPEWNGMEWNGTESTRVQRNGMEWNGMEWNGMEWNGINPNRKEWNGMEWNQPEWNGMEWKGMEWNGMVRNRMEWNEMERNGFNPIGMEWNGMELCGMEWNAGGMERNGINPNGMEGNRMVWKRIEWNQTEWNGMEMNGMEWNGMEWNGMERGMEGNVIEWNGNGINTSGMEGNGMESTREQWNGMEWNGMESTRMEWSGMESTRVEWHGMERSGMVRNRMEWNEMKWNGFNRIGMVWYGMEWNCVECNRMEWSNQPEWNGMERNTMEWSGKEWYGIEWNGSKCNEMDSTQLEWNGMEWNCVEWNGMEWSVKELNRINQNGMRWNGTERMGIELNGMEWNHPNGMEWNGMEWNGMEWNGMEWNQLEVEWSGMEWNGMEWNGMESPRMEWSGIEWNGMEWKGMEWNGMEWNQPECNGMEWNGINPNGMEWNGINPSGMEWNGMEWKGKERYGIEWIGTKWNGMDSTQLKWNGMEWNYVEWNGKEWRNGMEWNGINPSGMAGNGKEWNGMIRNRMGWKEMECNGMEWNGMEWNGMEWNGVESFRVEWKGMKSSVMERNGIKPSAMEWNGMEWNGIYQNEMEWNGMEWNGMASYRMEWSRMEWNGMEWNGMEWYGMEWNGINASAMEWNGMEWNGMEWNGLNPNGMERNGIKPIEMAWNGIEWKKGMYSSGMERNGINPSGMEGNGKEWKRIEWNQAEWSGMERNGMEWNGMEWNGMESTRVEWNGMEWIGMESNGRELKGMEWNGMEWNQPEAIVWNGMEWNQPEWNGVEWNLPEWNGMEWNEMDRNGMVRNRMEWNEMEWNAFNPIGMEWNGMESLRVEQN

SEQ ID NO: 929086 - protein, 262 aa, Homo sapiens
MGRERTAGSRASQQASALWQGQEETWNGKEWNGINAHGMEWNEMEWNGLDWNGMEWNGMEWNGMDWNAREWNGMKTTHPDGMEWNGMEWNEKEWHRLEWNGMQWSGMGWNQHKWNGIEWNGMVWNGLEWNGKQSTRVEWNGMEWNGMEWNGMKWNGMERNVMEWNGVEWDGINPNGRKWNGIEWNAMESTRVEWNGKEWNGMEWNGMERNGKEWKGINPSGMEWNGTEWNGMEWEGLERKGINPSGMEWNGIEWNGMEWKGI

SEQ ID NO: 929087 - protein, 136 aa, Homo sapiens
MHTISDFAMFSPVLSQLVRICCLDISSKGLMRKIFPDLYFQHCFSIASIQKDSLAGYKILADMFPLEDLVGQCHQKYSENQGTLSLSEENRNFKTERIEEEEEEEGLEEEKEEKVEEEEEGRTSPGLSADICQGKH

SEQ ID NO: 929088 - protein, 374 aa, Homo sapiens
MPRGLKGSKKDGIPEDLDGNLEEPRDQEGELRSEDVMDLTEGDSEASASAPPAAKRRKTHTKRKKERKPTVDAEEAQRMTTLLSAMSEEQLSRYEVCRRSAFPRARIAGLMRSITGSSVSENAAIAMAGIAKVFVGEVVEEALDMCEMWGETPPLQPKHLREAVHRLKPKGLFPNSNYKRVMQTGVSAEMFAIPRGLKGCNEDGIPEALDGNLEEPRAQECELRSEDVMDLTVVDNEASASAPPAAKRQKTDTKGQKERKPSVDAEEAQRMTTLLSAMSEEQLSRYEVCRQLAFPKALVARLMWSITGRSVPENMAIAMAGIAKVFVGEVVEEALDMCEMWGEMPPLQPMDLREAVCRLKPKGLFPNNYKKVMF

SEQ ID NO: 929089 - protein, 173 aa, Homo sapiens
MFAMPQGLKGSNKDGIPEDLDGNLEEPRDQESELRSQDVMDLTEAKRQKTDTKGKKERKPTVDAEEAQMTTLLYAMSEEQLSRYEVCRRSAFPKARIAALMQSITGRSVSENTAIAMAGIAKVLVGEVVEEALDVCEMWGETPPLQPKHLREAVRRLKPKGLFPNSNYKKIMF

SEQ ID NO: 929090 - protein, 138 aa, Homo sapiens
MLAQRLGVLPGGDGSGNGGSNNLGGNDDGGRGDGSNGDGVSNDGRGDDGGGRCDNGIEGMVVMVVVIMAMGEVMIIVLVVVVEVVVMAEGMVMVIILVVLVMIVEVMMVVVMMVIVEATVMLLMMMVVVVVVMVWLCG

SEQ ID NO: 929091 - protein, 149 aa, Homo sapiens
MGHLFICREDISLTSALQNRFVKAAPASLESPVIALLCMSDLTVGTSVTQLQNLNTMGTTGSQGGRGQVAALSHQRQGGCSDLGPRTHPVVISPVPECIIGIACLSSWQRPHIGSLTAKKTDGSWRMTVDYYKLNPVVTSISASVSDVV

SEQ ID NO: 929092 - protein, 165 aa, Homo sapiens
MSFSAFLYILTLNSCLPLEILLTQWLKLSKGTRALSEECIHPILAYPDPKTLKQLRGFHGITSFCQIRIPRRLLLAVQKPKEVAVLHCWGYQKGKEKETEENHRADIEPKRATRIEAVKLQIVLEMEPQMQSMTKIYCGPLDWPASPCSDVDDIEGIPPDKISTA

SEQ ID NO: 929093 - protein, 197 aa, Homo sapiens
MGKRLWNSVTGRGWNSLEGLEEGRKMCKSLELPRDLLNGFDQNAHNYMDNEIQTGPLYCVQPKDLVLCLPATLATVKRGQGATQAVALEGAGTSLGSFLSHVESVGAQKSRIEVWEPPSRFQRMYGNASMSRQKFAAGEGPHSEPLNGRSISNLYHAQKSHRPSKPAHENSQEGGCTLQSHRIGAAQHHGNPLLALA

SEQ ID NO: 929094 - protein, 149 aa, Homo sapiens
MRSCGITQHLPFYGHSAFEAIGKVKKLSLINSSFLNPGETIISEKYTQQIHEIHQKLQCLQLPLVNRKVPILLHDNAQPHVAQPTLQMFVKDQIVVGLEIKISFSQRDSRVGKSRKTGHKYQSESGTWKAKRMHERTLPELLHDNSSFT

SEQ ID NO: 929095 - protein, 135 aa, Homo sapiens
MVMRDTSSRPHCYTPTGTITVYKCHGNVRKPKPTKTKMVTRVTSGRPHCYTPTGAMTVYKCHGNIRKQADEDSKLPDLWLNGRFSVSWNIDSQEKNAPELIPKKAAGGGEGAYNGKAGATTRVEHLKQRNFCIAN

SEQ ID NO: 929096 - protein, 300 aa, Homo sapiens
MESYVRDKHSDHNRRVLVSYVRDKYSEPSSSVLESYVRDIHSDPSSSVLESYVRDKHSDPSSSVLEYYMGYKHSDHSRRVLESYVRDKHSDAPSSALESYVRDKHSDPSSSVLEYYMGYKHSDHSRRVLESYVRDKHSDTPSSALESFVRNKHSDTSSSVLEYYLKGKHSDPHSSFLESYVRNKYSEPSNSILESCVRDKHSDHSRSVLESCVRDKLSDHSRSVLESYVRDKHSNPRNSVLESHERDKRSDPHSSLLESYVRDRHSEHSSIVLESYVREKFRPQEGSSGILCEGKTFRPQ

SEQ ID NO: 929097 - protein, 139 aa, Homo sapiens
MGRNLGQYAAFKGRGSCGFPQCIVPLVHCPPCVVHDGGSDSVLKAGKKTGSKDFLIIMQEEEKTTITAIVFGTVLSFKMEIAPIHQALHSSLSPTPGGHLSSLQLYEFNYSRHLIDKWNHNRPPSFFCMWKSSFSNTNS

SEQ ID NO: 929098 - protein, 182 aa, Homo sapiens
MLGIIFRWDMMNNTTGCTETVILEVSKSHRATESHRCLRIPPPGTLRGSRTAAGPRFAVPVPVHVYADIGFTLAMVPKMIVNMQSHSRVISYEGCLTRMSFFVLFACMEDMLLTVMAYDCFVAICRPLHYPVIVNPHLCVFFVLVSFFLSPLDSQLHSWIVLLFTIIKNGSFCLTIKLSPPF

SEQ ID NO: 929099 - protein, 183 aa, Homo sapiens
MPLATSAIKGDRPIIWRTGYQTAHRMAVMHPQIPSEMGKLRLAGGGPEAVKPGQGLRKYLSLGMGPPTLPSLTFMCRLEPRYTVKMATACHQCAAMKRQGSPGVDRRRWDMELGRGDARTRQGTTWVQDTQVGLCPELAIFGKNGQETLVQYEAPAPATDRDTEPAYALPAAGMTSATPHPQG

SEQ ID NO: 929100 - protein, 135 aa, Homo sapiens
MRELLCNNRPEQLLQETATIKAPIAPADPWSQEVIYNFCKAVSSVSCMPFNIHFNSNIPPESSGDWRMQQPCKVEQSILGSIPGPCHTALSTENSSGAFGDPYGPGWLPVPRCLCCFPCLLSEPNMEEEVAVLGA

SEQ ID NO: 929101 - protein, 439 aa, Homo sapiens
MESSRNPPPEVIWLHNGNEIQESEDFHFEQRGTQHSLCIQEVFPEDTGMYTCEAWNSAEEVRTQAMLMVQAVSKDNGHFEVLQNEDVFTLVLKMVQPWHAGHYEILLKNRVGKCSCQMLLMLENSPAKALLQGSEPASCEGLCGGGVGADGGGSDRYGSLMPGWPARGQGWPEEEDGEDMRGVLKRCMETRQHTEEAIHQEEMEQLDFRDLLGKKVSTKTLSEDDLKEIPAKQMDLLLGGKKKLPAENGSSSAETLNAKAVASSKPLSNAQPSGPLKPVGNTKPAETLKSTSKEELKKDLKNDVNCKRGHSGTTDNEKRSESQGTDSPSLQGEAARSTITWTLNGKTLKTTKFIVLSQEGPCSGALGTCTKAGAKGWDPGLCGTCPHLGIRLAEPLMAPPPVAPQRRPEPELIPSSSVERALFTGLEVGDTEAQASEEL

SEQ ID NO: 929102 - protein, 295 aa, Homo sapiens [sequence omitted]

SEQ ID NO: 929103 - protein, 148 aa, Homo sapiens
MQLQSTWQIWPAAIATLEHTAGFMGTVNASSRAQRTSDRAVNCNSRAHCRSDGAVNCSSRAQGRSDGAVNCSSRAHGRSDGAVNCSSRAHHRSNRAVNSNSRAHSRSDGAVNCSSRAHRRKFRSGTSQTALAPSHLHSEAILQSEWQA

SEQ ID NO: 929104 - protein, 208 aa, Homo sapiens
MDWNQPDYNATEWNGREWNAMENNGMNWNAMEFNGMEWNGMESTRVESNGMEMESNGMEWNKYEWNGMEWNGIEWNGINSSGKECNGKEWNGMEWNGMQWNARVWNGVNASGMEWNGIECHGMEWNGVEWNKHQWNGMEWNGMEWNGMKRTGMEWKGMEWNGTEWIGMEWNQHDWHGMEWKGMEWNGMEWYGISPSGMEWNGMEWNGT

SEQ ID NO: 929105 - protein, 735 aa, Homo sapiens
MESKRIIEWTRMESSNEIEWNNPWTRMQSSSNGIEWNRRMDSNGINIERNRMESSSDGNEWNHYRMESNGIMKWNQMESSSNGIKYNYGMKSNMETNGIIIEWNRMESLNGIEWNHLQMEMNGIIKQWIRMDSLNGIRRNHRMDLNGIIEWTRMESLLNGIERIVIEWIECNHRMVSNGIISKWNGKESSYRFEWNYHRKDSDGINIKRNQTEWNHRMDLNGIIEWTRMESLLNGIEWNHRMVLNGIIIQWNRMESPNRIEWNNHRMDSKGIILNWNQMELSNAIEWNYRMQSSRIIEWTRMVSSNGTEWNKSNGIIIEWSRMESTSNGIKRNYRMESKRIIEWPRMESSNGMEWNNPWSRMQSSSNRIEWNHRMDSNGIIIERNQMESSSNGNEWNHHRMEVKGMETNGIIIEWNRMDSLNGIRWNHQEDLNAITEWTRMKSLLNGIEWNHRMVSKGILIKWNRMESPNRIEWNNHRMDSNGIILKWNRMELSNAIEWNYRMQSNRIIERTRLESSNGMEWNKSNGIIIEWTGIESTSNGIKRNYRMESKSIIEWTRMESSNGMEWSIPWTRMQSSSNGIEWNHRMDTSGIIIERNRMESSSNGIEWNHQMEADGIIIKWNRVELWNEIQCHHHRMDSNGIIIQWKLMESTSNGIEWKHHRIERNGIIMNLKWMDSSSKGFEWNHRMKLIEIIIKWNRMESLNGIEWNHHQMEMNGIIIEWNRMDSLNGIRWNH

SEQ ID NO: 929106 - protein, 146 aa, Homo sapiens
MARDQQAAPPAAPVQDPLGEASWAPERNEQLWTGETNNSRCATLRAVTLAVKIAASLLKPARPRTHGKEETPNTSEHQKEQTPDTPPLRTAPTDILNGIMNTGAQRVEGRKGVRDEYLPVEPQGANINDLNTSKNEIWNKQKVRRR

SEQ ID NO: 929107 - protein, 150 aa, Homo sapiens
MDQSAGCGFTPEAIETTNPLGGKNNSRHTTLRTVTLTTKVCSFTPEPARPRSHQKEESPNTSEHQKEQTPDTLPLRTVTLTARCCEPLKGTEIVHSESSDFKAVACQCSQLNKALPSTTRCLRGFVCSSSCYNYSPQKCIVHCKINKTII

SEQ ID NO: 929108 - protein, 138 aa, Homo sapiens
MTATYLTHCKEMDTGEPGYGLACAQMEGVKLLTLELALQAGCAAVRGSQLLRGATEPEQTVEIKANSVKSYSTHTTSLVPQETSRIKTLAEWKCSHTSSYCVLEDALMSLKRGRGKSFEFSSAVTRWRCVKGYFLPGC

SEQ ID NO: 929109 - protein, 148 aa, Homo sapiens
MERKTNTKQRRQHQQQKNKLMKMRNNQQKNAENPKGQSAFSPPNDHNMSLARAQNWTEDEMDELTEVGFRRWVIKNSTELKEHVLIQCKEAKNLDKRLEELLTRITSLERTINELMELKNTVQELHVSIDKSTKWKKGYQSLKTTLLK

SEQ ID NO: 929110 - protein, 260 aa, Homo sapiens
MSRALDVLQMKEEDVLKFLAAGTHLGARAIAAFKNPVDVSVMSSSNTGQRAVLKFAAATGATQIVGRFTPGTFTSQTQAAFREPRLLVVTDPRADHQPLTETSYVNLPTIALCHTDFPLRYVDIAITCNNKGAPSVGPSWWMLALEVLRVCGTISLEHPWEVMPDLYFYRDPEEIGKEEQVAAEKTVTKEEFQGKWTAPAPEFTAIQPEVGDWSDGVQVPSVPIHQVPTEDWSAQPATEDWSAAPTAQATEWVETTTEWS

SEQ ID NO: 929111 - protein, 134 aa, Homo sapiens
MKDETSNSEGAKATGHELANQPPQQLMPAGQWRPEVTRDIAAEASENPGYSLKSRTQISPPTAALRLPLYPVGRLGKSRGRRRPYQEAAGKLQSYLEKPHYLQGKGPIPSPSVFLTPSSIPEKGPHQTLNLLVP

SEQ ID NO: 929112 - protein, 166 aa, Homo sapiens
MNIKQVFALMEKVLLVWIEDQISHNIPLIQSQIWSKALTLFSSLEAEIGEKAAEEQLAANRDQFMRFKERGQLHNINVQGDAASVDVEATASSYLENLSNFNDERSYPKQQIFNAEETAFCWKKMSSRTFTDAEEKTVPGFKTLQDRLPFLSGTNAVDGITLKTEL

SEQ ID NO: 929113 - protein, 552 aa, Homo sapiens
MMCFPDFPFPDDFPNFMHNSKIQEYIIAFAKEKNLLKYIQFKTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQALGWVLKTVVNITGMIPALEQELPLEKKDKQVIQALNAMIPKLDASQRSQSNGQKGLTAERCLLTPLSAAGVIDPFLKRDLGCSPEYPLQMVTNFMVELVFFKVMISSRSGSWVMSRVWDNGYPWDMLLVTRFGTFLKNNLPTAISDWLYMKQMNARFKHENYGLMPIKRVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVHQSHSCDNPLIH

SEQ ID NO: 929114 - protein, 134 aa, Homo sapiens
MVYRASKVIGQPQSSAARLRRSGKESESLGPEFHGLWEWLPVGSRTDGTWLRRNPGLRAFLGLVARFLALVASSWGRQAWRNAWSLRFRRLEVLVCWRCGWGLSHSGGKELQLRNMLLFGCLYSIIVHLEGEVN

SEQ ID NO: 929115 - protein, 142 aa, Homo sapiens
MGQKRLVSVPGATRAIAEFSSEAEQCAQLGQILRLLGPKLKQLGHPTGREVKCSECACSFECGHSGSVLSTSHAFAHFILTPPGDTHVNAINRTQKIQLLIQKASENSPCINIQCSSINHLNVPHGNLAQYTFLGSSEWFLP

SEQ ID NO: 929116 - protein, 304 aa, Homo sapiens
MWSQEEPTVEWTAPQLLPPALGPNINTDVGVGVDIGEGVGIGVGIGVDIGEGIGVDVGEGVGVDVHIDVDVVIDLCVGEGVGVDVDAGVDVGVGVDAGVGEGVGVDVGIDVDVGVGIDIGVGLGIDISKGAGVDGGVDIGVGVNIAEGVGVDVGVDVDVGADMGVGAVVGVGEVGVDEDVGVSVGVDVGVDVGVGVSIDISESLGVDVGVDIGVSVDVGEGIDVDGVGINVGVDVDVGVDIGVGISIDIGERVGVDIGVGVDVGVDIDVGVDVDIGVGVGVDIGVSIDVGEGIGVDQDLGMLLL

SEQ ID NO: 929117 - protein, 175 aa, Homo sapiens
MTNSIITAFEKARPAGHKGGSRAATSHTETESSVGSQSGDVRPAQPEVEKGWLWTVTGEEEVSLQGDDLACALEAGECVRKRCAQAEANGVEILGHPWLLGLFLMPLRLDSGLTLSPATHVFAGVSCSTWVGLHEGTVELGMNYFKRLFLVCRELPRLILTPLGPYFFDHIHRDG

SEQ ID NO: 929118 - protein, 121 aa, Homo sapiens
MLLLFFQTYHWLKKQGHLFQAEPETCCGPCWSTLPFTIRFSLSPSLKKAREPVNTARESNPVVVCLPLERAAHLRLQGVPQLELLQEDTFPTPKKGPNRVVTARQDGHLACSHSRKASNSH

SEQ ID NO: 929119 - protein, 505 aa, Homo sapiens
MEGLEEDRKMWESLELPRDLLNGFDQNADSDVNNEVQAEVVLDGDEELIKFNLAAEICICNEEANVNSQDNGENVSRACQRSWWQPLLSQAWKLKREKWSCGLDLGPCCSVQPQDLALCIPAAAVPAQAGVKGGQGTAQAMTSEGASPKPWQLPCGVGPGDAQKSRIEVWEPLPRSQRMYGNAWTSRQKFAAGVEPSWRTCARVVWKRIGAVGKGPLSSSPQNGSSTDSLHCAPGKAADTQHQPMKAAGAEVVPCKVTGVELPKTMGVHPFHQCAPDMGPSAAGLLEFARGPLQTLFAWVSAVVAAEQQIFVNRECCCLIVPLEVLSQRSTQPSQPYTLSYKWKPWEFSEVRGKDRSSKGIPGPLSRTQCPLQQVIRRQDTGPSSLFPIMEENIQIDPFLGQLSKCLILYCSILKALTMEILTAGLFEYLSRLRGSQLSGSNQRQMFSAQCSRQCKSLILERREIHICPGPGGPSQTAAGKLSPSGTQGSFWVEKAENDIWGVWI

SEQ ID NO: 929120 - protein, 275 aa, Homo sapiens
MSQQVSMAVTLLSQKAGSQGLSPDALKQAKLLQANIPSANIPSATSSLSPVLTPFALKPDGTRLFPNVMSPLASDLLPQMPGSMLFQSPFSIVALEPSKKGKRKPPNISTVDLKPKDEAVLYKHKCQSSLPSVMTALLAAQPRQQAKQHGCMWCGKNFSSTGALRIHGWTHTGEKSFVGNICGRVLPPKPNTRQTLAQPRWRRNSLNVNGTYGTFYCVPTRPRGHLWEQLVCGVLMNGISVLIKKSQRAALPLLLCEDTVRSQQSVTWKRALTRT

SEQ ID NO: 929121 - protein, 147 aa, Homo sapiens
MEQNIMHRAKSRHSSRSCTPPLACIFGNRLWGTIPRGQKGFQENKCKKEHNTKMYKNRENQDYKRGTNETDECTPEEAWLIQQIKLQLVKTEFHIKQEEVTKKKELITKTKKRSQAALQEAMETNRKRKEEKGTCHMAVCEQYKTKL

SEQ ID NO: 929122 - protein, 354 aa, Homo sapiens
MMVLQEPVQAATWQALNHYAYRDGVFLAERLYAEVHSEEALFLLATCSYRPGKTYKAYRLLKGHSCPTPQCKYLLAKCCFDVSKLAEGEQILSGGVFHKQKSHDDIVTEFGDSACFPLPLLGHVYCKTDRLAKGSECYQKSLSLNPFLWYPFESLCEIGEKPDPDQTFKFASSQNFRNCLPNSCKAQVPNHSLCHRQPETILTETPQNTTELNRLNLESANSKYSLNTDSPVSSIDSAVISSDTVPLGTGTSILSKQVQNKPKTDRSLLGGPASLSPLTPSFGILPLETPSPGVGSYLQNYTNTASVMDVTSTGVPPKKSVARIVQIGAKSVFSQSGNSQEVTPILAQTESSGP

SEQ ID NO: 929123 - protein, 165 aa, Homo sapiens
MSLLFSFLNPRGLSLRASSAAILLQPTTGDCGGGGGGGGFVFQLLFCCCCCCCCCCCCCCCWCSKAPTAAVGFSVGEIWERTDAASRSISCQTSLAQRPPPAACHLPRSSEADAPPPSHPATLLRLAYARRPQGSRRSLPPDAPGGPDGWDETGPPQTVLFLGVG

SEQ ID NO: 929124 - protein, 139 aa, Homo sapiens
MFSFPFCKLEALGDSESKEESNSENLKLSPEGWVRVAKQEGGRNGLEGARDAARRPVVVAAVWERWNGGLGYGMGRHGERLVKLKYWDLKQQFWGKILSSVEYEGPVGCQRKYIDWAVGHVNMDSREQETDLSNKGIAW

SEQ ID NO: 929125 - protein, 144 aa, Homo sapiens
MAFSVLISCPGRLSSRSVTIRGILGQPVTRLINEAVIPLYPVVPNPYTLLSQIPEEAEWFTVLDLKDAFFCIPLHSDSQFLFAFEDPTDHTSQLMWMVSPQGFRDSPYLFGQALAQDRGHFSSPGTLVLQYVDDLLLATSLEAS

SEQ ID NO: 929126 - protein, 132 aa, Homo sapiens [sequence omitted]

SEQ ID NO: 929127 - protein, 154 aa, Homo sapiens
MGIQSPAHVKCLVVILYHILLTLPGCPGPLCCPLDIELLQPFLDSYTCYGWGPFPDSSHLNRTFTLIGAECLWLNGPCFIGELIEDNLMEVSASDSVLHDEEDVKVPENKLKLYNLAEGFRLFKTAFDVFYDMPTEHEDDEDEHLYDHPLPLNE

SEQ ID NO: 929128 - protein, 144 aa, Homo sapiens
MGGDVSKRDKRLTKCPGQCEKKCGIRSPTKSPHWGTAKWICEKRPLSSRSQNSRSTDSLHHAPGKASGTECQPVKAAEGIVPGRVTGAELPKALGAHPLHQCGLDMSHGESKMSSSYIHKICLYIKDDNVEFYLSHVLLENSEG

SEQ ID NO: 929129 - protein, 169 aa, Homo sapiens
MCFVKQMLEGSMLGWGSHGGPPLGQCRRKMWVGSSHRVPNGTLPNRAVRRGPPSSRPQNGRSTNSLHCAAGKAADTQCQPVKAARRGAIPCKVTGVELLKAIVAHLLHHCDLDVRHGIKGDHFGTLRFDCLARFWTCMGPVAPLFWPISPIWNGCIYPMPVPTLYLGSN

SEQ ID NO: 929130 - protein, 144 aa, Homo sapiens
MLVSAQSLERAEVARRSWCVSTAPSVCTPSQAAAVPRLSPNFALRLEWALTAGRSQAVGAGTCRDAWVFRHGIGSRHMQRCLSLQPWIEQLQLCPGAQVSCLLCGVGELGLQPLFGWLQLCLGGNVGELCSNTFLLLESTTSEL

SEQ ID NO: 929131 - protein, 178 aa, Homo sapiens
MSVLRVSLGGHTLIVIPEVLLSSVDECSGAQGDWSAGLEVDVFLGAHGEDVVVEQEVCASVPEIAAEEEAYEEDADSEFPELWMDSAAGSAAGLYPSARSMFSPYREGPIRGPCALAPNPSSERRSPRPIFDLEFHLLEPVPSSPLQPLPPSPSPGPHARPELPERPPCKVRRRLFQE

SEQ ID NO: 929132 - protein, 283 aa, Homo sapiens
MMSIGTLLAYTLVSVCVLLLRYQPESDIDGFVKFLSEEHTKKKEGILADCEKEACSPVSEGDEFSGPATNTCGAKNLPSLGDNEMLIGKSDKSTYNVNHPNYGTVDMTTGIEADESENIYLIKLKKLIGPHYYTMRIRLGLPGKMDRPTAATGHTVTICVLLLFILMFIFCSFIIFGSDYISEQSWWAILLVVLMVLLISTLVFVILQQPENPKKLPYMAPCLPFVPAFAMLVNIYLMLKLSTITWIRFAVWCFVDWLSYAKARCEPAATQAALPAIRQRKTP

SEQ ID NO: 929133 - protein, 181 aa, Homo sapiens
MQLPEEVDLVSQPFQARLQLCLVHVSFIHVLLDEDKFILRFCTLIDLILILVLEVLHQPLHIAKLRLQLQLLLAQSLQLPPKVVHVALKYVDPSHLLLLQEAPLGLQHLVLLLQEPYLVDEGGKLVVEGLDLLLLLGVHGLDIGIYLQVNRAQQALHIVENGVSISSSIYPLSYNQSNYTL

SEQ ID NO: 929134 - protein, 152 aa, Homo sapiens [sequence omitted]

SEQ ID NO: 929135 - protein, 139 aa, Homo sapiens
MKSYFKLNLLANCPLPSDEGFRPKSEVYAASLLEFCRRSTPANAFCLSITSRGCRTANIAEQQILLPDPSSGTLSQRGIWLYEVSERKSLDPWRFPGEAMPCLALAKHPLSMDCIHFPTSPNEMNQIPQLEMQKSPVFC

SEQ ID NO: 929136 - protein, 191 aa, Homo sapiens
MEAKQKGFPLIKPSDHMRLIHYHKNSMDETAPMIQLSPIVSLPQHKGITGATIQDVTLQRPHTGTTEWTKHQRWWPALPTLGALSCLRQVPLVASGSLEFQACGSYLVRCHGRGDLRSMLIGSLDLAPFLGVCTDVPPYLSCSHLCEGSQEYVKLLGICACLSRCSAVTPYSSVYQTQGPGGVGSQGDLLI

SEQ ID NO: 929137 - protein, 138 aa, Homo sapiens
MREAKNSPTDLFHGTLNSSGLNLDGSLLRDLASSPQCNGAVSLFPGRSAGREIIDTHKIVKAGYRGVTAFWSHGANNALDIPAFIIKFNEGGGREALQLQYWLLPLHQGAQMTYTAGIHRSGDGCPSHQELSRLRGKF

SEQ ID NO: 929138 - protein, 145 aa, Homo sapiens
MTPWQLTSPLCLLESEQVMGYVCGCSGDVVGQGQRIPGQGSGTSGMQLGCFPQEWPGRQSWEEPADKGVIGSNAPLSSGCGSSAVSQPCRQQELQPLSARWRALCDRHLQLHFPAASQHSKTFRALTIVPSDSLALLQLLSSFST

SEQ ID NO: 929139 - protein, 150 aa, Homo sapiens
MGFKLIWVEDKGVPPEAGLEPCQKEDSEEPDKCSRQWKGSLSVDVPKSIHSPTEGHLDLQFLAMMDNTTKNTYLKDFNEAFKITDRILRGENDFSAFGVPEALSRGDCQKLLATVAFSSSEGWKREQLQASEAFGGSDAGSFQQGQWIPT

SEQ ID NO: 929140 - protein, 154 aa, Homo sapiens
MGRNQPKKAENSKNQNASSPPKDHNSSPVREQNRMQNEFDELTEVGFRRWVITNSSEPKKHVLNQCKEAKNLEKTLDKLLTRITSLEKNINDVMELKNTARELREAYTSINSRIDQTEERISELEDQLKYSVKTRLEKKELKETNQAFKKYANM

SEQ ID NO: 929141 - protein, 352 aa, Homo sapiens
MEWKGLEWNGKEWNGMEWNGMESTRLEWNGINPNTMEWNGMERNGVEWNGINPSAREWNGMECNGMESSGMEWNGMECKAMQSTRLQWNGMECNGINPSTAEWNGMECNGIESSVMEWKGMEWNRMEWNGMEWNGINSIAIEWNGMELTRIEWNGMEWNGTEWNGMEWNGKERKGMEWNGMEWNGTERNGMEWNGMEWNGINTNRMEWNGMEWNGMQWNRIIRNGMERNGMERNGMEWNGMEWNQLDCNRMEWNGINANRMEWNGMERNGMEWNGTERNGMEWNGMEWNGINASAGEWNGIEWNGMESTRVQGNVMERNAMEWNHPEWNGMEWNAKPWNQLDCNGMEWNGKE

SEQ ID NO: 929142 - protein, 205 aa, Homo sapiens
MAKRGQHRAQAIVSEGANRKHWQLSRGFEPVGTQKSRIEVWEPPPIFQRMYGNAWMSRQKYAAGAEPSWRTSDKAVWKGNVGLEPPHRVPTGALPSGAVRRGPPSSRPQNGRSTNSLHHAPGKATDNTSLLKQPGEGLYPAKPQRQRCPRPCEPTSCISMTWILHDILEMSLPSHVDTSLLGINHSSDDLFSSTVLSLKYFEEQG

SEQ ID NO: 929143 - protein, 573 aa, Homo sapiens
MGPSQKLLGIYRKYMTCRADLQCVYFLQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGRFVCEYAGEVLGFSEVQRRIHLQTKSDSNYIIAIREHVYNGQVMETFVDPTYIGNIGRFLNHSCEPNLLMIPVRIDSMVPKLALFAAKDIVPEEELSYDYSGRYLNLTVSEDKERLDHGKLRKPCYCGAKSCTAFLPFDSSLYCPVEKSNISCGNEKEPSMCGSAPSVFPSCKRLTLERQGHKQPPPTQCLCQRQLTEYGPLEIFCPQALVYYIALNPRNQIPKFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNEPFLDRIVTCDEKWILYDNRRRSAQWLDQEEAPKHFPKPILHPKKVMVTIWWSAAAGIGQQKGPNSSPRQCPTACCTTHTSKVE

SEQ ID NO: 929144 - protein, 164 aa, Homo sapiens
MGLKLPGNCLEKEEHILKVCELFKIEHTLSSWTPYHFLCQIFDINMQSSLDEESKHLVERNGYHRHIVILPPKVFTSDRKYSDYIFNERTVKKVKPCPGVGHWRTGHPFITDEIDHEDYGGGFPPSYIFGCWFGGNHQRQRKEMLRQADWFSWMKRNRYKVLVW

SEQ ID NO: 929145 - protein, 119 aa, Homo sapiens
MQGTGDSPSFSETERPLGLVSGSKPITRGHQGAGPQGAPGWIANICYRTNWFVSPLCNNIPITVRQQDLQQRKFHNHSTPSEDTRGDPQIHLTKEFWAGAFKGIVEGKGLENWGCWPNV

SEQ ID NO: 929146 - protein, 620 aa, Homo sapiens
MLLTCLGKDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVVLRGGGFLPMTPMAAAPEGNVKQAEPEKEDIMVMDTKLKIIEILQSEAKSRRTWSSDGQEKMSVPAPEQVDSVFLHLFALSRPSVDWMVPTHTGEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKLVNSGEDVLVFYNDRASFQTLIQMMRSERDRMDENSPLMYHIHLVELLAVCTEGKNVYTEIKCNSLLPLDDIVRVVTHEDCIPEVSEPSLAVPFSLLCGVCCRGSLGDMVVAGLGEPSWL

SEQ ID NO: 929147 - protein, 138 aa, Homo sapiens
MPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICNAGNALKYL

SEQ ID NO: 929148 - protein, 151 aa, Homo sapiens
METSDLRDEERALPALAMAHCQQEDPASPGEEEGASNLVIDLIMNASSDRVFHESILLAIALLEGGNTTIQVGRQLGYWYGIPAEQEESLFWEPDVWVVLSMWERSEASSGVRAALLLHVGVRELLALKKEGGSDLSPAGVPRDTALLRKL

SEQ ID NO: 929149 - protein, 467 aa, Homo sapiens
MLDGLSWCSGGSWKPLRRGICLHRACTLHKADSKEVNEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRGGFQRISNNTERHSSGISQTWA

SEQ ID NO: 929150 - protein, 280 aa, Homo sapiens
MSFWSSISFNLAVLMNLLVAFFYPFKGVRGALPFEGFQKGRGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLTLPFNGDWCAWSTKIEAPQLAAFGGSERKAPQELGQPRNSRVTQPHCVLGTPDLLSRTYTKRSVFEAVIQQLSGSPFLVNTCSDHKRLSPKRQEMPLWSTPPCPSRHFDLSSNLPPVGLASFLFI

SEQ ID NO: 929151 - protein, 209 aa, Homo sapiens
MRWGALHIETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKVLEGFLEILCRLYP

SEQ ID NO: 929152 - protein, 142 aa, Homo sapiens
MTKAAGITVLDIKIFHKVNRTACYVAQKQTPGPSVNYSRSGNFHLRNIINSFMVPAIWLANCLFTELKFYIQKEEEELAFSLHEHTLERSCEDTATARGGHLQARKQTLTRHSSCCHLHLGLQSFQNSSNLYYIVGHLLAMV

SEQ ID NO: 929153 - protein, 183 aa, Homo sapiens
MGHEFKMGCKAAKTTCNINNAFGPGTANECAVRWWFKKFCKGDESLEDEERSGRPPEVDNDQLRAIVKADPLTTTEEVAEELRGDYFTVIQHLRQIGKVKKLDKWAPHELSENKKNRRFETSSSLILRNNNEPFLSSIVTWDKNCILPDQLSGWTEKKLQSTSQSQTCAKSRAWSPFGGLLSV

SEQ ID NO: 929154 - protein, 141 aa, Homo sapiens
MPLHSSLGDNGRLGMYYSEECNSRCLGNMKHGSSQTTHSGKTAFRGKQCLSRNLYERRAPDMEIPREEDKRHKEQQTQSTLYENECGNRKEDHVARAESAGEKVEGNEVRKVAKGKIRVLLRQQLCAETTIHIKVEEEKLP

SEQ ID NO: 929155 - protein, 193 aa, Homo sapiens
MNTEWIIAVTQEGLSCYYNLPIKEKAHRGCVKSRIENLVSIDKIQYEYIVHKLEFVEDISNQKENGDDKIDRYTNTFRTLSLLVVISISLDFSASSLSICLQWKIRGVIDINLFSSYLKEKLNDTENPHLKNRKKEVIKYNTETTVILPDAPLAALLMDSFGARQEWAAWGPRELPGPFYGFLYPFILFGSLN

SEQ ID NO: 929156 - protein, 151 aa, Homo sapiens
MQLVSQSQDTNNLHTYVVYRKALVTDPDYCITQLPFGEKQQKPYKNQLEPCKNQHKRDFIVSLILAIKGLDPYTTGLRTSNDVVRAFYLYIFLFFLSVFLNVGLIFFLLFLIDFLRLRAKLDLGRPRLADFGLQCHRDTIQCNTVEYNTIR

SEQ ID NO: 929157 - protein, 140 aa, Homo sapiens
MHYSSQHSPSWLPLARGGSSPTPCASWRKCLVLEFLAFLWAELGSEAKEEKEEERTCRLLGKCVDAENHSLVIGGLFPIDSRTIPANESILEPASAKCEGMEARNGYSFNIHPEGDIWEQETEKVDTEARESAGPVEMRA

SEQ ID NO: 929158 - protein, 164 aa, Homo sapiens
MEGVKSGKKDALPREEEYREAVWLQWLCGTAICSAQSKLPGSFVYTVKGKPPTQASLMLDTSPHTKLEHPRSTSDYCAGSEYFKPMDLIWGWDLLSKATWLPGFSPVSRGSEWFCLAGVPGAIEVKKQTSKQTNKQKLPQLAQCLPKLPSSFVLETQGPCGVVI

SEQ ID NO: 929159 - protein, 191 aa, Homo sapiens
MSDLGPLNKEIKGWCYHYCKNNTKPLFWRGVADAEIPIFDLGWKKYMMKSCGEDGFHIQVRLHPFHVMHINKTSCAGLTGSKQGTVARVHIGHVIVSIGTKLQNKEHVIEALHRAKAKFPGHQKIHISKKWGITKFNVKTWWLRNGSFQMTAGSSTSPVVPSGQVVGPALMRASTVLPLLRPNNKSYFLST

SEQ ID NO: 929160 - protein, 262 aa, Homo sapiens
MNKIEKYHFHSISSVHHSLVEFHLKELRNKDTNIEVTFLSSNITSSSKITMYDSDEIRCEFGDISRVGMLDMNSAVRHYKFLLEGVHFTPKTVATSWCSFWLTQSHTARYENPGATILLQCPLVYSKKSTTTFLVIFKAVGVGRGAGEGDTKDCGKELTPWCMTANQCHQQSPIGAKGEVQVQQRYGKGIIAHATPQCQINQVKFKFQSSNRVWKKDRTTIIGKFCTALLPVNDREKMVCLPEPVNLQASVTVSCDLKIACV

SEQ ID NO: 929161 - protein, 137 aa, Homo sapiens
MKSCGEDGFHIQVRLHPFHVMHINKTSCAGLTGSKQGTVARVHIGHVIVSIGTKLQNKEHVIEALHRAKAKFPGHQKIHISKKWGITKFNVKTWWLRNGSFQMTAGSSTSPVVALWTSGGPCTHEGFHCAAPPKAQQ

SEQ ID NO: 929162 - protein, 145 aa, Homo sapiens
MPDLQETPSELSFQDFEYPDYDDYRAEAFLHQQKRMECYSKAKEAYRIGKKNVATFYAQQGTLHEQKMKEANHLAAIEIFEKVNASLLPQNVLDLHGLHVDEALEHLMRVLEKKTEGIKDKVVKKTHNPCLYWSLLSSGVYHLVG

SEQ ID NO: 929163 - protein, 299 aa, Homo sapiens
MKPEAPLCLSGTPVLICIFLMVNDVEYHTVAAASPCTMSSYCSAALLLRLSQWKKRLPCWSLTVSPACTKLDLLGTTPPEPCSPPSLGAPGTRARWWAWRGIIINWDDMKKIWHHTFYNELRVAPEEHLVLLTEALVNPKANREKMTQIMFETFNTLSMYVAIQAMLSLYASGCTTGIVNGPWRWGHSYSAHLRGLSPPPCHLHANKVLSSGTTMYPGITNRMQKAITALAPSTMKIKIIVPPERKYSVWICSSILASLSIFQQMWINKQEYNKLAPPSSTANASKWTNVLVEDKSVAW

SEQ ID NO: 929164 - protein, 245 aa, Homo sapiens
MISFKILLLIDNAPGHTRAMMEMYKEINVVFTPVNTISILQSMDQGVIFTFKSYYLRNTFCKTIPAIDSDYSDGPGQSKLNTFWKVFIILDAIKNIYDQWEVKMSTLTGVWKKLIPVFMDDFEGFKASVEEVTADVVEIPRELELEVEPEDVSELLQSRDQTRMDGELLFTDEQREWFLEMESTGEKAVNIVEIITKDLEYYINLLDKAGFEKIVSNFERSSTVGKMLSNSITCYREIFCERRVN

SEQ ID NO: 929165 - protein, 146 aa, Homo sapiens
MEQRVIEGKLDKGGSDPPSVFRLLMGTGKSYFKIRNFLVMTGWAPSDGTEADRHFYCCLLSIPKHPWCKKTFSHQYQQRVSVSQSHQFQNQQRHCDDIKGALAKRMQQAEKPEQAGCIVLMHCLYFSVVLVIHQGISFSNFPNLLR

SEQ ID NO: 929166 - protein, 138 aa, Homo sapiens
MIGSFLRPPQQEAAMFPVQPAELQSSAPGSWQREQDREGKVKIKDGKNGQGQDKDLHARNMKEELDCEGKRKEVDVEKHLKISHGPLRWIPNKLRINCDKVNQERIDISTGSQGRTTDISSRCQCFMVGTRTCDLLVN

SEQ ID NO: 929167 - protein, 151 aa, Homo sapiens
MGWKVGGFQGFWPANMAWAMTVAMVEQSSVSPYALVLAVAEIWWVGQSPCLQVSGYAKGGREEESILGRTKCHKKNEMEAENSSSVCFSHYKSKYIASPNCQGDWNMPLSYEHTKKNEVVYEHLDSLCNPELSTDTKKTQSMTPQIGCSEL

SEQ ID NO: 929168 - protein, 139 aa, Homo sapiens
MHTRTSKCLNHSGQAFLQNRLPQELATSARNLATRPRNAHSPGFHLSHVPSVRDPTENRTQLKTDTARSPRKPIGPSQVLWVTLTVEDTSTPSLATNHAPLTISLKPNHPYRTQRQYPILQCALKRLKPIITRLLQQGF

SEQ ID NO: 929169 - protein, 146 aa, Homo sapiens
MPCVSREVKKEPSTERQNQPFKVLATKTVSHEALDAGIYSAIPTEKVDGTCCYVATYRDTFRWSSASQRQRWRWRVMAAWRCGGGCEHLEDGSHYVAQAGLELLGSSNSPTSAYQAAGTTGLHHCTPPIQVHIPRNEDNAWHKVGI

SEQ ID NO: 929170 - protein, 147 aa, Homo sapiens
MSCHFFNKIHFLLWKITGEVCETCVPLKSESEELAHGDKRSQLKIPGRRETHIGKQKGTCKVYRIMAYKMLQVVLCSTLLIGALGAPFLLEDPANQFLRLKRHVNLQDYWDPDHSSDVWVNTLAKQVFVLETNGPSPFIFLNSHCIS

SEQ ID NO: 929171 - protein, 219 aa, Homo sapiens
MEQSWMENEFDELTEVGFRRSVITNFTKLKEDVRTHHKEAKNLEKRIDQWLSRINSIEKTLNDLTELKTTAQERELCDARTGFNSQFNQVEERITVIENQINEIKFTNVDMKEKVLRAAREKVELPTKGLTADLLAETLQARREWGPTFNILKENNFQPRVSYPAKLSFISKGEIKSFTDKEMLRDFITTSPALQELLKEALNMERNNQYQPLQKHAKL

SEQ ID NO: 929172 - protein, 137 aa, Homo sapiens
MSTGTQCLAPPYEIAGPLVAYNAHQGKLQAPACNSNPKELKCRLTLAKPQGLPNPTATDTSAALEHAQGLQPACHLIQGPRPLYSADDDADQNILTSRENLSSISSLWLCYLKNLGILCSRCCLYRRNGKFFNNLCP

SEQ ID NO: 929173 - protein, 153 aa, Homo sapiens
MGKPPTQASVMMDVPPPTKFKCPRSTSDYCAGSENFKPVDLTLLGAMGVGSTELDHLAPWFQPPFQGVNGSVSLAFQAPLGPKHHLKHEYSFNSGEAGEQSRKAPAMTFGGDDSYHSGHPYSSMTNTTGSAVRDQVQNPRSTTYQICKLQPYI

SEQ ID NO: 929174 - protein, 185 aa, Homo sapiens
MIQLPSTRSLPQHMGVQNEIWVGTQPNYITNNQRNANENHNEEEKHLDFKAACDTRSANVPMTESHVPWKKTSHVLVTIPELLAYSSITTCDTGVFWVTVVTTTGPNRSYVKDYWSFIKQQLRNHMPICLTLIASGVMDGKPGATVQQVAFMASSLLAVTGIYQCSPSAICIEVKVKGWRADLEG

SEQ ID NO: 929175 - protein, 167 aa, Homo sapiens
MCIFITWECCVVLRRKSLNTFILDWQEKGDNSLTKRNRSLQANRGSIPGQAQVVAKAGLNLGCAPPVGLHSPWIVLERLSIGVSMLHSYEGSSSCVYAGVIGDTRIPSPRSFMITEAACLLKYRPYNFGSICEELEVGIGEDYNWERETNWEMSVGGEGEAYRWMCE

SEQ ID NO: 929176 - protein, 227 aa, Homo sapiens
MATSKLNHFVLVAIGERKATEQRIFTTEKLEEQFLPSNTRSFSLAASSGQSYCCMCSQKFKFSEPWELMDEPQAPLGVHENVHSCDLLVKSPGSGFSAEILYKLFDLSGPQFPHLQNEDNDSSCRELCCEFNALPLDCPGCCFGKSLQGERVTAAGESSLCKQHQQWMRPPQGWKKTGKKYFSEKQAGSEPAFTYGVGNELDAISRINCKSENPFKHITILENQQQL

SEQ ID NO: 929177 - protein, 143 aa, Homo sapiens
MAPVPAAACLLSIMLHPPPPISESKGKMQVRVKVQRESLVHSGFSWGFCNCAFAQELQREGTESFDLSKKHDLTLKSIILQMTYFAFKRRKKCWQSAVLQVADRMTVVPSICSGICKGPISATNSSYISAHSPEKPTTPHYRS

SEQ ID NO: 929178 - protein, 143 aa, Homo sapiens
MILLCIHGNMTQPSEPNPLRSKKETFSPKGILPKEKPIQISRMRDDVTPEHQETAHLALALGKGECGNIKVGTESTGKNDQVMEAVQRVKLSQREQVSFENHFYTQRAYSLDWKMKQHSETENSTGSCMSHCYMNITEGERLM

SEQ ID NO: 929179 - protein, 224 aa, Homo sapiens
MIVPLHFSLGDRARPCPKKTKQKTTTTKTRKVEKLPPPLGLRWVTLEASTALGLTNTCSDYFLATDKVHSRPKGSSVTGGPRNAIWKPEPRVRNLNEEIKGHYHKIMNVHESVSGCLLPHKLINKGAVPKPKASQLFSVLPTEERGRKTCLTCEERSPKFRQMGESLRDELDGLSGYILKPQRAVRRGEQTGKDQETRHGEFNVKPNFQRIGRIQDCQSVNLCS

SEQ ID NO: 929180 - protein, 149 aa, Homo sapiens
MKCPFFPSTVVTRCDALHTELDEISHTGGPICESHGARSRKAPPLIILLSNWTSQITWILHKTKATVLPQKHILETQERHSITANKRVFKFTKRVEVNFSKVSQKESGNRQESDVHLSSITNIYLFCNEEELKERKIEGCMFQRGFQAG

SEQ ID NO: 929181 - protein, 130 aa, Homo sapiens
MVVGSTINDVLAVNTPKDAAQQDAKAKDNKKEPLCRQKQHRKALDKGKPEDVMPSVKGAQEHLQKVPLPSMYNKSGGKVRFTLKLEQHRLWIGSKERTEKLPMGSIKNVVSEHMEGHEDYHMMGFIDFCI

SEQ ID NO: 929182 - protein, 298 aa, Homo sapiens
MWRHGGDTGELQELERKLEDQLVQQEAAQQQQALASWQQWVADGPGILNEPGEVDSERQVSTVLHQALSKSQTLLEQHQQCLREEQQNSVVLEDLLENMEADTFATLCSQELRLASYLARMAMVPGATLRRLLSVVLPTASQPQLLALLDSATERHVDHAAESDGGAEQADVGRRRKHQSWWQALDGKLRGDLISRGLEKMLWARKRKQSILKKTCLPLRERMIFSGKGSWPHLSLEPIGELAPVPIVGAETIDLLNTGEKLFIFRNPKEPEISLHVPPRKKKNFLNAKKAMRALGMD

SEQ ID NO: 929183 - protein, 275 aa, Homo sapiens
MGVKMLRMPPASTFNRNSLYFHATAPLGIPLPTEYDSRGAVPGAQPTRQVNVALGLALHNGIFEMDKCSLSLSFQATELWLVWPKEVYGGLSELPLEYSSDLQQEPCLLITCEGGSGCAKALLLSSVGMLLAAAAVIRQLGGVHFACTSAPQHPAAVGGNLSSQHIKMCSHPSTRGRVVSLPVAPSLVPKATAMGGECPWDSRDAKAQGVLGPREECSLVWLGSQNGSLLQLLRTGKKVWDTEWTPSLEQCLPTVSMQFLMLVSGARKIEGLSHG

SEQ ID NO: 929184 - protein, 140 aa, Homo sapiens [sequence omitted]

SEQ ID NO: 929185 - protein, 141 aa, Homo sapiens
MNAQMRAPAPKDPSKNSETQGKVEPQVEGALMPESLPGGRPLPGHTIGGYGSSLGARIRELLQGPADFGQEDPNLLGLCTYCVPGANTPDFILSSQQAREHREAGAKSASSCLVCDPAQSRRSRNIDDLKSPRCRVWTWAG

SEQ ID NO: 929186 - protein, 141 aa, Homo sapiens
MMPPNMLCGSGAIGTAGKQNEEQDLRGSMWPVLLPRAVFYMLQAFLCVAQGMSVELILSYSPIWGSGSKNSGDWATILEEGEKGACELSEGDWILFPLTKTVWPARLDPRWNPAENVTWGLGPSPPGIRGGPRLTTSLQSC

SEQ ID NO: 929187 - protein, 137 aa, Homo sapiens
MTSGVIQEEDRKMRESLKHPTDLLNGFDQNADSDMDNKVQAEVVSDGDEELIGNFLGAKPQRCHLPPDPAAPFGALLLHLAGPSQSSQDTGCEGTVRRGAQAVMFAHPPLTCCVAQFLTGQGSVPVHSPEIGDPCHR

SEQ ID NO: 929188 - protein, 1543 aa, Homo sapiens
MGQTKSKIKSKYASYLSFIKILLKRGGVKVSTKNLIKLFQIIEQFCPWFPEQGTLDLKDWKRIGKELKQAGRKGNVIPLTVWNDWAIIKAALEPFQTEEDSVSVSDALGSCIIDCNENTRKKSQKETEGLHCEYVAEPVMAQSTQNVDYNQLQEVIYPETLKLEGKGPELVGPSESKPRGTSHLPAGQVPVTLQPQKQVKENKTQPPVAYQYWPPAELQYRPPPESQYGYPGMPPAPQGRAPYPQPPTRRLNPTAPPSRRGSELHEIIDKSRKEGDTEAWQFPVTLEPMPPGEGAQEGEPPTVEARYKSFSIKMLKDMKEGVKQYGPNSPYMRTLLDSIAHGHKLIPYDWEILAKSSLSPSQFLQFKTWWIDGVQEQVRRNRAANPPVNIDADQLLGIGQNWSTISQQALMQNEAIEQVRAICLRAWEKIQDPGSTCPSFNTVRQGSKEPYPDFVARLQDVAQKSIADEKARKVIVELMAYENANPECQSAIKPLKGKVPAGSDVISEYVKACDGIGGAMHKAMLMAQAITGVVLGGQVRTFGGKCYNCGQIGHLKKNCPVLNKQNITIQATTTGREPPDLCPRCKKGKHWASQCRSKFDKNGQPLSGNEQRGQPQAPQQTGAFPIQPFVPQGFQGQQPPLSQVFQGISQLPQYNNCPPHKRQCSREPPQKIPTGVYGPLPEGTVGLILGRSSLNLKGVQIHTSVVDSDYKGEIQLVISSSVPWSASPGDRIAQLLLLPYIKGGNSEIKRIGGLGSTDPTGKAAYWASQVSENRPVCKAIIQGKQFEGLVDTGADVSIIALNQWPKNWPKQKAVTGLVGIGTASEVYQSMEILHCLGPDNQERAATVEPPKPIPLTWKTEKPVWVNQCPLPKQKLEALHLLANEQLEKGHIEPSSSPWNSPVFVIQKKSGKWRMLTNLRAVNAVIQPMGPLQPGLPSPAMIPKDWPLIIIDLKDCFFTIPLAEQDCEKFAFTIPAINNKEPATRFQWKVLPQGMLNSPTICQTFVGRALQPVREKFSDCYIIHYIDDILCAAETKDKLIDCYTFLQAEVANAGLAIASDKIQTSTPFHYLGMQIENRKIKPQKIEIRKDTLKTLNDFQKLLGDINWIWPTLGIPTYAMSNLFSILRGDSDLNSKRMLTPEATKEIKLVEEKIQSAQINRIDPLAPLQLLIFATAHSPTGIIIQNTDLVEWSFLPHSTVKTFTLYLDQIATLIGQTRLRIIKLCGNDPDKIVVPLTKEQVRQAFINSGAWQIGLANFVGIIDNHYPKTKIFQFLKLTTWILPKITRREPLENALTVFTDGSSNGKAAYTGPKERVIKTPYQSAQRAELVAVITVLQDFDQPINIISDSAYVVQATRDVETALIKYSMDDQLNQLFNLLQQTVRKRNFPFYITHIRAHTNLPGPLTKANEEADLLVSSALIKAQELHALTHVNAAGLKNKFDVTWKQAKDIVQHCTQCQVLHLPTQEAGVNPRGLCPNALWQMHVTHVPSFGRLSYVHVTVDTYSHFIWATCQTGESTSHVKKHLLFCYNGSSRKNQNWQWTRIL

SEQ ID NO: 929189 - protein, 442 aa, Homo sapiens
MFYAYVTAAAAITTSTTALQLLNISQFSENFHVEQCLKRLKNMNLEGSIQDLFELFSSKVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKEESSEFDVRAFCNQLKHKATQETSFDFKCSQSRLKTTKYSSQKVIGTPHAKSFVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 929190 - protein, 816 aa, Homo sapiens
MSYGLLSGEAFQCTQKHHCYCNSRGVSGLQRALPHSQLQVTKYDAAAHQGFLIPNFPITTVFKAKDMAKPTTEFHLEGPFPGTTSGSKYHISQSPLRKGLTELGPRPLRTEHHPGAASTSEGKPGIVQGFSPCDSLKYGLVGRERPDRPPARHPVKVRSSVVIEDKSTRDPEYVYSQPYEQGTLDLKDWKRIGKELKQAGRKGNVIPLTVWNDWAIIKAALEPFQTEEDSVSVSDALGSCIIDCNENTRKKSQKETEGLHCEYVAEPVMAQSTQNVDYNQLQEVIYPETLKLEGKGPELVGPSESKPRGTSHLPAGQVPVTLQPQKQVKENKTQPPVAYQYWPPAELQYRPPPESQYGYPGMPPAPQGRAPYPQPPTRRLNPTAPPSRRGSELHEIIDKSRKEGDTEAWQFPVTLEPMPPGEGAQEGEPPTVEARYKSFSIKMLKDMKEGVKQYGPNSPYMRTLLDSIAHGHKLIPYDWEILAKSSLSPSQFLQFKTWWIDGVQEQVRRNRAANPPVNIDADQLLGIGQNWSTISQQALMQNEAIEQVRAICLRAWEKIQDPGSTCPSFNTVRQGSKEPYPDFVARLQDVAQKSIADEKARKVIVELMAYENANPECQSAIKPLKGKVPAGSDVISEYVKACDGIGGAMHKAMLMAQAITGVVLGGQVRTFGGKCYNCGQIGHLKKNCPVLNKQNITIQATTTGREPPDLCPRCKKGKHWASQCRSKFDKNGQPLSGNEQRGQPQAPQQTGAFPIQPFVPQGFQGQQPPLSQVFQGISQLPQYNNCPPHKRQCSSRFMYYTVSPSDTRGIVTDKHL

SEQ ID NO: 929191 - protein, 515 aa, Homo sapiens
MQLNLALYTLNFLNIYRNQTTTSAEQHLTGKKNSPHEGKLIWWKDNKNKTWEIGKVITWGRGFACVSPGENQLPVWIPTRHLKFYNEPIGDAKKRASTEMVTPVTWMDNPIEVYVNDSEWVPGPTDDRCPAKPEEEGMMINISIGYRYPPICLGRAPGCLMPAVQNWLVEVPTVSPISRFTYHMVSGMSLRPRVNYLQDFSYQRSLKFRPKGKPCPKEIPKESKNTEVLVWEECVANSAVILQNNEFGTIIDWAPRGQFYHNCSGQTQSCPSAQVSPAVDSDLTESLDKHKHKKLQSFYPWEWGEKGISTPRPKIISPVSGPEHPELWRLTVASHHIRIWSGNQTLETRDRKPFYTVDLNSSLTVPLQSCVKPPYMLVVGNIVIKPDSQTITCENWRLLTCIDSTFNWQHRILLVRAREGVWIPVSMDRPWEASLSVHILTEVLKGVLNRSKRFIFTLIAVIMGLIAVTATAAVAGVALHSSVQSVNFVNDWQKNSTRLWNSQSSIDQKLANQIN

SEQ ID NO: 929192 - protein, 810 aa, Homo sapiens
MGQTKSKIKSKYASYLSFIKILLKRGGVKVSTKNLIKLFQIIEQFCPWFPEQGTLDLKDWKRIGKELKQAGRKGNVIPLTVWNDWAIIKAALEPFQTEEDSVSVSDALGSCIIDCNENTRKKSQKETEGLHCEYVAEPVMAQSTQNVDYNQLQEVIYPETLKLEGKGPELVGPSESKPRGTSHLPAGQVPVTLQPQKQVKENKTQPPVAYQYWPPAELQYRPPPESQYGYPGMPPAPQGRAPYPQPPTRRLNPTAPPSRRGSELHEIIDKSRKEGDTEAWQFPVTLEPMPPGEGAQEGEPPTVEARYKSFSIKMLKDMKEGVKQYGPNSPYMRTLLDSIAHGHKLIPYDWEILAKSSLSPSQFLQFKTWWIDGVQEQVRRNRAANPPVNIDADQLLGIGQNWSTISQQALMQNEAIEQVRAICLRAWEKIQDPGSTCPSFNTVRQGSKEPYPDFVARLQDVAQKSIADEKARKVIVELMAYENANPECQSAIKPLKGKVPAGSDVISEYVKACDGIGGAMHKAMLMAQAITGVVLGGQVRTFGGKCYNCGQIGHLKKNCPVLNKQNITIQATTTGREPPDLCPRCKKGKHWASQCRSKFDKNGQPLSGNEQRGQPQAPQQTGAFPIQPFVPQGFQGQQPPLSQVFQGISQLPQYNNCPPHKRQCSREPPQKIPTGVYGPLPEGTVGLILGRSSLNLKGVQIHTSVVDSDYKGEIQVVISSSVPWSASPGDRIAQLLLLPYIKGGNSETKRIGGLVSTDPTGKAAYCASQVSENRPGCRPLCRKQYEGGDTGREPIMLNRPKMPNKAYRLR

SEQ ID NO: 929193 - protein, 222 aa, Homo sapiens
MLWELQLYVTVSGTILKMIKEAGAIISTRHCNPQNGDRCVAALARVECTHFLWPMCIGEVAHVSAEITYTSKHSVEVQVNMMSENILTGAKKLTNKASHPFGAGGGGPEAVQNPEVERMETNWRNGDIVQPVLNPEPNTVSYSQSSLIHLVGPSDCTLHSFVHEGVTMKVMDEVAGILAARHCKTNLVTASMEAINFDNKIRKGCIKTISGRMTFTSTYFLS

SEQ ID NO: 929194 - protein, 131 aa, Homo sapiens
MAALPACGWSAGPGGPGDSVTPRFPPHQPSSLQQFARFGRNFFRYLTCLMGPCRLLDKIAGSLQLAAPAADLCAPQGGLRWGFLEVWVLADGVSRTLQNVASEIGLGHSGTAPASRRKSRGPWKEGLGKGW

SEQ ID NO: 929195 - protein, 137 aa, Homo sapiens
MGFQECQAKQEAPWKLPGPKDAGHVVASRTRAARLTSRAGSGGLPRPGTSPSPTVTVGDGGSHGFTTSCRCAGLRSRDRWGRHQKNGAQGTWRGAQMPERQRQSPSGSSPSHGRAVERHRGPVPAGPELPEPACSLL

SEQ ID NO: 929196 - protein, 134 aa, Homo sapiens
MTPKTGLCWSPAASVSPYCSQPAGPDSLPLLSHHPDKTHQLGHLSSPQWGPLFCKCPKNAMGLSVSVLSRETESRRRWLAGDLGRSCRRPSSPEHRAGSLPSSLGAFFLSSPSTAQMRPTHTVEAKICIIVLFM

SEQ ID NO: 929197 - protein, 174 aa, Homo sapiens
MQDKVLFTFLSPLLKQKKGLTFFAENCATWGWGRRDASTPLVTLAGVPGNTEFNVLSLPQEHRFSLLAMKLLPGDWGGVISVIRDCFSYPLQYLFQRYEENLPEYQCHHISDPYTSGPELLSPGLSPIPGLGLSLEKDNKFGFLGFYFQFSETPLAFTLAPVPPTSARGPEHLE

SEQ ID NO: 929198 - protein, 281 aa, Homo sapiens
MNVDVKIDTSWIFQDMEDSAEERECLQEEAAGRPDMDMGALRRQLESSEQKLSAAEDKYVTSESGLRSRIQELELSERKLLRKVDQLSTHVAQERSAWLQAQEKLAALQGELASQIREESVARRQQWRLRRLQERLRRKDEALGQQAVALERCRRTQRRQLGLVQRLERNVRCLCRAAGLLLAQRGHRGPRLSRGATEAAAELRALQARAERIEREREEAARILHEHRATERQLPGHLEELRCCIYGLKLSDIGLQGPGGGTLPKKPMPCNRNLETHVSYW

SEQ ID NO: 929199 - protein, 154 aa, Homo sapiens
MRYFSDFSLLPGDGCCCFPSWTEENSCLYGFFCKLCGEAGGALPAAAGWASVWIYRLEMEENQLKNEMQDAKDQNELLEFRVLELEERERRSPAFNLQITTFPENHSSALQLFCHQEGVKRNGWAQNLARKEKKERGVLSRGKAVALEIGCECF

SEQ ID NO: 929200 - protein, 886 aa, Homo sapiens
MARSRQSPEGPCTWSRIRPGRASSVLAPGPETTSELPRDLAGSNREQVPSLEVDPEIQARRPTLPHAGPEGQEPAWDSALVSGWKDIADKGKDNRGRGAAHWQLQGAGMRWPLQAGAALLAFKPPLPEGALLLSEEHVQRPWGGTSCVLCGKELVPCAAGEETRRTPGEPSLDEQILLLVCGCPPEECLDESLLRMDLAWISENLAADPAAEAFLLVQTSALPLWGPAGDSASWRPLLLQEVPSDGQKIQEELATRSPPPPKATGHPGWDCHQTRGRGASLFHEAPYISNHPFLKKHPKDLKDTWNNGGGSLAGRTEEGKARGTLGRKGKNLGDKYQLSQESHQNLSLENGAGAAEDVQDQNGASETKAATCRPGSWQEFLMPLLQGEASVSKEGPESLSRRERVEGYVWGLRGGLSSENEEVAPPATFSRAHETKEPWPTDSQLLAGKVRATGRTARGKEENQVWLGNALLLQGGSLEDKGLEEEDEMPHQEASGLGCRGAPEEPDSQEHESKEMLFFAGETGLPLFPRFALSVEGAEPTDHGHPQAVSKGHNRCALTIDELAQDVEACFQQLSTLQPGSRGWQCSASACRGENWSFAQKWHSGWERAHSQQVWGNWGICSNEEAKSKESGEGDKPGKTTALGTSEVPGNPGTLPHWDEASPNPPQGPAEPWGALERVRSRFHQLISGLKKQRSQILHDNTKLHGDQERFHERVCALEREREREVTKISRLERDNHRLVGDISQLKKELDQYLQAISDLEDCNGKSYCKILELEEENETLKGNLGQLQKATSESVRKSKDTMEQVTLENWKLQTLISELGVSYKELIKDIVLGIEDMIRALSGENEHLLRRVHVLEREVTLQRSTDQGRLDSCFQEPVGHPWRRK

SEQ ID NO: 929201 - protein, 180 aa, Homo sapiens
MVGLLGNAWVPGHYCVELSSAPVVAAHPSLVTGLALPSCAIFAQATSVWFLSQAAKLCLQIQNLVYLSEIYGSRYSVLPSSSMCAHNGIKNKLCLRMAGTGYDQTLKRVDKMMGNAWRFGPNVCGRFTALFLNRINTPRSPSVMRFKGTLTPERIHQLDRNVKDSESEMALMNLDIETKY

SEQ ID NO: 929202 - protein, 138 aa, Homo sapiens
MALLAYWIGPRAWTAQGTEVPGGGLASPGSAAGTAAAQEEIQGCRLTQHLISTDMKENGSERMCMGREEVPGNWSTQGQWGLWACDVTSIPKESMPRCLKHPDVQRMSGMDRNSPRTEVLADSSPKYACKLLNLFRLN

SEQ ID NO: 929203 - protein, 135 aa, Homo sapiens
MGGMGAPLGRLVGPRTHHAERPTAVQPLAARCWGCGMSMDSGVRIPAFKAPLLTLLAVWPGRPTVKSGAIVLHVCGWAPSPPFYSTTPLFLIKFTFKAPLPLTGAVMRGAEASDLGMDEGRALAVSCSWRGQEGL

SEQ ID NO: 929204 - protein, 136 aa, Homo sapiens
MIGVGATSRQSRRTCSTWWEDNSPKPRGSADAPAPPGGKITALSLRGPQTHLLHLEGSSLHRDLGSQPGLQFVTEALGDAEEDEDDEDFVEVPEKEGYEPHIPDHLRPEYGVLSPSTIALSKGAERSQHMPGVMGR

SEQ ID NO: 929205 - protein, 161 aa, Homo sapiens
MLFAGGGAWPLLFLDGDLGFQPNHVVEKKNPFSGEEYKAAEICISKEPNVNSLDNGKNASRAFQRPSQQPLSPQAWRHRKEKWLHGPGPGPHCSVQPQDMVPCVSVAPGPAVAKRSQEPRMGDPLTACTIHREKLQALNARTGKQLYSFLYSAEPQEWHKT

SEQ ID NO: 929206 - protein, 149 aa, Homo sapiens
MGNEIRLYQYNPKGKAQSKQWLLRDGSSPVKAKADQLSAKVMAKIFRDAQGILLVDCLKGQRTIRSAYYECFKKVSQGFSLKKNAWKSFSRVLYHDNVHAHSSHQTENFAKSHLQAAETANARSVIVNGVCFYMLKENKCTMHNNVIDF

SEQ ID NO: 929207 - protein, 211 aa, Homo sapiens
MVCIIKQSREVSASLRNKEKEYKERNFTAGPLGMTSHIGRTMMMTPSRKTSKFLLGILKGEGVYEQGARLSKRHHSILMPPDMSDSCKKNASHINPGDEKNLSLNFTHLCNFSLILTRKNAVLFMEDVWTKKKRIWGNRRKSLQIRFPRDRVGGEGDGQRCSFACHLSSVENASMCQWLQMDSWLCSRGLEEPSPKAISIDTGTSDNLRGY

SEQ ID NO: 929208 - protein, 146 aa, Homo sapiens
MWYSLLFLGYKPIQHVTVLNTANNCNTMMFVCLNIEKLRYPPESPRGRKRDSVLIVNGREAYKFPETDNTALFIGISTLIFTAIIETVLSEAEVIGVSILQKRKLRSREVKKLAPGGRARKCSERCACHGGSHALSSRVRCAAGEG

SEQ ID NO: 929209 - protein, 308 aa, Homo sapiens
MRCRRIEVNVKLRKAKRNDQMLKRRNASSFPDVAASPLEKNRKNQGTVNWSVDDIVKGTNSNNMESQLQATQAAMKLLSREKQPPIGNIIWAVWLLHHDDPEVLADSCWAISYLTDGPNKRTDMFLKIGVLPQLVKLLGASELPTVTPALRPIGNIVTGTDEETQVVIDAGALAVFPNLLINSKTNFQKEGTWTMSNITADPQDEIQQVVNHGLVILVILDAISNIFQAAEKLGETEKLSIMIEECGGLDKIEALQNHENESVYKALLSLIEKNFLVEEEEDQNAVPETNSEGCTFQVQNGTPGTFNF

SEQ ID NO: 929210 - protein, 162 aa, Homo sapiens
MVSLPAQECPAPGTLSATPLALPCQSSTPTHWQDSNLGRTDPPAWHGPLSCLQASFLMELSTKHIPHPPEAHDLTPTPKKTESCEIRSFCLCTFSLCLPSCEHQTYSCLIRTGSSASSLRSPGLEQQGWRRKEKNQSPLGGPSCAPGAVMGWRWLCFSESTQ

SEQ ID NO: 929211 - protein, 152 aa, Homo sapiens
MNAMTSRRTWAPSARNSSLDLTEIHPLKPASQARCEYCVTRMRSNHLTQDVAAPTHAACAPHSSPVSPASCSRNLLTGTQQAGNLQRWNPNKFKKHNIMNARSISGISENLGAARTPPPGGQQKMWTDAAGPVGTQEEEQGEVNCGLFRGWG

SEQ ID NO: 929212 - protein, 142 aa, Homo sapiens
MPLARALPPCAWIALGLAPTFLAQGLAWKCSPATLQHVFVLQSTDKKKGGKFQPFKKLFGKRKKKDPSLFRVPSLGKKSYSHQSVSNGTFSSDEETLEDNLRFYKALGNSTLDQIAAFLIMSPVLVIDSCPQTCIYETCTIF

SEQ ID NO: 929213 - protein, 137 aa, Homo sapiens
MSSQKQVTSKWLHKHDDIVHGVVWLFQAPVHRQVLGRACSWTRHVTPKGMRWHPKRGAQTLKPRKGRFYLLISSFSSAIRSPRDSDMLTALSAPCPALAGGSGAGSALPLLPVMWGSRPPPEDRGPQCYSLLSTCVQ

SEQ ID NO: 929214 - protein, 137 aa, Homo sapiens
MKHKFSNLTVPKNQRKMMIKMKTHGSSKSRIDSSIQHAYQAIADIETARWKSLPGKTLARLRTGRNAHWGGATEVCAVCSQVDPGPSSSWVEPGIQSVSQEAHWQEGHSLTSPRVSVSPFSFFSPNKPCPTHPSNGL

SEQ ID NO: 929215 - protein, 171 aa, Homo sapiens
MAGYSSETKFPDERSGSNICSSPISTVLQPPLQIPRQTGSVLDLQQTPKDLHLRVLTVRRKTNKQKGHPRQNTISMEQSWTENDFDELREEGFRQSNYTKLKEEVRTHGKEVKNLEKKLDKWPTRITNAEKSLKDLMELKTMAQNYVTNAQPSVADRSPGRKGISDARSNE

SEQ ID NO: 929216 - protein, 158 aa, Homo sapiens [sequence omitted]

SEQ ID NO: 929217 - protein, 300 aa, Homo sapiens
MDSQALKKALTHVPVLSLPMGQDFSLYVTEKTGIALGVLTQVKGTSLQPVAYLSKEIDVVAKGWPHCLWVVTAVAVLVSEAVKIIQGRDLTVWTSHDVNDILTAKGDLWLSENHLLKYQALLLEGPVLCLCTCATLNPDTFLPDNEEKIEHNCQQVIAQTYSTQGDLLEVPLTDPNLNLYTDGSSFVEKGLRKAGYAVVSDNGILESYPLTPGTSAPLTELIALTQALELGEGKRVNIYTDSKNAYLVLHAHAATWREREFLTSEGTPIKHQEAIRRLLLAVQKPKEVAVLHCQGHQKGK

SEQ ID NO: 929218 - protein, 158 aa, Homo sapiens
MDNVSRELTGFRRWIITNSFELKEHVLTQCKEAKNLKKMLEELLTRITSLEKNINDLMELKNTAQELHRAYTSINSQINQAEEKMSEIEDQLNEIKHEDKIREIRMKRNEQSLQEIWDYVKRPNLHLIGVPENRPTFKFRKYREHHKDTPQEEQPKDT

SEQ ID NO: 929219 - protein, 144 aa, Homo sapiens
MRSDGFKSTWHFLCLHSFSLLLPCEEVPSAMIGSEEDRKMWESLELSRDLLNGFEQNADSDMDNEVQAEVVSDGDEEFVGTGIKVFLLCFGKRLAAFCPCPGDLWNFEVERDDLGYLAEELSKRQSFKGKQSIKVWNICSLRMQ

SEQ ID NO: 929220 - protein, 149 aa, Homo sapiens
MSIKLDSSLMVTQGLLVKMLRRGPLGSTPVGQLRLYCMQKFSLSTQMSMRVMKSSAAGIPEIRGENGPLHAYLIYLFPRSHLGPGTSSGTQQLCAEFPASSSFSPGEVQLIPSLAYLSSSPYDCHPCGCPTPTDNWTPKEQGPVWWTLF

SEQ ID NO: 929221 - protein, 137 aa, Homo sapiens
MQHWKSDASSIIYLGTLGRFTYHHQPHFICEMEIRAAQSSSLSEVLLPPRKPLDAVPPFPSAFNFNTSDKPVVPQGGRYSRQIQIQLRSITSCVIFGKLNNSLEPQLPLLLDEEHKSPRCLWDFVHVIFAAKNNLLL

SEQ ID NO: 929222 - protein, 136 aa, Homo sapiens
MAEGKEEQVTSYMDGSRQKERACAGKLPLIEPSDLLRVLHYDENSAGKTRPHDSITLHWVSPTTHGNYRSYKLSHMSCFSQYYEVDIAVCQLQVSFILVISVRNLHILACWGDKRCVELSRVIESDADLGFEPSSI

SEQ ID NO: 929223 - protein, 164 aa, Homo sapiens
MLLTLHSAQDNATSKNNPVPNVSGADVKKSCIKTKKPDEFGVTKERCRRGGQSKVYELYCFRIRTVSRDWDEGNLALSITLIPGFSPRNEFLPPQGFFMRWCLTTTPCSFIPGCCPPADTVPFPVYIAFIPDYLVHSSFFVYLPTQHGDDEDEDLYDDPLPLSK

SEQ ID NO: 929224 - protein, 174 aa, Homo sapiens
MAPPGACRPGQCAPRTVVLSTAPYVKNFSRIHHSIWICINKAEVLVMTTPWITPAPVFLEPQSFADLLNGFDQNADSDMENKVQVEEVSDGDEEQRYGLESELMLKREAEHKNLENLQADDAIEKKNPFSEEKFKPAAEICVNNEEKNVNHQENAENVSRVSQRDLQQPLPSQA

SEQ ID NO: 929225 - protein, 136 aa, Homo sapiens
MAFFHSIQCIGYSDVLVVEGVSSELKEAHQEHYILFTIPITLYGFWDIPILLVVAGLCWDVLLVSTILTYESRVSFGEVGGFADPGKLHGHSDSTAKKSRARSDPGDQFYSSSYCADVKTFPEIGLPEFISLVVLP

SEQ ID NO: 929226 - protein, 148 aa, Homo sapiens
MCLGSGECKIHRSDVKYFQKHLSESDIPLHTAAMSVWLTWEKCQKGWHEMMVEAHFPDGVDVIWQSIYELKSLSDCGSASFAFQEGYTYMDVTKKQKKNEDCHQVNGSAIWMGLEFLCGPKSAQSPLHHGSRPDEFLIQMSTWKHHSA

SEQ ID NO: 929227 - protein, 134 aa, Homo sapiens
MENPNGMFSLCCMVEVLVPEPGIWALLRRQQQTTEGVADVKQIMNSINYSYDISRTEMEEMRPHTKEYRQYLKDAKGKERDSPTEPPEENVTLQIPCLLVQTCLRNGKEANRAEVDVAKGEEAIELEGENVTTG

SEQ ID NO: 929228 - protein, 192 aa, Homo sapiens
MLVKVLHMDSGSGICSHIHVSSVMAVQQDVCTLELGTVERKLGKPGASRSQPPYFKPSSRLTAVDRCGQRKMLQQNKPKTDLPERVNKTKVDPLTTTREVAEELNNDHSAVVRHLKQIGKVLKKLYKAISPSSCDVQQKVDFIQQLATTNSVVGPGRSPKALSKAKLAPKKSDSHCLVVCCQSDPLQISESW

SEQ ID NO: 929229 - protein, 138 aa, Homo sapiens
MQVLVSYERSSQVVLGQTHNSAAWFPMWMMKKKEKNKMMMMMKKRKDYKILMKKGMRMKAKKRKMMMTIHSYLFLSEQKLYGINTTKFCGRKEKPSPFALLEAGECQTPVVARQVKPDYACSIHCGNYYIFAMPNKWG

SEQ ID NO: 929230 - protein, 154 aa, Homo sapiens
MAGTLAGLSFQLSDSASARVLSLFQHPHDVGAVVLFLDLRDVQCATLRIKSDPAFKFGFKVLRFSGIPFYNLLVESIKPGNVGTKGKLPLHLLKVCQKSLTRGRLRRKGIQINLTCKQSLPNEEPKIQGKLSIFMLRFNKVWTVMEKYDWTKRV

SEQ ID NO: 929231 - protein, 253 aa, Homo sapiens
MGQTKTKSKYASYLSFIKILLKRGGVRVSTKNLIKLFQTTEQFCPWFPEQGNLDLEDWKRIGKELKQAGRKGNIIPLTVWNDWPIIKAALEPFQTEDSVSVSDAPGSCIIDCNEKTRKKSQKETETLHCEYVAEPLMAQSTQNVDYNQLQEVIYPETLKLEGKGPELVGPLESKPRGPSPLSAGQVTVTLQPQAQVRENKTQLPVAYQYWPPAELQYRPPPESQYGYLGMPPAPQGREPYPQPPTRRQSYGTT

SEQ ID NO: 929232 - protein, 192 aa, Homo sapiens
MFFSGKPEAGSLSPDHTSKENKKAITVIITIIVVIIINNIIIITALSAPKLWTFEEVFETWNWPCRLSEGPLANPEHWPSLPVRCCAPDLGVENQPAKQVPRRSPHHHLLSHLTKDQRVGHRYPEQRKALLKSPSLLVAEPELEVKFPYLSACHLSPTLPGKQKRERQGEFGEIPDGSMSKVLEKLPAAERN

SEQ ID NO: 929233 - protein, 393 aa, Homo sapiens
MVTLFRAVEEHCPWFPEKGTLDVKLWDCVAAKFRELVPTGNYVPVTVWGDWALVRAILMTYQSCDPLQLPQVSESGNPLPLPQLSSPTRPLLSAQPLPSPTPPPPEDGENSISNSGDFGLTSPPDDLISFHEEPILVAPEARTRTAQDHNYANFSLFKALQPLAPEPSNGPRTKLQFTCNSAGLPPSTAAPHPPVISVPQPVTLPSTQPASLYPSSCMDAPAILVAQDCANNHQYAFTSSAPPMPLLTLSYQSDILNFNAWAYPVALEPPNAQGVGVRRYAPLNLTFLKEFKDACTQYGPTSPYVKMVLQTLCTEVILLPLDWDLLAKAVLSPSQHLQFRTRQSEESPLQTQLNRADGILITQAQLTGPDNYSDTTAQLGFDALTTEQVTKCV

SEQ ID NO: 929234 - protein, 175 aa, Homo sapiens
MAPFNITFSDPLAKFLLPVLTTLCSAGLVPEGRMLPPVDTMIPLNWKLQLPPGHVGLLLSLSQQAKKRVTVLAGVTDLNYEDEISLLLHSGGKEEYAWNTGDPLRHLLVLPCSVIKVNGKLQQPNPSRTTNGPDPSGMKVWVPPSGRKPQPAEVLFEGKGNTEWVVEDGSYQYQL

SEQ ID NO: 929235 - protein, 150 aa, Homo sapiens
MAGFVYIWIKNGILLPPWPATPPTCAYANPQTLGGRQTSDWKWSRTHWQKTQVAGRQEDVEESMPVEEHMTDASRPAGHQPAEQGRVWPGQLKESPSHGQRGNYSPSGSPSAESYFHSIKLCTHSPSPRVIRFFPVHQGKNPRIQKALCP

SEQ ID NO: 929236 - protein, 141 aa, Homo sapiens
MARGHGTRDYKAFGRIWKFPLLGIKPKVYDPESVGYKGECRRVAGTDYVGISRNLDFAPGVRMQTFQVTILDDLGQPTLEGPEKFELLLQMPMGAVLGEPNKTTIFIEDTITDYQRINLSLLIDAAYETLFNSLSPYIKFL

SEQ ID NO: 929237 - protein, 210 aa, Homo sapiens [sequence omitted]

SEQ ID NO: 929238 - protein, 153 aa, Homo sapiens
MRETLAEEEEEEEEEEEEEEEEKEEEEEEEEEKEEEEEEEEEEEEEEEEEEEEEEELLLFQPDISCGGTKERSDPPVHISHGSKIYPLWCYTLPWVLQHFVWLCVDRSLEMRMVDMPRGTSRLCLCEGGQFVTQSNSAAAPGAEQSDPKPPNS

SEQ ID NO: 929239 - protein, 181 aa, Homo sapiens
MILRKGQTSYTELTDKEKLLERTPELTANAWDEAVPGYTCAKPAHIELVTASRAECEAKGTWSRTQEVSDPQFLKNIKSLAPESHMGRKKQWVLEWARSFGWEKKEGKEHLSKINFYPVKIQCGDTGVVWMQPTVIKFSHYSNLKSMRAVKWILDLAMRKALGVLSELCHWRGKDQHQLLT

SEQ ID NO: 929240 - protein, 146 aa, Homo sapiens
MGPNINGSTREILLDSKRENTDNSSVAIMGAQRSAAVKVESNLHVTLESNLHVIPSQLQALPEDSGAFLMLSGPAVFEVSAEASESHFQAVSFQTAKTLAQFGDLLFVLKSPVSLSEDLFGLLLRALKLRVYCFGGLAFTTGDLRA

SEQ ID NO: 929241 - protein, 138 aa, Homo sapiens
MQDLFYNRSSKSGYSKSIAQSVEKESANLLVPTVCYEILDFVHNWTQPLTEFLCEREHNRAANKSQNTIVRIQSREDHKFNESTGSRCGNRWIDSGELKFTELSVLLGIGMNKKKVVGLNVTFKAFAIGLMGAPFSKI

SEQ ID NO: 929242 - protein, 141 aa, Homo sapiens
MQNCESIKPLSFINYPVVKSELLGYIRPKQIQGSQHGGDYTAMTGFHWLHYIRHRGLVSGSFSVTAPKLSYKLTLFCILGFRWCHFASYPDPTFLTDCFMCPKLLTHFLPHTHRFGSTHSKHYSDRNHTSTPSELGLKSIR

SEQ ID NO: 929243 - protein, 138 aa, Homo sapiens
MERIKAVLSKAIHETCNILCRIARCLQLEGFLLAKLGILLNMESIEDISYIYIGTELLPLLKGALFTWLSQNDAASMENNMESPQKLKTELSDDPVIPLLGIYLKELKLGSQRDTVLLLCPLKHYSQQLRYSDNLNAH

SEQ ID NO: 929244 - protein, 136 aa, Homo sapiens
MWVGPDKRIKAGCPSQQCFSPEASETTSPPEGTNDCRRAALRAITLTSKIRSFTPEPARPRTHQKEETANTSEHQKERAPDTQPLRTVTLTARQWNEGEAQQGPSVWSLPGLLGPDPFGTGVLRFIIDKQLLMWMN

SEQ ID NO: 929245 - protein, 157 aa, Homo sapiens
MLPLTAVTVAVGFAPETCPQARLEVYGGVLIKQFSWEFTCIKVRIPHFKQLYSELTTDLKEREGRKKSRFKSDGQGNTAESGLFSTALKRHKKLKTTGANLKGLGMIILFNYANGECGNFLRNRTGVLKFENAQGLPGELVGQQTFLGLNPGQSKQL

SEQ ID NO: 929246 - protein, 139 aa, Homo sapiens
MVLCMGRSLLAVLVQEYLVEILLLPAMPVTQHRDTEILHQTLDARVLGWLAPWEYVQMAKKHKKRCLASLAIREMQTKPTTRYHNQIHTRIAIIKKLGKCWQGCGEIGNFIHCCWECKRMQLLRKSLVIHQKIKHRVII

SEQ ID NO: 929247 - protein, 190 aa, Homo sapiens
MLELMPPGEGAQEGEPPTVEARYKSFSIKMLKDRKDGVKQYGPNSPYMRTLLDSIAHGHRLIPYDWEILAKSSFSPSQFVQFKTWWIDRTQEQVRRNRAANPPVNIDADQLLGTGHNWSTVNQQAVMQNEAIEQVRAICLRDWEKFQDPGTAYPSFNTIRQGSKEPYPDLWQGSKMLLKSQLPMKMPKKS

SEQ ID NO: 929248 - protein, 173 aa, Homo sapiens
MKVNGKLQQPNQGRTTNGPDPSEMKVWVTPPAKARLSKKNKSEGIALPDFKLYHKVKVTKTVHGYWYENRHVNQWNRIVNPEIEPNIYSQLIFDKANKNIKVEKDTLFNKWPWDNWQATWRRMKLDPHLSPYTKITSRWIKDLNLRPETIKIIKDSIRKTFLDIGLAKELVHK

SEQ ID NO: 929249 - protein, 163 aa, Homo sapiens
MSSLSGKPCPNQCSNLLEHLSVETMANRASGKWDVRSGRKYGGSHQWDEAAGPGSGIQLGFLCLLRGKETLSCISAESWISGFLAYIPPVTAADGFCQLSVKNSYKAAVKASAGLWSYLNTQLEGSASELEQFCKPMFQLSPNTEPIYFSRSRLKCTAYNGSL

SEQ ID NO: 929250 - protein, 169 aa, Homo sapiens
MPGLQGKAPESSSYSTGITVNMTLDPDTAHSELILYEDWRKVTCGYPQDHHSTSSRRFSAFPCVLGCEGFTSQEDAPSKWMLENEPEGGNLDRKRRTTCEDETHPGECHMKREAEIEWCILKPENTSEDWQPAGTSESHGMYSSPEPLERAPPCRRRDFGLLASELSFF

SEQ ID NO: 929251 - protein, 271 aa, Homo sapiens
MTTAAAVYWETTPDPIHLDLKISPGEAAEQQRWLPAPSALGAPSQRAIELMLTMALLYVGSGNPLGGFTQSGSVRLGPLKETAWLPLGGVGVLCWGDSHLSGLPGLFRDSWQERLGPLNVRPWLLLSPGAPSQGYNSSVHKPLAGFAAIPAARHHPMRRDGSRNSVVLGSVQSVAASGNSRGMHSSVLGFQGPGGMGSRGVLLIHRMHRSVEKTWFPGATPLMLPGAEEEEEEEEEEEEEGKEDAEEEGKEDDEEEKEEEEERGRGEWDSL

SEQ ID NO: 929252 - protein, 151 aa, Homo sapiens
MASEGAGPRRWQLPRDVEPVSEQKPRIEVWEPPARFQKMYGNAWMIRQKFAAGARPSCRTSARVVQKGNVVSVSTRPPPSGAIRGPLSSRPQNGRSTDSLHCLLGKAADTQHQPVKAAGREAVPCKATGDAMMVQHSQINQCDTSYQQNEG

SEQ ID NO: 929253 - protein, 145 aa, Homo sapiens
MLIRWLDKQLAFQLLPIADRPLLLKSAKHFFRLLVFSETFISLTVLSLQERIQACPWNATGYSPFELLYGRSFLLSPSLIPDTRPTWTVPQKSCHPIFCLVVLLFTILNYSYMPCSCLHCWFTLFLQAITADISWCYPQTATLNS

SEQ ID NO: 929254 - protein, 154 aa, Homo sapiens
MIYQTQHTAGPWQRQQEPSTICLKMVTCLWVAVDLLWRRTLGEGQRDLPAAALRSPSPPLSPRKQPPLPPLSWHWRYDNEQDTNGLYPYGARRTPELVASWLEVRVAPEASKLAAGVCREGSLVKNCALNLRFGLNPDRELKTITPNPYGYCEN

SEQ ID NO: 929255 - protein, 142 aa, Homo sapiens
MLNWLSGRVGQRRGNKPLICSVCRLPWYKCPLWSISGCQHEDTGCGIRRRCIQLSLQSQDKPAPTHYWLNLTNPAKHKPKYNSPLESENLQVHKIAKPRCAPEVRLRPASVCVTNLSCFQRHPSQARVVPNWCSHLAANWRL

SEQ ID NO: 929256 - protein, 133 aa, Homo sapiens
MYNSDTSFFKIFVLISLPISKQETQRSVCRNEEMGKHDIQKTAGNTVHCAVLAVTPMVMGLPGSCGSLPLPSSRREYWTARPQPRKRSKVKSGSMVSTECVSLWQHRKVKKLSQTTLIPILNFPRGYNKEKQY

SEQ ID NO: 929257 - protein, 164 aa, Homo sapiens
MLAACKLGNEPSRSVAFVAGSKQWAQGPNSEEAAEERGASAALSCSSSSSSSILEVTRTTQLQLRHGEQSAEKRAAKLFWEKRHDWQFETSPGLSLSQAQSSSVCGKALYFMRAGANDSNPNLKGGFTPQYFTHLGCSTSKQACAIAVKTCLRSQDGTKTTKIE

SEQ ID NO: 929258 - protein, 163 aa, Homo sapiens
MGCNLRTLPAIQISLEQIHLAPGINLIVALEFTTKSNNTCLWQHLRELPVSAQAVPELDLPQNPRPMLRPTNSSLLGKKTLISDHKSPVDLGVVLLIGVEGTTFLIFISQFYEVIISTEYSSDLCAVRSGSRSCILENPNLVWVEFAKGVTKYEMRRIYENKQ

SEQ ID NO: 929259 - protein, 154 aa, Homo sapiens
MHKRVSNSGAQTVASRSGGESFIAWQNKEQKWANCKQKSAADMRALRPNTKCSYVRHARTEANRKETEAGEGAWETHRRSTMVPQLWQLSASLYNSQAYRIRREPGNRRVENQLQGARVHTAARVPYPSFTVFQSDVQLESFLCVKTIEGWIFL

SEQ ID NO: 929260 - protein, 150 aa, Homo sapiens
MRIKEKRGKEEGKQIYKSTSLTSRNSSRKRSWLPGQQGYHLRGDMKSLRPGTMHQPSRTDTGHKAEQSVQAHSGAYKNTSVARMEKVGGAEPRERPRRGGDTGRDPIIMTGFLRFLNVVLLTFWGALSLFAVGGCCPDVGCLGISLASTH

SEQ ID NO: 929261 - protein, 147 aa, Homo sapiens
MYCFSDHVNAYFFTFPLLLNCQNRENLFKNTYLKKKESLIDTGSVKAQQWAPSHHITSPKVDSENSPKAQSQDSPGSPHDLRTHCRSCLREQSRSRMVPPEERAQHPSNVPTSDTSWAAFSDADSSSVSLETQILSSKFKQDQRQTV

SEQ ID NO: 929262 - protein, 312 aa, Homo sapiens
MGNSELIGRGYHRAQSSKHFTHRAQSSKHFTHRAQSSKHFTHRGQSSKRFTHRAQSCKHFTHRAQSSKRFTHRAQSSKRFTHRGQYSKRFTHRAQSSKRFTHRAQSCKRFTHRAQSCKRFTHRAQSSKRFTHRAQSSKRFTHRAQSCKRFTHRAQSCKRFTHRAQSCKRFTHRGQYSKRFTHRGQYSKRFTHRGQYSKRFTHRGQYSKRFTHRAQSSKRFTHRAQSSKRFTHRGHGQVLGPVVSASELQVVVLALSVAGKLSCRYKENPGWTVWPDPSGLHEDHQGRRFPTAPSITNLRMASSLIFHNFKYI

SEQ ID NO: 929263 - protein, 161 aa, Homo sapiens
MSIIKRQKIKDAGEDAEKSALSYAIAKGSSEGLCHEEWYILAQILGFSHGLCNLQNRRFPRVATPPGPWESSDWHLVGAPLGQSFQRKVQAGIFAVLQSPLVIPRQTGCGVDLEQTPADLQLRGLTVRRKTNKQKGITSTSTKRMSTAKPHLKVTNIKDQR

SEQ ID NO: 929264 - protein, 278 aa, Homo sapiens
MGCTHCPTNPRHLVTKLKPMFIDHSENSRALNNYTNFTLPVIYGDEEFTGSWSKGHSCYALANRLTALFPCCRDLWSFELERHDLGCLVEEISKQQSVQDGSAEGKCEVEACTVPTGALPSGAVKRQPPSSRPQNGRSTDCLLRVPGKVTVTQYQPVKAASGAYLPEPMAAQKLPMAVGGYPLHQCGLDVRHGFKGDYFRALRYNDCLVGFWNCMGPVDPLFWPISLFWNGSIYPMPVPLLYLGSNKLVLDFTDSQVEAACLVSGTFNLDFGVNAGMS

SEQ ID NO: 929265 - protein, 253 aa, Homo sapiens
MCSARRQLSGVTFLQTGSPSIYFYYFFLENFQADDAAEKKNPFFEEKFKPAAEICISGKEPNVNPPDHRAKVSRPCQRPSQQPLPSQAQRSGRKKWFHGPGLGSSCCVHPRDLMPCVPAAPVMAERGQHRAWVLLQRMEALSLDSFYVVFGLWGSVEGKCGMGPPHTHRVPTGALPTGAVGRGPPSSRPQDGRSTGRLHYAPGKATDTQGQPVKAARKEAVSCKPQGQSCPRPWEPTFGISVTWMPSKFPLYG

SEQ ID NO: 929266 - protein, 157 aa, Homo sapiens
MMFCVSFSGILALQLEEIKDLKGLDDAQSHSKKPSAEGSCRQTNEVGQTLSAKRQLEHLLCCLDKQRSYPGTLGKMGVAVAAGLHLSAILLSGGFIAIPCQLELNSGQLFPDSRGPAGGGFIHILVIVDNTALTMWVQISTSIFLWIYAQKWDRWII

SEQ ID NO: 929267 - protein, 245 aa, Homo sapiens
MHVLSAPRLLRLYSLFVESPTITIVPGPDFNPASHIIPDTTPDPHDCISLIHLTFTPFPHISFFPVPNPDHTWFIDGSSTRPNRHSPAKEGYAIVSSTSIIEATTLPPSTTSQQAELIALIWALTLAKGLHVNIYIDSKYAFHILHHHAVIWAERGFLAMRGSSIINASLIKTLLKAALLPKEAGVIHCKGHQKVSDPITQGNAYADKIQIPVTPQGHSPFLTPPAYSGLLFFAELLLHLSVTFH

SEQ ID NO: 929268 - protein, 196 aa, Homo sapiens
MPLWASYLMIPGLPLLTQPACFIPLFGPTHILLIGPFYRELIGPFYRALIVPTHPKSPAGFTSHRHSPQDFAAPSLNTPTAQRELVPDNQEEKTVSHKEMETCYPGEEGMVVHTRDSASDQAQQVPAGHAKCGACRAGAHLEPAPAQEHRMASFSDLRWYMSYGQGRCLLVGSLPASAVLLTHAADAGGLAPWDWA

SEQ ID NO: 929269 - protein, 138 aa, Homo sapiens
MKLLKKLLLKHSRGKSRFRASEGSIFRSSEQSPDVPPLLLQVLWGYSFGSGPLCSGSTAYCLSPSSLVVPAASCDRVRKQADPLSSNLNAKQATRALGLSNFQTSEKHSHSERRYSYTCQSFSYSRIGEVKVHVKGTI

SEQ ID NO: 929270 - protein, 677 aa, Homo sapiens
MSLPSRLFLDFHSAILSGLQLFGVIHSVFTNLLLWANGVLNESKHQLNEHKERLITLGFGNITTDDHTPQCNCTPPTLCTAISHGIYYLYPFNIEYQILASTMLYVLWKNIGRKVDSHQHQKMQFKSDGVMVGAVLGLTVLAATIAVVVVYLIHIGRSKTKSESALIMFYLYAITLLMLMGAAGLAGIRIYRIDEKSLDESKNPARKLDSDLLVGTASGSWLISWGSILAILCAEGHPRYTWYNLPYSILAIVEKYIQNLFIFESIHREPEKLSEDIQTLRVVTVCNGNTMPLASSCPKSGGVARDVAPQGKDMPPAANGNVCMRESHDKEEEKQEESSWGGSPSPVRLPRFLQGNAKRKVLRNIAAFLFLCNISRLPATAREWRKLKKATAGSGSEEPDNSRGGTGGENWDTKESEKQGTLWIPPAFGCRPEYDNGLEEIVFGFEPWIIVVNLAMPFSIFYRMHAAASLFEVYCKRCPNSTDPQNVTDVSRFLLLKLSEDPELQPVLAGLFLSMCLVTVLGNLLIILAVSPDSHLHTSMYFFLSNLSLPDIGFPSPTVPKMVVDIQSHSNAQLHNMIALQMTCFKDVEIPNFFCDPSQLPHLACCDTFTNNIIMYFPAAVFGIGGYLSSDVSSSLRKAAVASLMYKMVTPMLNPSIYSLRNRDIKSVLRQPHGSTV

SEQ ID NO: 929271 - protein, 149 aa, Homo sapiens
MSFLVLFACIEGMLLTVMAYDCFVAICRPLHYPVIVNPHLCVFFVLVSFFLSLLDSQLHSSIVLQFTIIKNVEISHFVCDPSHLLKLACSDSVINSIFIYFDSTMFGFLPISGILWSYYKIVPSILRISSSDGKYKAFATCGSHLAVVC

SEQ ID NO: 929272 - protein, 243 aa, Homo sapiens
MPLATSAMKGDRPNIWTTGYQTAHRMAVMHPQIPSEMGKLRLAGGGPEQVRRAVWMQVVPLRTTCVASKEESSVLSHVLSPTPGSILELNMGPPAAFCKQGPVPQQPRPGAWTLVLSRLGWGCRPAPLYAKAHVCIYAVDVQQATCSYHMLREAETKTSAPSVTKTMPVPTAILTAEFSLVQGAAHAPKGSCHTEDPAVLQDPRHRGPEKEDEGGEEGLALIPRIAGSVYNPCDIGSNIILSA

SEQ ID NO: 929273 - protein, 165 aa, Homo sapiens
MGKKQSRKTENSKNQSASPPPKEHSSSRAMEQSWTANDFDELREEGFRRSNYSKLKVEVRTHGKEDLMELKTMPQELRDECTSLSSQFDQLEERVSVMEDQMNEMKREEKFREKRIKRNEQSLQEIWDYVKRPNLRLIGEPENDGENGTKWKTLCRKLSRRTSPI

SEQ ID NO: 929274 - protein, 139 aa, Homo sapiens
MYSQKEGKNLVRDSPEDWILSCQKEETLNTSEHLKEQTLDTPSLRTVILTTRVRSFILEVSETKNPPEGTNSGHSYRSSAAGLLEFAGGPLQTLFAWVSAAEAAEQRILLNSKCCCLIVPLEVSSQKGTWPCEVSVCPY

SEQ ID NO: 929275 - protein, 161 aa, Homo sapiens
MILAVGGSAGQEIKETQKIVKAGSRGVTAFWSCDAANALDMPAFVIKFSEGRGPSAAGLLEFAGGLLQTPFARLSPAETAEQQMLQNNKYCCLILFLEASSQRGTSLYELSVSPFWEVSPSSSTWGKCPEGECTCTPVAHLSEVYPHQNRRLLVYGTSTTQ

SEQ ID NO: 929276 - protein, 176 aa, Homo sapiens
MAAAGATGLVVIDVATNALQAKVIAAAGSGEKCNLVMQRGTQFSVNYSQSSLKDAVRKLVGKGGMNVAINMVGGDVFLEALHSLAWEGRIAVVGFAGGSIVSVPANLLLLKKVSVMGLYYGQYKEMNFPVFSRSLSSVLQYCQQGRIQPYVGMVFKLEEAALLQGCRVFWGVHSGP

SEQ ID NO: 929277 - protein, 186 aa, Homo sapiens
MALNICFQRKKQAAIFAVLQPPLVIPRQTGSGVDLQQTPADLQKRGLTVRTLTNESNNININKKDTHTKTPFKGHWHQRSKVNKSMKLRKNQYKSAENSKNQNASSPNDCNSSPARAQNWMENELDELTEVGFRRRVITNSSELKEHVLTQCKEAKNFDKKLQELLTRITSLGKNINDLMELKNTA

SEQ ID NO: 929278 - protein, 160 aa, Homo sapiens
MGFWCGCPFSLLVFLLTVRTLSCRSVGVCWRSTPDPVCLQPVEAAEHQILQNGRCCCLILPLEASSQRGTSCMRCQSAPTGGVSQLGYSGVRDPLEEAVCPFSDLKLHTGRTTTLFKAVRQGRLSLQKFLLPFVQLCPALRGGVYRGRQAWLSCSGLHPV

SEQ ID NO: 929279 - protein, 175 aa, Homo sapiens
MAGCTLIGCRRLLMDTKVSVSVWAFATAVVAAWLRGAGVGDFCTSGNDSAGMRHWWGHGWQTLCLPTLDSSGSVVGERGSVHSCQQQWHDRVHTHMPAGLLCRSSTLSTLPFFFSDLVPKFQRLCMIMWTESTSRSYHPTSAVHIDTSWQCFALLLVDSSHHSWLLRPFCSSARS

SEQ ID NO: 929280 - protein, 135 aa, Homo sapiens
MPRPASAHTSWAAPTVQQAPTFPCINFHSLGILGGKFGYDDLVMGRNESFLLISITNRKDHVFDNSISSWWDPDPTGLWPFKKREMHTHQGCMCIEKRPGENTGKKAAIRESRREALREPRPASTLILDFQPPEL

SEQ ID NO: 929281 - protein, 142 aa, Homo sapiens
MLLSLAAFSVISVVSYLILALLSVTISFRIYKSVIQAVQKSEEGHPIKAYLDVDITLSSEAFHNYMNAAVVHINRALKLIILLFLVEDLVDSLKQAVFIVPIVYEKYKTQIDHYVGIARHQTKSIVEKIQAKLPGIAKKKAE

SEQ ID NO: 929282 - protein, 139 aa, Homo sapiens
MKVATLIDSSFMKDFSVACDADLPSYKAQGQQPDVAFTHPLDFVSTFAQWSSHFLRAPEKENSSRNNPTFGSICGRASFQRVWLAVLAGPFISKVSKQTGLGPHPCRFSAGKTDLNPLCKFTQRFHKMDSGSVKTLLKK

SEQ ID NO: 929283 - protein, 147 aa, Homo sapiens
MKRFSSYTHDENLVELLKGTENMQFTALATTLKVFSLPSPEHITSVLRLALLMVARWLQQFQMSHRDTKRSQMEDAISSYVPLFKKYPDWVITNDRHLFTSLFWRLRSPRALVSDEGHPMAEEHESKKYKEKKCGQTHPFIRSPLLK

SEQ ID NO: 929284 - protein, 168 aa, Homo sapiens
MVGEASQSWQKAERNKSHLTWIVADHIAIKLELRIKKLTQNRSNTWKLNNLLLNDYWVHNEMKAEIKMFFETNENKDTTYQNLWDTFKAEEMDIFLNTYTLPRLNQEEVESLNRPITGSEIEAIINSLTTKKSPGPDGFTAEFYQREEVLETFAITNNVQARFPLTQV

SEQ ID NO: 929285 - protein, 162 aa, Homo sapiens
MIGYFCTSCFCLISILVSSLIGRVEDHSKKALESCQPLDIGLLSLQNHKPTNIFCYKLPSDRYPVFNNKKCIKRQVYAADSTGSGGSVCYISSICLKLVSQKQKLRKRFGFRCLIGNTLRKSLLYNERSRSVQRKELSYNAVATEIPATHTGTSEAGMIFPE

SEQ ID NO: 929286 - protein, 154 aa, Homo sapiens
MLFWFFLEKGFHFPCVGPSVEATLPVGRDITLFARLSTVCATAWSRVTSHIPKQKALSPESTCFCFLCPKWCSLFGDLNYPFFLESSTPCGLEYWGFHNTFRSRQHDDTVALWVGTRGCQCGLPSCGDMGTMVPRAGSSLVMAVFSHWYLAVAT

SEQ ID NO: 929287 - protein, 142 aa, Homo sapiens
MWESLERPRDFLNGFDQNADSDMDKKSRLRRSRMEMRNLLGTGADVCFKVRALMGASARAVWKGNVGLKPPHRVPTEELPTRTLKRGPPSSRPQNDRSTDSLDSAPGKATDTQHQQLRGGLYPAKPQGRAAQDHGNPPLASV

SEQ ID NO: 929288 - protein, 142 aa, Homo sapiens
MVVRKYNYYVSGQEPEGKDLYDSPSALSLQPQLPQRKNNSRAPDLLSPPVPIKLTTLHLPQTIWEFVETFWPKSETNPQQNTLRAKETTTLSNRLWYLSCHLKDTEISWIIVVSGHRTQKQAKPQMAKAGGDIYSLLCMCFP

SEQ ID NO: 929289 - protein, 150 aa, Homo sapiens
MAGCRSGALPREKAAEAWREIDRSAGGPALLADPVHPPQLPARVLSPSFPGAGRAGLLLRPTPTRNSSWPASAARSRGSRSRLSLHTSLQAEGAGSGSGLGQPIKGLPQCSGGLKGSSSAAKVGAQAEEAPRASEGCEDCQHAVTMMCHG

SEQ ID NO: 929290 - protein, 166 aa, Homo sapiens
MATAPRAAALGRAPACPWLLLALWRGKWKKFFSLLMFSSTWKEFISPSTPSSFCPLHSSLIRLVTLEREEEPRKEAEIIYRLMSPKREMKTSSQERTKNCLNNWAFCGQRGNNHLVLTGWQSGSMRGYWVLVNTVELQVKRRDRKQEVGKGILIVIRSLIPIFPES

SEQ ID NO: 929291 - protein, 165 aa, Homo sapiens
MKQVSTVKVRAFIGKEWDPATWNGDMWEDPDEAADTEFEKNPALPEATVMPSPKAIARQDNVDSPQKSHRTPLFASRPVTRLKSWWVPRGHLKAEERGSQSESQNLKSKEASSAACSLWLKAREPMANHWCKSKGLKAEELGVQCWRAGSIQHRRKMKAKKLSRF

SEQ ID NO: 929292 - protein, 143 aa, Homo sapiens
MVYGGLCSTTCFGLFNSGGTFADLLPKYIVTSDAEVWSTEDAVTQVLSIVPNRFSAPAHLHSPPQSSPLSIVAVFMSLNTQYLSRTYTSELNCVVVAARISDDWMSSSETDCFSDLSPVRQGIQAFALFQHSTTGCKLPPEGR

SEQ ID NO: 929293 - protein, 149 aa, Homo sapiens
MPSPSQIPGASEAIRQCQSSATKPRRSGKESVREPWASIPGALGVAARVAAERAMNWAGFFIFDEKEPKRYLIWDKEKGALTLTMPLAPATFLRANCWAAYDYRCRKPKKFSSTLMELRDFSNVATHKSHMKKLITFQKINEKTIKIRN

SEQ ID NO: 929294 - protein, 170 aa, Homo sapiens
MGYVPQTFPKLHGDDDGDGGSDTDDYGDDDSGNGDNGDYNGGEGSDDDENKNGDDDEVTVFSSVTTEKFKYLTHMIWRDLWDTLKTLKDCSCPPRTWCVYMGVGVRGFKEPIDSIIPPPPNPRSHPLMLVDSFILYDPSSPLEPVHVFPAFPFPLPGALTLRQRNAFLKR

SEQ ID NO: 929295 - protein, 164 aa, Homo sapiens
MVKIRALLQLKCHPVKLLEVKNTDNAPDHTNKQVNPLAWHTGKPGKAKTAVPVKIQLKDPNYFSNQKQYPIKLEARRGLAPIVEKNPNTREKQQYTWIVLPQGFCDSLHFFAQALERDLRDLQLENGSVLHCLEYGHLAASPRIILDHELVLNLGGYLPLFESF

SEQ ID NO: 929296 - protein, 179 aa, Homo sapiens [sequence omitted]

SEQ ID NO: 929297 - protein, 142 aa, Homo sapiens
MIGFQLNRKKKNWMWTVPSLTNDSYQVHNVFSSNSFQLLTVKLKPLEELRAPVTTNSNKTKGLPDCPKKPTKGTFLLNSILWNDCNAPKAIVLQSLAMGTVIDWAPKEHYSQDCSSKNTSCSEYNYLLDYIKDGWQSYRLRQ

SEQ ID NO: 929298 - protein, 187 aa, Homo sapiens
MASEGASPKPWQLPRGVEPASTHKSRIRGWGAHGETLLEQCEREMWGQSPHRVPTGALPSGAVRRGQLSSRPQNGKSTDSLHHLPGKATDTQCQPGKQLGGRLYPAKPQGWSYPRPWEPTSYIISMTWIANRQECLSLLKLCPQPPLPPGALSQGDRSFIYKPLTGGAAFLLEAPCPEKRNLERQSG

SEQ ID NO: 929299 - protein, 143 aa, Homo sapiens
MASILEETNLTRRLKIQSPKCTSFDTKYTSFDTKYTQTLYRLYPFPSYKISNLLSNSVSSTFNICPGPFQGQIQNVRSRSSQRKPDIAVGWTCQIINDPISFVRCTHVAKFLLIFSKHSEGKAAVFPPLLQCQHQCPAPDGML

SEQ ID NO: 929300 - protein, 115 aa, Homo sapiens [sequence omitted]

SEQ ID NO: 929301 - protein, 149 aa, Homo sapiens
MGQVGGLFFKPVGGEHAIAVVVMGQRLGLRQHVQVPVVGGVCICQTSVLVSGVGSGKVCMSSGGNEQYRLIIWSLDNMLALAGVALSKVSLSLGPPMLCMGQAVMGKSWAISSPQRVGLGDCGKWVGFVFKALYSSSMCQKWQRGWDDP

SEQ ID NO: 929302 - protein, 178 aa, Homo sapiens
MPPSYAKKVPHKMPLRLITVRLACFTTRYPKGLGSFDLSCIYFRGHQKHNSAVVFCRFLEVLKIYNQQVAKPVRPVFFPSGQRGPPSPPEEDPHPTTTTNPGHEEYCQMNSNIPLRPKMQTQSSLSSFLSTSQAEGRGLFWSPELCSTADASTPLAASDGVSVCDMSPSPLFLSLIQL

SEQ ID NO: 929303 - protein, 171 aa, Homo sapiens
MIGFERTQLGACKRLGPSAGLTVQSICVSVYFIHLSLNQGSAGTDPLQLVPPRLNVDSYLSPYTKINSEWIKGLNVRLQTINILENNLRDTILNISLHREFLAKSSKAIAAKPKIDKWALIKLNSFCTAKETINRENRQPTEWEKIFTNYASDKGLISRVYRQLKQQAKNK

SEQ ID NO: 929304 - protein, 134 aa, Homo sapiens
MVFYDVVSAVLPQMLTRNQHFQYFNFFLLVPLKLQAPLACILTSEIPIITESLLDKSVIIVRQEDGERLINGYKALTAWLLKGTCSDLRAGMVLNLGAVTALLGVHSWGTTDMPAPYRLGPLWNLSTEELEWGS

SEQ ID NO: 929305 - protein, 144 aa, Homo sapiens
MSLLVKAVQQASRKFKLSYIFLSSEPSKLFQSLPLTQFQSQFHIFGYPYSSTPLYQYQFTVLVCSYPVNKDIPKTGDAIRQKTSCTTNLFGKGKVREIGSLRLTMLFLTSDSENHKQGLESGLYELRAYPGRQASRAESILPTL

SEQ ID NO: 929306 - protein, 155 aa, Homo sapiens
MEICKTLVRTRTSALQLHSIGQRHKERSKKMSKDSYSDGLLPRSLKELREKEDMLAGVEIYTWTLQNLLFIKIGYTSAKTDISVCQPTDQTSAKPLMQHYGIGAIRANKKQKKLIFSALLLCKEECFSSPEDAVSKALDWKQRRGSYQTPDLLTH

SEQ ID NO: 929307 - protein, 140 aa, Homo sapiens
MCTTCRGDDRIFMLLFNGKIHFFLGAIFDESAKKDDEVFRTAVGDLNQNEEILQTEKITFSVTFVDGNNPFQAVQEVRPLFCRAAVVCSGSTSDPIHLGPSHTWRCHQWRLQNSKDGCLLLPPGSPSQRETDLMLAGMLL

SEQ ID NO: 929308 - protein, 244 aa, Homo sapiens
MVLKQQLPPLQQAASKGAAEPQDTEERRKKKKEGRRGGGGGRRRRRSSRSSSREKEQEEEEEEEEEEEEEEEEEEQEEEEEEEEEEEEEEEEEVEEEEEEEEEQEEEEEEEEEEEEEEEEEVEEEEEEEEEQEEEEEEEEEEEEEEEEEEEEEEKRKKRRRRRKTKKKKGKREEEEEEEEEEEEEEEEEEEEEEEEEEEEEEEEEEEEEEEEEEEEEEKRRRRRQIIHVSFYYCDHNSIENCLV

SEQ ID NO: 929309 - protein, 149 aa, Homo sapiens
MKIYREVQRYLIEQGPGQEKMASSDLSGKSFPTTTWIHKWKSGTDGKAEWILETNTNVCRILLKLPNSHTYSPLNTCAQCKLSMDLLFLGLEDGGPLLTDPLGNAPMGTLCGDSNPTFPLCTAAVEVLHEGSEPAADFCLYVQAFLYIL

SEQ ID NO: 929310 - protein, 143 aa, Homo sapiens
MWEDAQVLMPNRSCQGHQALDIEIASGHPSTFEFPRKCHQRSFEIGHQAFFPTTSDWHLYKSDVHRRRPCEDTVRRQLAASPGEFSGETKPAAIMILDFLPPELYVHTIDKFCEYVCHKMPSTTAEVEFASAPLTFMGKENLD

SEQ ID NO: 929311 - protein, 200 aa, Homo sapiens
MSQGLKLKPMKPGIEDNWSKMTKWKPPLTCLHKKAPTYELKIRLTILVSDYKHWLLDSISGPTWGLGTLQPFRKEHKSGWVRYLLIVEPWTLSKHRDSIVPVGVTTGVLVSPLPQLQAAEHREKDFICLGESKNKSLSLVIQIILPDLIPNCQGGTSLSMQELQHNWAWVPPNADMASVNKTLDHMPNSLLTPGKPSQEG

SEQ ID NO: 929312 - protein, 167 aa, Homo sapiens
MGSSAAEQGAELIGEAQARAGPHGGGWGEAQAWRAAGPRALPHGKAAEAQREFEHQHGLVCTAGGPGAPSTAAGPGAKPLTARDGLLSAGPSEPMPTGNSCWPVNTACSPGSRPRLSLHTSPQAEGAGSGLCRPREGLPQCSSGLKGSTAARVGTKAEEELYSRRRL

SEQ ID NO: 929313 - protein, 171 aa, Homo sapiens
MKSFLLVVNALALTLPFLCHENDERPFYQKTAPYVPMYYVPNSYPYYGTNLYQRRPAIAINNPYVPRTYYANPAVVRPHAQIPQRQYLPNSHPPTVVRRPNLHPSFIAIPPKKIQDKIIIPTINTIATVEPTPAPATEPTVDSVVTPEAFSESIITSTPETTTVAVTPPTA

SEQ ID NO: 929314 - protein, 135 aa, Homo sapiens
MSPSFQVPPHSPHPDVGDCSRSCVQEIDFRTINISSPTQDSFSLSNSEDIKFTLAEAIIMASPKGVVRQDNADSTQNPYPPLLFTSRSVTRLTSQQSPRDLTVGTTVTQLENLNAMGIIESQGGRGQVVALNCQK

SEQ ID NO: 929315 - protein, 153 aa, Homo sapiens
MQWHSATQQELIFVLAVSSPKSHLQFPRVVGGTQWEVKICFWTHSRHCWLATEDLFLNVLIWVSLQGYCMSWQWLSPDARDLREEERTKARKMEATTVYNLISEVMSHHFCHILLITNESLNPAHTHQEASLKLKAFSLCRKEFVDKDEFAGQ

SEQ ID NO: 929316 - protein, 176 aa, Homo sapiens [sequence omitted]

SEQ ID NO: 929317 - protein, 143 aa, Homo sapiens
MVTYRWGFGVDVLFVDDDAIPFCLLVFLLTVRSLSCRSVGVCWRSTPDLFAWVSPVEAAEQQILQNSKYCCLILPLEASSQRGTRLYEVSVSPYWKVDFGNQKGQREYEAHVVPLMLCLWSLQLFRNPESYSTFSNKFRFYLN

SEQ ID NO: 929318 - protein, 181 aa, Homo sapiens
MDSACVGFVQLWAFSHIDFKKTGATDFGGIRRVIHGPMALMDVKIHCCGRSGTLTLNDGGCGQKQVSDGGCGQKQVNDGGCGQKQVNDGGCGQKQVSDGGCGQKQVSDGGCGQKQVSDGGCGQKQVSDGGCGQKQVSDGGCGQKQVSDGGRGQKQVELEGHTFGHENGGTKKNEVACKRPL

SEQ ID NO: 929319 - protein, 160 aa, Homo sapiens
MILAVEMPCPERKNLERQSGYSGFAKLRCAPPSLNFPSSVYTVRGKPPTQASVMVDAPLPTKLKRPKSTSDCCAGSENFKPVDLSLLGSMGVEPTELDHLAPWLQPPFQGRERLCLAGTPGTPGVRKKTRCLPKRLPSFVLETQGPGGIGTRGILLVHRL

SEQ ID NO: 929320 - protein, 151 aa, Homo sapiens
MAVKLGTLLLALALGLAQPASARRKLLVFLLDGFRSDYISDEALESLPGFKEIVSRGVKVDYLTPDFPSLSYPNYYTLMTAITFVKAARGSQKEFSKLSREAAKNALLLLVMRDSAMHSEHRESSANYVNRKKMRSLISHGPPQNTKAKRV

SEQ ID NO: 929321 - protein, 132 aa, Homo sapiens
MPASLGSLIEAHYREYSLSGKNVVRCLWEVYDKMLTKVNSEDLAAVASVQALLSYSLISQSASSASWVPFKFNSPPHLQPIIKDRCGEVWSGTGGEEEPVGLSFDAGLGPGQLLCENGTSDAYSPRRWPVAV

SEQ ID NO: 929322 - protein, 143 aa, Homo sapiens
MAHSGASVTQPLWLWGEGKVWHPALARPARSRIPATVTVAPGSRLGGRILHAGGIHSSRWPSWEEMSPCEDMAPGRDAGATARAAGRAAREDSMAEKLFVWGYHRRESNFRSSTFGQQIKASPSIVFIVTANSVPYCISSGPQ

SEQ ID NO: 929323 - protein, 189 aa, Homo sapiens
MSTGLYPRVGPSEEDLVALKGEEGSFPRRVPSDLEQALVAALRTWVRQPCHLPLPPTLVRPLDLTSGSLGSLGCSRLLQKEGSLQRTPGERLPPIRSTGLGKWSLKEHAEESEWRGCRLGLSVPSRLRGPCTGTWFLARSGEGLALLGLLLAFPAVPAQLPRAQSGGGRFGGRSPGKVTKRAPEENARV

SEQ ID NO: 929324 - protein, 163 aa, Homo sapiens
MQVRGSKEPVLGRNSCWESGRGQPQGEWPSGARETCLQPQPYGRPAVQHLYSPQLSKNQGKSDTFSQPRGTYRAVMTMWYSRWAPGAGKRHSEGQEIGQVQDLGSNNEVAMLWSCSGHVDATGPVEPGELQGRALKVWSPLWSRLPVLSATSSLWDSPTALPL

SEQ ID NO: 929325 - protein, 164 aa, Homo sapiens
MATVILPCVASSSTWASSHPIALVKFFWSKQVSILNYHLCHQLSLCIPSKLSKDEQFSPWSVFKRIFPRGHWQLPRMSFPNFWKNSNIGWYLPAPTVCRHCSLHYAIIVLLLTLFWDCVSCDSHSARHFVNTVLTPCFNTMITISQLSKLRLSGKLTCPTSHDW

SEQ ID NO: 929326 - protein, 143 aa, Homo sapiens
MKSMHLLFQGAGTPMGFCLSLRLPEGLFLSFPPQEASRTWKLGVLRVCILLPLGQMEEVPVPESLLRSLRAGRRLGETRRCWEVLEGGWGTLRAVGRGLEGWGRLGGVGRGWEGVGDTLRVHSIHRVSHLFSTSFVLSTVPRI

SEQ ID NO: 929327 - protein, 143 aa, Homo sapiens [sequence omitted]

SEQ ID NO: 929328 - protein, 165 aa, Homo sapiens
MRLIILTKLRTWICWHCLCIYLGAMDPGQTVFSKANVADHKGPYRREAGESESEREMGRWKHREREKKNRKEGRKKGRKEGKKEKEEEKEKEEEKKKKKKKKKKKEKEEEEEEGGGGRGGGGEEEEGGEDEGEGGEGEGEGEEEEEEEEERGRRRRRKREEEEKV

SEQ ID NO: 929329 - protein, 158 aa, Homo sapiens
MYEKGWYTGRSLLKELSPHREPLLGQWKGNVGLEAPHRVCTVYEAVEGGHCPPEPQNGGRSTGSLRPSHGKATGTELQPVRAAREAEPCKATGVELPKVLGAHPLHQCVLNVGVRKDYFGTLKFNNYPDGFQSCVGFSTGLTGARTYPNVEGRDLLCY

SEQ ID NO: 929330 - protein, 143 aa, Homo sapiens
MWKRGVMSADVYFGWKQRDHLGGGFVKGIPEKPEKLVQVVMGKGTCFITPSSLWNSGTTDQPLHEDPRVGTTALYSHLAPAAEHEHADLVGADDMIKLSTEGLQVQYPGLDLPIGCLISLLHQRLVIHYMGLLGGLGHSIPVF

SEQ ID NO: 929331 - protein, 144 aa, Homo sapiens
MRKDLSLFTFSKRYTQLQGLRTTETIDVVISIYLTTYSGYHKDTRDFKIENVRLALTLARKTPQIASCNSFSSESIEKFQCNQQCGCRRHERLGDMVMLIKFKSDHREWVQGARFFCAQYSTYLHFPQMLRWKFNVSFMYLFVN

SEQ ID NO: 929332 - protein, 167 aa, Homo sapiens
MLMIYILNKYRPLSPSRPSQSSGGDETHLPLSLWARLMPGASVDRGHAPGLPKLEKAARLRWVHHSSCCPLDTVTKEHSGPGALGLVIGWLWPASGPEGVGCLLVVLLPRGLAHAAPPPTHQDPQGPLHTQLSPIPSDSPFSFLRWPGAYLGVRTFTVSGNAYWSPR

SEQ ID NO: 929333 - protein, 127 aa, Homo sapiens
MKVCSFTPETSKTTNPPEGKNKLRDQEETPNTSEHQKEQTLHTLPLRTVTPTGRVRGFVLEVSETKNPPRSFAMREPFGSRMCACVWIRSQVTRSDVDHVRGRGERSREGGGRRNRWSRGGARRGGE

SEQ ID NO: 929334 - protein, 127 aa, Homo sapiens
MDKQIIGTDLTGKVTGKVSLEKGDQEGILLELVGGRGDANHARSIPVIVKATLCPIPLMHSTWDIYCRISKSKSYKLQVNVGGDWTRVWIQEEALAPLEAITVTANPQGKYILNGLGHPKLSGMQTM

SEQ ID NO: 929335 - protein, 200 aa, Homo sapiens [sequence omitted]

SEQ ID NO: 929336 - protein, 165 aa, Homo sapiens
MAGCSPEPCLAGRQLRPGEKAAKAGREAPVGCTAGGPSTPSAAAGPGTKPLIARAGRAGRLLRVPGPPSPRPPGTPAGRQAQCAAPVPAGASPSTPPCKLRDAAKVGAQAEEAPRASEGYEDCQHAVTSHQLCLKQQALGDACSSPIKGPGWGTNSIYYGWSEKH

SEQ ID NO: 929337 - protein, 115 aa, Homo sapiens
MCGPFFQPRQCPEWAAAPELSPYPPMALQSVPGEVQPLGVTGRSPCLITASSLLSISTLITPQHTSVHPTYSIVSSPAPSGHTCECHIGEECLTSLNSCYSAAEGLQHGRYLLNI

SEQ ID NO: 929338 - protein, 173 aa, Homo sapiens [sequence omitted]

SEQ ID NO: 929339 - protein, 147 aa, Homo sapiens
MKLFELLIWSSTCILVMDLLSDGYFENTFSLLCHSFAGLLEFAGSPLQTLFAWVSPAEAAEQQRLLPPHSSGSFSAEAVPTATPSPGALSEGDGSSIYKPLTGAAAFLSEMACPERRNLERRSGYSSFAELWWAPLSLNFLVALFML

SEQ ID NO: 929340 - protein, 163 aa, Homo sapiens
MSECLGDNGSCSKHRTTATAYAIVQIPQPVEHPSMGNAQRKSSAQCLITFSSSFYPWLHIRITREGDASEEGTSAGLEVSKVSVFLFQDPVVFMNNFYSGHRLPKEQIYNLHAWSSGRLQVPGVTCSFWKRTMNLCVPSIICRLNELIIIAQICTLKIYGNPL

SEQ ID NO: 929341 - protein, 150 aa, Homo sapiens
MILVNVEVVEVESKLKMKIREEVWNFEDSDISDSDQGKRAKKENEAKKQIQIIRQHGGPLELIVVNLVKLVIMVIHCTLALLSCMRMNVTANKGSIQINKYVLAKNKKSRESNDQCLSRYFLFTYHFKLRYFDGFSAVRLLGTDAEIMKY

SEQ ID NO: 929342 - protein, 135 aa, Homo sapiens
MKLPEEGSGSNICCSTIFAVLQPPLVIPRQTGSGVDLQQTPTDLQLRDLTVKRKTNKQKGIASTSTKKTSTPKPHLASSPPKDCNSLPAAEQSWTDNDFDELTGVGFRKSVITNFSELKGEVQIHSKEAKTLKKD

SEQ ID NO: 929343 - protein, 154 aa, Homo sapiens
MHREWKSQMEREVAKKRMFLSKLPAWKLECKPSRETGDTGDSNSPAGPACHTRAEKALRQSYGGSGKLGQRVLKWEHKVLSKYDLISAHDSPEGRSWQEFPPSLERRQTNGSKSEFRPTFRSGAGSVSSILYLQLLMPSYQWGWTNEGHICDLW

SEQ ID NO: 929344 - protein, 150 aa, Homo sapiens
MWVCSFTSEASETTNPPGGTNNSRRTALRAVTLTAKVCSFTPEPARPQTHQKEETPNTSEHQKEQTPVTCPLRTVTLTARVHGFIVEVRQSAIPLPEVTTYDGLLIALSVSVSLIPVCLLHTKQPGGFFKKCELYQVIPQLKFYRNFPCA

SEQ ID NO: 929345 - protein, 160 aa, Homo sapiens
MTHPAKGYFSVHCPDLPMKEENGPGIEKGPGPAMQAAPPGTSTCKLSLALHEPEVSWRGYVRTCGIALAGATACPFAAPSYKDEELDDQRDVAGESGSCPPGGRGSDAEDFSHGGECPLCIASDVQDDDPIACHRLTSEHPCWRLNLLLAELPVLAGRLH

SEQ ID NO: 929346 - protein, 122 aa, Homo sapiens
MLIQTISCRRIAEIREGCVLRGEVCCVLLRRFSSLVKDERHIKKSPLDIASSILLLESELGHDGWSYNSHPVTMSLQGYKAVIFRKVEPLDKKIKGIWGLSYITEPFQALAFFLLNPVMLDN

SEQ ID NO: 929347 - protein, 168 aa, Homo sapiens
MPGAFLLAAVIIPGLPGLAAVSLRSLSLSSHGCTLSCKECQDGKRYAKEQSGIIILREKGSLDIVALLSCCGLCSVQTFPWLRLHCEGKTAYSNLSNGGWPSPHQARESQVDFRLPSGSENFKPVDLSLLGSVGVTSTELDNLAPWLQPPFQGSKRFCLAGIPGATGV

SEQ ID NO: 929348 - protein, 126 aa, Homo sapiens
MAGYSSETKLPEERSGSNLCCSPISTVPQLPLLTPRQIGSGVDLQQTPTDLQLRVLMLEGKLTNKKDIHTKTPSVRHHHQRPKECSSSPAMEKSWMENEFDELREEAFRRSNYSELKEEVRTHQRS

SEQ ID NO: 929349 - protein, 148 aa, Homo sapiens
MRSSWVGSNPMTWCPYQKRQIWAQRCTKRRQCEDTDGRRHVTTEAETGVMQLQAKESQRLLSFEELWSRAPLERLNCALISSGAGPENGKASQFIDGNREKGMAMGNILKEDPYSKLRLAGLERWNRMSPRWPLLHGWRVVVLEVTGG

SEQ ID NO: 929350 - protein, 136 aa, Homo sapiens
MAPPPTMGITIKHEIWVGTQIQIISVTNSKNVLEPDNYILHFQQNLSTQMLLQKPNTFWGPMADVAYLGIEVDKENGSNSSVRWNRPSGIITISFNVMAYEDVLLGVAAASCDREGDMKRITEKLAQNFDVVELLS

SEQ ID NO: 929351 - protein, 136 aa, Homo sapiens
MAHVYICNETARCAQRKIRECFHDLLQGKMAVKRTKKPIVINSSKTETTFKKRWGHLASKLALGSKATAYTSSVFPLAPSAWRGLLASSRCSGHSSKEARTEWGGGAPCELSRYRLFFYMQWVRALPFLYYSQTSK

SEQ ID NO: 929352 - protein, 140 aa, Homo sapiens
MAAAILDSPPLPSLPEDQTNYNLPLSQSLIQTKALTLLSCLKAKRDVVEIAKELELEVKSEMGLSCCNIMIKPEGMRKCFLWMSKENNFLKWKLLLVKMPNYQNHSNLQQPPSRSVSNHQYAEKPSIRKRVQLAEGSDDH

SEQ ID NO: 929353 - protein, 164 aa, Homo sapiens
MGKSLSMMAEKHEKAVEEKLEASRGWVIRFKERSHFHNIKVQGEAAIADVEAAASYPEDLAKIIVEEGVKISTLTGIWEKWIPTLMEDFKVFKTSVEEVTADVVKMETELELEVETEPGPELLQSHVVLSPLPSPVLWLVAPDTVTLIPLTLDSSESVSKCQTS

SEQ ID NO: 929354 - protein, 146 aa, Homo sapiens
MYEKACMSRQKPAAGAEPSQRTSTRAVGQGDVGLDSPYRVPTWALSSAAVRRGPPSSRSCEGRSTDNFHSVSGKDADTQPQLMRAAVGAKSCKATRAELSRALGAHSSHQCALDDSDLSGEGVVASNWMVENFTGLSQACVFSVMD

SEQ ID NO: 929355 - protein, 137 aa, Homo sapiens
MYEKSKRHCVTGCCQESKHSNEEFQSRNLLEAVRCHEMSSSLGTRDLGFPAMFAPLFTVEALPSRNPIPSSQILPRQLFLKAFKASKDGVSSSRFKTPCSMVDSRHAEKIKPGLGLRSSHSDKGTSQANENIIVQCN

SEQ ID NO: 929356 - protein, 155 aa, Homo sapiens
MCLGDDIFDMTNIRGTHSKNTNGSTYVGSGEDRKMWESLELLRDLSNGFNQNADDMDNEIQVEVASDGDEELVGNWSKGDSCYVLAKRLVAFCPCPRDLWNFELERDDLGYLMEEISKQQSIQEVTWVLLKAFSFKREAEHKSSENLQPDKIIKK

SEQ ID NO: 929357 - protein, 149 aa, Homo sapiens
MVAGSWAGVVSAAASMSTPIPISRVQGPFQVNDIMTAEERDRFPTGQQAIPSMDPHWDLDSDHRDWSCKHLLTCDLEGLRRIREKPMNYSMMSTITQGKEENPSDFFEWLWEALRKYTPLSPESLKGQLIIKDKFITQSATDIRRKFQK

SEQ ID NO: 929358 - protein, 145 aa, Homo sapiens
MDQSAGCGWAKGSCDRLHLEKQDTPNQILHYSHSLSNHQTWRYPPVPGLVGPMPTEPDPCSLLVQQSEIDLKAYCLYRFHFWGQGIVEQKAADSFCRLNHPCLTALKRAVVLSAWHLSSENIQTASSSGSLTPVYPDWETSPSRG

SEQ ID NO: 929359 - protein, 193 aa, Homo sapiens [sequence omitted]

SEQ ID NO: 929360 - protein, 157 aa, Homo sapiens
MAPVVVVLTTHSKFMVFKGTRTMLTLSPSSRKLSGYTRWYCSEFLDGIVDDIGLLLLLEPQPPLVGVVLQERVLGSQQQLHYLVLQELQDHLLGEPGGGHHGVGVVQEGGEEDEEHEEENKVAYSSAILKELITSLDKALTSDFHSHPKKLRGRVLV

SEQ ID NO: 929361 - protein, 136 aa, Homo sapiens
MGTFTQCLYPHCIFEIHHQIPLCPLIVRTEHLDLLEAFLPHPYLMLETTSINSETQLEAGLQRNPDNTIHNSQTIGQRRLSMDLLKKGNRKAIQRLLSIDSRSESGNQLPVRKSFNPPVKYYLKRNQKNMGLDSSL

SEQ ID NO: 929362 - protein, 174 aa, Homo sapiens
MRNLWETEAKADNATEKKNPFSGKKLKPAAEICISNEEPNANHQDNGENVSRHVRDLHSSPSHHMPEGLGGKNGSLGWAQGHSAVWIVRNWCPVSQLFQLWTKGAKVQLRPWFQRVQAPSLGSFHVVLSLQVHRSQELRFGNIHLDFRGWTEMPGCPGNALLKGQSSHREPLIG

SEQ ID NO: 929363 - protein, 140 aa, Homo sapiens
MAEEASEWLGPAGSPRPRTADLTFPRRHDAPLGDMKFTQYPFGVAMERVEVCFEAKEEERREDKEEKRREKERRGEGKRREEERRGEERQGGEDKKRREEKRRGEEKGREEKRRGEERRGREEKRREEKRREEKRRGDSL

SEQ ID NO: 929364 - protein, 139 aa, Homo sapiens
MCGTQCQLAAGEGSLESGGGATPAAAHVSPRAWLSKWGDQVSLLLPPEPSADAPVDDQASPLRLLPPRPEYPGPGASEAAWSAQGQGCLQDVIGIFVLGLELCRQVAGGPALEALPSKRVLVSQVIPAHRTLPTPPCPN

SEQ ID NO: 929365 - protein, 146 aa, Homo sapiens
MFWRLHQQPESALCPVCLAKLPVTFIGLKDAKYCSWVCLRGHCQRRLTFELQVLQLLDSWTNTTGLPGALEPSATAEGCTVSFPTFEVWTQTDPLPASLLLNMQMVYHGTLLRDHQGNTCYIYEVNQNLLCTKAQGSNDNSGEEPY

SEQ ID NO: 929366 - protein, 142 aa, Homo sapiens
MTGVLIKEDILNRGTYKGEDWVKTQEDSCLQAKKKSCPKEPTLLSLLLWTSSLQTTSMKGPMTAEVMLVCAMAVVWCPLALGTASELKSTQLNWKKGLALNHILKWGLLETFLFVQLASFHNYTRRTNVSTTGKSGSTWSNS

SEQ ID NO: 929367 - protein, 164 aa, Homo sapiens
MGSLPSQAHLHLQVATDLGISAFSWARKPLLLPQDRMCLLLLTGVSPLLVPALVSQQSCGQTQALSCAHSNFREKLWPSPDAVMSQPGQGWPEAWGPGCQFSRPEPEIMVLFLGPPIAAHGPISMHFLPSEAHKSPGLSQIQADERLPACGEKLCTVGLLSNES

SEQ ID NO: 929368 - protein, 307 aa, Homo sapiens
MQEVQYNLLPGSWLIAPRNGAISRAQCWTLLMANWALSGGHSQVSLAEGTLILVGLMDRNGEKGIFQVNGCITDLTYREDQSLARQRCKCCPHKSVSQGIGQMHIFWTLQAEMNGKVQATGENGGSRTDINYCKEEQKKRAWGKNIRFDEKKAILGNANKLRYGKFLKMVCPECDPSDVQMCQEFLPSGGFVVLLTSGVKPQTFTVSVTALRVGASGVVRSSQWVRGLNDFRSEAADLCDVQICPEFLPSGGFVVSLTSGVKPQTFTVSVTAPKGGVSRVVHSSQLVHGLTDFRSKAADLHSECYSS

SEQ ID NO: 929369 - protein, 153 aa, Homo sapiens
MFPVLFPKSFMISTFTTSYLDCIKNLEVLVRGTRQEKEIKGTQIGKEKNQSVSVANDMVIYLENPKDSSKRFLDLISKFSKVSRYKINVCKLVAFLYINSNKAENQVNNSILFIIAANNFKIPKNVLNQGGKRFLQGELQNITEINNRCHKQM

SEQ ID NO: 929370 - protein, 154 aa, Homo sapiens
MERPCDVPANSTVSDASCQPASTPDRCYLFAKSSGDGPCLFLEETSLLWALTAHCLLSAVVFCGCTLAFCVSIILRGNSGSFENKDRQHHPDTKAWQRHNKKENFIPISLMNIDGKILNKILANRIQQHIKNLSTMTKLASSLGCKAGSTYANQ

SEQ ID NO: 929371 - protein, 126 aa, Homo sapiens
MGVGLFCAVLMLVNESHEITCAGVSLHKISLGLLPSMVHVHNVQRAPSEDSAGLWLHLHGWCKVCCPLAANPSIASHLHACTSVFHHYAPAAATTTASANAVVKTDGYHAWSIMCYVLCKVFYVLT

SEQ ID NO: 929372 - protein, 151 aa, Homo sapiens
MGFPHMESASAWRLDFLDSRTMRKKCLLHTQFTVLFIVAAQIDQDTHPQILANSELILNWVENVSATSAPLHEGVWKKPCCYGYRVTSNKNEPCLNPSEGPWLLISLASLFQPTLLTWELLEGCMGGWCGPVEAAKDFESHYLKLKSQSMR

SEQ ID NO: 929373 - protein, 134 aa, Homo sapiens
MGDTSTPMATRADISLGHVRSKSTGCGPTAAPGLAPSFLHFLGALHEKPKAKDPRWNNGCFAVSSLGRSRELWYFQALIRALIDRAGVSPSWTSTVILKITLIKYRLNPKGISLMAKGNQSSYKQTLTHKTQES

SEQ ID NO: 929374 - protein, 179 aa, Homo sapiens
MQKLHLKVTNSKDQREKNWIENEFDKLTEVGFRRWVITNSPELKEHILTHCKEAKNLDKRLEKLLSRITSLEKNINDLVELKNTAQELCEAYTSINRQIDEAEERISEIEDQLNEIKREDKIREKRMKRNDQRLQEIWDYVKRPNLCLIGVPESDGENGTKLENTFWDIIQENFPNIAR

SEQ ID NO: 929375 - protein, 153 aa, Homo sapiens
MNELKDGRCRGFSCHRKWLSADIPSMEGKVFLYTRQLAFWRRLEKGQRNLERHHSKTGMSNPQAVNHTVFISNKSEIAIQKNNASFGFWLYNKLEVLTVIFKMIKKLNKLKISIYYIHQRSEVTGQTAALQTRKIDGGVQSSTIFQEQKPWSS

SEQ ID NO: 929376 - protein, 157 aa, Homo sapiens
MPITIPLKPNHPYPAQRQYPIPQHALKGLKPVITHLLQHGLLKPVNSPYNSPILPVQKPDKSYRLVQDLRLIYQIVLPIHPVVPNPPQSHSRRQTNLNCAPKKPIIPTIFCLVILLFTVLNYSHMPCSCLHCRFTLFLQAITADISWCYPQTATLNS

SEQ ID NO: 929377 - protein, 136 aa, Homo sapiens
MKYSVQRSNKPQQSGENANNKAEASTTQLPVWLEYKQAEKCEKRDWPSPLAYIFFPCWMIPVLEQWTPGSSVLGLELALLTPQLADSLLWVHVIVQAISGKPFANIRSCHKTFKNSRWLMNAISVKPLVLLCPCRD

SEQ ID NO: 929378 - protein, 204 aa, Homo sapiens
MLPPTALSLFPGSGRAGLRTCPRLQAPQLRKQAGLSGFVPPCLPTSILQIYPLPWVLSRKLHVQLELLQSLAGGFLLPEVFFLFLWQPSPRTPVRQIRNVFPEDQESFLYSCISLTSLNYLSSRNLTENSTEKSQEIPEALENKEMNGRSSEISQEPQGTQYGSERLSGRTSVVYIPRRFSIKQGPEREGEKRERQTQQAIDEY

SEQ ID NO: 929379 - protein, 139 aa, Homo sapiens
MARRAFPEGSLPNDPTPPPPRPPAPGPTATLVNHISTPALEGAGIRTISPPLRAGGWRLHCSQRAGTGSLTWGLLCGLFWGHPFSLSFHTQTPSSRHLWVLGWGPSARGFTWTMEDNLVLHSVPGAAAGTEHNGFIFIY

SEQ ID NO: 929380 - protein, 145 aa, Homo sapiens
MSVERLLGTWHVASCGVPFHRNQTLGRRSDLSPPVTAPVLELGKHICLSTFEAVSSPNPSAEPVFRLHVTAGQAAITSDTKLAQAGSGQPSLNSDVPPCNRGSAIWHLTHAYGHRSHDWTCGCCQCCQRGTRFSLQREKSTLLMM

SEQ ID NO: 929381 - protein, 196 aa, Homo sapiens
MFLPLTSVSTLCSNCPILSHARKLPTALLPFWNSQPLMGAHCPPVGLTRAVLWTQVMKEQSRGCKKLEALGSPPTGPVNLPRGAELEGSQVLWVWRAAPILRTYSTPCTNPLNTSVGTGTPTLHVKKLRLRHVIGFARCHSLSEWSGRKLNPNPADSNVPGLHFGMTPKCRRPQQRCGMGPCDSLRPMLPTSPPHV

SEQ ID NO: 929382 - protein, 157 aa, Homo sapiens
MPCWPKEPRVEVQELSFSFQTEGGFVTSPVDAAGGSVGCWLSPQKLAAAPGFDSGSAERPGLEGVSQPLHEAVILLLSARTKLICIISPGPQAPLGGAAWDSGEAGGAVTQALVRGQPSFRRPSVRGRKRCRPEVIKETETSREGTFLRSLSERLAS

SEQ ID NO: 929383 - protein, 185 aa, Homo sapiens
MRAGGYACVQWQRPGRRLVAHFGYRPRCGKLGQPVASLVVGDSEASALAAGEQPRRAPRAGRGGGVMRPVDADEAREPREEPGSPLSPAPRAGRENLASLERERARAHWRARRKLLEIQSLLDAIKSEVEAEERGARAPAPRPRAEAEERVARLCAEAERKAAEAARMGRRIVELHQRIAGCECC

SEQ ID NO: 929384 - protein, 205 aa, Homo sapiens
MGMNEWMNQQTNKRELERTQDQRSSPCKGERSRGELPLDVYFWNAAHWRVLHPHACCQLLVPPALRPRSQRMTVPSSWDTTSTLASPALIPALECKLLQALRPLAQPSTAQGLAEVTPCNADAESAACGAPRPTPVNLNPRSANHQAPAHVLLEVSFPGQASSLEPGWSPTRVCKALQAALGFTVCMAPDTQQDTHGPSEVCSYH

SEQ ID NO: 929385 - protein, 160 aa, Homo sapiens
MTSGGCCVPGCGEVWRERREREPGLCVALAGQLEFRVGVGLEGPAFRAAGRPCRPRARRDLAPGPAAVEAAFPRGRARDLQPAMPEPSPDSVGSCAARASLTSATPCSTAPSPIDHPRAEECECMAPDWQAAPPAAPVRDPLGEASWAPESGGDVENLYV

SEQ ID NO: 929386 - protein, 165 aa, Homo sapiens
MVLQAVPTAQPFLHLPLLSTVESVTMDDLPSGWCLEASSVEDQQHGAEVRSVFHCLSSSGCRMGRHPDCSCAVCSPAPMRCPTVRWPLCTVPLCAGPRVLPHCALAPVRCPTVCCLTVRCPTVRWPLRTASLCAGPRVLPPCAAPPCVPHCVLAPVRCATVCWPY

SEQ ID NO: 929387 - protein, 145 aa, Homo sapiens
MGDITGPQDIAWVQGVTALHGAHSAHSVVAGTVASIAPERALYWGEDVDTLFQECAHIEKLASPSGKALAFPTAPCRPRSQALQLPPGRVGRPVLSCQGNHSLWKANPKPLARLLRPNHGSVRAKIQPSTSLPTPHRQSPVPRKA

SEQ ID NO: 929388 - protein, 135 aa, Homo sapiens
MSSLYKCEWSTGLLTGHGFGLVQGWLSWGPVQATALLCPECPCLEKMEITHPSSSVAGGAAESESRLKAGAGDEERPELRGRRLEAGLAVGVRSLLFLGLQGRCLVDPQGGECHLWLHPYLYPLVNARLLGVLPP

SEQ ID NO: 929389 - protein, 136 aa, Homo sapiens
MWECARVLHSCASDGFRVFWQGYAGPRALSVQEGQSSAQSAHSAPLFGLPSEHVSSCQGPSHCDLSSWQLLFRSSAPRPGCPAKAKVAVRLPPYCHNLPKRHCSRQLLDSPRCSQTLCCAHCIVVDVAVSLPFWTS

SEQ ID NO: 929390 - protein, 148 aa, Homo sapiens
MVNSLTSFHCVPGKCKLSMPACESSHGGCTLQNHRAELPRALGVHPLNQRVLDYLRFNKVDNEINKVHPGKVAGHFVEAWKITDQLCLKWDLGSLLQTMGPVRTDLRVRKELSVVNFKTLLHRIGGSDGFISVWCFPCLHSFSFPLPL

SEQ ID NO: 929391 - protein, 167 aa, Homo sapiens
MRTCELKRQGHFRDLHSSPSHHRPGGLGRKKWFHGPGQRPCCSVQPQDMAPYIPATPPPAMAKRGQSTAQGIASEGASPKPWWLPYGVGPTGAQKTGVELCEPLPRFQRMYGNAWMSRQKSAAGAEPSWRTFTRAMQRGNVGLKPPHRVPTGALPRGAVRILQTPDW

SEQ ID NO: 929392 - protein, 164 aa, Homo sapiens
MAQCPMLCSAAAAVWTRARRLNVVTDEQASTGAFPVSNLGTWWDGRMNICFGQIDLRFLCKGTEKNTININKKDIPSKTLFKGHQHERSKVDKSTKMRKNQLKKAENSRNQNASSLKDHNSLPAREQNWTENEFDELTRSRFQKVGNSKLLRAKGACCNPMQGS

SEQ ID NO: 929393 - protein, 137 aa, Homo sapiens
MRKKIDFGSYEKCRDLASVMVYGASEATGQCQSSATKPRRSQRALGQSSRGSGSGCQEESWAAGIPWPGGQISGTCSKLLGEEVLEEHLAAAVQAFGSCCVLEMWLGVEERRLRKNWDRARPGEEQPGEEGRGQIGL

SEQ ID NO: 929394 - protein, 149 aa, Homo sapiens
MLPVGVLSSLLSHSHQLDQLRLQELEDVVVVFMQEDGAQKHLVKLRLAVLRPCGMEKTVSTMEKLCQMMASEQETILSPSGISPSSTSCIRVKGLLLMVLSDDVSQQLTLTLGQLDKGTDTVNVGISLHVHHLSWPAAYACHSRPRTGA

SEQ ID NO: 929395 - protein, 192 aa, Homo sapiens
MDLEKVLYESQAIVTIENPAAIILQDSSSYHRPRDLGWKNGFKGQAQGTATMLSLRTLLPASSCSNSSCGLKGPRYSSRCHFRKCKPPYALVVAMQNPAGGMKPPQRHSTRAVLRGNVELEPPNRVPTGAAPSRAVEMGPLATDPRMAQPPAACNLSMEKPWGQSCPRPWEPVQDTNVPRMWDMDPKIVLKL

SEQ ID NO: 929396 - protein, 157 aa, Homo sapiens
MTEGLSQQAWRRMVGDPVTEKRPGSNTGSFRRPATRSTDSLPEHDTNLDSDECQLGVDHMLNGYSYNGMRGADSESRQSGCRCVPAMDKGEHIHAGVPSRLLDCHGAWILSCHTPQRVSELLALVRSRMLARMDKQAAGNGSSYISASKSLFKAYFA

SEQ ID NO: 929397 - protein, 183 aa, Homo sapiens
MAKPQAPSRLAKDPIEFSMFSSHFQPYCCGGLTSDCPVSPACCQVGKLYRHSVLQRTFPDNKRNSSVLVLRGEPGLREKSRALIRPFLKTEITLDFFIYVIQQLYEGRDLTYSLLCPSVYVFNSAQWAAATHVSLLFLLKIILQFHSNGLCIVGRLMPDARQRRAPWLIAYIPVKTEGKDKFR

SEQ ID NO: 929398 - protein, 130 aa, Homo sapiens
MSIVYVCVKRESDVLRSWTNILSNIHDFFYSRKCCLDSRNYDFEYLLTCTGHFYVPGALPSVLHSLSHLTFMRAIGSRCDLEMLNNTSIPADKYVSFMFLCLHAARSMTSKSQISHRKRKYEDRQCKHQL

SEQ ID NO: 929399 - protein, 143 aa, Homo sapiens
MLSFTSGNPIYVLNKSCFVLNSQQYSEPSKDFAWSIVLIGSALQGLHGISPSHLLAVRLKEYEQLAGNMAMLTHFAPTKSHSLEVVDLQRPSILWPAPETRSLEERMKPCSPEQVMSQGIEVSRWAEIVWFLLPLLSSSGKVK

SEQ ID NO: 929400 - protein, 168 aa, Homo sapiens
MSKSSLRPPRKQKLLCFLYSLQNRTTTINTVLPRRNKFVYSCSIKIHALGSDEPLESIFCILLVVEAFSLQKVVEMLEEVVVEWSTLTPSATFHAVVRASALMIALNWSLSTSDGRPLRSSSSRLSSPLQNFLNHHCTVRLYQKLKQDAVVVNDWVAAIIWVKDLLRY

SEQ ID NO: 929401 - protein, 179 aa, Homo sapiens
MCRLVTYVYMCRAGALHPLTRHLALEVTFLYPRCFLQSMITDAKHELPCLTLRSILTKFYNTKYTIYNKLCNTEESPIFFIEYNERAVYTKQPPNVEVAEKPTNKADESSLSTKGVCRLAKTQKLANSFYCGGCENIRILINAVGNKKFYKVYRGKFFKTVASCYQQGIGFRIPVVTKV

SEQ ID NO: 929402 - protein, 128 aa, Homo sapiens
MRAKQELEIKCDTEMRKLNKKVLQEGVRRLNEQKKHLEGSADGKCGVGAATQSPHLGIAQWSCKKRDTVLQTQNGRPTDSLHCVPGKAADTQCQPMKATRKGVIPCKATGAELPMLWEPTSYISITRM

SEQ ID NO: 929403 - protein, 140 aa, Homo sapiens
MPSLERGTKQFSERGEVTQRREEKGKGGEGEGVMEEMRREKRRQDESTTPKKSGEPVEKITVPSLGPGDCAKPIRVPGLARKKPVLWEAFSEKLGHWIYKLTLSFPWVKLVLGDLMAFHQGHDLHYRHVTCACFPFHHDV

SEQ ID NO: 929404 - protein, 144 aa, Homo sapiens
MVTTTQEPNNKTRYTSSILMLSLRSSHGIVYSPGVYNRIINRQHKESSEAQITRSWSKSGNNSNIYVIVLLRLNEIKPIVSCTSTISESMESGGVFLHETSVFHETSPCCQKDVKIKFLYGLDGSHGQKIYIKYVIKYIFFYIV

SEQ ID NO: 929405 - protein, 127 aa, Homo sapiens
MWFWGWFMRYRTGPCLQLCSTSNGNGGVSQRTATVHIYNSTIQWSSQCSWYPRYLYDHNCTSSPMMLVTTPATWARQPQSPVIAMTCHRWPMSDFHLPILAQVISTSIQTQVYNFRKDKNDHILTSD

SEQ ID NO: 929406 - protein, 168 aa, Homo sapiens
MRGTRWEVIESRGCLPSCYLCDRIPRATSQLCSLHSGAVYLNVPDKAQANTVADQCIAPEGAKDKLWVGATTDSPDYDNVQELWDYSCNRVPKTLELPMCNISVEKLQEYDSNSRTAAWADYSKAIGMGLSKVMGSQPLPQCVQDAGHGVKKNYSGDLSFDIVYPLVF

SEQ ID NO: 929407 - protein, 155 aa, Homo sapiens
MRCQLDWIEGCLDGSVFLLKIVKQLQVGLSGGITGEGIVIIDDSSMHITVCDDLPVGQDVEVEDSDIDDPDPQDKLPPLPLLPCHPTQGEDKDEDLYDDLLPLNEYQQATSELQLSDNKAASLATQFCGVALGAMPGHMLEAFSSLSSVNHLTGF

SEQ ID NO: 929408 - protein, 154 aa, Homo sapiens
MDSRKTEKRLGEKPALRREPDRETKELESKAMNNFSVVMGLVANEVFGGIPVIPFQERACSGAMRRAVDGPSLCGALGSSQPSPTLELNRKLRPLCTPQIARGNRASPSKQRSGICTSALAAAGFYLYKIPTGLEVEWHNTIENLQTQVLNSGE

SEQ ID NO: 929409 - protein, 144 aa, Homo sapiens
MMEQILCGKDPSGEVKRERLCPCGAILCGAKFPISSGTQPTCTQVIKKFYCSHNAYLVVSSHGRAQHWDSKTCPKSSFKVKSGNSPHKYLLALFKVQSETFHKGKEDVAPTWRSGHETSSLIACLQSPIVWVPHSSTPGQPCSL

SEQ ID NO: 929410 - protein, 139 aa, Homo sapiens
MSPYYATLPSDASSKLGKLNFPNLKLVGLGLGLGNGTQKTDILAKGVGGCYQIPTYVDNEINRRNVDFWNTNQTQKISRLSSIPSKFKKKGTEFSFPLIPEAAAIRIQMAMGLCCHFTNETAHKFLFALTGSSDWQRKL

SEQ ID NO: 929411 - protein, 142 aa, Homo sapiens
MSHLPALSRVRSNHLQHSLKPKPDPEKGPNSLQFYDGRERNIFCKATEAIDNDSSDGSGQSKLKIWRGYSILDASKTICDSWETAKISTFTGVWKKLTPTLKDVFEGFKTSVEEVTAEVIEIRELEMQLEDVTELLQPPDKT

SEQ ID NO: 929412 - protein, 142 aa, Homo sapiens
MPFSSVEFLLAFFSSLFIEDWDPQAADSEKGISVQEIYWKLREIFGEGKQLRRASQNPQQLENKPFSHEEGSRQCIKASTKVHSLLHSDSLHLSFGEAPLEFWWASSPVEYSYSRNLRGPPGDDLACSSPLAPKKFLDRDDS

SEQ ID NO: 929413 - protein, 145 aa, Homo sapiens
MLKIPKCFFSSKGSQLFASKGTNWKKNEFDKFIEGGFKRWVITNSSELKDHVLTQCKETKNLDKRLKEFLTSITSLEKNINDLMELENTAQELREAYTSINSRINQAKESISEIEDELNEIKEKRMKGNEQSFQEIWDYVKRPNL

SEQ ID NO: 929414 - protein, 167 aa, Homo sapiens
MIPLSDCLKSLASLSFLALLRSEGNNILSIPSNPFPVQPLGKSALHVTTALMRPGRIDRIIYVPLPDAATRREIFKLQFHSMPVSNEVDLDELILQTDAYSGAEEVTSKCVPPKKQGKNMGSRKQVVQHMRIVKRIPRAIKRNPGKDIFKLFYKSGKEIHSYQVVTI

SEQ ID NO: 929415 - protein, 143 aa, Homo sapiens
MTMAVFSVVIHEEKDTVPIKEKLHLDSERLIMSQSKFTQKNKVNIYSNEDMDEAGNHHSQQTNTGTENKTPHVLTHKWELNNENTRTQGREHHTLGPVTGWRAKGGIALGEIPNVDDGLMGAANHHGTRIPMDIDEIGNHHSQ

SEQ ID NO: 929416 - protein, 140 aa, Homo sapiens
MWNSSTVIPSDTENAYLLSATFPDFPIVCFTAYSNRIPQPHKHSPYAKIKVAFSYFLTKCFTMGLRETSYSAFVIRLECSYFLGVALHPAATDMTPSFVDPRNVVSEGQYQPEANSPLPSQPRLLKLSPYQQKGCSHSYH

SEQ ID NO: 929417 - protein, 141 aa, Homo sapiens
MCFNACFTLFSAIYFIKCPSAAGLLEFAGVPLQTLFAWVSPAEASEQQIWQNSKYCCLILPLEALSQRGSRLYEVSVGPYWEVSPIKRDKLTRYISYNIQLKGQQHPNGQETSLQRELRYVCKVLDTFSEKFSLNANSMTL

SEQ ID NO: 929418 - protein, 148 aa, Homo sapiens
MVSPLTGTPAPLCTMLLLPGTPHEHQGCLIVWVELQTFPTDPSITLVPLLKETSHKWKVLGLKPYHLDSLVPEGDPLMWYTLPSPRSGSPYGIMDCVPADAVMECVGCPPARRWHLQKSGSCRVPMGFMPALFYPEEVLWCLSQCAEP

SEQ ID NO: 929419 - protein, 136 aa, Homo sapiens [sequence omitted]

SEQ ID NO: 929420 - protein, 141 aa, Homo sapiens
MSLQWLLHLGRHHHHKQNLLFSLFCLLHFSGPKETIKKNFYDKFLKYHKVERSWLLARVGKHSGEIYLAEKRMSLTAEQELSGKVCRKPDKSNIRGEEAVNTTKKKGGKQVEEQGGKGLIPVYSFALLFANPILQLTQSQR

SEQ ID NO: 929421 - protein, 167 aa, Homo sapiens
MFKSAEAVCCLLFYYDLTPEVESIEAVGLAELWKGKSPGPLCFRDKAMPHPASARPPWAVPTVQPVPILPVNSPIGSSTLLLTQSLGYDFSPAILLLPSDENWSLKSLVSHLEKLFNALGNGLVCRMSSGLGSNLSSRWLQRWVLLDQADLSSNTQHVGHREVAWTL

SEQ ID NO: 929422 - protein, 175 aa, Homo sapiens
MYENDWMSSQKSAAGSESSWRTSNRAVQRENVGLEPPHRVTSGALASGAVRKEPPSSRPQNGRPTDSSHCVPGEATDTEGALVVHMPAQCRNLEEFMPQTTLAACMCMCVWVGICEVRGALTEVKGIFQSPTAHLVSPTPLLMPFGDFYKLIIVFLVVHSLHSRSPWCSGLFSCS

SEQ ID NO: 929423 - protein, 205 aa, Homo sapiens
MDPHCNLDSHHGDWSRKHLLICDLEGLRRIRKKPINYSMMSTTTQRNEENPSAFLEWLREALRKYTPLSPESLKGQLILKDKFITQSAADIRRKLQKQALGPEQNLEALLNLATSVFYNRDQEEQAQKEKRDQRKATALVMAFRQTNLGGSERTENGAGQSRSRACYQCGLLGHFKKDCTMRNKLPPHPCPLCQGNHWKVHCPRG

SEQ ID NO: 929424 - protein, 147 aa, Homo sapiens
MTVTRGGVYRGRQASLSCGRLHPVRASRLLCLPTLASAMVAAPPPASLPPCSLISDCCASNDWSLAPLPRLECSGSTAVFGAGKQEPLSPLKLRPQSPLPPGALSQVDGSFIYKPLTGVAAFLSGMFCPVRKNLERKSGHSHFAVLW

SEQ ID NO: 929425 - protein, 171 aa, Homo sapiens
MSSPSLSPRLINEADIPLYPVVPNPYTLLSQIQEEAEWFTVLDLKDAFFCIPLHSDSQFLFAFEDPTDHSSQLTGMVLPQGFRDSPHLFGQALAQDLGHFSSAGTLVLQHVDDLLLATSSEASFQEATLDLLNFLANQGYKMSRSKAQLCLQQVKYLDLILARGTRTLSKE

SEQ ID NO: 929426 - protein, 184 aa, Homo sapiens
MSGYSSETKLPEEQSGNNICCSPVSAVLQPPLLIPRQTGSGVDLQQTPTDLQLRVLTVRRKTNKQKGHPHQNPICTSPSSKTKAMEQSWTENDFDELREEGFRQSNYSKLKEEVRTHGKEVKNLEKKLDEWLTRITNAERSLKDLKGLKTKARELCDECTSLSSRLDQLEERVSVMEDQMNEMK

SEQ ID NO: 929427 - protein, 142 aa, Homo sapiens
MGSLALMGGPRDSGIHYHEECQEKIYRRGNTEGSLERTCCEAYSGFGKIEFPELGIRENKSLRADGSHGKGTATFQGKEKAICLRRNPQTNRRSRNLKQESRVTNFPIQSQELREDLFITFAVQLMYMDNLSDQLHIKIDLN

SEQ ID NO: 929428 - protein, 139 aa, Homo sapiens
MLSIPQTPTPQQALLCDVPLPVSQCSHCSIPTYEQDPQLQVFWSSLRSTPDPVCLGISSGGCRTANIAEQQMLLPDHSSGSFLSEGYPAVYALPPEVESTEAGDELISSRASTVFHMPCEVFNKSLSDMLGNRSKRLET

SEQ ID NO: 929429 - protein, 444 aa, Homo sapiens
MTANGTAEAVQIRFGLINCGNKYLRAEAFGFKAGSAAVCLRSHLGRYLAADKDGNVTCEREVPGPDCRFLTVAHDDGRWSLQSEAHRRSFGGTEDRLSCFAQTVSPAEKWSVHIAMHPQAHLSAPPADEIAVDRDVPWGVDSLVTLAFQEQRYSVQTADHRFLRHDRRLVARPEPATGYTLQFRSGNVAFRDCEGRYLAPSGPSGTLKAGKATKVGKDELFALEQSCAQVVLQAANGRNVSTRQGMDLSANPDEETDQETFQLEIDRDNNKCAFCTHRGKYWTLTATGGVQSTASTKNASCYFDIERRDRRITLRASNGKFVTSKKNGQLAASVETAGDSELFLMKFINRAITVLRGEHGFIGCRKLEFNNGTYNIKDSTGKYWTVGSDSAVTSSGDTPVDFFFEFCDYNKEAIKMDGRYLKGDHAGVLRASAETVHPASLWEY

SEQ ID NO: 929430 - protein, 155 aa, Homo sapiens
MWVGPNKRIKAGCPSQQWQVAVTLTAKVCSFTPEASETTNPQEGMNNSRRAALRAVTLTVKVCSFTPEPARPRTHQKEETPNTSEHQKEQTLDTLPLRTVTLTARVRSFILEVRSRTHRVQTQYQSSFSRTAVGMEQEPFNQAGGLTKKGTLEQI

SEQ ID NO: 929431 - protein, 153 aa, Homo sapiens
MCAMMKATAVWCSALCHDSSLTLWNLFSRCLSRGGSPGEVSQRLEIQLTLERHGFEVCRLITGYSMETIVNTMEENPNRENITKVLEGLHHLRCHFVTEKVVKAIKPKTINSCWRKLCPDVVCDFTGFTTEPIKKMMKATVDMAKKNFFLSEG

SEQ ID NO: 929432 - protein, 154 aa, Homo sapiens
MGLTPKFSDGFSAIGGFQMHLKCVNCLQELAFKAYTILQILQSQDSTIPCGWLMNKNEKHDDKLVMFTNQSEDSEREVGKKNKDKRREPTGQEENKGFRVYAENISELIIQYTDPPWQYIPFLWLKFEAVSKPVNIIEATRRDWERAIRDEKGR

SEQ ID NO: 929433 - protein, 138 aa, Homo sapiens
MIDQNTKLIPVPGWPLRLRLKIYLSSRSASLDSGSRFAPVDTNFIPVPTDRGHSHAPEDPVDRLTSVDPTKKHNDSSEKNVVESLSSRLNQSEERIIDLNDRSFGITQSEEQKMKRIRNSEESHGSFESPSRKPMYVL

SEQ ID NO: 929434 - protein, 151 aa, Homo sapiens
MNSRVLSLVASVTMPESLAAAALPTADHSSGRINDMSPEELDITVYSIFCHKLNGYQEGVYSSVLNIPIPNIHMHFFLKEIKGVWGDIGRHLSHNQKTKVLLDSDTEHSGAERVDKQKISSACVPEHMLIMENDEKTGGDSGEDESEYGQE

SEQ ID NO: 929435 - protein, 195 aa, Homo sapiens
MGGSLNSYSKRVGAPEAWRSAWVWSRESPPVPGSLNRKGGVTQAAIPNEQVLQMPGDLLEHEAERDPLHLCLCTGRGSSLGNPAMTHTDWFQVTWNCTSGPGCTSHLGKTAAVAALLPPQAYDRESTIPQPTAEALSTVLSMEAPTTLQSRHSNLWPKTNVCVAILLRHQRMADFVSAWIKSGLLLLVLNLGNCL

SEQ ID NO: 929436 - protein, 128 aa, Homo sapiens
MYLGITERALQLTGNECCQNWILSFKAAGSLLAQSVSGNIVFSNMNPKARTKALCRSVAAKLLLLIFKFEFPAVSSLAAQLKLEQDELLELSPTWPQADSKTSCKESSLRGHHEMSLQERLNGLIMFY

SEQ ID NO: 929437 - protein, 175 aa, Homo sapiens
MWNSVLVPPLVSCGAFILCHLSAWRFHMTLCVYTSFSCAIENGDAFTLNPIIQPTLATSQTLTFKCANRSVLPVPEDLPYACTLPDPMFAIGTQRESCCPGCDDVLLEASIQQTGNHRARTKEVMWWQARYAFRNELLNSTLHEVLLGMLGMNITATVRRFGCVKWRIRDNYCTY

SEQ ID NO: 929438 - protein, 167 aa, Homo sapiens
MYGNAWMSRQKFAAGAEPSWRTSLRAVWKRNVGLGSPHRVRTGALPSGAVRRRPSSSRPQNGSSTDSLHSVPGKATNTQCQPMKAAGRGAAPCKATGEELPKAVGGHLLYQCDLDVRHGVKGNHFGDLRFDCPTGFWICMGPVVLHLRQFLPLGMGVFTQCLYPHCI

SEQ ID NO: 929439 - protein, 228 aa, Homo sapiens
MKKKMKMKKMKMKKRWQKKIKMVPLAASSHGRRNEEEDENEDDEDEEDEDEEEEEMAEEDEDDEEEDENEEDDEDEEDDEEEEQMAEEDEDEEMKKMKMKMKKKKKRWQKKMKMVSLAASSHGRRDEEEDEDEEDEDEEDEEEDNEDEEEMAEEEEDGASCCILTVMATPLASCESFLFAREIKSSGGGSGGSAEISIILLRYRKYVQHTYEALLLAKLGVLGLELIT

SEQ ID NO: 929440 - protein, 156 aa, Homo sapiens
MVKAKFEEGSKEFVADEEEENSDYDVELLLNLDLCLVINQHWRQHSLQCVNASTCIQMLKMKIQMLTMEKNMMWKRKNKDMGTSLHFTPVRKDLSHLTAEGQTCWRLEGTLSQSVSCQYHMVGVRTEDSIGDDEAGMEVDTTPTVAGQFEDADVDH

SEQ ID NO: 929441 - protein, 162 aa, Homo sapiens
MMTMALSPKVTQSCIMTPGEQFPTFLARGTGFVEDNFSMNRGLRNKVQMQVLGCQFQFPDIAPPSPYSQEYQIMHILSALPKLTEHVEIKLYPDNLKILFMIKQIFMEHFPGRMPHEDWSDAATSQGNTKPRRWPGTDPSLRLQREHGPAGTLILDFKIPER

SEQ ID NO: 929442 - protein, 144 aa, Homo sapiens
MVVCLYAAVGAEASCKHVYAMGCKLVPRTCVRTPRAISVLSVTYKEKSYPVVKLNTGAWTHFQLLKYWAISSKALAKEPRLGDCIAEGNNDEPLARMGVAMGASLDQEHSGHPARSGGWKSVVGLQQRQTAVVDVFYIQRTSSH

SEQ ID NO: 929443 - protein, 134 aa, Homo sapiens
MAVALGKKSMGYRPPCSCGVTNMHEAHIDHTAKHCVWDGESQMRRNGLWGTWSLMGAGEVKAVAADEIRGWTPQKMPVFVLRTGPVDKGAAGYERFSLQCHGNMTEIINSPRGMMDGIGWRCPWQNILLNYLLL

SEQ ID NO: 929444 - protein, 173 aa, Homo sapiens
MFSIFEQIGVEQQIPWLPKTAACDLTFKSLTNAFSENRALLSPPDFDKVLRVQRDASDTRLEALLSLIMKEEQHPKMYKHKELLKEKLCNFLFQKSLCLRSLSITCFYMFHEYNNAYIQCCKEIKNTKTLTLRVSQVVTPIIFTSRYRKYHRARRPLSDAGPSILDFPASRNT

SEQ ID NO: 929445 - protein, 138 aa, Homo sapiens
MKSSEPPESGRGEEGLSSGASRASTALLHLTPHFQPPAPGEGKLLFFLDAEFVVFVVPPRETSAAGKALNDEDGIVWPGSRTAADARSPISNIYPQGRVCTSETAALDSGVIEFLLKIHHWRCIRNSGRKNEVSRWKH

SEQ ID NO: 929446 - protein, 141 aa, Homo sapiens
MHVITLKTFQWDNMWRWKAVLLMVPTLCRPRLVVYKGVYNSVPGLHIHSPFTQRLTPATSSPASSIRGKHVCTAAGAFADFECVCACVCQTVGVNCSTEITTQRGLLQVRKLSRGSLSPAEAQGGPKVTKGAMGAGLCCPL

SEQ ID NO: 929447 - protein, 281 aa, Homo sapiens
MLRDTVAHPHYANQSLHAFHHWVTALTETNSSLVHFEVGLYDACGLVHFEVGLYDACGLVHFEVGLYDACGLVHFEVGLYDACGLVHFDIGLYGACGLLHFDVGLYDACGLVHFDVGLYDACGLVHFDVGLYDASGLVHFEVGLYGACGLVHVAVGLYDACGLVHFEVGLYDASGLVHVEVGLHDASGLVHFEDASGMVHFEVGLYDASGLVHFEVGLYDACSLVHVEVGLYEACSLVHFEVGLYDASGLVHVEVGLYDASGLVHFEVGLYDASAWDTNVS

SEQ ID NO: 929448 - protein, 164 aa, Homo sapiens
MDVDLAILCIVEETLEVMEIILAVVETLVEEEAMVVEVVAAEVVMEEVMVDIMDLEVMVATSRSGPGYSSRGGYGGGTRGYGNQGGGYVGGGGGYDGHSEGGNFGGGNYSGGGNYNDFGNYSGQQQSNYGPMKEGSFGGRSLGSPYGGGTGVGSGGYGSRRFWV

SEQ ID NO: 929449 - protein, 143 aa, Homo sapiens
MGFKHLEDEPCDQAVLKANNLDKYDCSFSDWMLVGDHKREVYFENNSSYCHSWAFCLRMKFYQHRGGEISVTEDQLQGTAAGLDPERDQVPCARKNSLTYHDPSHPATVPFQRAESEERAFSMQGEHWWPGQSGHGEFAAGVV

SEQ ID NO: 929450 - protein, 136 aa, Homo sapiens
MESLHITKLPFLALSPILECSGTISAHCSRCPPGSSNSPASASWVAEITGTLHHTWLIFVFLVETRFLHVGQAGLKLLTSGDPAASASQSAGITGEWTVGDNWELRFKEPCRGSREDLPTQLWIQAEIIALSGPKA

SEQ ID NO: 929451 - protein, 188 aa, Homo sapiens
MQLEFLTQKPGPCPVAFLSKQLDLTVLGKPSYLCVAKGLCVNIYTDSKASDPIAQGNNYADKIAKKAANIPTSVPHGQFFSSSVTPIYSPTEVSTYRSLTTQGRWFLDQKRISFQPHKPVLFCRHFITSSIPIMDRTLLVKSAKQFLRLLVFNGNFIPLTVLNLQERHLSLACRWLSSPCVHNFPSVS

SEQ ID NO: 929452 - protein, 235 aa, Homo sapiens
MIRRAAMALWEREHPPGQNVLSVGYKFPTQDPHWDSNNANHWENMQDLREMIIKGIQESVPQTQNLSKAFDIQQEKDEEPTGFLNRLREQTRQHAGLDLENPSDKECENFTLEAQKVYARRDKEKQKQKTKLMLSTFQQIAPNPHIPKQGFQGARDYKGPKPSLRGSKPPSGGSRPSFNKPPKGYRGARAENAKTEKEEGQDRYYRCGRTGHFKRECPELKKERETFTLMTLEEQ

SEQ ID NO: 929453 - protein, 129 aa, Homo sapiens
MASGFHDLYLLLFFSLINAVKMSASVNYWSMLTHVCWDLTATGCEFSHHNNQMKMSEMNLFAKTTDCLGTSEITQDCGDQLNRDMPKAGSDLYPCRRSLALSPGWSAMVQSLLTATSTSRVQISPASAS

SEQ ID NO: 929454 - protein, 136 aa, Homo sapiens
MLSCLIRTCFMNLGAPEFAGGPLQALFAWVSAMEAAEQRILLNRKCCCLIVPLEVSSQRGTWPFQTNATEEETKAEVREAPKDKSGLCGYSFLFSILEKSFPIAAWISDASWQIEAAYIYLLKNLNHFTLKSPVLY

SEQ ID NO: 929455 - protein, 244 aa, Homo sapiens
MSSGFMFPLQLGGSRDRDLGSSNGRGPFTSLLGLHPREMQGRYQSEHSAKGRLWHAGSVSKALSAFAPSQSEGSKGSTIVVAVAEGLSVASGSSTPEKCRSAANGKVQPGRQQGQDCCSGNGIGSGSGRGLSVASGNSIPGNQSHQQWECSVAGVGQLLCSLMKSSGPGAGHLECEEYSDKDDDGAAGENSICMLFRDIDLDEITQDVNVDRQEVQRLNAATCQCLSVWKARRSKQRRLMKSNQ

SEQ ID NO: 929456 - protein, 136 aa, Homo sapiens
MRGPGKGVGEKRMGWEKEGREGKAWVEEKESANETKEEKDRDVGGEPEGEGSWMPREGPRRGQQPCSKLGKQIAQIGAEEQRTPGGMTSEKKGADRIPHGLDGPEVLQDWRIAAPVNERAQRGYWSWAIPPQCQIL

SEQ ID NO: 929457 - protein, 145 aa, Homo sapiens
MLNIGPHSLLACRVSAERSTVSLMGFPLWSGPSAAGLLEFAGGPLQILFAWVSAVEAAEQQILQNGRCRCLILPLEALSQRGTCQYECQSAPTGRCLPVSLLRDANYSGHGPGGWVSSLALGSQCGVGNDSSSGRIILWVPSDVQ

SEQ ID NO: 929458 - protein, 179 aa, Homo sapiens
MFHQKKVHSVGLPGEEDPLTSVKLSVSRLSGTPTEPAARTFKSAEAVPTATPSPRCSFPDALPREEESKEAVWLQWLCQTAMGYPQFELPGDFVYTVRGKPPTEASVMADALPPTNLKHPRLTSDCCAGSENFNPVDLILLGSMGVGSAKLDHLAPWLQPPFQGSEQFCLAGIPGATGV

SEQ ID NO: 929459 - protein, 162 aa, Homo sapiens
MPSESQVLESGTQRACLVLYPTMAMLASEARKAITFLQAPLVDSDLYDEKTMAQDIGMGKDFMTKTPKPIATKAKIDKWDLIKLKSFCTAKETIIRVNRQLQNGRKHLRCIHLTSLISRIYKELQQIYKTKNKKQKKTPHHKVGKGYEQTLLKRRHLCSQQT

SEQ ID NO: 929460 - protein, 190 aa, Homo sapiens
MGAHLLHRHALDMRHGVKGGHFGILRLNDCPVGFWNCMGPGSHLYLRLHLPPLYNGREDLHVLLVRYHTADKDISETGQFTKERALIGLTVPHGWGSITIMVEGKKEQVPSCMDGSSQGENEEEAKVETAQTNRSRETYSLPGEQYGENCPHDSVISHWVPPKTCGNYGSTIQDEIWVGTQSQTISPHKG

SEQ ID NO: 929461 - protein, 149 aa, Homo sapiens
MFADLGERGKSAKTKTQKDLILFEYFKQQQQNANHLNKYFAPQMLSVNRSSKLEEAKDLQRGHICEKQGPLPSGIVLHQGDTSVEHGSAPVGTLTARNNGNVGLCEKGLWLQASMEVGLVTEGHFSSYLVLLTQILAEELCWSPCCPEG

SEQ ID NO: 929462 - protein, 149 aa, Homo sapiens
MGVTGCIWNVPASMGQAVKATVSGSKSTREEVCSGGLTGSLKTAWHTTNGWRAGARDDIWDEAFIKVHGYYPSGFPPLSLAIKSPSFTIFQFVHATSFFWMPDKSSGAASADTKGCHTSPLPLLAGGSCLTQKGRGPIKNDEFMSFVGT

SEQ ID NO: 929463 - protein, 135 aa, Homo sapiens
MLSHSDERILKRLLVTTLWSPGSLTLLLLKARLFLISSSPSILLVTVSNSERADLGNSELEKWVLRAIRNLINKPAPNSSGPLGIIFIQEVKLVKEIKKIEPKKEDTANLFEVQLAKLFYGVIPGSIKNQQGTCL

SEQ ID NO: 929464 - protein, 188 aa, Homo sapiens
MVLCIPTPPTPAIAKRGQGTAWAIASEGSSPNLGSFRVVLGLWVHRRQELNFGKLQLDFRGCVEMHNVQTEVYCREGTLIKNPFEVITKGKCLVGAPIRVPTGALPSVAVRKGPPSSRAQNGRFTDSLNCTSGKAAGTQCQLVKAATGTVPCRTTGTDNSMVSGLLRDENGEHCETLWHYETAFPIQL

SEQ ID NO: 929465 - protein, 191 aa, Homo sapiens
MEQPLYPSRNVLLVLGSEYAVENKTKSPSLLSLHKQLVDKYVYNKLSENLKQHHILGERLSTTSPITTSQTYEVRVYDTSTLLCKHKRPQNGKEWIHDPVVNKPGESTLTLLEEDQLLEITNDGGLKSMFKTTSNLYTLWIKVKVEYPEIATKPLKGLLSFPASYLCEEGFSAVTATKTKLQSRLDITHFW

SEQ ID NO: 929466 - protein, 199 aa, Homo sapiens
MLLRQFLLVLYLCGLNYFVISAKDKPTTNIILNGEELKALPLRTGTRQGCPFSPLVFNIENSTGSPNQSNQERETNKRHPKWKEEVKLSLFTDNMILYLEYSKDSSKRCPDLISDFSKVSGYKINVKKSIAFQLTNNVQTEPCQKLNPIYNNKNKKRLGIHLTKYVKDLYKGNYKTLVKEIIDNTNRKTSHLNGWELLK

SEQ ID NO: 929467 - protein, 360 aa, Homo sapiens
MISGHGAFQRLLSDHCHQQLHCYHHHHHYHYHHHHHHHHHHHYYHHPFPPTLSPPSPTPPPSPLLPPSIPTNTITTITNTTTITTTTTITTTTITSTIITAITTTITTITILTSTITTIITNTTTITTTTTIHSHQYYHHHHQHHHHHHYHHYHHNYHHHLHHHHHHHPHQHYHHHHQHHHHHHHHHHPFPPLLSPSPPPYHHHHHHHCHHHHHHHHHHHHHHHHHHCHHYHHHHPFPPLLSPSPTPYHHHHHHYYHYCYHHHHHPITTTTTTIVTIITTTTTTIITITNTNVTIITTTSTIIIISTITTTTSTAITITTITTTTTTITTTTTTTTITTTIINITTSYQLCPTIVWVIRV

SEQ ID NO: 929468 - protein, 316 aa, Homo sapiens
MALSREEGGAEDLQIISTDESQVFVAVQEWYQMDTYNLYQSDPRGVRYALVLQDVRSSRQAEESVLIDILEPDCHLHLHLRWADNPYVSGTVHTKDTAPGLIMGAALSICWEQEEKARGLASHLLARHGCLPWHRSQCHVTALLEVAGDDGYLFPQGNLGSQLVEYKEEMYITSDCGHTWRQVFEEEHHILYLDHGGVIVAIKDTSIPLKILNVDEGLTWSTHNFTSTSVFVDGLLSEPGDETLVMTHLGIRDICHLPQVPLLLIMGHPKYPSPVGGAQTGTRLEQRASPPRPRCLASAGPLGANQSDSRSAIDKS

SEQ ID NO: 929469 - protein, 299 aa, Homo sapiens
MLTNLFGVILVSSSLSDRDQSLFLSADEGATFQKQPIPFFVETLIFHPKEEDKVLAYTKESKCGMFFSPRQERWLVLPQISISSSGSCVHGVQQGTEALSPGSLTLSVRPRQKKKYNQWLELQNALTSPCPRVKRVHSVSKWALRTRQPRIPGYRWCRSCAGVSSAQRTRGRQAGDSAAKMQAAEPGLGWEDFRGGGGRPGALTQGAPGSIHSSQTWGTDPWAPDPAHSSQRTCPAACTGLSQALSSSPFCCCPQLGPGLASSGLPASTHSLWCGLLETLSDHGPPERLILSGLEAAYS

SEQ ID NO: 929470 - protein, 385 aa, Homo sapiens [sequence omitted]

SEQ ID NO: 929471 - protein, 272 aa, Homo sapiens
MVSPTDDNKTGNIGECLGASPEEDREMWESLELPRDLLNGSAQNGDSDMDNKIQAGVVSCGDEELVENWSKVDPCYILAKRLAAFCPYPRDLWNFELERDDLEYLTENISKQRSIQEVTLVLLKAFSFIREAGHKSLGNLQPEHMIEKKNPFSGEKFKPAAEICPPHRVPTGAPPSGAVRKGPPSSRPQNARSTDSLLRVPGKVADNQHQPIRAARREAVPCKPTGVELPKTMRTHLLDQCDLDGRPGVKGDHLGALKFDCLTGFQTCMGPV

SEQ ID NO: 929472 - protein, 145 aa, Homo sapiens
MVPAPLCTSGRIRLCVCLVLDFFWLSGSSAAGLLEFAGGPLQTLFAWVSPEEAEEQQILQNGRCCCLILPLEALSQRGTQLYEVSVSPYWEVSPTVVGSTQFKLPGSFVYLLKPQQWQTPLPQPCCHLAVGSQAAVLTVSEAPWA

SEQ ID NO: 929473 - protein, 149 aa, Homo sapiens
MGHDDDGGFVEKKRGKCGEKKERSDCYCVCVESLHVACYSSDLGHDNAFGWACLDSKLQVQIRSAPHVLIVTFLSRYELSSLTFQSRSYVKYLLLKVEEQKCKRLNQIMQAHLKSLLIFYWPEQVTWPSPTTIRWENIPTLLRGIAMTR

SEQ ID NO: 929474 - protein, 170 aa, Homo sapiens
MTGARGREVAASRDHGSTVQPWQQRETVERKKERKKGRKEGRKEGRKEGRKEGRKEGKIDSLTDIGQNGKSSSQRQAWVMNSEGGAAESPAVQEMVEGGSQVGSLSSWMDKVITEIGKTCGEVNLESREKNQESYFVQSSLRYLLDFKGIHQEASKRHFSHLCFLMHEEQ

SEQ ID NO: 929475 - protein, 324 aa, Homo sapiens
MPASSFAFNHDCKFPEASLAMLPVQPAELKKTLAKCQNLNLGLAASRIYLSYINEQQHQNDCLIDLKFCEDLCGAEEPHTIVTATPGHEEYCQTITNVPLRPRSLKSACGECCLVWDSPFRAVVSLLAQGRSRNVIQESSPGIEDLKSPLHHHKDCVASDLQPAQHQVSPKACCNHSLATAYVHSMSWSSAIRWLSQSHLCPSLQGGDFPQAPGGSRGAIWDPGTRVKTLDVYLVLYFTVDESALKPQDAVLPTLPSPYPKAQEAHSMQPQVHGAHCQATANVSLKPRGSHSACAVAGFSGPKARTFPDMGTSKCQMPFWMMRA

SEQ ID NO: 929476 - protein, 135 aa, Homo sapiens
MQRKEDGGGRGKTSTGKTDSHGDKSGVMKDLGTFCNSSERLAALRENPCEARQKQVTRGPSELPGLFPLLPLPLNFTQLSKLTQLQLRMISLSHFHSLGTHSIQGVSWVLQEQPTPFMGKNSSVFSYFRDLDSFQ

SEQ ID NO: 929477 - protein, 155 aa, Homo sapiens
MITPKVRATHSAPLSSLHSRSRTLALLPHTPTRTDPWPSPGAYEVGAPLSPWTNVIQRANSRAPALLCHQALSLLGSKRAGPALGPVSMKRDDHLFLQRTGTLCPRHSKVKPGSHSDYEDSIHWVRVMKPRVPGDSSGIAHPGTQRFTGTQQMLH

SEQ ID NO: 929478 - protein, 149 aa, Homo sapiens
MDLGADAWLTPQPQVHQEVPPRSAGAQGILTRKYGCIRKFTRKCRCSRTSYLEVQEVQVHQEVCIWECRCTRKSHVEVQVHQKVSSGSTGAPGSLHLGVAPAAAAAFLVVAVGTVLSEAPGHTPQQESWKSHLGLSSVAPTLAEPSGLF

SEQ ID NO: 929479 - protein, 135 aa, Homo sapiens
MRVLALNWAHPGARGRRRECAGPGPGPTEVEGFLLSPAPSPLLREAARPHQPPVHEGEATRGHPRPNGSSQPASRRSPDKLLHCAPSRFHRCLLAAGADCYGALHPAPASWAACTSQTAVCPSAHCGLHLSRNVQ

SEQ ID NO: 929480 - protein, 150 aa, Homo sapiens [sequence omitted]

SEQ ID NO: 929481 - protein, 144 aa, Homo sapiens
MLQTSCHPGHKSSQGLTGAETPLTKFTHMVVGSLSSSPYGPLHIQPEWPAGPPGVAAAFPQSYDPKEKQEFKIEVFIEKNAYKWTSTTFTRGVPCIVSISHGRGGAFNHGLNTATIPLVLAHEMICCLRNCNPSYFAISYRFML

SEQ ID NO: 929482 - protein, 153 aa, Homo sapiens
MRKKQYKKAENSKNQNTSSPHKDHNSLPTREHNWTEKEFDELTEARPQGCRIQATPEDPSSRPAPEDTVPDPPIWTKAPDLLQAVFPANNPSSAPWNSFFLLWCSVANHKEINSAKTQGNLEVYPSPAKLLWRLQPQTELKLQASKTLKKRTS

SEQ ID NO: 929483 - protein, 142 aa, Homo sapiens
MAILSLEGARLPAKVDPRCTIGSSSGHGPAAFWCGYGGMSEVPQRCGDVGAIGLLWRMHSGSGSYFKTVPCCSSLDPGECGGNTVSFPPWSNAVTRTLDSSLHWLRLSSLFFGPRIKANPKSVCFRPKISHWFWLYPETSQA

SEQ ID NO: 929484 - protein, 183 aa, Homo sapiens
MEHFIKLYKKKTDKDVRKDDRAVQKLQLEIEVTFEIDVNGILRVTAEDKGTGNKNKITITNDQNHLTPEEIKRMVNDAEKFAEEDTKLKECIDTTNELESYGYSLKNQIGDKEKLGGKLSSEDKETMEKAVEEKIEWLESHQAADIEDFEANKKELEEIVQPLISKLYGNTYSHPIFLLKSYS

SEQ ID NO: 929485 - protein, 214 aa, Homo sapiens
MKLPEEGSGSNICRSAIFAVLQPLLVIPRQTGSGVDFQQTPTDLQLRDLTIRRKTNKQKGIAATSTKRTFTPKPHLKAENSKNQSVSSPPKDRSSSPATEQRWMENDFGELTEVGFRRSVITNFSELKEHVLTHHKEAKNLEKRVDEWLTRINSVEKTLNDLIELKTMAQELRDTCTSFNRQFNQVEERISVIEDQINEIKREEKFREKKNKKK

SEQ ID NO: 929486 - protein, 250 aa, Homo sapiens
MGRNQSRKAENSKNQNASSPPKEHNSSPARKQNWMENEFDELTEVGFRRSVITNFSALKEHVLTHRKEAKNLEKRLEEWLTSITSVEKSLNDLMELKATVRELREAYTSFMSQFDQAEERISVIEDQINEIKCTEVEMKEKMLRAAREKGRITHKGKPIRLTVDLLAETLQARREWGPIFNILKQKNFQCRISYPAKLSFISEGEIKSFRDKQMLRDFVTTRPALQQLLKEALNVERNNQYQPLQKHAKL

SEQ ID NO: 929487 - protein, 191 aa, Homo sapiens
MFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFECVSS

SEQ ID NO: 929488 - protein, 242 aa, Homo sapiens
MAVQSIFPSIRLVTNPVTVVAPVAPGVLPVLRRQCCMMGNACLNALAGTMLMPLAGAKFVITHVPAALGPHPLTVQPAAPPRLCVKATVCPAVERVSTLTTESAKKPEEGLQVEQLSGVGIPSGECLAQCRAHFYLESTGLCEVCIVLHSLELCTLRFLVETTEELDLQEHQSFQEFREMPTCHQSCFRCAGKSPHNCTDCGPSHVLLDGQCLSQCPDGYFHQEGSCTASQSRGITGVGHCI

SEQ ID NO: 929489 - protein, 155 aa, Homo sapiens
MLLRTENVIQGNSTSSWQLDPYIEGDYIRIWIYGTLNLRDDLGHLVEEISKQQSSQDLVWLLLTVNICGKPLPSEAQGLIILKWFGGPSPGSSCPVKPGDIAPCIPAIPAPAIHKIRKGTAQAIASDGASPKSWWLPQGFGPSSRLYQSLPVTRF

SEQ ID NO: 929490 - protein, 154 aa, Homo sapiens
MLSYLPHLSLRLPLCPPLLPLSKSNYCINASLIKTLLKAALLPKEGGVIHCKDHQKVSDPIAVGKAYADKVARQAASFPTSVPHGQFFSFISVTPIYSPAETSTYQSLPTQGKCFLDQGKYLLPASQAHSILSSFHNLVHNSGLSSECYRVQPI

SEQ ID NO: 929491 - protein, 136 aa, Homo sapiens
MPSWPHVGNEHLKCATLFVIANRWKQPKYPLMDEWEKIGVHTYNGVLSIEGCLRLVLKVLEEPQTGFNHCCGKMSFTLRVSIALLFYDLQIFIFSPDLSFTFQMFMKSSVLRKMLVQPDCFNIFLHYRRNKAVIVY

SEQ ID NO: 929492 - protein, 156 aa, Homo sapiens
MKLPEERTGSNLCRSAASAGDTQANGTPSEGHQHQRPKMDKFTKMGRNQRKKAENSKNQNVSSPPKDHNSLPAREQNWTENEFDELTEVGFRRWVITNSSELKEHVLTQCKEAKNLEKRLDELLTRITSLQKNINDLTELKNTAQELREAYTSINS

SEQ ID NO: 929493 - protein, 211 aa, Homo sapiens
MCPHSEPEKQPCTLTSSPNPTTNTPLGLPTGPASQAAKSLCPRPEKQPHGLSPVDMPLSQRSSHLSVLLASAPLLQVCWSLLVVHSRLCLSGYHQRRLQNSQDCCLFFPLEASSQRGTCQMPAVALLCALSQGDGSFIYKFLTGATAFLSEMPYPEGRNLERQSGYSSFAKLWRFPEEGIIIIGDDNSIVVGSQGPRTEGPAGATAEEHKL

SEQ ID NO: 929494 - protein, 134 aa, Homo sapiens
MSWVPQLEMQKSLPSVLIFLGAADRSCSYLAILPATPGPYLLMPFKKSHGSDVEGRDGCYMHSGFACSQVTLNLGNPLVLKQAVRKQALCPRERLDIISLGCSANMTLRNSPRKQQSVLCILDKPSKTCKSPRD

SEQ ID NO: 929495 - protein, 558 aa, Homo sapiens
MWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITGQSRSHFSHQLLRQWILCLDSLLSSYITVFIASAVLAW

SEQ ID NO: 929496 - protein, 171 aa, Homo sapiens
MKKIRDQHRVFKLKTTTRYSHRFIRPFKHIKERRDLPCGRVKTFSQISTYVNRNENEMKERHQKNDPGTLTKGVKENVFKDDSQEGLVHKQRTRNGGLMRNLNGNNVICNSNSERFYMFWIENASITKGNRAVAYAHIMAPPDTPLPATYLLSKMAGKMQKKEDKRKYYFT

SEQ ID NO: 929497 - protein, 142 aa, Homo sapiens
MDVKERRPYCSLTKSRREKERRYTNSSADNEECRVPTQKSYSSSETLKAFDHDSSRLLYGNRVKDLVHREADEFTRQGSLDPVQTVVDNPAVAFVEALKRRFIGGQRVLFLTPSKPRTAESKGAEERERAPGGQGGLVGEQK

SEQ ID NO: 929498 - protein, 145 aa, Homo sapiens
MGTYSRSHVQYIWCSCSLAWTWHLCHHLDLSALLLCAWSHSVPGLPLAGMGSGLVVPAKCSLPGQDKEEISNIYLTGIQLGWMEVVKHWEIGCTFKVEATGFAEEFDIRCEGKRNEGKFKDFFLINRECDPPTFNSIRQDLEENF

SEQ ID NO: 929499 - protein, 160 aa, Homo sapiens
MLTATLVLLQSYFLHHGISTGAVCFAGIVVPLIHRFTFYSFSYLQSTREEKLVRKPVKLCLHILTVSCRGTPAMSDKSWYSVQVKDDGGNATMCKSPFLNSCLWGQHEIQKPGKSRFRIPSCVQFLLKISANCASCLGDVIAHDWNAGVYEDSDIGVLLK

SEQ ID NO: 929500 - protein, 171 aa, Homo sapiens
MMVKWASSNMNELNTSDYELHEVVQIMCKYEDNVFTLFMAPAQKKSKPCDTLLETSHHADQVLIASSYWGFLTNAFQYLCKCVDYPISNSSKRSQVRTEEAGNRGGIRRDWKLGFRLQLHKILHNSNILGADSSLEPFEENPAKQHHDFSLVKSKIEEPTVSTINFRPAEL

SEQ ID NO: 929501 - protein, 138 aa, Homo sapiens
MVMTEQVIGMSQGGAGPYFPLYLYVLGSFVVILAFDNTAISPSFYGLSSYTGRPLSINLHQYSEALKLSQIFLKDMLYLVLGIFNFPIKDVGISSLVSIISYVMFHNFFLLSICNITISLVLNKPQCLLLFSKSPNDD

SEQ ID NO: 929502 - protein, 370 aa, Homo sapiens
MNVAAKYRMASLYVGDLHADVTEDLLFRKFSTVGPVLSIRICRDQVTRRSLGYAYVNFLQLADAQKALDTMNFDIIKGKSIRLMWSQRDAYLRRSGIGNVFIKNLDKSIDNKTLYEHFSAFGKILSSKVMSDDQGSKGYAFVHFQNQSAADRAIEEMNGKLLKGCKVFVGRFKNRKDREAELRSKASEFTNVYIKNFGGDMDDERLKDVFSKYGKTLSVKVMTDSSGKSKGFGFVSFDSHEAAKKAVEEMNGRDINGQLIFVGRAQKKVERQAELKQMFEQLKRERIRGCQGVKLYIKNLDDTIDDEKLRNEFSSFGSISRVKVMQEEGQSKGFGLICFSSPEDATKAMTEMNGRILGSKPLSIALAQRH

SEQ ID NO: 929503 - protein, 165 aa, Homo sapiens
MSLHRHQNMPGIHYFRWVLGLADFKNEASDTHDVQMCLEFLPSGGFVVLLTSGVKPQTFTVSFTALKGGVSRVVHSSQWVCGLADFRNEPTDLHKVNLQTFAVSVTAHKGFLLAGHPWLHLDPIAPPGPAYAHRLVLWSHPEVIQWAEESFSTPTIAPATNQQQA

SEQ ID NO: 929504 - protein, 221 aa, Homo sapiens
MMYYYDDGTGVQVYRVEEALLKECIKRQIEHYFNAENSERDYFLRGKRGEQDSLPIFLIAGFQRVQALTTNLITEALKDSTEVEIMNEKMRKKNQKNGQFQALLHATPIDSGKRQANSWADKRRSVVRPTLQARNSPRPEKPASSSRWSPPPQVQTSLMPFSQWDAFSGPTHGPISMHFLHLEPIKTPDAAKLRHSLGLHAYKEELPTLCLLSAESCSAPQ

SEQ ID NO: 929505 - protein, 171 aa, Homo sapiens
MKEEQAERYNGGTGSTGKYSHFKWETMAKIERLQAHASPKSSGVVKAQCSEMISFNSMSHIQVMLMQEVGSHGLGQLHLCGFAGTAPLLSAAFQEAWCKLSVDLPCWALENGGPLLTAPLGSAPAGTLCGGSNATFPFLTDLAEVLHEGLVLPLQQTSAWASRPFHTSSEI

SEQ ID NO: 929506 - protein, 323 aa, Homo sapiens
MTLKPDTVIAHLILGSYEGASLYGWLFNVVFRGSQGEVIHKMNGLTTGRPALLQMLKKVLPRKKKGNLMETCVYQMERRAMGILTTDLWSFEHEKDDLEYLVEEIYMQQSVQEVTRVLLKPFSCMHSQRYGLELELMFKREAENKSSENLQPDDAIEKKNLIFWGEIQACCRNLQDVWKLLDVQAEEYYRGRALHGEHLLGQCRVPTGALTSGAVRRRPPTSRPQNGRSTNILHRTPRKVTDAQQHLMKVARRGAVSCKATEAELPKAVVSHLLHQCDWIKDTGGSLPCSGDLWNFELEKDDLRHLAEEISEQQGIQEVNWLF

SEQ ID NO: 929507 - protein, 146 aa, Homo sapiens
MWLLSTYYVYYSLNSYSSILVIIQNSYRLSVTYFSSQPSQPLFDHPVIVPISVKHIQKANTSNFPWLHFDLIYCSLIYSVTATLASSHFQNTKHTSTLNPLHSLCICLLYSDFMITAKCSLVTSNKIAIHISQSSFGKAESPGYMH

SEQ ID NO: 929508 - protein, 160 aa, Homo sapiens
MSRTNSCQLNPTTWKEAMLHGINRLRELKICLAGRKGSMGNSALCRQCRVDPALLFVVSGKAARGKPSELKIQIPEAFSAEEPSPSSPAPPCPPRPPYPASASHLLPSRKPHPKQAPISLLPLQQMPSESGPSKVQVPSSLQDLKQIKGDLGKFSDDPDI

SEQ ID NO: 929509 - protein, 142 aa, Homo sapiens
MSCLQKGATHLGLLRAVLSLNKATLTCSPSSCPPNLILPGCRTRTQDPTNKGSKWNCNIFLTDMQPAVHNAEGDEKERRAVALLGVQTSVLPRAVTCCYTLFGSLQFLVPLSFQEPLCYPLLTVEITCGMPGLATALHGVSD

SEQ ID NO: 929510 - protein, 141 aa, Homo sapiens
MLQGTQEDGHGEEQISQRRHEWLDVERVLMGARRQKSTPTDTGRGEPRPLSGWTPGKTISFLAPSSVEYYFHSVKPCTHFPSPPVIRFFWYTKARTQDAESLLFSQKGHNWCKLTPSTSRNALAHKILRQAVPAAPGNALG

SEQ ID NO: 929511 - protein, 224 aa, Homo sapiens
MEHFHHHRNSHARASKDLVNDFDQNADSDMDHEVQAEVVSDGNKKLLGNWNKGHWSYALAKRLAAFCPCPKDLWNFELERDNVKLQLMFKREAEYKSLGNLKSDEKNLFSGKKFKTAAENCITCRSQKSKIEVWEPLPMFPMMYGNTWMSRMKSAAGAKSSWRTSAMAVQTGNAELEPTHRLPNGALPSGAVRRGPPSSRRQNCRSTNSLHYAPEKPADTEHQP

SEQ ID NO: 929512 - protein, 144 aa, Homo sapiens
MCVCKSGRGPSTGTESASTLILNFLPLGLKFLLCFWDLLQQTALTKTPPLPVEGGPWKNSNWPTPWDGTLGYSSYLLKPEIHAAGGECFRGTLRHPEKRGKQDYLTCLGTWDCQNDVQSSLSYILVNNANISFKIVWDFYDSNV

SEQ ID NO: 929513 - protein, 139 aa, Homo sapiens
MERKKCIRQKEKPDRSRKLGERSTCIKSRKQTFEEESSLRNEQKEQSWRHHATQLQTMLKSYSNQNNTVLVQKLTHRPMEIKENSEMRPHVYNHLIFNKPDKNKQWEKDSSFNKWCWENWLAICRKLKVDPLPYTLYKN

SEQ ID NO: 929514 - protein, 142 aa, Homo sapiens
MLKQGLPVKKLLWWTLGSTPFEHLRLFSKEPQTEGCTVGFLTFEDLGLRLTSLHLSSQTADCGISLCDRVVYSTSITHITYITPATQRPDNQPLCLAHCCHNRNLSKTQGGPIIQPTTTTTGVQGPTHLMFRFPEKFHHSLN

SEQ ID NO: 929515 - protein, 201 aa, Homo sapiens
MDTEKQAILQAAETFGDELCITGSIREGGEYFPTGREAIPVNDPKWDPSDEMEDWKKRHFGVCIMEGLCRTKTKPLNYIKLFMLNQGFGENPTAFLERLRETLATPQSCAYKIPQDHSRQTQAAELPELVSGGTHRRLDVESSTPTGTSTGQATDQQNTVESGWGSRRKAWATKQPDSWGKPSHSIPLLVSPNLLSATSTQ

SEQ ID NO: 929516 - protein, 247 aa, Homo sapiens
MQYIKKMSVPCSKILEASTVIHLWGSAKDLNQHLYLPLTPQAPVDLLGHMAQVAEQLAQQPGPVAEPSLVLDPTQNWQPFESLDKWARDSEGILLALPGEGKLLLVGLMDMNGEKGTCQINGCIPAAKYVYANYSFWYWGNYYRMSLETQRTHCSGKGEPIGRLQLYPANLGATNQLHYIPWFSTYGQRCSWSSHTGPDKTGSILPSALEPSAKDLGARTAKTTFGENIYGELVMQTHCIYVPSPNC

SEQ ID NO: 929517 - protein, 156 aa, Homo sapiens
MLDDELVGAAHQHGACMRMCHLQIPLHCIEDRPSEFAGSIIFDLQNAVTGNGGLHSCLLSIGNCHRASWGRTVKAKIRSPTGRALKTVNVWQAQTQAQEERSLFFEFQVNENVWKMDSICSQEYMKRGRLSLCTDWRIRPKQNPELRKFSEGPGQA

SEQ ID NO: 929518 - protein, 245 aa, Homo sapiens
MVSSSLSDINIKVMLALGMGHQLAQASGAMAAIVFQDSWTLNDGEHDPKGTATLLGCYALVYRGQGTTWAWVPNRQLLCWTGALISRGLGTELVQAGMGKQKFVPSDVRVCSEFLPSGGFVVLLASGVKLQTFTSPLDSGAQQASPNGSRTWAAGRAARQSHALRLHSSALGRSMGQGTAEQGAALTGEALAMKEPTVVEGEAEAWQAAGPEPCTMGRQLTPGENSSAVPAGRHCRRTRCTLRSC

SEQ ID NO: 929519 - protein, 186 aa, Homo sapiens
MFKDRKYPAQEKDGNQKTQPQRDWKHSAPALEICETELKRDDLGYLAEEISKQQSIQDVTWALLKVEKENLFSEEKFKQAAKICISNEEPNVNSQDNGENVSRAYQRSSWQPLQSQAWRPKRKKWLYGPGPGPCSFVQSQDSVPCIPAVAKMGQCTAWAVASEGTSPKPWQLPCGVQPPALVLQED

SEQ ID NO: 929520 - protein, 134 aa, Homo sapiens
MCPELVSFSGILVSLTSRMKLWTLAMSVTAQKGGASRVVHSSWWTVVLLASGVKLQTFMVGFTALKGGVEPKIVLLTVRTLSFRSVGVCHRSAPYPVCLGISSGGYRTVNIGEQQMLLPDRSSGGFVSEEYPAV

SEQ ID NO: 929521 - protein, 153 aa, Homo sapiens
MHQVLHKIIEFNPHSGSDRFPYLYPGTFLFSVFFKVFPVAHPGLFQNEEDTWRNLQVHRPICKRTCEPTLAKFSGLHLSPILDAPCPRTSESKFFSFGLRLTSVICQRLLGLWPQTEGCTTGFPTFEVWGLWDWLPVSSPCRWPIVGLHLVVL

SEQ ID NO: 929522 - protein, 183 aa, Homo sapiens
MSAAPCSKVPGPMDRPMAEDWRIVNAPVSTVSSSKFVNLPISTLSKRTNQLSVKWTNQLSVKWTNQQNVGGARQGNKSRLPGLEEKEETRSTCERQKEQTVDRASLRTVTFTVRTCGFIFEVNETKNPPILDTPGHSLFLFAETGNTNLGKQPDLEHLQQLPYPSASEGRQQGSVNVVATNYF

SEQ ID NO: 929523 - protein, 165 aa, Homo sapiens
MLLNNNSDSYGKSSSYNYENTRKHVPPKLKGKPYFKSNLEGYLARYLTERILNFAVLPGHFTDLLRGHIDVPIFTSVQSCPFLLEQLRNSSDNQGSKNLKVARCKMFQAYPYNVKWPLLAASLPYIPTNGSISNILSHSLVACKVSTEKSADSGIHKVPFFEVSY

SEQ ID NO: 929524 - protein, 154 aa, Homo sapiens
MRFHGASMQNTREWHRKSQNKDVFLCCSWLTGVQTCQDLQRCLIKQRSELSSLNQRNLHAGSKSLHETLSNCACLKPFKACMELATLAVLGVSGEIEGMLSRKYWPLNIPFLFLITKCCQKHKSVRDSAAYRLLDTKGLQMAPKGGGCLQHSDF

SEQ ID NO: 929525 - protein, 162 aa, Homo sapiens
MRKLIAGLIFLKIWTCTIRTSTDLPQTENCFQYIHEVTEVGQKIATVLLFYGYCDTSKVMAKTEERGVPKNVTLKFDGCAAIDSIDGKGLDPSVSILIEGEVQKRSPEPVYQTFYDKLNVPVPEIPRKTKNLFLQLAEHVAQSLQVTSCYVCRGTVTGDQWP

SEQ ID NO: 929526 - protein, 143 aa, Homo sapiens
MWVGPDKAIKAGCPVTLTAKVCSFTLEPARPRTHQKEGTPNTSEHQKEQTPDTQPLRTVTLTTRVHGFILEVKQNRHVVNNSLPKTYNQKEDNIHIVLGPTVESYFTSHTSLKAFYPNEITFWATKRTSTYKFEGTQFSPYHN

SEQ ID NO: 929527 - protein, 143 aa, Homo sapiens
MWRRRRGRKGRRRMKKKEEEEGGRTRKEEEEEEEKEEEEEEEEEEEEEEEEEEEEEPNSFIPYCSPFLDFWAQCKLPVDLPFWGLEDGGPLLTVPLGSAPVGTLCGGSKPRFLFFTAIAEVLHEGSAPAANFCLDIQAFLHIL

SEQ ID NO: 929528 - protein, 159 aa, Homo sapiens
MGTLHKMALRCLPSLDPVKAFNLLLSDKKEKKHHLKLGVEQHKHPYGHHHYECVGSDLKPAKHWVSPKACCYHSLAIAYVFSRPWGSTTSRWQSHPDPNPSLKNGKILQALVGSRSAIQESETKVKNLEIYLVFYCTEAELPLLPTLPSPFQRQRSFAL

SEQ ID NO: 929529 - protein, 142 aa, Homo sapiens
MTLTACPAFQPYAWLSPERKNFPVQYSYGIIDEDLVREMELGILYPGFSVILSKLVWVSMSSFFKMRRIMKVCHETSRNQAAQQEVSGGKASKASPVFTAAPHHSHYCPMPPPVRSAAALDSHSGGNPAVNCTCEGTRLHAP

SEQ ID NO: 929530 - protein, 180 aa, Homo sapiens
MSPVPSYSLRHSNTEIRRVDNLTMASKCSSEKKSHSCPPPCPPATLQTQRPRRKKWFLEPDLGLPCSISLGTWCSVSQMLQPWLKGAKVQLRPWLQRVQAPSSDNIHVVCASGVKPSWRASDKAVQKENEGLEPPRRVTTGALPSRAVRRGPSSSRPQNGRSADSLHCAPEKASDNQHQQ

SEQ ID NO: 929531 - protein, 159 aa, Homo sapiens
MTQYFVLVFAILQCWLFSCSESVPGKRMFPVPKNTLAKGEFHTLRLGKVDQDFDQNADSDMDNEIPVEVVSDGDGKFVGNWNKGDSFHVLAKRLAAFCSCPGDLWNFEFDRDNLEHLAEAISKQQGIQEVIWVLLKAFSFMYPQIYGYIKFVFGIGTYV

SEQ ID NO: 929532 - protein, 135 aa, Homo sapiens
MGFSLLSHYLNFGVGAFYGPQIDMNLHSVPQCGIIKLDLQLSLRFDFQYKWPTGVLECPVIHQAAFKASLFKIITKYWDFDDQLQLKLNSILNYKFFFFKTESIKTFKFLFYFVKMTHYIASIICFFKKVNLFDF

SEQ ID NO: 929533 - protein, 134 aa, Homo sapiens
MVASRGECLRLPKPTWMWPVLTVCSFSFAFHRRLKCSPAQCPLGTQVFVRYPGRIRSHMNVEMEFGCPVADLLSDRQQPNSSQHSDALSLLSAEPLCCSPALLFVSFSSASRAWGLGFMSLISINASIRCKEGQ

SEQ ID NO: 929534 - protein, 250 aa, Homo sapiens
MLGLCYQPESHTCQGCTRHVVERSVWASKRMVWLLCTAGWEATGAGTGTSSVPSCARTRCIARGFHCGHPCLDEENAVAPGSLEMPGTAEPKESVTGLAWGAPRYRHPEGLKLFSPSPHLQCGKQGACFRPVCVTALLVLPFRSSQVLVPHPGRMRAILSTPLTALLCLSVPKFQRKPRQQGAGMSVPPQAHTWPDARTHTPHHHQQSPLYSHGKVRHKSSLYNFVSERGQNQSHCATHKIPNTILYWLI

SEQ ID NO: 929535 - protein, 346 aa, Homo sapiens
MTTITTTTNSTTATTTATTTTPITTNTTTVTTTATTTTTITTTAITTITTTTTTITITTITTTTTTTTTITITTITTTTTTITTITTTTTITVTTATTTPSPPPPPPLPPPPSPSPPSPPPPSLPPPPPPTPSPSPPPPPPSPLPQPSPPPPCRHHTTTITTTTTTIATITATATTTTAATTFTVPPPPPPPSPPSPPPLQPSPPPPSPPLPPPPPPPPSPPSSPPLPPLPLPPTQSLPPPPPLPPSPPSPPLLPPLLPPPPLPPSPPSPTPPSPPPPSPPPPPSPPPPPQAPLQLSPRINIYEVTLEYGVPSIQCDWYPYKKRRGDTEVRMPCEDKETHKGKKAM

SEQ ID NO: 929536 - protein, 188 aa, Homo sapiens
MCRLGLRGLTLSKYSGSWDWIGRFVPLVSTVSYRTLLFQESINTVQVGIVQGSTVYCFKLLNLWHYVNQVLVLESGLQDNVSDFNVINMVGLTTRLPWVEKIGNVKMGSGDTEHNMILSRILNRKRSHYHQPECTTTLACYHKQNLGPTGSLNHSKPNFLEREETPLEICFGLSNSKKAAVYETVLSV

SEQ ID NO: 929537 - protein, 143 aa, Homo sapiens
MFTLPLHSTSQSNSQDHLSLDFIVRITISILGKAIQQVSGGVPDFTTFSCLLLSPPNCSNLCLLPSSKAGSTFSDKNPDLAELRSKKSCIIVTWKGKFLEMKCPLYLMAAEIINAAIWMYMCKLGLRGLTFLSSYINKKNKTK

SEQ ID NO: 929538 - protein, 140 aa, Homo sapiens
MRSAHATALPFAFRSLEWKQPEALTRCRSPILNFLAKPPEWSKKKKGFSPCLQEFQSEDETFCLLAVRRGFMHYKYSGRSREKNRKTKKQDNDAWFKAKFQRSVFRSRSKDFSTAIWWKKIYGPKKESDIQKMEVMYRNS

SEQ ID NO: 929539 - protein, 167 aa, Homo sapiens
MLPGQPICCDHSGICGGRCLCFLSSGCSSLPSPPPDLQLSTKSSTGPPQFPAMRLRVEDRLEMLGSKEEEVIMMVRRHSKSRKREVPKSYKDLTNWLLKLFGSRKVVQESKGRERLKLMKEVNHKIFKTFAAQCVDYNLQGVNIIWDLPGKMDSQVPERPTDVEDGV

SEQ ID NO: 929540 - protein, 138 aa, Homo sapiens
MKLGRAGILGVYCEFYSRTKSSCGQGKKPGPLLLGCDGAAVFLHSTLQSVCAAPSRGEVRRGGKSHRAGSSGEAKPCTVERNGQSICGENTRRRSSALWGFRREGHPRTWKSSDAPILQRARDTAGKGSRTIPPTHQL

SEQ ID NO: 929541 - protein, 136 aa, Homo sapiens
MDAISYGESRKKLAPIHHFVPPKIHSRPSQYGVGELLVSFVEDPAPRVACSARLAGCCIVAGYLSGYFQQPPVLQKEQVPCAALDGLSQGRVLQTSQAGLICTQRTVLELTERQVLFNWGQHLMLQKCLATAFPRT

SEQ ID NO: 929542 - protein, 139 aa, Homo sapiens
MVASFLFSDRGFLASRIPMNGTLGHVEPWVTEENCGTQLLAFSSIRTNPGLLAMQEQWQAFSLIGSSNGWLAGSGAQRTPCQICRGGSQWWVCDGGKQQWWTASESSARAITNIDQKRGTIYHPVLKGVPAGSGRTFVW

SEQ ID NO: 929543 - protein, 145 aa, Homo sapiens
MILAERGGVCIVIKTQRCIFIPNNTAPDGSITKALQGLTALSNELANNSGENDPFTGWLEKWFGRWKRIIASILTSLAAIMGVLILVRCCVTPCICGLVQRLIKTALTKTSLNYPPPYPEKLLLLENQAEQLSQDMLKKFEEKAL

SEQ ID NO: 929544 - protein, 240 aa, Homo sapiens
MASCVSPQSILIAILLVRCFYYPCSADGILLVKDVSSDADRAICAALQTHTEVYWKGGARGESTECGHFPCIVDLVKWPQICVWKGLGNTPPCLVWTFPEGPSLSLSQGSTSEFVNLIALVQKPKSMIHGRCTCFPIAFCHDCKFPRVSTAMLSVNPAELSGISVDLRTSQHEKMEPTNFVTYCNISGKTQLVYERDHVIYLKMKQKPLQCFTETAMGTRSEWIGGPTKFTIEAYTNNHS

SEQ ID NO: 929545 - protein, 157 aa, Homo sapiens
MGFLKTAFTLVLGGALAGSVPANTPTAMVAQQVNWGRGCTPASSCSMVGRVHAHMHADKEGKARCTSMHTWWESNVRDGHVTKVFWRGVKRATGDGCPGHAPLQMLPCQTIWAPNYLEFCPYYFFKQLSLSAQVSVGVMESPAGRIPEIRGEICAYL

SEQ ID NO: 929546 - protein, 158 aa, Homo sapiens
MLNRTAELEHCAGRSTAVFTAGRQECVSLLKMCPQLSLPPGALSQGDGSFIYKPLTGAAVFLSEMPCPERRNLERQSDYSDFVELQRALPSLNLQLCLHCEGKTTYSSLSYGRCPSPHQAQVSQCAFLHCRGRRAKICISHISGCNVCSANQMASHKT

SEQ ID NO: 929547 - protein, 135 aa, Homo sapiens
MASEGASPKSWQLPRSVEPVGEQKAVQKGNVGLEPPRRVHTGAPPSGAMIKGPLSSRPQNGRSTYSLHRVPAKAADNASTLKKLGGSLNLENIPKDKFIKLFNCQQTSLISNNGSSAYARTELLANKLISTRISD

SEQ ID NO: 929548 - protein, 193 aa, Homo sapiens
MLKGSPSTGKPEAHSCVQYNDKNLHKRSQENLIQKRQDDDRSKERERERFEDASFGDGEGPSAKESRQPLEGPGPCCPVQHQDNGLHILANPAPTVDQRGPGTTHAATFLHEEACRQHHGEMWGWRSHRVHNGELSSGAVRKEPPSSRPQNGRPTSSFHPVPERAAGIQLQPDMITSLKCDKRNVHGSCECKL

SEQ ID NO: 929549 - protein, 221 aa, Homo sapiens
MAPFLRVINQLPGGTLIILDLFHHGKGRSLSSPEETLTPDMILPILLTMLLPRLPSMDSRNALPTVMVYHTALHLTKALTHFTAKEVWHQDSQVQESKGGSGSSSIRYTSSDSNFLLPIPATLSSAVLESKKGVTVLSGVIDLNYQDEINLLLHIGGKEEYEWNTGDPLGVLLVLPCPVIKVNGKLQQPNPGRATNDPDPSGMKVWVTPQGKQNKTKNMTC

SEQ ID NO: 929550 - protein, 217 aa, Homo sapiens
MPTARHFVGDEEKRTAGCDTLFGAPQFLVSPSFRVPSYFPVPAVEAICGNAWSSQSHTEPTPVLAPGAACPVAASTHGCVQWPDPMLINTPLATPHQARPWQVWDPAKYSLLGRVSRRGQRARVKLRQRHHQPQRFPTEKVTRHGSKVRGLMGLGEVVVYFSKQLNGVHSLGRRGLRQPYLHLWGFLVEMNVDYLHSKRCQCPLWSRPLRTTVIPAA

SEQ ID NO: 929551 - protein, 153 aa, Homo sapiens
MQEVGSYGLGQLCPCGFSGYSPTPGCLHGLALMSFAGSWCRLSVDLPFWALEDSGPLLTAPLGSVPVGTLCGNSNNTIPFCTALAEVLPVIRDYLQNHELEHEEKQENGACYDWEMELQYARIYCIHATGESGFNKYLPDNVDEAHRHNAFSC

SEQ ID NO: 929552 - protein, 143 aa, Homo sapiens
MSYFGAGTAVSRAPQDKKHNSNKENFPGRKFAVFVCDVAGFHKHQKNRVIALKFNVNFCQNLPQVGPWHCEKGHSFFPGCLPTNSPLPYILRLVPQETDSEMQTGKEDAYEGPPLKSTSAKRKRRSRTPELPNEMIANAISFY

SEQ ID NO: 929553 - protein, 149 aa, Homo sapiens
MKPAGLPSLLRDCKCTNQLPVKTDHWALPISRMWVGPDKRIKAGCLSQQWQPARVPFYTVEALFFTPEATETTSPPGGTNNSRRAALRAVTLTAKVCSFTPEPARPQTHQKEETPNTSEHQKEQNSRRATLRAVTLTERSIRRIWILAS

SEQ ID NO: 929554 - protein, 152 aa, Homo sapiens
MCCNPHPQGDGVGRWKLWESLIPPNEKCLQHQLVWALRMQTHLNVSWSNRAQQNKQATEIDMTITGILDCQQDFQTLLALPGTEAKTHMPTAFANEGRSPSAIPHVIEGKNSIVAMSTDWFWLDWVQILALPLTNRRPLNLGFLVNKGINKQ

SEQ ID NO: 929555 - protein, 178 aa, Homo sapiens
MCPRCWVVIPFLCVSLTSRTRSVWRVGRRCHPLASSNLPQLTPVGEGQIAELSSYFIISTRKHSRALQGAHTLQMCLGQWPQPLGLPARSWLWDWGETGGGNRGGRVGARCPGWKTVEASSVLGEVGWALNGKIGRTVELEALEGGAHSAKRCRMAWSEALDLWECLCLCPKGDTKEV

SEQ ID NO: 929556 - protein, 313 aa, Homo sapiens
MGLGLGQGLDLGQPNALLALHPKLLKAWWRLQIVGEYPRGLSLAALGQLLLGLLLLGLLLLGLLVLELLLLGLLLRGLGLLLLLLGLLLLLLGLLLLLLGLLPLLLGLLLLGLLLLELLLLELLLGLLELLLGLLLLLLELLLGLLELLLGLLLLLLELLLGLLLLELLLELLLLGLLLLLLELLLGLLVELLLLGLLLLWLLLGLLLLGLLLGLLLLELLLGMLLLRMLLLRMLLELLELLLEPPLPRAFGPAILEPHLHLVLPEIEHLRQLLQPKPLLQYTGPKDKRPATPSPGPSSGPGSATNKIIPPPK

SEQ ID NO: 929557 - protein, 213 aa, Homo sapiens
MGTHRRLWELRGGPQCGGFNQRRGLPSRRNCWGKDFTEVGEGLACWRSVQGFGLAEVVEVVLEVKEAEVVVETSGGGEVEVVVVEVERVIDVVVEVVVQLEDIVYSVEELEVVELIDDVDMVELKEAKEMVDMEQVMEWIELMEVKASSCQQPCGENPAGVLELGVKGTITIQGPARCPPQSLLAFFKIGNCSPCFLKDKNYPHGNQGMKRPH

SEQ ID NO: 929558 - protein, 135 aa, Homo sapiens [sequence omitted]

SEQ ID NO: 929559 - protein, 116 aa, Homo sapiens
MTAILIKRGNVDIEMHTEGRQCEEMKTEGEGSLLPAKGSPSRPSEKPTLPNLDLERWTVRDPEPFLLWLHSWHPMAHIEPSHMAQNKRIWEWQKASQTQPHKWLVVVQTERAQIWV

SEQ ID NO: 929560 - protein, 193 aa, Homo sapiens
MVEEASQPWEAEQLRNEECRPKPAHQVQISHWLCTRSSRWPLRDSPESRHCPGDGEWVFVSPPCLLLQAPLLPPWLLPDPVAGSMPASSPRFRAPVATQSGCLPHTSSPTSGLASRAADGQGSGGGRNPESPETPPHLPIPLAQPGSSLGQVRSAGLLSSTHQRMLHPLLHTDPFPVGLVPTTGLIWRAAWDP

SEQ ID NO: 929561 - protein, 128 aa, Homo sapiens
MQPECMQLNWKSRHLPPLLHTLHGSHLPRRQRQNPPSGCRPTSSGLTLSIYFPWLTLPQAHGVLFPEHVPSHPHLRAFARAAPSSGGASSPDACSLTSFRSWFDAPFSGAFTRASSTSYFPVLLHFSS

SEQ ID NO: 929562 - protein, 136 aa, Homo sapiens
MLCWEICCFLQSCPAGMFKSAEAAPTGVVSPRCSVSGTWGFYLTGAADFFSEMPCTERRNLERQSGYSSFAELWRALPIWNLPAALFTLSNEMNQVTQLEMEKSPTFCVDLTGRCRPELVLFSCLASRNLLSTSNY

SEQ ID NO: 929563 - protein, 129 aa, Homo sapiens
MGEEWLPVWGAMASPAGDLLVCASCLEDTRCPEWKLRREISGSQHAHMFCFGPFCQTVSHNGRAIRNSRWRINIPVVSLLCPQLLFSEFLASSTIPVGWSHSFSILPPATLVHISQHNPKTIDHKEKYW

SEQ ID NO: 929564 - protein, 135 aa, Homo sapiens
MAALAIGTLGWMRGFCRTQLPGAGQPRPLSLRTMCTHSKPPEVPPEAGDGSPDLGEDPQPHQPRKWWTRGPWATAMLQPSEELSRDRASLGHPMQLHRCQARHSREDEEKSTVGAVVHLLVAPIVFTSTPGSHPC

SEQ ID NO: 929565 - protein, 171 aa, Homo sapiens
MCRSSQAPHQQGRRARQAAWVSPCLPTRLVTLILCADRASPKPSLAQKAFVLLPFLPVPHGCLFFSQGGRKLPAEHTTSRPGASHLSATGDHISLPPCCVSGSSSPIQTPGPDPHQAPNQSPPPRVAGPDDTGPDHAEHSEFLPNLFFFPTSSSQICCSQDPFSRITGFTT

SEQ ID NO: 929566 - protein, 131 aa, Homo sapiens
MNPGNIMLSESSQTQKPTECMLPFKPTECMLPFVSNVQNGKSIETEARSAGACEDSEGEAVRAATALTVIVDVILVGLCREALPSSGRFHPELGPCCHETAEDEEKSTVGAVVHLLVAPIVFTSTPGSHPC

SEQ ID NO: 929567 - protein, 166 aa, Homo sapiens
MGLGAVEQGVVLVGEARATQEPMEWVGGSGMAGCRSRTLPCGKAAKAHTPSTATGPGAKSLIARGQQGWLAAPSAGPTKPTPTRNSSWPASAARSPGSRSCLSLHTSLQAEGVGSSLGQPRKGLPQGSGGLKGSSNATKVGAQAGEAPRASEGCEDCQHAVTSQED

SEQ ID NO: 929568 - protein, 162 aa, Homo sapiens
MISFKILLLIDNAPGHTRAMMEMYKEINVVFTPVNTISILQSMDQGVIFTFKSYYLRNTFCKTIPAIDSDYSDGPGQSKLNTFWKVFIILDAIKNIYDQWEVKMSTLTGVWKKLIPVFMDDFEGFKASVEEVTADVVEIPRELELEVEPEDVSELLQSRDQT

SEQ ID NO: 929569 - protein, 146 aa, Homo sapiens
MTKNEEIDLAGNKYSPRWEAPPRTVLHLHGRKAVLPLRPPWPLWGSLQLMYCDGAVDLDAAGIDIIIVNSSNSAGGPGNPKPNLIFGPTNQTAAWKRKLLFGWGQFSRGRGSCECLAATTQHLGDGSDGPLKTINKSGPYDVLLLI

SEQ ID NO: 929570 - protein, 169 aa, Homo sapiens
MSALFKQRPGKGQGLCGAEVMELGLGGHTALEWSPSLVLSLRKAERQEQEKGPKKFKGSWSPSNFIVAWDGRKLTRETFSGFANVAEVESDNNCVHSVSHPSFIHPRNILKHCQLKNDEVHTCGKEIFIYHKQRQPAGQPSHRLGSMASGSAESKQFEGRVKGTGTYAE

SEQ ID NO: 929571 - protein, 132 aa, Homo sapiens
MQYSANNTVRYVGYWHVELVDVEGYYVMYIQSYLSITAPKSQSVVTTAIFSPWDPGVEAGVHQGDQRVEKGTSGRGQSPLHPIFMDWKRRRGAMTGMGVCEWGRVLVKARACSTIPLPTVGTCSKPCTFLIK

SEQ ID NO: 929572 - protein, 135 aa, Homo sapiens
MPSSQSFARMGWLPSSFGSLRACHCQPSLNTFLTAAAQTPVLLQPLQAVGLVGFLEELLPGAVLAGRKHRGGGAAADTAKTSISRQAQLLSAGLEFHPLQWPCTVDVSATPGFCRKCLGDKFQLLRVLSSVPSMC

SEQ ID NO: 929573 - protein, 126 aa, Homo sapiens
MDDTEQCVMMQRPGARVYPHTVSHMHAHAPCTCKNMCLNVWAHVCMCMRFAQPPDYGPTWPMGAQTIQPQLRLGRGDPRDYGPRLPPSPITVPLVVLVSPLSLMQGGRDKNKVYNCQKHYGTVKGK

SEQ ID NO: 929574 - protein, 136 aa, Homo sapiens
MMLCSHCVLVGSTQFLFAALLVQEPYYMLNFLVIALEHTTYNFEFITVYIQGEELCRAPRCDPTMSIVPLCPFDGQPVPTTLFPDAACILVPCPITSAWKDVELATLIPTPMGSPEDGSGPIPDCLSHSGPEPRKS

SEQ ID NO: 929575 - protein, 162 aa, Homo sapiens
MAPGRGPLCIQSGGNSIIFSPPPSVPLFSTPLCEVIPSPRGTIGNRGDGRGSSQQACDVAKYHFLSPTRWLLINEARSQIRSLGFQFQAALTAVVATLGSGKPTGMKMLLSATSWLHEVGRLENSEMLGPDKGEVVRRTRSTQKSKTGPQYLLSSCHYVSQK

SEQ ID NO: 929576 - protein, 230 aa, Homo sapiens
MDLKLLWLPTAPFWVFPIPLFTLPSLRTYFVDLPAQAHLGVEGAQQCLDCTAAKASFIPGSDSYQNPHVPRHPQAPDYSKRGSEWLTVVELIEYMEICTRTRLVPASTLIGLTSEYSFIPAVRYLLLLENKPQAFAVYRVPHLILTATPGIKQWGLSTPVLQMRKCSLRRTSEKENIIGGLDLESISDRPTLPIIHSYNKYILSIYCVPEHHEFSIPNCKFSKTGTGSAE

SEQ ID NO: 929577 - protein, 144 aa, Homo sapiens
MGLLLMSCQPEEPSSLPLAPGGPSMDVSYNVLESSPQKPLLLGSVSQGAVLETQVEGIAFLQADGELAKEVVAEGRMCKVLDIESTGFEASSSACSSRNPSSWVSLQPDLSRSSVHLSCIGFPTRRLSCLLPSCCSRGTNSLGI

SEQ ID NO: 929578 - protein, 125 aa, Homo sapiens [sequence omitted]

SEQ ID NO: 929579 - protein, 128 aa, Homo sapiens
MWRLLDQDTCLASGRTGIECRGFSHIIQLLLVGAGTSDFTSSYPLPYTFGCSPVFQVPTLIPHGHWDMLLFLKSALTDKTLFPTSKEAPSHGFWILELKRADRCTGLFKVKVTDVDSEGKERPRVKGS

SEQ ID NO: 929580 - protein, 259 aa, Homo sapiens
MASAKALTWGHAQHTRPRLSPQPAPFTEGVCVSAKETASAHFTAEETEAQHCEGICADVSWYPDAELSVQVTLSCPGSLWSLEMPPEFPGTQFFCTPPGLIPRDLGKPKARASTITMLQTLDSTPPMLPVTAEMDSERPSRCSRIKPAENSPVRGFQVDRSSDSGYSGLEIQAAPQEGIPATQGQEPGLPSALSARGDLAAYGEKTEAQIPQEGLAVFGSVAGIKVKVIYGAPIWCSTLSYASSFLIQQRCRNTVVMKT

SEQ ID NO: 929581 - protein, 173 aa, Homo sapiens
MQDGNVDASQSKAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKVRGEESRTSRLMQLQLRAWGNHWGWCWGWEMNEEAP

SEQ ID NO: 929582 - protein, 148 aa, Homo sapiens
MPKRKAEGDAKGDKAKVKDEPQRRSARLSAKPAPPKPEPKPKKASAKKGEKVPKGKKGKADAGKEGNNPAENGDAKTDQSQKAEGAGDAKFDLHFGTDIIMLYRLSPSWLHLFPDSLVPMASGRAGKGNGTSLIHGYTASDKFALSQL

SEQ ID NO: 929583 - protein, 188 aa, Homo sapiens
MTCPGPQNQYLVWSRTCSSLSLGEHAQGSGGLSQIYLMSSSNVCSMGREGQPCSDTISLPTLPPQPPNPRQVSGLDLSSLEPGRQLNYFSGEDKPQRLMVSQPWHCRVTKGGPRGKWETQGAPATGAECKGGQHTVGKQTLRFTPFCVGQEAEPRPPPQAAALLPHCPPLPPTLLIPACTGCSVSAPF

SEQ ID NO: 929584 - protein, 209 aa, Homo sapiens [sequence omitted]

SEQ ID NO: 929585 - protein, 261 aa, Homo sapiens; identical to SEQ ID NO: 791801

SEQ ID NO: 929586 - protein, 362 aa, Homo sapiens
MGSQRRFTAEEQSRGADDAWADVEDVTEEDCALRSGDTHLFDKVRGYDIKLLRYLSVKYICDLMVENKKVKFGMNVTSSEKVDKAQRYADFTLLSIPYPDDDDGGDDVDDGDDDDDDNDAGDYVDAPLSIPDFLTHSLNIDWSQYQDGLIHTSLKPTEILYLTVAYDWFLFGRKSLPARDGGFTLEDICMLRRKDRGSTTSLGSDFSLVMESSPGATGSFTYEAVELVPAGAPTQAAWMGSSPLEVPKPRSVDHPLPGSSLSTDYGSWQMVTGCGSIQERAVLHTDSSLPFSFPDELPNSCLLAALSDRETRLQEVRSAFLAAYSSTVGLRAVAPSPSGAIGGLLEQFARGVGLRSISSNAL

SEQ ID NO: 929587 - protein, 200 aa, Homo sapiens
MQGIYREPKMYLLAAAKISDGSQYYVLLIITDGVISDMTQTKEAIVSASSLPMSIIIVGVGPAMFEAMEELDGDDVRVSSRGRYAERDIVQQAFNATAVVRHMRKLQLGTSQEGQGQTASHGELLTPVAGGEERALQKGMGGPQRCTRAGVEGLPLRPPLFCLPMQGRQLAVAVETAAWSRAQNCPPHCPTSSRALDLGS

SEQ ID NO: 929588 - protein, 463 aa, Homo sapiens
MSLGSKCGKLCRDSQGERSFPLSKAAFVTRCCIVTESNELSDATVQKEEAKTSLSLWLRPLSDGPFCLPGWDRALIQLQVRALLSSTGSQAVAMDLGNRKLEISSGKLARFANGSAVIQSGDTAVMATAVSKTKPSPSQFMPLVVDYGQKAAAVGMTDGECVVNPTRKEMSSSTLNVVVAGAPKSQTVMLEASAENILQQDFCHAIKVGVKYTQQIIQGIQQLVKEIGVTKRTPQKLFTPSQEIVKHAHKLTMERLYAVFTDYEHDKISRDEAVNKIRLDTEEQLKEIFPEVDLYEIIESFNTVAKKVFRSIILNEYKRCDGRDLTLLRNISCEVDMFKTLHGSELFQRGQTQLLCAVTFDSLESSIKLDRVITTINGIKDKNFMLHYEFPPYATNEIVKVTGINRRELGPDALAEKALYPVIPKDFPFAIRVTSEVLESNGSSSMASACGGSLALMDSGLPI

SEQ ID NO: 929589 - protein, 146 aa, Homo sapiens
MNMFTFLIMVMTSWVNTYFKIHQMIHIASVRSSEGPEMGRASPLPLNLGINFKQIASKNKSHGEFGKKQLIPDSQPQGFLFNWYGELPGEVEKLPRCRSCTARLQNSQAVVLKLPWVPKSPGGLVKTVICERPSSVRESVHLGVRG

SEQ ID NO: 929590 - protein, 145 aa, Homo sapiens
MTLGDGGLIYKPLTGAAAFFSEMPCPERRNLERQSGHKCLAELWWAPPSSNFQAALFTLLLCWQREFQAIHLSLLGSVGVGPAEPDHLAPWLQPPFQGSEPFQVPLGYEKKFPQLVQCLPKRPPSFVLETQGPGGVGTRGNLLSR

SEQ ID NO: 929591 - protein, 166 aa, Homo sapiens
MLPHCSDAGRSDVAGKENVSNAGERSKTIARVKFLSGKKVEEEEKEEEKGKQEQRKRKDLSLYSHMTTVDLKSLQNKDEFNLVGIIVVFEDLKVMLGTQIWVRRGSLKKVMRESRGSKLEVQGLLPEESDQSSKAQLTNLGPSQANVNSQGEDPLPSRNSDLIDLG

SEQ ID NO: 929592 - protein, 165 aa, Homo sapiens
MQQVGSHSLGQLYPYGFAGYSTPPGCFHRLALSVCGFSRCTVQAVGGSTILGKCKPTKSPELLIVIHNFHKDTIKVAAAYLAEGQQSHPKGVLWPTSHEQKGILIFCDLFGVNLDCFSDHMLFKPRFCEHLASIPKLQLQTSPQEHLLYILQTVFQNFTYNYLKY

SEQ ID NO: 929593 - protein, 143 aa, Homo sapiens
MWKRSKKRCSAATSAKIESLLRKLPGLGSVPNRLNPCQGTEMVYFDDNSLTRVSLHIQDPDCHGGRQGGASHILHGGQQRQERACAEKLWFSKPSDLVRHIHYHKNSMGKTCLRDSIVSHWAAPATHENYGCRQGVKPYQKVL

SEQ ID NO: 929594 - protein, 148 aa, Homo sapiens
MAMMHRTATLPSQKRIFWPLNVEPKLSGDTAVKNPFRALLTCDNTTLIDQNVLPCGELFVTHQVKESLSFQQRKGLICLTALGFVVLEEGYHIVHAQLVRGPSKWKGESLGFWPAHCTSITINFVQCADRIFNPFQPSICILVPCFNG

SEQ ID NO: 929595 - protein, 146 aa, Homo sapiens
MISGGQAGEPSNGSLRLVSGRQSGPGLSPLRNNGSFSSSPPGLGLCSGGITVLLICDVTPIGPAVKFLSLYSFSVFLRPAKHLQKIERTYIEILGAGSSNNCVHSVLVEAKEAPRGWLLLFDPESYDQCMRSRAVPTQSVLHELTG

SEQ ID NO: 929596 - protein, 144 aa, Homo sapiens
MTTCLQKGATHCRSPESCFVSQLIKLLFSFFTLQTERAVTQTGLKHITLLTMLLARKRREELQPFREPTRRGSLSQGSDTLSGALWFLASPSFQAPLHPPSSRCGDQQWKPHAVHLVQPQLHTELAPVQMPGATCPGAAAKHGT

SEQ ID NO: 929597 - protein, 336 aa, Homo sapiens
MVGRWSLAQDPPPSTQESVCFLLPFMAPRLSSGKRERDSERAVNEVGKGGGGEEEEELEGDTAAVRDTIDGKSRYAAVRDTIGGKSRYCSCKGYNRRQEQIRSCKGYNRRQEQILQLDTIDGKSRYAAVRDTIDGKSRYAAVRDTIDGKSRYAAVRDTIGGKSRYCSCKGYNRRQEQIRSCKGYNRRQEQIRSCKGYNRRQEQIRSCKGYNRRQEQICSCKGYNRRQEQILQLDTIGGKSRYAAVRDTIGGKSRYAAVRDTIGGKSRYAAVRDTIGGKSRYAAVRDTIDGKSRYCSCKGYNRRQEQIRSCKGYNRRQEQIRSCLSKLFLPTPLPNK

SEQ ID NO: 929598 - protein, 270 aa, Homo sapiens
MKFPLITELAIKKIEDNNTLVFTVDVKANKHQIKQAVKKLYDIDVAKVNTLIRPDGEKKAYVQLAPDYDALDALVEPLQLLAPCSCYLRSTWGFGGLCSHVPEGQSEPKFRSPGDLQVPGDLLGGCIVNVQLVWHLWSGAVIQADSCGDCPARTLFTEPPSSIDSRSRPNQLDLSGQAVSLGAACAQGIVWIGCTLDLWERQPCSLLAQESAGTGVTQSKMESLGRWSLAAFCCSRTARQETFWALPRFWLYLCLLSGQFPLQIQKSVEV

SEQ ID NO: 929599 - protein, 180 aa, Homo sapiens
MPHPASAHSQCTAPTVLHPLSHKPQAQAATPENVEASTPTHFSQPVTEESEGTSASPFLPSEGFCIGSLFGDLVIGLGEKFSNLSCVSLTGTTIFPCCGFQIVSILSQASKQGLAAPESNKNAIKNYFSKFPVGTRIISKKDVQIIAQGKMTSDGDFAIDLTGKNSADLNLGKEINRNKR

SEQ ID NO: 929600 - protein, 136 aa, Homo sapiens
MKKISSAEEQLNDSFCVCLTVDSSDQSCEIKSERNRQTHQFYIMEFLHVVNHQIESPFPLSLHINPQADPHVSPYNPKMHMFSSLLCPNGPSLILSQMFLPLGILVQISKVEMVTFSICVLTSGLTIILLQVKSGI

SEQ ID NO: 929601 - protein, 140 aa, Homo sapiens
MTFGGRQLLACYWALVETEHLTMDHQVTMQPELPIMNWMLSDPSGHKVGHAQQHWIIKRKWSICDWAQAGPEGTSKLHKEVVQILTVSTPATLAFLPQHALMASWGVPHDQLTEEEKTRAWFTNGSDNMQAPPKSGQLQH

SEQ ID NO: 929602 - protein, 137 aa, Homo sapiens
MNIIYPEDKAAVRGRGPFNWALSQRNAEPLPMKVISLCRGALQLVVGFRGLLLTISYSGKPPLAPCQSWVGNCPMLLLSDLCRSYCFFDESQHVYLHIQLKGQPLLATLSPLHESGAHQLLLVSQSWHSPVACLDLS

SEQ ID NO: 929603 - protein, 220 aa, Homo sapiens
MRRPIYTQGRNNVATKRLDFAASRDSKGVQKTAKSYEEARKVPLYTPEGPLPCQQLESRKGSSIYTRGTIALSATRGKEGFLYIHQRDHCPVSNSRQGRVPLYTPEGPLPCQQLEARKGSSIYTRGTIALSATRVKEGFLYIHQRDHCPVSNSSQGRVPLYTPEGPLPCQQLESRKGSSIYTRGTIALSATRVKEGFLYIHQRDHCPVSNSNLDFRLPEQ

SEQ ID NO: 929604 - protein, 142 aa, Homo sapiens
MTYMAYNHLHWAVLGSFKHENIGFHHRGLGAHLVATGSHQKFQSKGAIQSAEGLGTPSVASGWIQEANLTPLGPRQQFLTVCSFIPSFKAADRKGRCQGNRLSQEADWSKHRQSHGRSVDRADQLVNISPGTYQRRKANSGN

SEQ ID NO: 929605 - protein, 157 aa, Homo sapiens
MTEGFLYPGFSPWCTRRIRSHPGLENECKVLLSGVPVFLLLLVLVLFLLPLPPPSSSSSSLFFLFFFYLFFLLLLSSSSYSFFFLLLLLLPPPPSSTSSSSSSSSPSSSLSSPPPSSFLLLPLLSPPPSSSSSSFSPSSSSSFFFLFFEIGLSAAGI

SEQ ID NO: 929606 - protein, 142 aa, Homo sapiens
MGAGWGDLMGQKATFWAQKKKCLSSFRSMGTDLRVEPLPGTLPFSTQHFPDSQVSLFDQSAAGGQRDLGLKDCLSDSPILNAWCSLQSSDHADVNSPSPPASIEQDLLPLPYTHYTSHLSVMPLWQSKSLMHYAFQNIREII

SEQ ID NO: 929607 - protein, 166 aa, Homo sapiens
MTLLRKNQLGESRQTEIEVLTLSHRFQATFDLKIGFPPETGFKSCFTSFVSCLASYLNSYTFTFLVCKMRIIVSLSLGFYINSRHPKCKVNFVKGRSERTIRKKATAVVGICPLQNTGVANVIVLRENVKDANNNILYVEDVQNKIWLCKKEKKEKKTLYQTYRKI

SEQ ID NO: 929608 - protein, 154 aa, Homo sapiens
MQQHLGTVDYVYDASKNYSLTEVMGAVCEALRQYGPGYLLSLMGVRLLSREDLGRSQRALGQSSRGSGNGCQEESWAVGIPWPSGQISSTCSKLLGEEVLEEPLAAAVEAFGVLVCWRCGWGLSHSGGKLLQLRNTLLLGCLYSIIVHLEGEVN

SEQ ID NO: 929609 - protein, 225 aa, Homo sapiens
MVGKGAWLSGLPHTEFPCVTGGTQGEEKFKPAAEICISSKESNINPQDCGENVSRPSQRPSQQPLSSQAWSPRRKKWSHGPVPGSLCCVQPRNLVPCVPAAPDVAERGQHRAWAVASECANPKPWQLPHGVEPAVHRSQELREVQKGNVGSEPPHRVPTGAPPSGAVRRRPPSSRPQNGRSTGSLHCAPGKATDTQCLPVKAVGERLYPAKPQGWSCPRPWEPTF

SEQ ID NO: 929610 - protein, 165 aa, Homo sapiens
MACGQILPVFLLQPFRLSIIFHSLRDHTHSFLESFKSVIQIQGQNAIPMKMLISYFSELDKSLVKQTSTNKEGKHCERKALRGGRYGCCCHRWGTHAENHCSRAFYELHFILIGSDPGQGSFEQLRIGKIWAIGCYGKAESGQPAKGIGGGARMKGLLETIASYL

SEQ ID NO: 929611 - protein, 134 aa, Homo sapiens
MTRRICGYKEKMLNRANHSGKWEATRELPTGTCKTCQPPRLTVPPASHTNGVVSEISPLLSPSPPCPFCSHPGLAATHQIAPASFSIQGICPSMSYPGAPEPAKYQTYGKLPETGHQPCVRQQASLPHSAPGFL

SEQ ID NO: 929612 - protein, 143 aa, Homo sapiens
MLKDGAPSCPFLTLPRECELQMFDVRRRIAFLVCSVHSTPQGILAGLRAEAAPLFLLASKECRWRLTSTLQFAFLPPTINVPTPSFHLRTAKNCSLPLSLKVMAAGPRRRKLPGSEPVEFRSGDFLRSLKTFLQMLRMFHYIS

SEQ ID NO: 929613 - protein, 170 aa, Homo sapiens
MICSSMLSYALVSIEVSSVPGCQLCGEKCCNSSLKYGLGITVEFIYTLTIADSCMQSGDTLKDSKMILKLLYFIIGIILNFSGKTVSQTKLIVAIAGTFSSNMYQVPLHQSQQRLEESSAQPGWQDQCCCLHMLQSLCSKLTKINSNVFEQIGFAHPQPINIPYPEQAPS

SEQ ID NO: 929614 - protein, 234 aa, Homo sapiens
MEKKYAFISSMKTYSKLVPVEWDAAEIIPEYMEVTLELVSAKKLVAFCPCHGDLWDFKLERDDLGYLVEEISKQQSIQEVTWMLSNAFSFINEAEHKSSENLQPDNKIVKKIPFSEGKFKLAAEICISNEGLNVHPQDNGVNVFRACQRSSRQGFPSQAWRPRRKKLFCGLSPGSFCCVQSRDLVLSVPATPAMTKRGQGTAWAMASEDTSSKPWHLPYGLAFLAACRCTDVKN

SEQ ID NO: 929615 - protein, 152 aa, Homo sapiens
MEPTPSAILNLKKSKVWKGSQTSESITVTVQIRNGGQIGLATCSGLHREEFQTTAVTLGLINFKCNLAMKLDTLTWKVMQYREGIHGLSSGTIYSVDIREMRKKQHSRLGRRGYEMTKGEVSLEEWKPWVREEATLWSLGVFPACGGMARTV

SEQ ID NO: 929616 - protein, 138 aa, Homo sapiens
MTGELGLTGSQLEEVTLAALDAFSAFSLQKAPHRAQERAIGDVGLFFQKFTGPRGWCFLEKLAWAKGVLEFPTLAQRKEYWNGSSSHSPNMSRSSGYHGRRLDLFCPERKLFKKTPPLSEAGDSNGKSRHGVSHMQKG

SEQ ID NO: 929617 - protein, 161 aa, Homo sapiens
MYGRTFVLGPPPLPDSEPLRNYLSSLIQTQFFIREVGDEAMPIPVDTSLSSQHNFFAGTDMFICPTLTQRLQLKWTGPYTVILSTPTAERVQGLPNWVHHTRVKLTPKATPSSKTLTAGPVPRCKTTCISSERQQEEAAGRQAAERHHPGRKTRTPEDLKI

SEQ ID NO: 929618 - protein, 194 aa, Homo sapiens
MKEPFLEDKEHSGWPSEADNNKLRAIIETDPLTTIREVAKELNVDHSMVVWHLKQIGKVKKLNKWVPHELTQWLDQEEVPKHFPTPKLHQKKVMITVWWSAASVIHHSFLNHGKTITSEKYAQQIDEMHRKVECLQPALVNTKGTILLHNNTQPDFAQLMLQSYEVLSHPPYSPDLLPTNYHFFRHLDNFLWGK

SEQ ID NO: 929619 - protein, 145 aa, Homo sapiens
MVQWISHFRPTHLSWEGPEDIPLTNASQNRFVRAAPASMNSPEIALLCMSDLTMGTMVTQLQNLNTMGIIGFQDGRGQVAALKRQRQGDVYEFKLTRSGLLRVNTDCQLDWIEGCKVLILGVSVRVFPEETGIQINMGKKQQLCT

SEQ ID NO: 929620 - protein, 139 aa, Homo sapiens
MGKKQSRKTGNSENPSASPPPKERSSSPPMEQSWMENDFDELREEGFKRLNYSESKDEVLTHGKEVKNFEKKLDEWITRITNAEKSLKDVMELKTKTRELHDECTSLSSRFDQVEERVSVMEDQMNEKKKYRERHKDTP

SEQ ID NO: 929621 - protein, 145 aa, Homo sapiens
MQEVGSHGLGQMCLCGFAGYSLPPGYHGLALSVCGFSRCMMQAVDESTILVSGGLWPSSHRYTRQCPTTARVAEMQGTKSVDCTQHGDPEPYPQNHFFLLDLWNLEVIAPVNLRNHTAILKRINAIKKQDNCQHEQRLKSSHTVV

SEQ ID NO: 929622 - protein, 137 aa, Homo sapiens
MWHPAAFSPLLNKSQREGNSVTAQRVLGSCPMTTKTENLEACLHPGEINSHVAHTKPVWWSLHTDASEIWCHDSDQGTSLGRSIPCPPVLCSVKKIHLRTTSGPQTHQPKEHLTNFKSETKETRFIRGPKTPALVTD

SEQ ID NO: 929623 - protein, 154 aa, Homo sapiens
MNSHKSSKPKNQIGSQKSLPSTVGELMSSNSWLRHTEEVGWRGAVEIADYGESTGAQQDLTRPCSDSKGQWELSRTAGNTCMSLKRTIRALVQIRKLLRQFLYREGHTKGYHQSMAERPRRDHALNTGWDTLSNRGEMEKVKREYYRCLHAKNF

SEQ ID NO: 929624 - protein, 157 aa, Homo sapiens
MRTAGEKSAPMMQLPPTGSLPQHMGIMGATVQNEIWVWIQPNYIIPLLAHPKSYVLTVQSQSCLPNSPEEFINPRDKSADFSKFYSDNHWLQDKQRKGDRKPAVIQVLLEACLVKQDSNVMTKKAKPWMNKRGNKKRMFLNPKHQKEDFICRPNEKG

SEQ ID NO: 929625 - protein, 262 aa, Homo sapiens
MSAKLSFKLQHQAHPRIIQQSQAGTFNPHTPIQYPQTKPQGFLQSQAGLHSLGFQTCQADSVSETGSTCESSLQTRTCTPNHQADSPYELKLLGNSCRCRLYSMQRYKEFLLAALSPIITSYVIEYVRKKGIAVSIMALQMYQLPNPQNERDFAYVMKIKDLQMRRLSWLIQKDMTGRQPPANRKESCHQEPDCAGTLILNFQPPVLLEINVDGLLYPVYGIFVTAAQTDSDEATRSNRELPFHDTMYPYTTTEHYSKNTTT

SEQ ID NO: 929626 - protein, 134 aa, Homo sapiens
MKMLCSVIFLGHFASRKSPAGDDPAQALPGLEFATRDTPSTQPTRLHLACAPGRFPQLPQLCAQLQAGSHCLQPHGPRHIKSSALCSTPAHGSEAGLAPPLLPVAWGGCLLQAEGRGPQCYSLVCTHIQWIPSS

SEQ ID NO: 929627 - protein, 142 aa, Homo sapiens
MVQGASEVIRQHQSSTAKLRRSGKESVREPWARVTGSLGVAARRVGQSDFQWVPSQLGHSLGGIPGCGHSLAQWPDFQHLKQNPGGGGPGGTPGHCGLDVLKFLCTGNVAGISLTVEASNCNSEICCYLAASILLLYTLKAS

SEQ ID NO: 929628 - protein, 189 aa, Homo sapiens
MYSMYQIKVMKVRSLLNLHCENLVGPLEVMPITNGYPSFKNGFPRGSSLTLAHIQPSAIRQYCHLSAPTIVTAQVETLRLCYIQGTTVAKYRQSFLFVFGKSDATWLYHHNHNVVSCGSMTEPKARICRLGINEDPHTSEEKIKTQKFKGIKMDTMLTSKLGNCLFCCVLEKEEALMEFSMSSAVHCSF

SEQ ID NO: 929629 - protein, 141 aa, Homo sapiens
MIKNQCKKSKNSKNQNVSSPPKDHNSLPAREQNQSENAFDELTEVGFRRSVLTNTSELKEHILYQCKEAKNLDKRLQELLTRITSLEKNINELIELKNTARELCEAYASINSRINQAEERISEIEDQLNEIKYEDKIREKI

SEQ ID NO: 929630 - protein, 139 aa, Homo sapiens
MVQPMAGPEVPQGASMSGSQHSDKGSAVAPQNSETTVTTELQRGVTDSARGVLRCGPPGSVTVLSHSRHLQPSERGRVTTHSVPLPRWASQPEACCCPFHCHYAAGSRFLFCDQKNEVRGHRFMTLRNHTILNVYYSSC

SEQ ID NO: 929631 - protein, 137 aa, Homo sapiens
MEIHGPYEKVWVMAVVRVEGVEVESLEEGLNPLLKTEWSNLTCPFRKPSGSILLLHKTPKPFCLLCLNFSQTLFRAVKAQSPAESKILFKRLWRGSPVKIVGTYFSFLASLNLCQLSDFRIGKDLEIVTEIIIPNIY

SEQ ID NO: 929632 - protein, 172 aa, Homo sapiens
MTISDYLLGMSTGTSHHLPHQPLNYVYAPGPQNSLPKQLQASYRAYAGLWHWFVLWRVPSAAGAVLSVDGALAELGCADWSATCWAPHGAGRRVGFGSLASMDSVVPGPGLSPCIIQLCDISSSCLNPSCHLDQIILISQLLTSLDATSTTALGHTPFSPPTLPRPLLCSPG

SEQ ID NO: 929633 - protein, 196 aa, Homo sapiens
MRRHIQEVDVVSDDDEENKVQKGSATCTRTHIQSAAESGSQRRQAGPSAPVPPFPVIKGSGPFTPLLHMHLWAPLASFMVTLSASLSLDFIPGQIYLCKGGRAYSLGLGWGRDVLCKGLVRFCTSSIVCTLEEEVTMGKAVLEPEFHSPHPLEGDSKAHSMTTWLRSFGVVQVGPHTLLSSLPTPKIVPGIIKLVN

SEQ ID NO: 929634 - protein, 141 aa, Homo sapiens [sequence omitted]

SEQ ID NO: 929635 - protein, 156 aa, Homo sapiens
MLYVHKGLSWSIGCKNCGKSIVSGPGSTVPHSKVPHGFPWLDCLCFLASIRGCSYIIPSLSPWANFNLVQPSIKILCCTYNSGAKCLYPMQEDSNQDEDQHEKLCLVAHLLPDMIFPDNLEEVDYLVGIMDCSSPGEERRDKSKAALGYEVLESKA

SEQ ID NO: 929636 - protein, 197 aa, Homo sapiens
MPRRLGRCLLQRWGPHGEPLLGHCGPETPHRVPTGILPSGALRRGPLSSRPQNGRSTYILHHAPGKATDTQHQPVKAARRGTITWEAMKAELPKAMGTPLLYHCDLNVRNEVKGDHFAALRFDCPAGFQTGFGPVAPLFSPISPIWNGCIYPIPVPPLHLGKPLEEVWLCQHLDFGPMIPISDFSPAELWKNNFILF

SEQ ID NO: 929637 - protein, 170 aa, Homo sapiens
MLPFLCPSVLIVQFPPMKGSRDPQRERKTVWCDSRPDSHMRKGNPLLLAKGGSEWARYPAGEPVLFPGNCGTHGLEDSTRPEVKPQKTAADLQKTDLIIERKTSRKRQQEHQQQTQKRPPQKPQPRSASSPSNDRNISPSRAQNWMADQMDEFSEIGFRRWVIQNYAELK

SEQ ID NO: 929638 - protein, 166 aa, Homo sapiens
MIFFLITAGCLHSSARDPLAPPSVGNGDLRSYIAPLFSSSSLVTFMETSDYIEFTKIIQYYLSISRSKFLIYVIFSISEKHLLTFLERTLCNIVKSYAMMYEIKGTVTEICQVEWCGNDSKILQQMKIKLEILKKNTEITKETSLIEKLRFKKRKISLNECFSSQI

SEQ ID NO: 929639 - protein, 134 aa, Homo sapiens
MSQEKEFHNRRQCHQLRQEQAIFTSSVVECHQLRQEPAIWMCTCRESWPLNQFPDFNQFTDSDTQNEGDASFEWDPEQEKALQQVQATVQAALPLGSYNPTDPMVFEVSVADGNAIWSLWQDPTESTPNTTVCF

SEQ ID NO: 929640 - protein, 129 aa, Homo sapiens
MRFGWGHSQSISDALLLTKDNTLLKCFNFIPNMFLGGTLQNSSNISSYHMKRTYFQHKLIVLMLSLVTRVTQCLPDFHTRNLIPLPPSFILYDLKVFTICSPYTRKKRIMLHLLEGKLTIYIIGITLHQ

SEQ ID NO: 929641 - protein, 218 aa, Homo sapiens
MIKSKVVRQNLINEKWDKNLLKDFDQNADSDMNNEVQAEVLSDGDEQHIGKWSKGDSSYVLAKRLAAMCPCSRNLWNFELERDDLGYLTEEISKQRQQFGSLHLDFRGCMETPGCPGRSLLQWCSPHEELLLGQCGRKLWDWIPHRVPTGELPSGAVRRGLPSSRPWNGRLSGSLHHAPGKATDIQCQSLKAAMNVVSHKATRAEPPKAFGGHPVSNG

SEQ ID NO: 929642 - protein, 130 aa, Homo sapiens
MSVTSSSSMDQCHFYLRLIMSLGSKHNLSGLQQVALYQPAFVSLPSILLGASGLHKMIAKASFSKKILFGKATVHHRSRTKFSDCSTEVKGLQLCFQAKLYQLLSLFCPPLILSLLEAPLVQKWSSTSYA

SEQ ID NO: 929643 - protein, 390 aa, Homo sapiens
MEKYITQFSKTKERIAKRGGNSWTVTSYWLYVTIFQNISNLRDVFYREMSKLNHNLSEVMSKLEKQHSSKVFVVKRLSSSSRRSLVISPPVRTSTVSSPLTSPTSPSTLSSKSKSESVSATEDLAPDAAQGEDNSEIKELLEDEEIGKEGSEASSSEEEEPLLTCNGPSQAQPSPIIESARSQEEVPPSSPALSPGGALSPSGHPLSSAAEVVLRTRTAGDKSEQSKKRASIQRTSAPPSRPPPPRATASPRPSSGNIPSSPPASGGGSPTSPRASLGTGTPSPRTSLEVSPNPEPPEKPVRTPEAKENENIHNQNLEELCTSPTLMTSHIASEPGEAKKMEDKENDNKLVSADSSEGQDQLKVSTVPDKSNLTAPEPQEEVSTSENAQL

SEQ ID NO: 929644 - protein, 134 aa, Homo sapiens
MTSKVTSLNDSPEEIFDIDNEAPVVHSPPDGRITKMVLNQGNCHNSHKFDFVNTTEKVPIDNMVKMCDGLIEGLEQCAFIQEREIMTVYKIKETSETATVVNEAEESRGNIFKSHSAECLLVPRRPTSWSFDFF

SEQ ID NO: 929645 - protein, 412 aa, Homo sapiens
MEHDGQGNRCGDETAMGSVMAPLVQAAFHRYHWSRCSGQELKRYIHSYDCLLDDPFDHDWPKLPELPGINYSMDEQCRFDFGVGYKMCTAWCYKGHCMWKNANQQKQDGNWGSWTKFGSCSRTCGTGVRFRTRQCNNPMPINGGQDCPGVNFEYQLCNTEECQKHFEDFRAQQCQQRNSHFEYQNTKHHWLPYEHPDPKKRCHLYCQSKETGDVAYMKQLVHDGTHCSYKDPYSICVRGECVKVGCDKEIGSNKVEDKCGVCGGDNSHCRTVKGTFTRTPRKLGKTRGAFTLPKGARNISLAETREAKNVLAIKNQATGHYILNGKGEEAKSRTFIDLGVEWDYNIEDDIESLHTDGPLHDPVIVLVSSTLNMDAVGKVIIKWSIAASIYNIFVIYFHSEILGGNGECEPDF

SEQ ID NO: 929646 - protein, 159 aa, Homo sapiens
MWRCDTSGIRVWVTPPAEVSAAGNKSKPGEAVPKLSKEDPRSPLWVDITNPLLAQMKQKGRRRANWLSLLELEHQSFHSLGPQSFWLVLGPANSRTYTIGFPGSQAFELGPKYTTGFPRSPTCRQQTKVPFLQGILTRILILVIRSSCMNMHLGLVGAL

SEQ ID NO: 929647 - protein, 139 aa, Homo sapiens
MPESPTPLLGRDILAKAGAIIHLNIGEGTPICCPLLEEEINPEVWATEGQYGQAKNAHLVQVKLKDSTSFPYQKQYPLRPKAQQGLQKIVKDIKAQGLVKPCSSPCNTPILGVQKPNRQWSILTAKGDLWLSDNCEESN

SEQ ID NO: 929648 - protein, 147 aa, Homo sapiens
MDTHGESGPGCSLVIEIPWKLKDGLMEGREGRRKGISPGKPGLQRNILDKLPKSHGFISFLETLTCFINCFFSKFSLFELLFFYSDRKYVYLIATNQNPYQHSTLSNYYQLIVVDVNCDGPKSKDGPTALALILKTRNCDCDGISCP

SEQ ID NO: 929649 - protein, 170 aa, Homo sapiens
MGSCAPLASPTSTTPCSTVPSPIDHPRAEECEGTAQDWQAAPPAAPVWDPLGEASWAPESAVTLTTKICSFTPEPSETTSPPGGMNNSRRAALRAVTLTAKVCSFTPETSETTRPPGGVNNSRRAALRAVTLTAKVCSFTPEPVRPRTHQKEETLNTSEHQQGQTPDAPP

SEQ ID NO: 929650 - protein, 155 aa, Homo sapiens
MPLSEHRSSIPLESSQLSLDIQQNSPQALELFMVLLKKPNVNSLHKVTLCLASDEMLGGITLNSSSWHHFHRQTFSDPELLEVRVGSLDPGCSQLTLHIAPLCSAVHPVLRDALASGVPVGLCLREAVSDKSLEGGRSQGCASSFSSRGGGGSSC

SEQ ID NO: 929651 - protein, 155 aa, Homo sapiens
MQFLLAHRSANLGNKDDLQYSLEPQPTPMSLVLQAACLQATSYVPPLGLVGSLPFSCPFSSGSMRILGNTLISIQLGECFTNVYDLVGICRQNRLLLLSMGQKRSSQTQLKEGRIYPDVIIGKGKTGVFLETKVSNSLIQQVMFEGLLLSSLFYT

SEQ ID NO: 929652 - protein, 172 aa, Homo sapiens
MVQQARLEGSGGVVRKGFYEDRVKRSRESSANRGEIIPGTEMSKCKGTVSSAGPRDRNREEVMGADRGTKQAKMQVEHFEQKYQSSDSMFSSLCPLRLQTNALCPITGDIKHEHWIKVISSRFPHTQDSASSPRSHESSQWRMAFTDHGKDVPTALEVSLLSDSQRTELGNR

SEQ ID NO: 929653 - protein, 157 aa, Homo sapiens
MEEAGGAGKVLCPRLGVQGRPLRPWLPPVAGSLRSSQRPVEQGFLEGGCSLTMSSVPAGSGAAVHTSHLSQYLRQREKGGEMRDRGERFTWGSCSRGKRKGVPRLSPMASFLVPTLYALPATPRAHERTDVSSSLKGKCRLSASALQPVPEKSTQQF

SEQ ID NO: 929654 - protein, 468 aa, Homo sapiens
MLSQRWAVKERDCYSVSAAKLLALTPVCCSSGITLTLGNQERDYILWSKCMHDTSGPVERPFPEAFSESACIVEYGKALDISYLQYLWEAHTNILRCMRDCRVWSALYDGDSPDPEMFLQSLTEEGSVSSACPVFGLPQQLPRKTGPQLAPRKDKSQTELEWDDSYDTGISSGADVGSPGPYDDLEVSGPPAPIDPPKHIQEMKKNALLLFKGSYIEESDFQDDVMVYRLCAEKDSEDMKDSQEEAARPPAEAQAEVQSVPINNGPLLSTQPETDSEEEWNRDNSDPFHSEPKEPKQEREPEAAPESNSELASPAPEAEHSSNLTAAHPESEELIAQYDQIIKELDSGAEGLMEQNYPTPDPLLLTKEEEGKEESKGEKEKEGKKELEDEEDDFDSFIAEMPAVETVPSPFVGRDEAAFASRHPVRTQSTPFTGDHLKLLCGFCFRKYLYILEQERKVGKGKGYYRFV

SEQ ID NO: 929655 - protein, 142 aa, Homo sapiens
MIGSTVGSKWGGVAKIGHYFFEMVDDNRRLRSGVAAEQEPGGESMAQEGEEGSPVASEAKGPKAATETRSVDSGGQCREQWVRYTWGVVRSGYQSWHVVCCYFACPTQVGCSGSEKEINKSLGLNSMERGFSSICTWEIEPM

SEQ ID NO: 929656 - protein, 179 aa, Homo sapiens
MALLVRVELGFKSRLSDSRIAGLKPVSGSGFWLPEASAGDRGPSVGRAAGCPGKLLSPEISKPGGLGNIWGDAEGIPAGGVGTGVRYKVTLSLEKSERETLTQEEIESNCLEVVSFLRIGESVTWGNMRHSQPVCPGDVGEKPPPPQLGTQHFPAKLGFGTAMDALANFFVSQEQLPGS

SEQ ID NO: 929657 - protein, 159 aa, Homo sapiens
MFFFIFGKFYAIVSSNISSALSLSYLLGFQLRDSTPPPYGRQTVSCVFGESSCPPPAVEDLSQHWCVKIYCPPSGAQGFCSMEVKAFAFPALAAASSSRSAFSGLPPLPQSYLEASGLNQTESEDLRTKMGVGDEGLLVVELWNSASDKEEMNRAKHLQ

SEQ ID NO: 929658 - protein, 213 aa, Homo sapiens
MEESLGWSRLGVESQLSSSPVHATHFECLQKTELSVEGQPKEDRSHRIWPRATCNMKKNAWPQCLFIRHHEFGVRYTDIRSVAISTYEFWGNTNIQTITPGRLCGGRAKQRGRNVLGDNQGQTQCPPAEVLVNTDTLGKRIAWWADKTQKLLNSVDQTLQGSAVNIGAAARKAGAIDSLSPSCPSDFEDKGLMHFSLRVVPQMRVCSSRSSVD

SEQ ID NO: 929659 - protein, 139 aa, Homo sapiens
MQNPKPYLVVLSVLSDSIFVHSRPHGLCSSSVFLPQGFAFVVSSTYNFISFNYLFGALVVIIVVKQDKGLGGRVVNFGISWKLEVRGLDRDGKSCPQDPEKDSKEQPNLTEGEKAKGAVCKNQISWSLASAKLLCVGRV

SEQ ID NO: 929660 - protein, 138 aa, Homo sapiens
MTCSYIQSAENVTITWLGATGNHSLFLQLSPYWRFSSSFLSLGPQLLSVSSMTPATPTRLLSCHVVRCSSSCMEEPMWKKTEHPSQPIFPYQECGKPPWKQTLQHQSSFQMLQPWAMTLLQSYERLSQNHPAKWLPHS

SEQ ID NO: 929661 - protein, 139 aa, Homo sapiens
MVAADSGIPEHLGAQEGLFALTASKVPACTAWLLPTVSTHSYPRVKSGLIPGTINRGRRKTDSWAEGGQGGPDDWSSGCQTHRLKWELVVPFARPAEMSELPAAERSYPSPGPPPGLSTRWDDLSTKRSYPLQVFSELS

SEQ ID NO: 929662 - protein, 162 aa, Homo sapiens
MLLAHHLSSSTRERRAEALQGAKTKEVEYLNMLMVRIKRSLVTIPKVYNPKDYGKSVYDYFMTEQKWEVLSYDLKFLPMAQGKQQNNRTLRKVQFSLTDCKVVNEIQGISAVKSCDTAGHTGMYDCMSWTCQKVNIPQGNPSLNSASKENLFLQLGSFHQPK

SEQ ID NO: 929663 - protein, 157 aa, Homo sapiens
MLLLAQKLLSSHTAISLLLLLPIQVAQRRKSEPKCGGKGVCMVCSWSCVGCRAYAGDPWRGNIMSKHKVESITHSDNKKQFFFCWITERQRGVTEDMPYSTSYIKKCQNENFSKGSVRRKTDADPEICFPNANVKQFEDVPLDVHFLKNLAAAVSCH

SEQ ID NO: 929664 - protein, 144 aa, Homo sapiens
MTPAPDASFQCAGSSCWCGEAAGPLSNWVSIPCKQKLEKLQDLLSRLVQSQTLLQCTHTAADPLPQLTVMKQQPDLQFPQFPLGHIIQLFPNSESVQRGMRKCNYFSMSNHHYISIAQMCKKYFIKFCGHLHNSPLLQISYDYD

SEQ ID NO: 929665 - protein, 179 aa, Homo sapiens
MIKMLIISSGILLTSAAEARKPSGLTGRSHSHKAKQAKNDWLEILTASRAVWSLAWMTEFGGESGNHHYCGFGRQFSPDSAKETGRFGLGRIHQSVAKRLWPDCFSRFFLIGQGISAGNPAVPVRGLQTELSSPWVRAPGGRDSCGFRFNGFNLCCLPFLKRVADPDEGDSPSTEHQLC

SEQ ID NO: 929666 - protein, 138 aa, Homo sapiens
MTTEMSFPRDHEPSRRKKPRTHLKEQIRDTPSLRVVTLTTKVCGLILEVSETKNPPEETNSGHGSLLRRNTKLIPSERQNSYYFEYISVPAPPCSSTYLYCDTVKANGNFSYMSIQTLQSSSGQDTSGTATVAYEKAF

SEQ ID NO: 929667 - protein, 137 aa, Homo sapiens
MIEYRQLQQILLTTSLISHYVTSKPNRHEVYIVLGEGWLSRPNLIMQVDFPVDWCHLVCFLLYTWLTKRREDGAAILKTSSPWFLPAFTRASSQLAGCSLLKNDLELFFIKKKGLTKYSHALAVCLSNSFLTPISSS

SEQ ID NO: 929668 - protein, 142 aa, Homo sapiens [sequence omitted]

SEQ ID NO: 929669 - protein, 136 aa, Homo sapiens
MLVAGKKWSDSGYVFKEELAEVGDDWMRVNLLGLKEKRTGKEALKEETRAHQHGRSAEPKERLSQETTPGWSTNSNSMDAAHAFLTRTIVKSLATLNIHKSFQFPEAFISLDCAKIRKIWLNSRDIWCFVFCFVSE

SEQ ID NO: 929670 - protein, 153 aa, Homo sapiens
MGCIHCLTSPMIIPEKWFPEKVLPVHMLSDSTLLPVTEYFHFQTLLIIKFVLWMATIQKTQETKSVGEDVEKLEPLCTVGGNGIKIHVQEMNMQIDLQGISPPSFRENSKGFLRTRPDQPVANVPTTCDLLGSLNLQTERRELIAILHLSPDA

SEQ ID NO: 929671 - protein, 132 aa, Homo sapiens
MNHILFRLLPLLCMFTCSLFSGTTSGPISTLLVSVLELTMAARSPGSFYCNMLSEGLNVTGILLDDEIDAIFCAQQLLPGLLFQMQGGTWWDAIGSWGWFPPCYSCDSDGVLTRSDGLKSDTSSLFLSLLQP

SEQ ID NO: 929672 - protein, 147 aa, Homo sapiens
MVRAKDDMNFKIPVLRVAKTKRKYCQLVQVGPLTQSHSLPQYPTSYPTWDNWCCSLFPLGQGSPQYHPFVVAQEDVTRKGSLSRPQERVLGSRARKNSGVQAQLTSINIKIEIFRLIKRERHLVNLRHYMGKDTWLTIGILTGETPG

SEQ ID NO: 929673 - protein, 135 aa, Homo sapiens
MITVQKRPTPKIQLPPTGPFQNTWELGLSLSLKTQGHREKYEQTGFELNKKSANQEEMQVPNRLLLFSLHLKNKKTLFLEDLKLTCSLELNHSYSAPNVRLEYQIHFCCKSSGTYNLLDSTCPTVSRTMSTSIHT

SEQ ID NO: 929674 - protein, 149 aa, Homo sapiens
MGGTGKAFQGEKRLFLPNSSVLICAGFCLQFPPVPVSFSTQLFTFLASEVLSGSQQPSTQQLRLALRFGQFSASTARIKQAKEGGKSRLAESSGLHLSLVLDVPVLKHQTPSSSAFGLLDLHQWFARGSWAFSPRLKTTFFFSAFLLFR

SEQ ID NO: 929675 - protein, 139 aa, Homo sapiens
MAGSSSRDRAECERANGSKLLKKPYSPAYGPRHQGLNFAGPSEKHVEYSLELPAGRGICPVAAFPLKMTLQQKSESGWKGDGSGTLILRASRQVPGYLSPAGSHTTLETHDIQVRYDHQRLENRYSATMYNNDNGLNYS

SEQ ID NO: 929676 - protein, 145 aa, Homo sapiens
MQKSPVFCVDLAGSCGPELSGSIFLSFSFPFWLGVFLYNVIFQDVLMGSMQEIMILKNLLNNFLYSTCYMPGTIFKHFTNTKLFVSPQNSYIEILTLNVTVLVVGAFGRIQILLTNIYPKRKGLHTGVESLSLNLSQTAKLGEGF

SEQ ID NO: 929677 - protein, 143 aa, Homo sapiens
MAALWNRKGGKLYVFKAEAQTQGCRQSLGEWITARRDSSLAGSLGQAEETRQRAPHTAPDMESERYFAPIYTPPPGEKKNSRSLLPGVTHLTQAQPILLILKLFSSRCFQILMRSPDGYCKIPVPLYTLSSLAHKQLFFYLQC

SEQ ID NO: 929678 - protein, 155 aa, Homo sapiens
MQQDKLTFLEENDKDLYILWRGPSFNVQMGLNELLGHGSGKLFLQDEKGAFNFDQETVINPETGEQIQSYKSKQEASDGLITITPTTGSDGHPDARVRLDCSKIRSGGKPALEGFLQRLQVLNEVHRGMWPESGPCTSGMRPLECFLTLRDKVLD

SEQ ID NO: 929679 - protein, 175 aa, Homo sapiens
MKTDYYGKLVPGVGHCYKHNMKMWKQLWNWVETRRNLQSSAAVPGHSCSGKATLNHQDNGDNSPGHLRDLHSSSFCHRSGNLGGKNGSVGLAQGPPDLCSLRTCCLVSQLLQFQSSLKGANVQLRLQRAQAPRLGSLHVVLSLQVHRSQELRFGNLHLDFRGGMETPGCLDRSRL

SEQ ID NO: 929680 - protein, 143 aa, Homo sapiens
MWGKEREIRLLLCLCRKKYCIPRYFIFFMAIFLDGFAGFFGFFGFLEMDFNFLLNLNVSSPSIQTLNSIFVISVTSDWLRTTAMELVYSYEEIHQKIKNMEKYSDLKRQTQKKKYGKVYKQYKTKLPGQFYTPKCMNFEAFIS

SEQ ID NO: 929681 - protein, 130 aa, Homo sapiens
MFRIVLLHVTVFILSWSISYQTKCALPTGRLLRFAGNQEKCSGLKREGVLVEVKEESHEWPHPLQPGENLLWYLLYLCFYNTRRVYPALTPMYGTKDLTEDINLESVIPPGMFLGYIWGCLPQATYVSKI

SEQ ID NO: 929682 - protein, 145 aa, Homo sapiens
MWKGEGTDCEPESGPTPCTKSAGAFIMDFPDSRNKFQLLLNYPARPWTNQHSFSHSEPMKAPESASQTRQLRIFRPPLRQRAIHFRSPLVVKSFSVTEYNSSLLCSLSGVRVPHSSWSQGKKLEPAKWQVRKGLSPFLLFAELWK

SEQ ID NO: 929683 - protein, 145 aa, Homo sapiens
MGKKQSRKTGNSKKQSTSPPPKDRRPSAAGLLEFARGPLQTLFAWVLAAVAAEQQIFVNRKCCYLIIPLEVLSQRSTQPYLQLCAGRTIALFKAVRQGHLSLQSLLLSFYLSVPCPQRWSLQRQAGLLKLWWGPPSWSFRAALFT

SEQ ID NO: 929684 - protein, 150 aa, Homo sapiens
MGVEDEDTRMKLKLERYLEGGSHNQRMSEKQMGRELQTVVQDLDHYVPIPSFMREKSSPILFKPHLFELFSNMQLNSHFKLEREASQKVIKIVQTKEDSGLGTVLSMEVLQKTTSPNVKPFLTAAYISDASFRDCEDRAIVAQPGTTLPF

SEQ ID NO: 929685 - protein, 159 aa, Homo sapiens
MEAMASFHDTSVQWSPFAFDIIGLEKFTITYIYHYNIIQSIFTTLKTRYALPICPSLPLPLGTTDLSTVSIVLSFSECHIQAAESISPSPDAVGPTGVLGVLKKGRHVVTSDSRNLELVASSISSVTKCYGSLKSIGVVIKLLASGVEPPGFKALLQTY

SEQ ID NO: 929686 - protein, 155 aa, Homo sapiens
MLNIGPQSLLASSLVSLCPAENASYVFYPQLASGKEVFHKPIIYGSANTEKSFSWQTNLLCYFFCDFVVLSFLLIISVKRFQGGTNQSPQLSHCYPAPLLTHHGDCFKSTWMSSSLVPRSPTISPATLQPGFEPHIWTPLAKTSSGLLELLLKGG

SEQ ID NO: 929687 - protein, 145 aa, Homo sapiens
MPRLGQAMSCKGWSEAQSSQPWGDVPPPPPPFPPGPARAPHRLSLFQALSPQKQSFVLEVLSGCLEYRKLLTVVVDAFYVEDGRLCLRVDHSRFEVICYLATFLLEELGFQLFCNIIKSQPVDKMCKVSHPYLPTRPRGPRVRSV

SEQ ID NO: 929688 - protein, 155 aa, Homo sapiens
MRTSRRRLRLQTPGQCARILGVLGPHLQFCLLTPQGPVLAVQKEPNYSQATSKTLRQDNESCAVEQDGEPGGKGTYGHILLQLQCARQNLLGSMQTDLGNAQRRYLCGNSVQGCVETLDRGSSLEDCPSGPDKHVSQQIPAQAGWILNCNKENLD

SEQ ID NO: 929689 - protein, 136 aa, Homo sapiens
MFTQELSRSHGVKSNTLEIYLVLYPSAAQLAIKVQDKVLPIYPPLSRGRQISSYGYRQHHRPTGRYDLALLQESLTNGNLTFSAFIMRSDLWQEVKGEKEMCKAVQCTLHPTSFNVSTIHSFSTMSKPGNQCWYNS

SEQ ID NO: 929690 - protein, 157 aa, Homo sapiens
MWLLVSLRFRAPTHSPHLKAGVRSGSCLRTSVPATALHKADTCASAWSYLSHHSSQCAWLYAVSGPLLLDQVGGTSPVGTNKIQTEVLLATEVSGWRSNTLRIPIDSIEKTLNDMMELKTVARELRDTCTSFRSRFNQLEEKVSVIEDQMNETKREV

SEQ ID NO: 929691 - protein, 167 aa, Homo sapiens
MVCLEFVPSDVRASPEFLPPSGFVVSLTSGVKLQTFAVSVTVHKGGRPELVIPPGGFVVLLTSGVKLQTFAVSVTAHKGAWTQRVSSSKIYCEELKKKTPTTRNGTPARCRCWRGWPFIPLSGPTHILLIGPFYRELIGPFYKELICPFYRELIGPFYRDDDFDYIR

SEQ ID NO: 929692 - protein, 139 aa, Homo sapiens
MFPHQVLWALLRVESCPYHLSKHLSLPAQVSMEVMVSPAAKISKVHVRNGPSSSVQLTHFPGVSWVQELVSVLVAPCRVPGFLPNQPNICVLPVSTLDSSPSKICLKCASLPNVPVSQWQILLVTASSEPFYLLVLISD

SEQ ID NO: 929693 - protein, 166 aa, Homo sapiens
MLWFFLDPEVISCPEFIPSSGFLVSLTSRINLWTFAISRWEYVLSHFGNSQCFACLAEFVAACGFFQRRCEFFWFSWYVPVVALTAENPGVESPHAVLSVQVGSCTLALHMGNPSLSAILGSEDSAFLLIAPLGSGSVETLCGDSNPTFPLCIVLVEFLHEGAPPL

SEQ ID NO: 929694 - protein, 134 aa, Homo sapiens
MSAAACSTAPSPIHRPRAEECGGTGRDWQAAPPAAPVDDPVAVTLTAKVYSFIPEASETTNLPGGVNNFRCLALRAVTLTAKVCSFTAEPARPRTHQKEENPNTSKHQKEQTADCNTHRKGLPLFQTLHQELMR

SEQ ID NO: 929695 - protein, 547 aa, Homo sapiens
MESPGGNDNYLTITGPSHLFLSGAETFHTPSLGDEEFEIPPISLDSDPSLAVSDVVDHFDDLADPSSSQDGSASAQYGVQTLDMLCGHDPWLDGARWGLLSGGLIMDLNHSIGTQYSANPPVTIDVLMIDMTSDLMGHSQLTTTDQSELSFQLGLSLRGGTILPPAQSPEDRISTTPSPTSSLHEVGVEDFWRQISSQKTVVVEAGKKQKFPKKRKKKDPNEPQKPVSAYALFFPDTRAAIKGQNPNATFGEVSKIVASMWDSLGEEQKQIYKRKTEAAKKEYLKTLAAYEDNQECQATVETAELDPAPPSQTPSPPSMATVDPASPAPASTEPPVLSPSIVVNSTLSSYVANQASSGAGGQPNITKLIITKQTLPSSITMSQGGMVTAILATVVTSWGLQLDPTSTATIQPSQQAQIVTRSVLQAAAAAATIKSVPPLTLKMQTTLVPPTVESSPERPMNNSPEAHTVEATSPETICEMITDVVPEVESSSQMDVELVSGSPVALSPQPRCVMSGCENPPIPVKSYLLGTCLRACFGNTSWASGSA

SEQ ID NO: 929696 - protein, 138 aa, Homo sapiens
MAKKLKTLKKKLDEWLSRITNADKSLKDQMELKTMVQKLRDECPSLSSLLDQLEERISVMEDEMNEMKQEEKFREKGIKRNEQTSKKYGTMRKDQIYLISQQKLYKPEESGGQYSTFLKKIIFNNCQNFISRQTKLHK

SEQ ID NO: 929697 - protein, 162 aa, Homo sapiens [sequence omitted]

SEQ ID NO: 929698 - protein, 180 aa, Homo sapiens
MSQSLDGRCSSSGATPQRALGTAWAAAPQGISYKPQQFPHGVRSADAQNASIKRLGHFSLDFRGYMEKPRCPGRSLPQGQNLHRKTSTRAVQRENVELEPPHGVPTRALPGVASVVEMRPLPSRPQNGGFIGSLYPAPGKAIGTQFHPDIILLGWRTRTWVKVQQTQRFQARKIDALEIL

SEQ ID NO: 929699 - protein, 138 aa, Homo sapiens
MESKRIFERTRMESSNGMEWNNPWTRMQSSSNGIEWNHRMDSNGIIIERNRMESSSDGNEWNHHRMEMKGNRMELSSNGIEWNQHQTEKNGIIEWNRRESSNGPEWNHLMEWNGIIHGLECNHHRMESNGIIEWTRME

SEQ ID NO: 929700 - protein, 2457 aa, Homo sapiens
MKLKWMDSSSDGFEWNHRIKLIEIIIKWNRMVSLNGIEWNHHQMEMNGIVIEWNRMDSLNGIRWNHRMDWNGIIEWTRKGSLLNGIEWNHRMVSIGIIIKWNRMESPNRIEWNNHRMDSNGIILKWNRMELSNAIEWNYRMQSNRIIEWTRMESSNGMEWNKSNGIIIEWNRMVSTPNGKKRNYRMESKRIIEWTRMESSNGMEWNNPWTRMQSSSNGIEWNHRMDSNGIIIERNRMESSSDGNEIIEWSRLESLSNGIEWNHQIESNGTIIEWTQVELSSNGIEWNYRMQSNGIIECNRIESSNGLEWNHRMEWNGTRIIERTRMESSNGMEWNNPWTRMQSSSNGIEWNHRMDSNGIIIERNRMESSSDGNEWNHHRMEMKGNHRLDSNGIIEWNGMEQSMNSNGIIIEWNRMESSSGIEWNYDQMESNGSSSNGIAWNHHQMESNGIIIKWNLMESLKRIEWNQSNGIIIEWNRMVSTPNGKKRNFRMESKRIFERTRMELSNGMEWNNPWTRMQSSSNGIEWNHRMDSNGIIIERNRMESPSDGNEWNHHRMEMKGMEMNGIVIEWNRMDSLNGIRWNHRMDWNGIIEWTRKGSLLNGIEWNHRKNHRMDSNGIIEWNGIEQSINSNGIIIEWNRMESSSGIEWNYDQMESNIIIIKWNQQQPSSIGIEWNCHQMEFKGNIIKWNRMESSLNGNEREFNGIIIEWNRMESTSNGKKRYYQMESKRIFERTRMESSNGMEWNNPWTGRQSSSNGIEWNHRMDSNGIIIERNRMESSSDGNEWNHHRMEMKGGSLLNGIEWNHRMVSIGIIIKWNRMESPNRVEWNNHRMDSNGILLKWNRMELSNAIAWNYRMQSNRIIEWTRMESSNGMEWNKSNGIIIEWNRMVSTPNGKKRNYRMESKRIFERTRMESSNGMEWNNPWTRMQSSSNGNEWNHRMDSNGIIIERNRMESSSDGNEWNHHRMEMKGMEMNGIVIEWNRMDSLNGIRWNHRMDWNGIIEWTRKGSLLNGIEWNHRVESNGIMIKWNRIIEWNYHRMDSNESNGIIIEWNRMVSTPNGKKRNFRMESKRIFERTRMESSNGMEWNNPWTRMQSSSNGIEWNHRMDSNGIIIEWNRMESSSDGNEWNHHRMEMKGNHRMYSNGIIEWNGMEQSMNSNGIIIEWNRMESSSGIEWNYDQMESNESSSDGIAWNYHKMESNGINIKWNQMESLNGIEWNQSNGIIIEWNRMVSTPNGKKRNFRMESKRIFERTRMESSNGMEWNNPWTRMQSSSNGIEWNHRMDSNGIIIERNRMESSSDGNEWNHHRMEMKGMEMNGIVIEWNRMDSLNGIRCNHRMDWNGIIEWTRKGSLLNGIEWNHRMVSIGIIIKWNRMESPNRIEWNNHRMDSNGIILKWNRMELSNAIEWNYRMQSNRIMECTRMELSNGMEWNKSNGIIIEWNRMVSTSNGKKRNYRMESKRIFERTRMESSNGMEWNNPWTGRQSSSNGIEWNHRMDSNGIIIERNRMESSSDGNEWNHQSNGINIEWTRVESTSNRIKRNYRMESKRSIEWTRMESSNGMEWNNPRTRMQSSSYRFEWNHRIKLIEIIIKWNRMVSLNGIEWNHHQMEMNGINHRMDSNGIIEWNGMEQSMNSNGIIIEWNRKESSSGIEWNYDQMESNGSSSNGIAWNHHQMESNGIIIKWNLMESLNRIEWNESNGIIIEWNRMVSTPNGKKRNFRMESKRIFERTRMESCNGMEWNNPWTRMQSSSNGIEWNHRMDSNGKIIERNRMESSSDGNEWNHHRMEMKGEWNHRIESNGIIIEWNRMASTPNGKKRNYRTESNRIFERNRMESSNGMEWNNPWTRMQSSSNGIEWNHRIESNGTIIEWTQMELSSNGMEWNYRMQSNGIIECNRIESSNGLEWNHRMEWNGTEWNHRIESNGIIIEWNRMVSTPNGKKRNFRMESKRIFERTRMESSNGMEWNNPWTGGQSSSNGIEWIHRMDSNAIIIEGNRMESSSDGNEWNHHRMEMKGMEMNGIVIEWNRMDSLNGIRWYHRMDWNGIIEWTRKGSLLNGIEWNHRMVSIGIIIKWNRMESPNRIEWNNHRMDSNGIILKWNRMELSNAIEWNYRMQSNRIIEWTRMESSNGMEWNKSNGINIEWTRVESTSNRIKRNYRMESKRSIEWTRMESSNGMEWNNPRTRMQSSSWNHRMDWNGIIEWTRKGSLLNGIEWNHRMNHRMDSNGIIEWNGMEQSMNSNGIIIEWNRMESSSGIEWNYDQMESNNRMELSSNGIEWYQHQTEKNGIIEWNRRESSNGPEWNHLMEWNGIIHGLECNHHRMESNGIIEWNGMENSMNSNGIITEWNRMESSSGIEWNYDQMESNEWNHRIESNGINIEWTRMESISNGIKRNYRMKSKRIIEWTRMESSNGMEWNNPRTRMQSSSIEWNYHRMESNGINIKRKKTELSNGIEENLRTDPNGII

SEQ ID NO: 929701 - protein, 504 aa, Homo sapiens
MKLKWMDSSSNGFEWNHRIKLIEIIIKWNRMVSLNGIEWNHHQMEMNGIVIEWNRMDSLNGIRWNHRMDWNGIIEWTRKGSLLNGIEWNHRMVSIGIIIKWNRMESPNRIEWNNHRMDSNGIILKWNRMELSNAIEWNYRMQSNRIIEWTRMESSNGMEWNKSNGIIIEWNRMVSTPNGKKRNFRMESKRIFERTRMESSNGMEWNNPWTRMQSSSNGIEWNHRMDSNGIIIERNRMESSSDGNEWNHHRMEMKGRIFERTRMESSNGMEWNNPWTRMQSSSNGIEWNHRMDSNGIIIEWNRMESSSDGNEWNHHRMEMKGNHRMDSNGIIEWNGMEQSMNSNGIIIEWNRMESSSGIEWNYDQMESNGSSSNGIAWNHHQMESNGINIKWNPMESLNAIEWNQSNGIIIEWNRMESTSNGKKRNYRMESKRIIEWTRMESSNGMEWNNPWTRMQSSSNGIEWNHRMDSNGIIIERNRMESSSDGNEWNHHRMESNRIMERNPV

SEQ ID NO: 929702 - protein, 501 aa, Homo sapiens
MKWKHHRIETNGITMKLKWMDSSSNGFEWNHRIKLIEIIIEWNRMVSLNGIEWNHHQMEMNGIVIEWNRMDSLNGIRWNHRMDWNGIIEWTRKGSLLNGIEWNHRMNHRMDSNGIIEWNGMEQSMNSNGIIIEWNRMESSSGIEWNYDQMESNEWNHRIESNGIIIEWNRMVSTPNGKKRNFRMESKRIFERTRKESSNGMEWNNPWTRMQSSSNGIEWNNRMDSNGIIIERNRMESSSDGNEWNHHRMEMKGNHRMDSNGIIEWNGMEQSMNSNGIIIEWNRKESSSGIEWNYDQMESNEWNHRIESNGIIIKWNRMVSTPNRKKRNYRMESKRIFERTRMESSNGMEWNNPWTRMQSSSNGIEWYHRMDSNGIIIERNRMESSSDGNEWNHHRMEMKGESSSNGIAWNHHQMESNGINIKWNQMESLNGIKWNRHRMNECNHRMVSNGIIFKWNGMESSHRIEWNYHRMESNGINIKRKKTELSNGIEENHRTDPNGII

SEQ ID NO: 929703 - protein, 323 aa, Homo sapiens
MKLKWMDSSSNGFEWNHRIKLIEIIIEWNRMVSLNGIEWNHHQMEMNGIIIEWNRMDSLNGIRWNHRMDWNGIIEWTRKGSLLNGIEWNHRMVSIGIIIKWNRMESPNRIEWNNHRMDSNGIILKWNRMELSNAIAWNYRMQSNRIIEWTRMESSNGMEWNKSNGIIIEWNRMESTSNGKKRNYRMESKRIIERTRMESSNGMEWNNPWTRMQSSSNGIEWNHRMDSNGIIIERNRMESSDGNEWNHHRMEMKGRIIEWTRMESSNGMEWNNPWTRMQSSSNGIEWNHRMDSNGIIIERNRMESSSDGNEWNHHRMESDRIME

SEQ ID NO: 929704 - protein, 605 aa, Homo sapiens
MEWNNPWTGRQSSSNGIEWNHRMDSNGIIIERNRMESSSDGNEWNHHRMEMKGEWNHRIESSVINIEWTRMESTSNGIKRNYRMESKRIIEWTRMESSNGMEWNNPCTRMQSSSYKIEWNHRMDSNGIIIERNRMESSSDENEWNHHRMEMKGMEMNGIVIEWNRMDSLNGIRWNHRMDWNGIIEWTRKGSLLNGIEWNHRMVSIGIIIKWNRMESPNRIEWNNHRMDSSGIILKWNRMELLKAIEWNYRMQSNRIIEWTRMESSNGMEWNRMESSHRIEWNYHRMESNGINIKRKKTELSNGIEENLERTRMESSNGMEWNNPWTGRQSSSNGIEWNHRMDSNGIIIERNRMESSSDGNEWNHHRMEMKGEWNHRIESSVINIEWTRMESTSNGIKRNYRMESKRIIEWTRMESSNGMEWNNPCTRMQSSSYTIEWNHRMDSNGIIIERNRMESSSDGNEWNHHRMEMKGRIIERTRMESSNGMEWNNPWTRMQSSSNGIEWNHRMDSNGIIIERNRMESSSDGNEWNHHRKEMKGNRMELSSNGIEWNQHQTEKNGIIEWNRRESSNGPEWNHLMEWNGIIHGLECNHHRMESNGIIEWTRME

SEQ ID NO: 929705 - protein, 146 aa, Homo sapiens
MNCTYEGSRLCAPYENLTPDDLRWKSFILNHQQHPPPHPIHGKIVFHKTGPCCQKEEDRNMWNSLELPRDLLNGFDQNADNDLDNEIHAEGVSDGDEELVGNCSKGDSCYVLAKRLMAFCPCPRDLWNFELGRDGLGYLAEEIFKQ

SEQ ID NO: 929706 - protein, 139 aa, Homo sapiens
MNQLSVKWTNQQDVGVTLIAKVCSFTPAPARPRTHKKEETPNTSEHQKEQTPDTRTLRTVTLTARDDRFVRDRWHTTALQSPDYFPQSNFLIKFFLTIYLPLSLSAPNSYLPDMHSDSSISSPFPLGRLIPYFNACDLF

SEQ ID NO: 929707 - protein, 144 aa, Homo sapiens [sequence omitted]

SEQ ID NO: 929708 - protein, 140 aa, Homo sapiens
MILRPRQPCGTHELLFIMDKVPAELLKECMFQMPKELSRQPSGLILEVVCTESCDVNHLWVSQPWIPVPVPVEVASRGIQWTLYEMVLFKSENSIAVPFNSCVKASLVLVYGKGFRYAEIFIPQAYRTAWSQSELVDQLP

SEQ ID NO: 929709 - protein, 164 aa, Homo sapiens
MVHVQALLLTSSGKLAWCLGQWVDLVSESMGMGLEPDSMGAVLDPEFEGVGLALRTIGMGLMADLQGWSWSTGLYRVLGAWKNCCENEDRRLTVSMKAPSFTTSCTQQDENKADLRILEHPIGKDQEKVLRSVGAQRDEEKGRDGDCDGDVLLRQKSAAIAKLD

SEQ ID NO: 929710 - protein, 173 aa, Homo sapiens
MEQLSAERGHSSSLLYYVLHSEKWVSVSWDVERGIFLRFGIEMVTKRIVMAVNNPDLLCHEYFWHKGHRNSSQDVLLLPQCLLIVPSPIVLVSTPAQCHNLAHMGQLLAGHFLHFSTGQYSPAQGVLFQLRSLTELALLLPLYQSNKKLSLETGQDLLHKSLLSLQNPKGSAP

SEQ ID NO: 929711 - protein, 167 aa, Homo sapiens
MAQVTPGVSCAAALEGTSNKPPQLPHPGSANSAGLQNAREVGMWWSPPRLQRIYQPAWESKQKLAPGVKLPQVVPTMAMSSGVLECSHCWVGPLAACNIHLGSYRHWAPTHLSNHLSCASSTALGADLPKALGAQPQPQVDSEYRLLSGKSLCSRKMGILGEPEKDD

SEQ ID NO: 929712 - protein, 422 aa, Homo sapiens
MGWPLCFKALAATVLLAEDANKLKLGQRLIIRVPHTVITLMEQSGHRWLSNPRMLRYQGLLCENPYITLEIVNTLNPATLLPIEWVEHGKPMLCGPGYDCCVEILDEVFSSRKDIKDQPLKDPDVEYFTDGSSFISEGVRWAGYAVVTLNSVSEAHPLPVGTLAQIAELIALTRALLLAKGKSVNIYTDSRGNRKVDREAKRAAMTEVTKKEKETLTMPLLELPLTEPPNYSANEKAWFEQKNGIYQKGGWWKFSDGRLAIPEAIAPPPQFIKQFHQGTHMEKTALETLVGWHFYVPRLIAITRTICEPLQGPTQPPGIQKTEATPCENLLVDFTKLPRVGGYRYRRFVCTFSGWVESFPTVTEKAREVTRILLKDIIPRFGLPLTLESDNGPAFMAENSTTVNADVKNQMETAYSLSPTEF

SEQ ID NO: 929713 - protein, 135 aa, Homo sapiens [sequence omitted]

SEQ ID NO: 929714 - protein, 149 aa, Homo sapiens
MTWMPAVILGSCLCLLKALGLYNQQVAKPAKPLSFASEQQTPLGPRQVQRKDCQTTIGVPSSPKALQSAFGKCCLAWYSPFRAVVFPLVKSRSRNDIQESSPGIMDPKGSPPHLGIATGYSGPKSSSVSSVRKESLLGLQAVLPGVGED

SEQ ID NO: 929715 - protein, 175 aa, Homo sapiens
MEYTYQDYVHGRTSPRAELSTRNSQKIGEHVRASVKGLGAIPLKIEHQDSAPELSTRNSQKIGEHVRASVMGLGAIPLKLTPISRTILKSRPMDLDFLKVILNTNLFFIVLEPGKSKIKLLALLSSGEGLLASSFADSSLLTVSSHGREHRERKQTLSCLFLQGHTFISVLSFSL

SEQ ID NO: 929716 - protein, 132 aa, Homo sapiens
MWDWSPHTESPPGHCLVELWKWGHHPPDLRMIGPLVACLQHEEATGTQFQPMRVAARAEPCKATVLELPKGMGAYCLHQSALQVEHGVKGEYFGALRFSDCPAGFWTCVGPTAPFFCPTFPLWSSNVYQMYS

SEQ ID NO: 929717 - protein, 176 aa, Homo sapiens
MAALQGLSQEIKAVENLTDNHLQAWFSASLQWFRTFSFSSDKFIITNRRKPSSLNSSKSFSFQLCFFAGPSAAGLLVFAGGPLQTLFAWVSPAEAAELQLLQNGKCCCLILPLEALSQRVIQLYERNVGQPLLGGVSQLGYLGIRDPLEEAICLFSDLKLHAWRTTTLFKVSDRDV

SEQ ID NO: 929718 - protein, 167 aa, Homo sapiens
MVDAPPPASLLPCSLISDCCASRPVGTLVDNSLNQSSSSGKGRKEIDIPMIQSLSFIPCSRYQEPDFCGLHHLYSLALWLANGGTSRSLMDRRRTKSEFYFPQVLVCVQTVAVFLYLKPQLLLQQSLSHHYSNCQVSGTTASLCRLPGSHPRLQTVKTPQITDSKNF

SEQ ID NO: 929719 - protein, 142 aa, Homo sapiens
MCGGNRPLIFQLDICLCRGLAEPPVPHLQSLMVERKLERLERNNRAACTSTSYQMRECVSSQKIHRILQKGSQSASLSGSQIPCLLTGGDPHHRGRKPPYKGVFPLASGQCPPRTEIPKEESGSHLCCSAACRHLQVQEKPR

SEQ ID NO: 929720 - protein, 155 aa, Homo sapiens
MCTITTYICKVQEHVCVHEQIYTYRHKHTHEQKLNEENDLVLFTLVPPNDVVPFWRLCAHQRCEGHPKMRKTASISYLHGQYVSSAVQIGVWACQCICALWYNIRDYRIADHILMFYSEISLKRVKNMKYFEESEDMERVSIQLHLTLVGMEKLL

SEQ ID NO: 929721 - protein, 139 aa, Homo sapiens
MLCLEYCYWLDSYGWLEAQAWRTCLLRRYENEHLHNCLTSFLVGLLLHAGDPFQSLVTLDFPAPGGIISKGCGTAKMATRSGSSIPGSTDLLLALTHLSIFGGLTTCFARVAATFAEKPRKPGYLRLPGPHVWLEKLLC

SEQ ID NO: 929722 - protein, 232 aa, Homo sapiens [sequence omitted]

SEQ ID NO: 929723 - protein, 141 aa, Homo sapiens
MGASLDQKRSRHPARSRGVEVNSGSATMAISSGGRRAIAQLRLEQAGSRRMPDGFLIKRENRENIIDLIVKAMMVSLHTLALEFLHSLFLSSKTFFPEYLVASHLLQYINKKIARGGKTNAKHPFDELVEEFQDQDLMIFD

SEQ ID NO: 929724 - protein, 187 aa, Homo sapiens
MNPPEGTNNSGRATFKSYNTHCKARPRTHQEEQPTLDVPPLRAVTLTVKVCSFTPEVSKTTNPPGGTNNSRHTIFESCNTHREASLQWVRTSSFSSEKFVITYLLKLTSVNVSKSFSIQLCSIAGKELRSSGGEEASGPSAAGLLEFAGGPLQTLFAWVSPVEAAEQQILLPDPSPGSFISEGHPAV

SEQ ID NO: 929725 - protein, 170 aa, Homo sapiens
MHVYATSPPVAVHVHTTFHMHLVPAADHDSAEGNCGVGALTQSPHWGTALWSCEKRPPSYKPRNGRSTDSLHHAPGKAVDIKCQPMKAARSGAIPCKATEAELPKAMRAHLLHQCDLDVRHAVKGDHFGALRFDCPTGFRTYMKPVSPLFWLISPISNGNIYPIPVPHCI

SEQ ID NO: 929726 - protein, 147 aa, Homo sapiens
MIHTTFSYLEKVPSLRYVFISSLNADHYSKLVPGEWSTAEKTHENMKATLELATAKRAQGTAQAVASECASPKSWQLPHGVEPASSQKSRIEGSAEGKCGVGVCTRVPAGALPSGALRRRLPSSRPQNGRSTDSLHCAPGKATENAS

SEQ ID NO: 929727 - protein, 155 aa, Homo sapiens
MASFSHHFNFLFPCSHLLLVTLISSYKDPFDYIESNKIMHYNCLISRFLIATTKFTLSYKAIFHRFWKKKARICFSHLLFNIILEVLANAIRQEKKCLSPTAMILRSLQPCGTSLTPSPRLELSGIISIHHNLPGVQAIPLPWPPEKLQTLNARL

SEQ ID NO: 929728 - protein, 171 aa, Homo sapiens
MPKRKVSSDKGAAKEEPKRRSERLLAKPAPEKVEKKLKRAAGKDISSDKKLSFRLLSTTAVCCRRRPAADFYPSGSSRVSAALLIQSTVDTLPDPEGWKSVAGLPQQQTAVVDGERKLSSSRNKHGPEESAAARFNRTKTELPYNERGLKEACTNLLTLLLQQSSLNLFWF

SEQ ID NO: 929729 - protein, 176 aa, Homo sapiens
MAVTFAPVNVTTEVKSVEMHHEVLSEALPGDNVDFDVKNVSVKEVHHGNVAGDSKNDPPMEAAGFTAHAGCAPVLDCHMAHIACKFAKLKKKTGSTSGKKLEDGPTFLKSGDAAIVDMVPGKPMCVESFSVYPPLSRFAVCDMRQTVAVGVIEAMDKKAAGAGKVTKSTQKAQKAK

SEQ ID NO: 929730 - protein, 164 aa, Homo sapiens
MLGRAALLLSGKVFGVTSASGLSSPPPPTGPLSPTARTPTLKRCIPEALSSAPMLGLSVCAILQWGHAPRVVLPLPLVSRHCLVDTQGELAAGDKLSSRALKADRSRRKGHWTESVHKYLLRSYYASDTVQAQGCAEDESNNIPKLCHVGGCVMLVGERQRRVR

SEQ ID NO: 929731 - protein, 155 aa, Homo sapiens
MRLPPHCFKMVAWAPAIMCQLALLWFSSVEDVDHPGNHLQLTEETLKPTRPVQTGETPVPEDSPYGISGSLMQWGPSAETGISVLGPLLGKQSLGTFQALVPWQGASRVTHLLSVCSARPLPPLSMRNTADNAQLQGPSLRILGKQREAEDCRET

SEQ ID NO: 929732 - protein, 141 aa, Homo sapiens
MSIRSIWSSVEETKSQLNTTGIRTSIVGSWYRATSFVLWTLELKCPWRSCGFLLPESQRSVARAGCSLPVQLTPSPGDTEGQERVPVCDSPVQDPQLPPFALGLCPPSVYPQCLPSKDLLRVCQSSRFLGLLMADVPPGCL

SEQ ID NO: 929733 - protein, 139 aa, Homo sapiens
MQILGLLRLHNFFCLEKPPFGNHVLLCLVLVESICYISMWNFYSFFMSNTVFPMVFTGQFSSSENVETWEYIIRNHFTENKNLSSNMSAQCHCETAENPCEDKTHLQTRKRALTKCQTPSAAETLFLEFAASITVGIEQ

SEQ ID NO: 929734 - protein, 157 aa, Homo sapiens
MLNIGPHSLLACRASAKRFTVSLMGFTLWVGEVLLGNILKSVFQLGSILPVTFRWGVWADVFFDVELPGAFVYTVRGKPPTQASEMADTSPLTKLEHPRFTSDCCAGSKNFKPVDLSLLGSMGVGPTEVDDLAPWLPPPFQGSEQFCLIGIPGATGL

SEQ ID NO: 929735 - protein, 176 aa, Homo sapiens
MGQRKVHSRHKALMKASNILLTLQNLPFSYMDDNSNKTPSQKETQDPSPDSEFTSALNLDYPKSKVLQNCERRCKGNGNEDKLKIVSIWRSKEERENESEISQYPCLAGLCRVLVHNVQDTSALKSVVVLQQLVMKGIKKALRQFPELIDSQTESSMIEKDFRSLDKEPFNATTSV

SEQ ID NO: 929736 - protein, 210 aa, Homo sapiens
MQKLDLKNASSPVKDHNSSLARGQNWMGNEFDEVTEVGFRRWIINSSKLKEDVLTQCKEAKNLEKNLNDQMELKNIAQECHEAYTSINSQIDQVEERISVIEDQLNEIKCEDKIRGKTMKRNEQSLQEIWHYVKRPNLHFTGVTESDKENGTKLDNTIQDIIRENFPNLAREANIQIQEMQRTPPRYSSRGAIPRHTIVRFTKVEMKEKC

SEQ ID NO: 929737 - protein, 139 aa, Homo sapiens
MVTEQYFEILTEDSPHPNPPPPYPASTLIPATNSNNNTPTRHPHILRPWAIWEPQRVGDTTNHSGEEHEVCQKPMIKQIPDPTTGLQPPQPPRSAQHSDLNPQLNLPQGLCWGHRPLLLIIHSDDYQRPATHSCYPTSS

SEQ ID NO: 929738 - protein, 137 aa, Homo sapiens
MRYRRQTDVGSMTTGITFTGRNQLLGNTCDTNWSQPHQNVNAAGRSPQPMMGAELVGDYSSDDPIDYVTHMAFRLQLHGAPSKMSPEFLLPQGLSITLVGSLSSIVNLRVPLSLESRYFSHVFYRIVTLIVVLRRDE

SEQ ID NO: 929739 - protein, 139 aa, Homo sapiens
MSNSPLARVGPNALSMHGHWLSPEGQVLLRLLRPSSMPPGRIRPKREAMITVQYSIPHPSPPVSPQYVFWKKVTEDKRGESAGAVKEDAANEYHLNRDMKKRGRRTERWGHTQKAEQVQRPLRLVMFEEQQKDWPGIGQ

SEQ ID NO: 929740 - protein, 173 aa, Homo sapiens
MLNGFDQNADSDIDNEVLAEVVSDGNNKFIENRSKGHSCYALAKRFQRMYGNAWMSRQKFAAGTDPSWRTSGGAGQKGNMGLEPSHKVPTGALPGGAVRRGPPSSRPQNGRSTDSLHHTFGKTSGTQCQPIKAAVGVVPCKATGVELPKTMRAHPLHQCAMGVTGGVKKILEL

SEQ ID NO: 929741 - protein, 144 aa, Homo sapiens
MSVPFFTGPFLSKQSNNSLPSVFITSPFLHLFQNSHNYNHPTNMLANVSASVAFRSPLQTYVNAECSHRALFVPYGKGHKVSLSWKLIQNQRIQRKNTREEKERLFHEIRKGLISSQKEWYQLLLVPLVEFGCESIWSWTLFGW

SEQ ID NO: 929742 - protein, 142 aa, Homo sapiens
MVPEQSSCQSAAWGLKISLYWNSASLNEEKDTEGFRNEDPKKQGNLCISMLFDKVDSCGEVCEDKYDLMATKEVSANTVVEAHLASLRRNKMPSRAGAQGIEFIEDKVRELTGSHTSYRDLQAIIVKTLVLKMSEMVDIGEF

SEQ ID NO: 929743 - protein, 147 aa, Homo sapiens
MLKGRSTGSCSGHWRYAGSASLVCTLRHMYPLCTPSFLQPQISIIMQMANSKMWLPFNRLIQICLNFTWAQSQTPAKVLCNPTKSEVSYNVQRHRNVKHRVMLREILVSGASMNELRSSGRSGQKCWKGNNQCGFVYRKLMAGFDFS

SEQ ID NO: 929744 - protein, 148 aa, Homo sapiens
MKRSKAERTHVLFFIWIFDVCLEKANRKMVTEREREEQCCSRIAWVKVKIQEVGDLDYETCVSDGRKLRLQSWRHPQLRGAKWEQNGHSYEDGLSPSVGLYVHHRTANNGKDVESTQVPINGGLDKENVDARANDDQLDLSFYSRSLS

SEQ ID NO: 929745 - protein, 193 aa, Homo sapiens
MTAPYLLQQDERNDHEPGKLAKLQAQVRIGGKGTAHRKKKVFHRTATADDKKLQFSLKKLQVNNISGIEKVNMFTNQGTVIHFNNPKFQASLAVNTFTITGHAEAKQVTEMLPSVLSQLGADSLTSLRRLAEVLPKQPVDGKAPLATGGDDDDGVPELWRILMRLPGMRQAELSRLLKKIKLEEVTGSCYFLL

SEQ ID NO: 929746 - protein, 141 aa, Homo sapiens
MSLSDSFEESSGSPTRYSSETKLPEERSGSNICCSPISAVLQPPLLIPRKTGSGVDLQQTPTDLQLRVLTVRRKTNKQKGHPHQNPICIKTGNAKNQSASPPPKERSSSPAMEQSWTENDFDELREEGFRQSSYSELKEEV

SEQ ID NO: 929747 - protein, 152 aa, Homo sapiens
MLSVSLMGFPLWSGHSSIQLMQFAGGQVQTLVALVFPVPGSITGEGCETAKMAACFFFWKLCLKENHFPNHKSRDFPTPWRTRAPDIPLYYGPDQNNTRTLGGWDIFLFGAKSSFLSSYVPLPAEERLCNLWRSAPADALLLLGSVSQTESQ

SEQ ID NO: 929748 - protein, 161 aa, Homo sapiens
MGLGATEQGTALIGEALAACRSPWRKGGSGKAGCRSRALPRREAAETRREFERSTSGLALLGDLVHPPQLLAWVLSPSLPRASNASWPLQVWSPPSPCPPGTRTGLPEGASSGLGQPREGLPQCSSRLKGSSNAASVGTEGEEATRVSEGCQHSVTSHKHK

SEQ ID NO: 929749 - protein, 142 aa, Homo sapiens
MLCCLEISSVRYPKSSLSNSKLHKSLGQSIENSTFLYGELDPIHVTSYVVELLDLFIILKETEMTLSGVECAQINTMLSPCAVMKSNIFKHLIFIFTSTCLFIFHCLHTTCLSDSSDSSELRMEILLLKILQEGPEHHLVWV

SEQ ID NO: 929750 - protein, 382 aa, Homo sapiens
MPIPQHPVDLLRTRALFSSPFVADTVLDTAAAYNLGPNQQPLKLQQTLCQRLLREDIQETLCQRLLREDTQQTLCQRMFRGDTQQTLCQRLFREDTQETLCQRLFRGDTQQTLCQSLFRGDTQQTLCQRLFREDTQETLCQRLFRGDTQQTLCQSLLRGDTQQTLCQRLLREDTQQTLRQRLLRGDTQQTLCQSLFRGDTQQTLCQRLLREDTQQTLCQRLFRGDTQQTLCQRLLREDTQQTLCQRLFREGTQQTLCQRLFREGTQQTLCQRLFREDTQQTLCQRLLREGTQQTLCQRLLREETQQTLYQRLLREGTQQTLCQRLLREGTQQTLCQRLLREDTQQTLRQRLLREDTQQTLRQRLFRGDTQQTLCQRLLREET

SEQ ID NO: 929751 - protein, 183 aa, Homo sapiens
MQSYHQDTSPVYCVTFSCPCSATTKAQPADGFSQCGSRECEASGFARTQASCLRHWAQGAPFSYKIRPRVVEPSPLHPPAASTRAGAGIHGWETHRCFTSQDSADNPLYQPIAWQTCWVARPRREKTITAVRLSRSHIPRKRGRVLHQGNTHGTKDSEQQPSAPDLPSDTAYTNEKEPENQLW

SEQ ID NO: 929752 - protein, 157 aa, Homo sapiens
MNFLPQSGRPRCFPEIASGRTLEAQVWVDGLGNLVLQALEGQLVQKQLCGLLVPPGFVQRQGAKPVPVRLLDPSCSQDPLAGDFGGQGLPGGLPGGGFVVSLPNASHGVGLWPLPCHWAEPGELEAVLVPDSNGGEAVGRIQRVCVLGSMQKMLPYT

SEQ ID NO: 929753 - protein, 264 aa, Homo sapiens
MRSITGSSVSENAAIAMAGIAKVFVGEVVEEALDMCEMWGETPPLQPKHLREAVHRLKPKGLFPNSNYKRVMQTGVSAEMFAIPRGLKGCNEDGIPEALDGNLEEPRAQECELRSEDVMDLTVVDNEASASAPPAAKRQKTDTKGQKERKPSVDAEEAQRMTTLLSAMSEEQLSRYEVCRQLAFPKALVARLMWSITGRSVPENMAIAMAGIAKVFVGEVVEEALDMCEMWGEMPPLQPMDLREAVCRLKPKGLFPNNYKKVMF

SEQ ID NO: 929754 - protein, 135 aa, Homo sapiens
MAGGPGWEDPPHKEQWIGVLLKEAVWLHSGKAAVLCWGHPTSSRPFGLSKAHRPKQPTADVLARDPEARICKAPGSLYMFEQLLCGDSTQLCASDPRRWRHGPIRGPPDPQIAKIHGRSVVSRGHAITHCFPPPG

SEQ ID NO: 929755 - protein, 153 aa, Homo sapiens
MSEGQVVGDVATEVADEGFGIYSELEQIIDKDESKKNTLQAVTIIHGKDDGGSPSSTILMHNSQIKTGLGSRRSRHQQIWCLEEMRQRKSFLPRSLLNQKQVSYFLDTMRVQPLGKYSHSKWEKLAKTKGLQAPCKFEIQQGSQILKLQNDLL

SEQ ID NO: 929756 - protein, 152 aa, Homo sapiens
MIRQLNLLFTKIRCSAATAADTQANRVRQGKLTNRTPTPKTHLYITIIKDQKLIKPQRWGENRAEKLETLKSRVPLLLQRNAEEIQTNSKEVKNFEKQLDECITGIINAEKCLKYLMELKAKFRELREEGRSLRSRCNQLEERVSVMEDEMN

SEQ ID NO: 929757 - protein, 137 aa, Homo sapiens
MIPFNFCQSDGYQVQVEVPYPKCLEPKVFQILFWNICITLWASCGPSRHFQQYLYATRERISRKNYRDGDVAEPATDKNPSDTKLWNERALFSWEHPRTHVSKNRAPRIQELTPAGCPLIQFNSNTTYLKIVSDPMG

SEQ ID NO: 929758 - protein, 189 aa, Homo sapiens
MEWNGMESLNGPEFSHDQLESNGIFEWTQFKSSWNASEWNHHRMESNGIIIKWNTMESSSNGIKWIHHPIMESFNGIEWNHHRMKSHGIIEWTQMESSSNRIKWNHRMDSNGIIIEWTQKELSNGLEWNHHRMDSNGMIERTRMESWIGLKWNYRMGSNGIIEWTQMESSNVIDHNHHRMESNVIIKWN

SEQ ID NO: 929759 - protein, 311 aa, Homo sapiens
MDSNAIIEWTRMESSSNGIECNNRMDSNGIIMEWNRMESLNELEWNHHRMESNGVIEWVRMESSSNGIMWNPSSNGIKWNHLMDPNGIIIEWNKMESSSNGIIIIEYNRVESSLNGMEWNHLMDRNIIIIELKHLLYPNRIIIECNRNQHRMESHGITKWTRMESSLNGIECNHQMDSNGIIIEWNQMESLNGLEWNHHQMESKGIIEWTRMESSSNGIGWNQRRDSKGIIEWTQMESSLNGIEWDHRMDSTGIIIEWNRIGSSSNGIEWDHHQKKSNGITEWTQGNDQMDANGIIKWNRMESPNGIEWSY

SEQ ID NO: 929760 - protein, 199 aa, Homo sapiens
MDSNAIIEWTRMESSSNLLEGNHHQIESSGIIKCTRMHRMESHGITKWTRMESSLNGIECNHQMDSNGIIIEWNQMESLNGLEWNHHQMESKGIIEWTRMESSSNGIGWNQRRDSKGIIEWTQMESSLNGIEWDHRMDSTGIIIEWNRIGSSSNGIEWDHHQKKSNGITEWTQGNDQMDANGIIKWNRMESPNGIEWSY

SEQ ID NO: 929761 - protein, 251 aa, Homo sapiens
MESSSNGIECNHRMDSNGIIIKWNRMDSLNGIEWNHHRMESHEIIKWHQTESSLIRIKWYHLMDKNGITIECNRMDPHRMESNGIIEWTQIESLTKLNGIIEWTRMESSSNGIEWNHCMDLNGIIIKWNRKESWNGIERNHHQMEWHGIIKRHQMESSSKRIKQNHPMDTNGIIIKRNRMETSNGIECNHHGMESNGIIIKWNRKEPSNGIELNHRWNHHRMESNGIIIEWNRMESSLNGVEWNHHQMESN

SEQ ID NO: 929762 - protein, 274 aa, Homo sapiens
MGLNGVIEWNRGESSNGFEWNHHQMESSGIIEGIRMESSSNGIEWNHRIDTNGIITPIESTNEIECNHRMDWNGIIIKWNRMELMKGLERNHQKDTNGIIIEWNQMESLNGLEWNHHQMESNEIIVKWNRMGTSSKVIQWNHRMDTKVTIKRTRMESSNGIEWNHLMDSNGIIKWTQMEDSNGIIIEWNRMESSSSMIKSNHQMDSNRIIKWTRMESSSNGIIEWTRMKSPLNEIKWNHRMDSNGIIIEWNQMESSNLLEWKHQVELKGIIKWT

SEQ ID NO: 929763 - protein, 149 aa, Homo sapiens
MCSVQAQVPKELWSSVKMLLPQTLVGHKPPGEGACHTTQGGQAPGEGVCYTAQGHMGKHQEAGGAGGKCGSSLWFLQEEMVKVGLSTSSGKYRPLINGMLLRMQLSAGSFSEVGTEWGQRLPKGVIQVLGALNKELDKTHKQTNKRMKH

SEQ ID NO: 929764 - protein, 116 aa, Homo sapiens
MDSYICMTEEASQSWRKAKEEERHILHGDSQENVCRGTALYKSIRSSETYSLSYKQHGKTCLLDSITSQREEEVEVEVEMEEEALAAAEEGEGEGEEEEEKKEEKKEEAADTAWQD

SEQ ID NO: 929765 - protein, 145 aa, Homo sapiens
MVLSKCLPWTKVKMMMLENAEQTVLRSILTPVSTTSQNHDLRQMQWQLNRPCEASEQCLKHSEDRNSGTNTPVSTELAPASASWKHCKSACSYSREMTTVRSQRRGKQQPWASRKAEADAWNHPEVFYHRMCNFDFHTQNGLNSG

SEQ ID NO: 929766 - protein, 214 aa, Homo sapiens
MERPHEGSQIRTPAEVPAYNQYQPPDIKTVWKRLNILGEKLKGKKQRLQPAQLKKKVESAEQVACEDASLAAGTKRHKLGGSKHSEMVLSQTHGHGSSKSELKVLAGLCSLWRPYGRALPRLQLLVASMANTILVFAAPRTQMYTVFQQRLHKYSGPEELGIFEEHQGGQCGIHGKDRGRVGDELTLRLHLPLKLNLFAVLLWCFLASGIISKG

SEQ ID NO: 929767 - protein, 1092 aa, Homo sapiens
MGQTEKPFQIEEDSVSVFDASESCVIDCEEEAGTEFKKGMESTHCKNAVEPVLAWSMQNVDYNQLQEVIYPESSKLGEGGPELFGPSEFRPRWPPTPSPAVQMPLMSQSQMPIQAQYPQYQPVENKTQPSVVYQHKPSAVFQYPPSPEVQYGSQAVRPVPNSKALYQQPKAMAFDLTVPPSGQGSALHETIATARKQGDLEAWQYPGMLQTMPAGKGSQARASIRQGSKEPYPDFVARLQDAAQKSIAEPPGLCPRCGKGKHWAKECRSKFDKNGQPLSGNGEEGSAPGPATKWGIPDSAICSSGFSGTTTPTVNTTISGNQPITIRQLSPATAGSAAVDLCSTQMISLLPGEPPQKIPTGVYGPLPEGMVGLILGRSSLNLKGVQIHTGVIDSDYKGEIQLVISSTVPWSANPGDRIAQLLLLPYIKIGDSKTETGVFGSTNTAGKAVYWASQLSENRPVCTVTIQGKQFEGLVDTGADVSIIALNQWQKNQPKQKPVTGFVGVGTASEVYQSRWRMLTDLRAVNAVIQPMGSLQPGLPCPAIIPKDWPLITVDLKYCFFTIPLAKQDFEKFAFTIPAINIKEPATRFLWKVLPQGMLNSPTICQTFVAQVLQPVRDKFSDCYIIHYVDDILCASETRDKLIDCYTFLQTEVANAGLTIASDKIQTSTPFHYLGMQVEERKIKPQKVEIRKDTLRTLNDFQKLLGDINWIRPTLGIRTYPMSTLFSILRGDPDLNSKRTLTPGATKEIELVEEKIQSAKFLKLTTWILPKITRQKPLENALTVFTDGSSNGKVAYTGPKEQVIETQYHSAQRAELVAVISVLQDFNQSINIVSDSAYVVQVTKDVETALIKYSVDDQLNQLFKLLQQTVRKRNFPFYMAHIRAHTNLPGPLTKANEQADLLVSSAFMEAQELQALTHVNATGLKNKFDITWKQAKNVVQHYAQCQVLHLPAQEAGVNPRGLSPDALWQMNVTHVPSFGKLSLVHVTVDTYSHFICATCQTGESTSHVKRHLLSCFAVSGFPEKIKTDNGPGYCSKAFQKFLNQWKITHTTGIPNFQGQAIMETTNRTLEAQLVKQKKEKVRNITLPRCNLI

SEQ ID NO: 929768 - protein, 177 aa, Homo sapiens
MESSNGLKWNYHRMESNGIIDWTQMESPLNGIEWNLRMESNEIIEWNRIESSLNRIKLDHHQMESNEIIIEWNLVESSSNGMEWNQQGMESNGEIEWNPLESSSNGTECSHHRTESNEINKGTRIVSSLNGIRWNHRMDSNGIIEWTRMETSSYGIEWNPRMDSNGIIIEWNRMELN

SEQ ID NO: 929769 - protein, 172 aa, Homo sapiens
MGLTALFLPHIFMFDHLLSRAGKWESHDLKDDVGTEQKPSLFPESEHGTLFSRCLYLLSPAAPRKEGILIFKLKIWPKAHCCPQCPPDTFLLPFSFYGNALFEEPMKQCQAGVRISSNFFEEESPFHRSQAMSEWIKKNRVPFYEILSAHAYGYDVVSHCGFDFCFPDDEFH

SEQ ID NO: 929770 - protein, 166 aa, Homo sapiens
MGLGAVEQGAVLVGEAPATQEPMEGGGSGMLGCRSQALSTGRQLRPSEKSSTAAAGPGAKPLTARGRQGQLAAPSAGPPSPRPPGTPAGRQEARSPGSGSCLSLHTSLQAEGASSDLGKPRKGLPPCSRGLKGSSSAAKVGAQAEEAPRVSEGCDGCQHAVTSQKE

SEQ ID NO: 929771 - protein, 239 aa, Homo sapiens
MNNATGCTETVILEVISLISQQDPELQPILAGLSLSMYLVTVLRNLLIILAVSSDSHLHTPMCFFLSNLCWADIGFTSATVPKMIVDMQSHSRVISYEGCLTRMSFLVLFACTEDMLLTVMAYDCFVAICRPLHYPVIVNPHLCVFFILVSFFLSLLDSQLHITFFLWLDGFYSFPYFLCEYCFLRYAFHWNGKHCELSEKITHGIGKRFANHISEKRLICIINKEQLQMNNQKPKAPH

SEQ ID NO: 929772 - protein, 173 aa, Homo sapiens
MPLATSDMKGDRRNIWTTGYQTAHRMAVMHPQIPSEVGKLRLAGGGPEAVKPGQGLRKYLSLGMGPPTLPSLTFMCRLEPRYTVKMATACHQWVHRRRWDMELGRGDAMTRQGTTWVQDTQDGLCPELTILGQNGQETVVQYEAPAPATDRDTEPPSALPGAGMTSATPHPQG

SEQ ID NO: 929773 - protein, 181 aa, Homo sapiens
MGVTTAYIIDATTPFLGGGDTAEVEKALYFPSEDEILRMELGIQQAKEKGHQNEEDTEVRIHDDWVIQRATDGYKAVIGHHSQDHAFYTCKKDQEKHLCQAALMRDDSAMRLHVHNHLGNHGRGETDVSPAQVGEEEVHGGVEGGVRADSQDTEEVPQHRDQIHGQGQGQQSEDRLQFWIL

SEQ ID NO: 929774 - protein, 127 aa, Homo sapiens
MEQPHLKVSRWTSPRCKSVEISTALTDRLRQRVCVFGCLGTEDGKDIRKKCHWGCEQPCDIESSIILSPLAYGEQHHRKNITGVLYNYFGLGSNIILYFPGYWAQKHKRVYNPCDIGSNSMLSFTGC

SEQ ID NO: 929775 - protein, 135 aa, Homo sapiens
MGICKEKRKKEKGRKEGEREGRKERKKEKERKKEKERKKKERKRRKEERKGERKMVEAGKKADNKFCSEEVDAQRENGEQTEKEAKNNLQGKHNIQGTRKRIEASKVEKEGQIREEKSHEIPLRSHGIKHLQCPS

SEQ ID NO: 929776 - protein, 128 aa, Homo sapiens
MSLRVGARAKRNPWVSGDPGGPDQCSLVVGADAWAHRGRARPEVQVRAVDPGGGWDDRRVVLAVKRVLEAQERNAQDLQRLGDSRRREHAVFLWDRKASVHQVRTTTFIGDIDYVLEHISHRPGSNHL

SEQ ID NO: 929777 - protein, 125 aa, Homo sapiens
MEPSMSLDRATSLQPRRKTPNHLSLSSHLLMGHGKAGIQPLHLEEWKCPILDTTLPLVVICPKDPFGCDSFSDFAFAGLESFKEYSSGFSIVSNSLPPPTPHTVFWREITKSSPYLLVESYAPPF

SEQ ID NO: 929778 - protein, 142 aa, Homo sapiens
MLGLTGSLLEGEWVHPFLLLPAGYSKSVLPGTPAAIFDDELKKEIRTQIHRGEGCVRRGIKKSRKAKDCQQTAKAVGKWHGADSPLSSQEQPTLLASCCQILFPVSTVQTALSEVVQCGGPGPKVPTSLPQCPIFNTLEPFQ

SEQ ID NO: 929779 - protein, 143 aa, Homo sapiens
MGEFYVAHSYGDHGRHSEREKEEVTGEHNDMSDCPAWLGKGNVKLWNSVDDGCESAEALRDDVEDFHIPGEELPLGSEFLGGEREKLGDPPRAGGELLGDGSKNMWYIIDERGDSEESSEEDTGEPNGFIDCPSRLKKYPSNN

SEQ ID NO: 929780 - protein, 188 aa, Homo sapiens
MHNQTIIASTHPEPGWHWQRRSAQKTHSNFLALFSKCCEPLRGTEIEHSGSADFEAVACRCSQVNKALPSITRCLRGFVCSSSCYILIWTIRLPAATEKGVSFSPPVKSAYPIRALPQVLARGASCPFQIITEFTKRSASTCGVLPPAPQATLTMDPCGANQEWAAGDPASSQGLPAASSAPVFHWAL

SEQ ID NO: 929781 - protein, 135 aa, Homo sapiens
MTNVSSNNPTISPLTTKSSFSLISPTLGSHTAPNPARSSPEKHLPLSLHTIPKNFCRPNTLPLFHFIFLINIRRQEFQASEPKLSHHIPCDLQQRDDFEFWLSFDHKEFLCGKTVREAAMYGSSSCSTPSSIWCY

SEQ ID NO: 929782 - protein, 155 aa, Homo sapiens
MTRDIQMAKRTHGEKGSCGNSFSRLKRPCLPALKRTADLPAQHLSSAKGQTASSYGSLTPVPPDGETPSRRGRQTPPTGELRLASGKCPSGMKFPEEGTGSNLCSSAASAGDTQAKRVWSVPLANSSRSAAEGPIRRKTNKQNAIASTSTKRTST

SEQ ID NO: 929783 - protein, 150 aa, Homo sapiens
MGCNGNRDYALFKPWHLVHCISAASAPVVAKKGQGTSQASKGARSKPWQLSHGVEPADAQKSRIEVCEPLPIFQRTYGNAWMSRVVPKGNVGKEPPCRVLTGALPSGAVRRGPPFSRPQMVDPLIACTMCLEKPQTLNTSLSKHLEGKEC

SEQ ID NO: 929784 - protein, 136 aa, Homo sapiens
MSQGGAMLLPVPGWNFKSYPVRHRGSGACKLSLLIPLNSNSFLGVCTGSKLPLCWSCSYFCQTARVSKAPGSLRVPEWLFCQDSTQIEGLSGVGSCRRAPDPRVAKISGTSVGSQGCTFTHHFLGQGRSPWFRIAA

SEQ ID NO: 929785 - protein, 159 aa, Homo sapiens
MVDAPPPTKLQCPRSTLDCCAVSANFKPVDLSLFGFMGVGSTEQDHLAPWLQPPFQGSELFCLAGIPGNNRKKKKILQLAQCLPKWPPSPSDIRACDGAVAGFFIQCPDAHTSRGSIQMGRLWGSDPIAAARDECLQLQYPAKALKDVILCVIMLSPPK

SEQ ID NO: 929786 - protein, 147 aa, Homo sapiens
MQEEDSNGLGQFSPCGLAGYSLHPGCFHGLAMSVYGFSSCMAQDVCACIILGSGGWWPSSCCSNKQCPEWHKPGESQPPAKGGIFTGDTSRCVRDRGCCCQLLWDWVKGDEWRNEDKDKKICFKRRCQGLLAPSEQRLWASTTLHIY

SEQ ID NO: 929787 - protein, 147 aa, Homo sapiens
MSSRPGLREPLLYSSLLSLLAIKGDTCAERAGLLHRKLKLDTFLTPYTKINPRKIKDLNVKPKTIKVIEENLGNTIQDVDMGKDFIMKTQETIATKAKVDKWDPIKLMSFCTAKETTIRVNRQPTEWEKNFAIYPADKGLLSTIKFI

SEQ ID NO: 929788 - protein, 216 aa, Homo sapiens
MGAGLSYAVLVIPDNAIEMKTPFSGEKFKLAAEIYTSNEEPNVNHQDNGKNVSRPCQGPSQKPLPLQIMYGNAWMSRQKFAAGVEPSRRTSTRAAWKGNVGLEPSHRVPNGTPPSGAVRRGPSSSRPQNGRYTDSLHCAPGKSEDSQCQSVKAARRRGVPCKATEAELLKTMGTHLLYQRDHDVRHGVKGDYFEALKFDYPTGFWTCMGPVAPLFW

SEQ ID NO: 929789 - protein, 198 aa, Homo sapiens
MKTPFSGEKFKLAAEIYTSNEEPNVNHQDNGKNVSRPCQGPSQKPLPLQIMYGNAWMSRQKFAAGVEPSRRTSTRAAWKGNVGLEPSHRVPNGTPPSGAVRRGPSSSRPQNGRYTDSLHCAPGKSEDSQCQSVKAARRRGVPCKATEAELLKTMGTHLLYQRDHDVRHGVKGDYFEALKFDYPTGFWTCMGPVAPLFW

SEQ ID NO: 929790 - protein, 610 aa, Homo sapiens
MRLGLHMSAPGYIPTLHFSSKGPWGLVCLLLFSLLPSEAPSRDFSTPRPTGENDLGLGEGNMGELLNECSISVFQDEKFWRLVLQQCACTHQYSTVHSIRNTSNHHSPPTRVRVSHSPPTTPRVSHSPPTPPRVSHSPPTPVRVSHSPPTPVRVSHSPPTPPRVSHSPPTPVRVSHSPPTPPRVSHSPPTPVRVSHSPPTPVRASHSPPTPVRVSHSPPIPPRVSHSPPTPVRVSHSPPTPPRVSHSPPTPVRVSHSPPTPPRVSHSPPTPVRVSHSPPTPPRVSHSPPTPVRVSHSPPTPPRVSHSPPTPVRVSHSPPTPVRASHSPPTPVRVSHSPPIPPRVSHSPPTPVRVSHSPPTPPRVSHSPPTPVRVSHSPPTPSRVSHSPPIPPRVSHSPPTPVRVSHSPATPVRVSHSPPTPSRVSHSPPIPPRVSHSPPTPVRVSHSPATPPRVSHSPPTPVRVSHSSPTPPRVSHSPPTPPRVSHSPPTPVRASHSPPTPVRASHSPPTPVRVSHSPPTPPRVSHSPPTPVRASHSPATPVRVSHSPPTPVRVSHSPPTPPRVSHSPPTPVRVSHSPATPVRVSHSPPTPPRVSHSPPTPPRVSRADAG

SEQ ID NO: 929791 - protein, 437 aa, Homo sapiens
MTVGSLLVPSMLWGCHRLPGMVFKLHRSSYSILQCRCLHGSPPIAESLTDPSKLDSGKEPHISLIPNKQDRTLTIVDTGIGMTKADLINNLGTITKSETKVFMEVLQAGADISMIGQFSVGFYSAYSVAEKVTVITKHNNDEQYAWESSLRGSFTKKHDKEVSNDEAEEKEDKEEEKEKEEKESEDKPEIEDDYCTRMKENQKHIYYITGETKDQVANSTIVQRLWKHGLEVIYTIEPIDEYCVQQLKEFEGKTLVSVTKEDLELPEDEEEKKKQEEGKQKTKQKKNQSLRTSAKSTYGWTANMERIMKAQALRDNSTTGYMAAKKHLEINPDHSFIDTLRQKAETDKNDKSVKDLVILLYETALLSSDFGLEGPQTHANRIYRMNKLGLGTDEDDPTADDTSAAVTEEMPPLEGDDDTSRMEKNARVHGIFPDNYI

SEQ ID NO: 929792 - protein, 164 aa, Homo sapiens
MCHVSKVTLYRHCNQWSVSWTLLCVTDTEEIPCGNPDSGNGQHLGWRESNMTSYLMKKVKCKQLTVKCHILQEVCKRSVAITGDGSSMRVVAPEDPPVGQDVEVEDSDWMVEENCSFAHVIYQGKTIFIKKAKFKYDRDFPFSSANGPCENNLKSPINYKNVSL

SEQ ID NO: 929793 - protein, 137 aa, Homo sapiens
MHRLSMPHSCCQEMGRRGTSESRLSPLMSSIPFSAIPFWAAVKEYLKLSIFVHISAGYTRSMVLASAAGEGFRELPIMVKEEGELAFYVVRERARESCQALSNNQLSYELTEHSLLWGGSKAIHEGFTLYDQNSIEL

SEQ ID NO: 929794 - protein, 199 aa, Homo sapiens
MWNCESIKPLSLYKLPSLRCVCLQVCVLAAVCACRCVCLLLCACSCVCLQVCVLAGVCLQLCVLAGVRACSCVCLQVRVLAAVCACRCVCLQVRVLAAVCACSCVCLQLCVLAGACACSCVCLQVCVLAAVCACRCVCLQLCVLAAVRACSCVCLQVCVLAGACACSCACLQLCVLAAVCACSCVCLLVINITEYDKIC

SEQ ID NO: 929795 - protein, 147 aa, Homo sapiens
MVKGEEEPKTFFTWQQERDVQAGKIPDTYKTIRFCENSLSREQHGENCSHDLITSLPGHVGVTGPSLDTWGLQFEIRFGWGHRAKPDYLCYHQHVNHFSSWNILDTGPKRAFNLPSGTLGLQASPTGCCYRACMEFTPTGTKAAGQL

SEQ ID NO: 929796 - protein, 140 aa, Homo sapiens
MGSHLLHQCDLVVRLGVKGDHFGALRFYCPVGFWTSTGPLAPLFWPIFPIWNGCIYPMPVPPWYPGNMSLSAAGKQTNTGIKIEEFSASLEQTKVSKREAKSVSARGGLPDHTLNRMWNSEYLCSKLRNHPQFTQMKSTV

SEQ ID NO: 929797 - protein, 223 aa, Homo sapiens [sequence omitted]

SEQ ID NO: 929798 - protein, 138 aa, Homo sapiens
MVPIYIEDVYFFYFLDCFTNFFVLIFNLILDLIEFSCNPCIELNSPSVISMPPFWLQIFVGSQSKPLVMSQHLFFITAEFFSDSFSSREGCVGQGFFCFVSIVLCISVNRFSIELCGSPYGPKDGVYRYFGEKTTCTK

SEQ ID NO: 929799 - protein, 140 aa, Homo sapiens
MLAGTDFFALSVGHRQGWLLRVGTSPLFSMQSFILAAVLVQGQGTGESRSSLPYACQGSSCNGSHTGGAGQTILPQQQWRGRVHVHTFVHWWGKESKICLAQTCRQSNVGVKAWSTSAIAIMQASRESKAALQADVRFGC

SEQ ID NO: 929800 - protein, 148 aa, Homo sapiens
MAPAFARMCLPNKGVGLSGIIRKACEKSKAPHSQLSGWEKYLVTGCPRTPRIVTDLEDSCLGQESKTEKATPVSQRQLTSWPSMVKHTRGSVRVMAWAGACPGHPQSCCWIIWKTYEWTTYEKVLNVTNHQENANQNHNETSPHTCLG

SEQ ID NO: 929801 - protein, 216 aa, Homo sapiens
MGKKQSRKTGNSENQSTSPPPKEHSSSPAMEQSWMENDFDELREEGFRRSNYSELKEEVQTHGKEVKNLEKKLDKWLTRITNAEKSLKDLMDLKTTERELCDECTSLSSRLNQLEERVSVMEDQKNEMKREEKFREKRIQRNEHSLQEIWDYVKRTNLHLIGVPESDGESGTKLENTLQDIIQENFPNLARQANIQIQEIQRTPQNTPREEQLQDT

SEQ ID NO: 929802 - protein, 135 aa, Homo sapiens
MVFNWREFCHQGTFGNVWRHFWLPQLGGCYGNQRPEMLLNILQYTGQPHNKNDPSQNVDSQTECAGPRSRPRPTPRPNHWSGAGGKGCRQQARLQATERTLARRNSVIGSRKKLQSPKAKLVPKKVMVTGICCRL

SEQ ID NO: 929803 - protein, 148 aa, Homo sapiens
MRKNEHKNSDNSGRQKTFFPPNNCTNDHTIGHKTILSKCKRTEITPATLLDHSAIKIEMKTKKIAQNHTITWKLNKLLLNDFWVNNEIKAQIKKFFETSENNDTTYQDIWGTAKAILRGKFIALNTHMKKLESSQFKNLTSQQKELEK

SEQ ID NO: 929804 - protein, 260 aa, Homo sapiens
MDNATHHREYIQYATFSLTCGCPWTILPTTESIFNMLPSPSLEDACGQYYPPQRVHSICCLLPHLWMPMDNILPTTGNIFNVLPSPSLVDARGQYYPPQRVYSICYLLPHLRMPVDNTTHHREYIQYAAFSLTCGCPWTIYYPPQGTYSMCYLLPHLWMPMPVDNILPITESIFNMLPSTSLADACGQYTTHHREYIQFLKAQFEEEVHREISQPASKWIVSKLKKGRRFRKQTQQNRAKGFQPSLGKELLIYLWETVNT

SEQ ID NO: 929805 - protein, 159 aa, Homo sapiens
MLEPTVPTETLAVSWHSLWWWEASFPRLTYGDTDSSLKASALFLSQHLPFSGITHIHLVNFGQSYLAKENESNQHVSEGTSLSYPFVKKDVLASPSAMIVTNIHEAHIDHTGKHCVWDGESQMRRNGLWGTWSLMGAGEVKAVAADEIRGLTPQNPETA

SEQ ID NO: 929806 - protein, 189 aa, Homo sapiens
MVYQRAEAQEPASLEDLGGGQAIVVLFLALEQAEVGGELLLQPQLDVHEQLVLLILPLTVSSHIAQLSFNTADQRLDLRQLPALPSALRSASPGRSWPGSAQPAPRAGHYVSLHTHEQSLLPLILSSEVICSQTGIVDLQDNPGILNDVTKNLVAQVLDGPVVVAVVMGGPGAHDFKMGKQQETDIQLP

SEQ ID NO: 929807 - protein, 165 aa, Homo sapiens
MAINGRLNGEMKMLPYPLDRRHDYLAEISQLQCLCHIQSLTEGIPGKMWFRCEHCDRSQGECLVILLDICLISALASSQDCHSNHSPNLAQPLKPTVTIHVTHIPIPKSSSVIYNKWMRRDTEEKHKEEGHVKIETEIDDAATNQGSQRLQESPTARKRLKSCLP

SEQ ID NO: 929808 - protein, 254 aa, Homo sapiens
MLLYVRGEVGVGGWRWIPDGKPRSLKARQGQGVAEETSGASQVQADQVYTPESTRHPDGGTRRRCLEKSTEHVRAPETRAEHARVLETNPHRARESPAHPRRARESPGNRLTEHVRAPETRAEHARVPETNPHRACESPAHPRRARESPGNRPTPSKREPRKRTNAEQVRAPEIDQRRARGSPRKPTCAEHARVPETRAEHAVVLETDPRRARESPGNRPTRSTREPRKPTRTKHAGATASFHAPPTCWASSEF

SEQ ID NO: 929809 - protein, 140 aa, Homo sapiens
MVSLILIALGSLVACHPSPALLTPGASPSSLSSKWLGAQDPAKDFALKPASAKVIDHLNFLSELQATPSPHVPGTSHRSPGTAAPATGQVRTGLIPPTLGVRPPGWEHEAVLDPELQLLVGPGGEREPQAAKPPLCTPNI

SEQ ID NO: 929810 - protein, 146 aa, Homo sapiens
MYLLAVDIASHLGHQNVSRICSFQWVLGLADFKNEATDLSVRGLADFKNEAAELGKKINEYVNQFDERTLETGMFHETNQQRGYHSFWQPQSIPGTWMRIGEILCPATVKKLHSNVCVCMYVCIITPTLSNSSFPNICFNFHTQLI

SEQ ID NO: 929811 - protein, 138 aa, Homo sapiens
MGIPSQSLYPHCIFGVSWVSCTNLEGLDQVPQLCLLVTRGQAPAALEGLKCSQSAGVVMGAVDKSAMAWQVVGHKTVCHSEGVTGKCAWYMPARCHLKKSSNGKARASGEKSAVVLAGKYFSRTTKALLQADVARQGQ

SEQ ID NO: 929812 - protein, 158 aa, Homo sapiens
MKTWESLELPRDLSNGFDQKADSGMDNNVQVEVVSSGDEELVGNWNKGHSCYAKRLAAFFPCPRDLWNFELDRDDLGYLGEEISKQQSIQKEAEHESLEDLQADNTIEKKNPFSGEKLKPAAEICISTKKPNVNHQDNGENVSRDVRDLQGSSSHHRP

SEQ ID NO: 929813 - protein, 147 aa, Homo sapiens
MPMYLKGIGHCDLSHNCIRRHLMSSNAVVLADSEAEEPHPMATTTTGPLRVMPGERESMSESRITNGSKIQLQECSYLITHATHVTGFDLSSLKSNTHPKGPDFFVSKSTTNQDLTFVLNSYSQIRIFSCHPPSSVVLWGVSLALFR

SEQ ID NO: 929814 - protein, 145 aa, Homo sapiens
MHSWGEVYKQPSSQSRPVKTQVRSCHSSAENTNRFLSLSIEKTVFIMTCGDFCDLPFYFLSSHAQHHWPLCCSLNFLTQGLCTCFHYCLGCFSLRYLHDLHYHFPSLLKSYLPRSSPLVTLSVFLTPFQHLIPSSCFEFILGTYH

SEQ ID NO: 929815 - protein, 159 aa, Homo sapiens
MAVCNPEEAPHQEPTMVAPVSQTSGLQNLFHRSQFFAQCLVPGKGGSWGPGLMFLRQWREGEGTVICEWIFVLPGFCQNNGPLPSCHCSSCWLPLLKFTDEAGNLVVYPLPPHSWIRGAHCLWREQTLQQDLRLHRGKCPGGATSGERNTRKPQKIISH

SEQ ID NO: 929816 - protein, 172 aa, Homo sapiens
MGRQEVTQIGLALSHRQACPALSRSDSHPKAKATYKILASLGERVSLAVFHCSHSHAKPSGLYTGWSPAPATTLNGFACQLKWGLCCLLQLGFRRSITTVGHSLTIPLTPSPGVSGGQEWILVFSSQGSCRVPRFLSFQFSICVLPPSTLNAFPLKISVFLMSRSLIERCSS

SEQ ID NO: 929817 - protein, 136 aa, Homo sapiens
MRTSKGYSGLAVEKEAAAIPSAWQRLEGRQRSGKLHSGGGEAPGEHVGLSLVLSWKQQEKVGKPVVIDDVLTVLGRLLWTLWFGFLDWLLQIVGHTSAVIYGLAAVCIFCLSMQQLGRSRKRSLPSINEEMGPFAV

SEQ ID NO: 929818 - protein, 153 aa, Homo sapiens
MWLSQLSSEQGPPPLAQSLTATGLFSVTSFGLAPLTDTRPWKLASVIASFVKGLLCAGYHVGSPGGCVNDGDTMPTFHQEKHRKNLAKKPAGWRDARRTLKALLRIKAIIFYIPPTGDSGSRRSEPLQCIVTFLQRAQHRNGEGKEQHCHGKT

SEQ ID NO: 929819 - protein, 194 aa, Homo sapiens
MTKMSTSRICEHLAHSKCPINVRRRMIMMIMMVVIVVVVVMVMIMVVVVIVMTNDGGGNDGDNSNDGNDGGNDGDNDDEGGDGESDDNGNDDGDGNYGDGDDGNDDGDDGNDDDEGDDGDGSYGDGDDGDDGDDGGDGGDGGDGGDDGDDGDDGDEGDDNGNYGNGNAMMAMMVMMVLVMMVVMMVMEITTVVI

SEQ ID NO: 929820 - protein, 234 aa, Homo sapiens
MNINKTDNHTKTPSEGHQNPRPKVDKSMKIRKRQCKKAENSKKQKATSPPKDHNSSPGREQNWTENEFEKLTEVDFRRWVITNSPELKEHLLTQCKEAKNLEKSIKSQINQAEERISEIEDQLNERKHEDMIREKRMKRNEQSLQEIGDYVNRPNLRLIGVSESDEQNGTKLENTFQDIIQENLSNLARQANIQIQEIQRTSQRYSSRRTTPRHTIIRFTKAEMKETMLRAARQ

SEQ ID NO: 929821 - protein, 312 aa, Homo sapiens
MYATRLIQMRSYLENRAQQHWGSGAVVKKLRELQPGEKRCVVGTLFKSMPLQPSILQEISEEHNLLPQPARSKYIHPDDVLVLEDELQRIKLKGTIDVSKLVTGIILAVFGSVRDDGKFLLLVSGLGLGGGGGESLLGTQLLVGVVTGQLRDEGEQFSAAHVSRVVLEGNLLSHSTQSRDSINKAKYLTKKTQAASVEAVKMLDEILLQLSSSVPVDLVIKPYQATIDGVRFLGTSGQNMSDIFRYSSMEDHLEILEWTLRHPQLWLLVTIPDLSAMQTACLVNLPSLACQPISFSGFGAEDDDLGGLGLGL

SEQ ID NO: 929822 - protein, 142 aa, Homo sapiens
MINGLNDAYSHYGFGPIVTAAALMSGGTPGFLVLALGTKNFIASGSSGKACVQIAGKGTWLAINAFHIVFIASHLHLAFIDLVHAKSIEKPVGQQHACPIHCSIICQANFTPYFGSLCAYDAQTIISPMSKHRNQFYPLIIF

SEQ ID NO: 929823 - protein, 136 aa, Homo sapiens
MAEMTGIELRIWMSTKIIEIQEKVKTQSKEPKEFSKKYQEMKDKIAILRKNKTDLIELKNSLQEFHNTIISINSRIDQVEERISELEEQFFESTEFFKVKTKEKLLKAAREKGQVTYKGNPIRLTLDLSAESLQSR

SEQ ID NO: 929824 - protein, 383 aa, Homo sapiens
MSWRLLQCHPCCGLNLLLSLVTTGWAPLSSFLASSKVERIESGPQGVAHLPSEVEGGFPGWKLQPTMVSRCLHRDFPSLIESLIPSLCRTCCMLGVVNEDEVKAAVGPWDLHSPRGPSGTEAESGGSLVEKQQQADVTWGLRAGWPRPEAGHSHVAVGRVELLVVNEVDHPGEGLPADATLEGSFGAARGHWALGSIPGWDGLPGALAPGGFLPRWLQQVDLAMLSEDGVVQEDLATLGARKGPFLAMGLLVLDEVGDPGEDHPTVGTLEGPPTSGPTRHYRDACNSLLGTTFGVLEGWLVAAALAALSLPTSPEEVGDFTDFTSHLRPMTSDAPNRVPPKAGITTSWEETELWLKSKNSKQRGLAWCPGSSPACCVALDEEL

SEQ ID NO: 929825 - protein, 147 aa, Homo sapiens
MICWAQEDQIQDSELVRMMFNLLRRQYDSIGELLQALRKTYTISHTSVSDTINLLAALGQIRSLLSVRMGKEEELLMINGLGLRSRHSRSKNWQLEVVFPATLKRRGMGSQKVTTQQGSTQQITRLFLYFDLHAALLCEFILDDLKM

SEQ ID NO: 929826 - protein, 138 aa, Homo sapiens
MIVDTYKEKDILSIASYLKIGGWWLAREILGRITGVWWLAREISESGQTRIKKLTRSYCRSKANLWVYEMDIKNLYSSPNYVNRLFADKSDQGRTNLFILVTFTVKIKSFLSHFMRPSTWIVKVKESTGSSSTRIAKF

SEQ ID NO: 929827 - protein, 147 aa, Homo sapiens
MSSLYMCGFVFGISIRILPDRRQLHAIERVQEASMLRNKQDELVKSSQWRKKGGCPQKSSLSELNWNENYNSHHLKKAREKSLIKSKALFLFNSLKAERDEEAVEETFGVSSDWFMKFKKRSHLHNIKVQGEAKFLCLDYQPCPGSD

SEQ ID NO: 929828 - protein, 128 aa, Homo sapiens
MKASQCLLNYIPENSHILRMATLNGHIGHGHVEKELEESDTSRLNHSGTVVLRALTQVAEEEQFEFLKDQETLKLNLWDMALNPQFGPGRRWCPDTDPGILDVCQGCGCGSPTAGFILSLGKTRHPWG

SEQ ID NO: 929829 - protein, 150 aa, Homo sapiens
MRKNHCKKPENSQNQNASSPLKDHNSSPAREQNWIENEFDELAEVAFRRWVITNSSKLKEHVLAQFKEAKNLEKRLEELLTRITLLDKNKNNLMELKNTAQELHEAYESINNGIDQAEERISEIENQLNEIKKYREHNKDSPREGQPQDT

SEQ ID NO: 929830 - protein, 284 aa, Homo sapiens
MEESPQRPGRARQVQATAGDFDWLSTSWTNLSVKCRESGKTEGFLKPFQKQVYMNGDNVATITPFPSPGEDKDQPFTGEESAGLGVLTNRLREKKGGWKLTWPNLELFYVKGAEIHQASSESKFYIVFCIELDLQGEFAALPKQARHGLLLPDHKVECPGKGKTVARSDNPQNVCGVLHGFLGGCSQKSMPLWAQALPMAAPPPSFPGIQQPGLEGLSLTHGAVFVQQRLEAQVSSVLPPFRQGRLECLEATSSSPAGPQGPTPSTSHQLCSSSFWRKPLISRG

SEQ ID NO: 929831 - protein, 212 aa, Homo sapiens [sequence omitted]

SEQ ID NO: 929832 - protein, 140 aa, Homo sapiens
MAEAMAKLGSERKKEQGLIQELKQNQSLELWYENRKGKIKTGESGDGEPDLLRILMWEYISNLLSHAATDYLCELGQFANLHMPLISICKMRIKQYYFPHNVPVAIPGRSIVKHYIYVSCDDGDDDEDGLRSMESYEMMF

SEQ ID NO: 929833 - protein, 200 aa, Homo sapiens
MLFDKPNALLEEKYIDQEELNKTKPIWTRNPDDITNEEYREFYKSLTNDWEDHLSVKHFSVEGQKKKNNIKLYVCRVFITDNCEELIPEYLNFIRVLVDSEDLPLNISHKMLQQSKILKVIRKNLVKKCLELFTELAEDKENYKKFYEQFSENIKLGIHEDSQNQKKLSELLRYYTSASGDEMVSLKDYCTRIRKTRNES

SEQ ID NO: 929834 - protein, 165 aa, Homo sapiens [sequence omitted]

SEQ ID NO: 929835 - protein, 181 aa, Homo sapiens
MLSFFSYVFWPHKCLLLRSVCLNPLPNCDGVVCFFLANLFKFFVNSGYKTCDRWVDCKHFLLFCIEKAYLKIRRDISKKLTANVILKREKLKAFPLRTGTRQGCPLSSVLCNIVLEILARAIGKIKRRKYSHIGNEEVKLFLFADNMNLYLQNLEDFSKRLLNLVNEFSNVSEYKIHVQNQ

SEQ ID NO: 929836 - protein, 306 aa, Homo sapiens
MITIIVLLVHANTCVAGAIGCIIYPRCVVGAIGYIIYPRCVAGAIGCIIYPRCVVGAIGYIIYPRCVVGAIGYIIYPRCVVGAIGYIIYPRCVAGAIGYIIYPRCVAGAIGYIIYPRCVAGAIGYIIYPRCVAGAIGCIIYLRCVAGAIGCIIYPRCVVGAIGYTIYSRCVVGAIGYIIYPRCVVGAIGYIIYPRCVVGAIGYIIYPRCVVGAIGYIVYPRCVAGAIGYIIYLRCVAGAIGSIIYPRCVVGAIGYIIYPRCVVGAIGYIIYPRYVVGAIGCIIYPRCVVGAIGYIIYPKCVVGYTM

SEQ ID NO: 929837 - protein, 194 aa, Homo sapiens
MERSYPLRVSSKLFYCSIKLLFILLTVNLSVYLILPGHRTRTWEPLKVNKKERRMKERRAAALQGPQPRRSLSQGCDTLFRGLQFLVSPRFWAKLHSPHSLVSAVEAAYGMPGPATVSQGASACASMELPTPPQLACLVVHSGCTPCSLTHPLLPHAWLALGRHGIQDSSMSQMQPARPGAANVIILRGEGFKT

SEQ ID NO: 929838 - protein, 141 aa, Homo sapiens
MFYPPSGPARYTIVIKDDFPPWMFTGHHRHSPDEMAMYPLADFPVPPLSRSGANGEKGPNETHKLPVSVTEKQTWRCGMEFGNGTCAFQTGIACRTGKIKNSKTEIMHVEARSAFFLLIHFFGWRGEWGRGASCFAIINRQ

SEQ ID NO: 929839 - protein, 145 aa, Homo sapiens
MGVESRHRSPVNSLRKDGNEIPGDQDSQSFWDRVLKRRELYRERTPVIYQGSLLNILQSTDQQMHVRKLSSEEKIQAKTVGIRWLVGIRSGSRNQMLRVKCSRWTIHQYDRKKEPISGHKWDGTKKHCTGEYWKEKQVEGGTYAN

SEQ ID NO: 929840 - protein, 135 aa, Homo sapiens
MALAHEHPVIWRAGVARMAPGSQLCIWQQCLWARPGQQPRLSLSTVALLIPEKRKPWGHLDQASAGRMLPFLCSAGSDSHGINSSEAGSPLGGLGTLPHGHMAQDTLFFVTATWQGGPRTSVDKDASGAPEPPGN

SEQ ID NO: 929841 - protein, 184 aa, Homo sapiens
MTGQWESDSKDVSEKRTRRPQCGRHQRRPVGQMIYVCSSFDLTSLPLAVSSRGQRRSYHPLMYPIATDSDKGGVVVSSGMWNMMTEDLWNFELERDDLGYLVEKISKQQNIQDVTQLFLKAYSHTHSQRDNPKLQLMFKTEAEHESLENLQPNHVVEKKNSFSGEKFKPAAEICISNKEPNVSS

SEQ ID NO: 929842 - protein, 185 aa, Homo sapiens
MDEAGNHRSQQINTGTEKSNTTCGNARLPTTRFQMCSPVPRQDTDENWTLIPLKFPAASVTSASQCTEDTDEALNKKAANNIASDANILCSYQQEVSGQSISSLCFNLDLMDGQCTHTITHYFQTSVNLFLSFAAISAFASKPLCCRSTGVAGGPLQTLFAWVSPMEAAEQQRLLPALSSGSFVP

SEQ ID NO: 929843 - protein, 164 aa, Homo sapiens
MSKMFWVKVQVKWEGLLPAVLGAAWERRVGEIKLKEDFVASEAIGQSQSSAAKPRRSGKKSENLGPEFQGLWEWLPDGTRLRRNPGLWAFLGPVARFPAHVASSWGRRFWRNPLQLRFRHLEVLVCWRHGWGMSHSGDKELQLRNMLLLGCLYSIIVHLEGEVN

SEQ ID NO: 929844 - protein, 165 aa, Homo sapiens
MNHQRKTKGVECTLTAVSGKWTFLATKPGPAAKTKSPQAGGFNDRNAFSRRLPGEGKSEIQVWAGLDPEAAAWLVDIIFSLGPHRICLLYVCLNFLFLEGHQSYWIRPQPDYLILSHCCLENALSWLSEPPALFPRSGLEHRLTTANCSGKPVILPGAGAGARGG

SEQ ID NO: 929845 - protein, 117 aa, Homo sapiens
MEKLIPDARIAYIENPKGSAIFEELDLLESGPVKGQNRGEDDARCLRGSVSIGRFQNVKGILEVSGNTSRQSTYRGSCSCELTAGYQAQKIHLQKQNGLPWALHGWTGGISLTSPYT

SEQ ID NO: 929846 - protein, 136 aa, Homo sapiens
MATLPNHVQPRLPSQHLVLVSAPSTSGSTVPKGLAIHLNMCALILPSSVKVTTTHSPPMLESSSLPYTQPTPTQSRPLILDQDPRLGTAFSTTSLLHLPGFDTSDSILSLTTFTFPRFDEDLSLKVLQINYSVVRF

SEQ ID NO: 929847 - protein, 134 aa, Homo sapiens
MTESQTCPFPSLSTPAPCSADFTVCSSHEPFSSPLQATWGTWSFQPSSAIWSLRKLSTFWFGPRLRTISSLYKPPGGCYVQAPVPQSLECENKLICQPGQTSAPKCMRRKRETSESFYFPASHNISVCGRGQRQ

SEQ ID NO: 929848 - protein, 120 aa, Homo sapiens
MQLMPPENIPVYLCSTSHGGSLAARRSGVPGFLSHPLDLKRSQALPKCLRTSQDDSITQPKGAGGFESREDECLLCIFGKSSGMTLFLMFIYELSFTGGGAVESCAVPRVVTLIRGHENR

SEQ ID NO: 929849 - protein, 154 aa, Homo sapiens
MVVLFDRAHSFRRDAHGAVREEGDTRLASQISRTNPGNQWGDRCRSQIALTSRSPFEKGGVELAAAVGASGVNGWLLHPAAPSPLQDGALLVTWFPYGFERFSCVVGVCITFLSWGSAGSNCHFLTLRKSWTQDLILAAAARRGPVAQLSMWKL

SEQ ID NO: 929850 - protein, 177 aa, Homo sapiens
MVLSQIPSFGTNPIPHGNPRNPIQDSFHWELSELCLHPRQLETADEMHSVKDKDSAERIAPRVAQVIMGNNASNHSLEKISKIFDNHEGTGSSNVQTPAPIGWTPAVYTNTGVLEHHPEGPSVRRHPGRTRGFLSDSKIYFISVSRIGLSLNRKPLNKHYMPARHINAIKEPCVLLN

SEQ ID NO: 929851 - protein, 131 aa, Homo sapiens
MSRGRAISEAKRGLATASGASMGQSAGDMGSGWSAMACGLLKTRLEAGGTRELNLGSVGQDENSCQPDRRSPGLSRAQERLGTGAPTVPFTLTHCRGSQSVVGKSLGLEKLQGPDELNIGCEEVILEACEK

SEQ ID NO: 929852 - protein, 162 aa, Homo sapiens
MCLSVYEYVNVAKCVCESCSAILTSLLTHVLQSLKSCSASRSSLLILKSGFVSSTLLEFFNLIETHNESNSAWAARDICHPTSPNYCLHPGHLCSSLCTLHICFPVPRKTFPPPWTWKALLAFLDPALISLLPRHPHFPGWIRLITPVPTTPLSLLSAPFLE

SEQ ID NO: 929853 - protein, 158 aa, Homo sapiens
MVVLLVGSPAFVPSVPEEGMWMLGGPASGETQATSRWTLKWEDKDGWETKFPIGVLYVTKFQPMGCQRSVQRRLLRAFCRKVGMHICAFLNLLLHPSASSMDRMAEASLHTDCSQAPLQPLSCPQLALLALVQVHNSSRPSYTQRPPHPHKVHVKARS

SEQ ID NO: 929854 - protein, 134 aa, Homo sapiens
MNTNFYCEENRSHWKFFSRGVVELSPYFNRISAAAVVGDLAVMGQGWEQGLLEGGNSRTLNCQKIALPFHQTHEEHAEDHMSDVDRSICPFPDSFKSFGERCFVSVQTQASSRSGGLEAGSVACTPRLYMVHFD

SEQ ID NO: 929855 - protein, 134 aa, Homo sapiens
MLSLPQSPNPQEALKCDVPCPVSKCSHCSIPTYDSEKFVITDLLKPSSVNLSKSFSIQLCSVAGSSAAGLLEFAGGPLQTLFAWVSPVEAAEQQILLPDPSSGSFIPEGHLPSSNTVLGEPLLSSELSDRNVQV

SEQ ID NO: 929856 - protein, 167 aa, Homo sapiens
MESITRREISDQLLSASEFKAAVNQLRLHLRPRPSAQQKPAILWTRFMETAMQDGAQGTKPPLCATGNCWLVGMEEVAACGNPGWAGCWLERRCVRVMTGEQISPVLLLHDKSRRCNLLLREKCPTIILTPCRGMSLGSSASNHSSQAPREQNQDRPLSFFTLHERS

SEQ ID NO: 929857 - protein, 176 aa, Homo sapiens
MRNPEGVLALAWWGVAVSGLLGRHWGRSKGTCSALAGLLTDSKEATENLGEKQPRAEGREISIWLQWNSELESELVFAQGGPQLVVTGPSGRASSSPLSPTKPLKVFLGQSVFIRGHKSFLEHFPAPALLMEATGFHEHASLSWSSTLMSHLEEELSHMERMSTVHAPLFPRSCFQ

SEQ ID NO: 929858 - protein, 151 aa, Homo sapiens
MVDAPPPTKLPHPRSMSECCASREHGSLGALVHGDPSGRSHGWQTGHALSRLVLQREGNTGLHLPQNSGRSRTSFLEAVIEPCLVRVCGAILLLPGTVTVASMGAMALAPGFSRSQGPSVHIKVFHLNLSQGMKNIINCGICNIMDDIHYL

SEQ ID NO: 929859 - protein, 281 aa, Homo sapiens
MRGRFTPGKLANAKIQPLLTLLISEYDLVSAYEVDHRGDYVSHEIMHHQRRRRAVAVSEVESLHLRLKGPRHDFHMDLRTSSSLVAPGFIVQTLGKTGTKSVQTLPPEDFCFYQGSLRSHRNSSVALSTCQGLEAHWGQTGSPPLGKTGSEGTDRKSTGADKKSTGDRQEVREPTESPQGLDRKPTGMDRRSTGNRQKVRRQIGSPLGLNRKPNGTDKKSTRNRQEVRRRQSAGARQERAGSSTFLRLSALCGLLVDVNREQVAKQKWDLYSSRFTSGNRV

SEQ ID NO: 929860 - protein, 139 aa, Homo sapiens
MPSKSQSLELVPKLQGLGNAPPGLQFTLYKCLDSSRTAQPHAGLHYVDINSGMIRTEEADYFLRPLPSHLSWKLGRAAQGSSPSHVLYKRSTEPHAPGASEVLVTSRTWELAHQPLHSSDLRLGLPQKQHFCGRRKKCM

SEQ ID NO: 929861 - protein, 409 aa, Homo sapiens
MTSYGPDFVCDLCFHLPSMCPSIDMPQPPKEDLFILPDEYKSCLRHKRSLLRSHRNEELNVETLVVVDKKMMQNHGHENITTYVLTILNMVSALFKDGTIGGNINIAIVGLILLEDEQPGLVISHHADHTLSSFCQWQSGLMGKDGTRHDHAILLTGLDICSWKNEPCDTLGFAPISGMCSKYRSCTINEDTGLGLAFTIAHESGHKGDYVEYSANVYEWSRGMSDAGREQATVPRNCCLQLSLLSFMEGELCFSRCLHEACVRALGSSVLPVVAIIMPKVKKKRLADDGGSSPGKCDSHSFGMIHDGEGNMCKKSEGNIMSPTLAGRNGVFSWSPCSRQYLHKFLSTAQAICLADQPKPVKEYKYPEKLPGELYDANTQCKWQFGEKAKLCMLDFKKASDYWHMLNAT

SEQ ID NO: 929862 - protein, 139 aa, Homo sapiens
MTTGKLMWYDYVSRKLKRIGVKMDLITDYWKWGKERTRNRESKMNDQRFLGNLKKIKPECKKPREVFEGNHFLIVTSECQRFQKSLWGLPGVQAKDWSSQVMLNLLAWGPTMQRASQLLFHKISETVILPLKWAVHAHT

SEQ ID NO: 929863 - protein, 146 aa, Homo sapiens
MRSCFWDLRLHMVKKAVARLDAVVVYASLQVQRPVMVDGQGWHPWAGADTKIQLPPRQFDNQGQVDTRKATASVRGCQENPEIQERLSIAGTIKNQHQNQGAHMTRLFLFYLNIQSRLLEYCLPYTKLTQYILLLNHLIDFGHNFG

SEQ ID NO: 929864 - protein, 209 aa, Homo sapiens
MGKTDTGYFNDEINHRLYGFSLEEVTPTQDCATTSRLTSQHPGGGPACVYPCVRPCVSVPVCAPVCVCACVHVCAPVRVCACVCTCVCLCLCVHLCVSVPVCAPVCVCACVSTCACLCPCVRLCMSVPVCAPVGVCACVHVCAPVCVCACVSACACLCLCVRLCVSVPVFMCVRLCVSVPVCAPVRVCARVCACACLCLCSCVCSWAYL

SEQ ID NO: 929865 - protein, 117 aa, Homo sapiens
MAVPRPFPAVSTGHCWQLTHLTGMNCEEEPVKAGKPFDRHERLLPDGETELLEYNEAALKIIAILFNFSLQLHIRGEICHSRGRVCTREQWNIRNTFMENTHQSICLLPDLEKGERI

SEQ ID NO: 929866 - protein, 190 aa, Homo sapiens
MRCSTSSHHITHITKLQRPSRSPFFRLKEQGLSLPFTGAGLRCCEQDQGSSGADLRPRGSEKGVTLETPYPMHLRGPVYKTVLCCSDDAEVGTQAACNGMEKDLLRTLAFAALRPLPLAPKDTESQAGGRHIDRTSPRATSERSQEPYDANTPKLNTPSTRLKSQTVALSRGKFYTQRWPLKCSTGLSGF

SEQ ID NO: 929867 - protein, 153 aa, Homo sapiens
MANAGLQPLWLFLYLTSVFCLYIFHHVAALDSESTQARRLPDQVDITTKQFQSWICALVQKGSQATMPTESLPWRLGWQDTEGTESPSRPKPGFRQDHGCSPGEETHEEDIRVLPSDLNPATEDPEGGFSLGPVWKAVLRAGPKLGSTFAYAR

SEQ ID NO: 929868 - protein, 166 aa, Homo sapiens
MRSSRRALHLQPVTTSSTFSSNEVLSESPAPCSLSPLPPPSPPVPPPNLWSNSCGQVEDKWTTRWRHLTGTNRRGDPRPTALSRDTWPTAPCQELAWSSCLFGLWARAGSGSAHFALIPGSTRFPQTLIFVFLIPGNSSPKQIPFPPFPVNVRWLMQATSALVHVT

SEQ ID NO: 929869 - protein, 136 aa, Homo sapiens
MRQGSSSFSSFKLTQRLRLRPQDSEIPGKLVRRKGEQSISAVSKLPSLRHFVMAAEQTKMEASQVQLRKGSLHQRVRVMGQVTRALQTGEAGQLWDDRLWATTSRGDKEVSAEPRSCALQPTEGPRRGFLLVRSLM

SEQ ID NO: 929870 - protein, 138 aa, Homo sapiens
MGRVFDRGAGAGEFLMRKRHKQSKGKNQPFARQASGQMQAGALCSWSWREHLLSSLPGARAPWNPKLSGFRTAPGKCVASFIRRQRLAVLRPSPWLLPDERSGAFTLLAPLKHTCPAHLDLLSIAVGRAVCNLGLRKR

SEQ ID NO: 929871 - protein, 133 aa, Homo sapiens
MVPVTDWNTIHLIKGHFGAADVEHPFPPPCMSDIPTREGSLSVLQPREHAWYWPYELSLENGHIGKKKQVMFSPDLCYSLYDVEVKSSVDYSITYTKGLCTLIGVREPPSSFTGMDYIIGKILEMQIYSIEFK

SEQ ID NO: 929872 - protein, 149 aa, Homo sapiens
MQRGGWVGAQAPVPRSTAWRLASGLPGKHAERDGPTASTAPGQGAMRKDMAGYIAITHKGGECTPKSAILWLLLVVVAAACILWIKMKHTFQTVKGILELTASFQGKDIFQPSENLSADNSLAEDPHFEASSCMQPRAKQTAFCRLPAF

SEQ ID NO: 929873 - protein, 135 aa, Homo sapiens
MKKQAEWAPLHRGWCIQMSTHQSCCGSTKTTEASARGSLERITRNTSRNRQAVPRLHSWDDGQRQRQGLAMVAVIVPALEEAALHRDLEMKGVYAFPVNPPYGRETSKRHSYIKLCSMLAGFIDQKFLGQFCMMV

SEQ ID NO: 929874 - protein, 150 aa, Homo sapiens
MYISRMCVPPWVLPRGQDRRAPGLCGKGASGPALPPITPSHRRNAHTCNLLLHFLTVVYKRRWSLKLMRGDRRASAHGCCLCPGSPQPFQGPGTESGGTRDGGLEACSRLSLLVEDPILQGPVPYALPSPESPRQPRKHTAWEQDPPRPG

SEQ ID NO: 929875 - protein, 148 aa, Homo sapiens
MKPLLRKMPWLIKGTGTFSSSVAPDIPTPIPRSWLDTLGNPRDAAKVMDSCRAEGAAGRPGASCRGSLSTRKAWSARVGLCLSQAWGLDRSWPVSVLSVDTGPGAESVPSVDAGPGAESVLSVDAGLGAVSLHLMWSQGSLTTCALTY

SEQ ID NO: 929876 - protein, 179 aa, Homo sapiens
MTRTQAGRGGMVCLQVSPRISGTCKRTGTAVSGSARPARGQAWLSAAQPTVALWAAHQGNPAWGRHDFIEEKLKWVACMEMESPGTFTESAWCRKPNRRVGTCPLLRSALKPCRCQKKTHTGVFHSLILEASRTDLNHAQHGESKLKRAAPRYPQSTRDWLRCRVWPDTPAEPASCCLF

SEQ ID NO: 929877 - protein, 125 aa, Homo sapiens
MKGHADIYIKRMFWNEYQAVQGKRACAGELPFIKLSDLLTITRTAWENTLPRFNFFHLVSPMTCGDYYNSSHLQPQILDNTQKVPQPFQLISLHCSRAEAAGNASPGCKHRHVVCGSQCLFQWGN

SEQ ID NO: 929878 - protein, 339 aa, Homo sapiens
MLRAANTVANRVQGAWPPGPTFLDKVGAIHWPPMHRYLLKPAGTVAVAVAGTVAGAVTMAVAGFVAGTVAVAGAVAGIVAVAGTVAMAGTVTVAVAGSVALTGSVAVAVAGTVAVAMTAGTVAVAGTVTVAVAGSVALTGSVAVAGTVAVTVAVAGAVALTGPVAVAVAGSVALTGSVAVAVAGTVAVTVTVAVAAAVDVAGTVAVAGAVTVAVAAAVDVAGSVAMAGTVTVAVAGTVALTGPVAVAWHCGCGYDWYCVLAGAMAVAGTVAVAVALTGPVAVAAAVDVAGTVAVAGAVTVAVAGAVALTGPVAVAMTGTVAVAVAGAGVIAVRGRQGLE

SEQ ID NO: 929879 - protein, 165 aa, Homo sapiens
MQMKVFLYESHSVKFTRPSAAGLLEFAGGPLQTLFAWVSAAEAAEQQILVNSKCCCLIVPLEVLSQRSTWPCEVSPAACWENHCSLQSCQTGTFKSAEVSAAFCLAVPCPQRWSLQRQAGHLELWWASSSSSFLAALFTYSSLGNGGCPSPSLAAALQFDLRLLC

SEQ ID NO: 929880 - protein, 140 aa, Homo sapiens
MGIRHLVKLAFQTSGKDRTGTAGKHWGKNEVGFKPQPLHQDECQNGKDPEFDPRCGGDSMVGKALFPAGGVLTDLTSREGSVRCGWTCTYSLPQQFSSTTRLLRRESADAPGRIKTSSFFNPVSEEFCLRLETSYIGLGP

SEQ ID NO: 929881 - protein, 135 aa, Homo sapiens
MPHFPLCAAISSFHASECFSCFPSGFQHFFPTRYIQCVITYVLFWFFLVEESLQTGFVWETFSPVISSRDFSKGLCDGLRSALLQESFGRPAWCLSQQIHRDDPVLVWALSLSLQGLDRHNDGSGIWIHWNGPGT

SEQ ID NO: 929882 - protein, 139 aa, Homo sapiens
MKMTCQGFSCSCLKWGRGGGGETEEEGERQRRRERDRGGGRETEEEGDFLHQGWELAIKIIRQLMEKFNLDLPTVTQAFLKNNGELEATSSFLAAGQRADRYPIWSQQGDIDLQKDDEDTRDALVKKLSAQNVAWRIEF

SEQ ID NO: 929883 - protein, 284 aa, Homo sapiens
MQQVTTNLVANTSLFSTVLEATSLKSVVRGKVKVSAGLVPSGGSRGEAAPGLCQLLRAASIPWLVATTSSLCLPGHWILHRGRRWSCRPVPRCVPTLLSSWAVDGTAPHGARGGARQGGSGRAGAHGSGGGVCSGTAGCRSRALPRGEAAEARREFEHSTSRPALLGDPVHPPQLLARVLSPSLPGAGGAGRLQVWGPPSPRPPRTSAGPQAPHAAPVPARASPSTPPRKLREPSGLGRPREGLPQCSGGLKGSSSTARVGTETEEAPRASEGCEGCQHAVTSQ

SEQ ID NO: 929884 - protein, 162 aa, Homo sapiens
MLYNLLLTLFFSLSFQSLYTFRTYNVDHFRNPPQLGTESLLEALTRRLGCRLPPSREEHSSSFPGESLSQKVLLRSRGRTGLHSHPFCQISLRKQVVTAQVPQNSFFQSRTFCRRGKCVHLGDKQPYRKQEDGCNCWNIPQMRTSGRESGLKAPSSGFCLEV

SEQ ID NO: 929885 - protein, 151 aa, Homo sapiens
MNSNKRDYCNNGGSGSRRDSSNSYICSSSSSSDTDNNNSSSNNSGSHYSEDSSGSRSNGSRNSGDSSSRCSSSSNSSSNSSSSNRNSGKDSSNSDNSNSSSSNTSSICSSSSSGTSPFIAWKNSQKLDIYIKLNFYHVNFMFHFKFYPNHL

SEQ ID NO: 929886 - protein, 143 aa, Homo sapiens
MGAGLSHPVLVISQVCCYQQYEYRLIQQVFTDCGLEFCFHICVLKGDRRGDQERRRRLHEDEGRDWNKAAMSQGTPGATRSWRRQGRILPRPFSRPGPADALIFDFQAPELYLPFWRSRLPLVCGQQSLEGVSVAIYLNTHIR

SEQ ID NO: 929887 - protein, 145 aa, Homo sapiens
MGRNQRRKAENSKSQSASFPPKDHSYWPAKEQNWIENEIDELTEVGFRRLVITNFSKLKDHVPTYSKEVKNLEKRLNKWLTRINNVEKTLNDLLELKTTAQELRKPIRLTADLSEETLQARREWGPIFNILKERIFNPEFHIQPN

SEQ ID NO: 929888 - protein, 141 aa, Homo sapiens
MVQQFQILENMEVSLELGMGRETFAASPFHHNPKVLGGQNGFMSQAQAPTDLCSLGTLLPASQLLLLQSWLKEAQVQLRLLLQRVKAISLGGLWLPYDASQGKVEEGSMRFAFFVVLGSIIPRVESFFPVDLLIDQGRNKV

SEQ ID NO: 929889 - protein, 141 aa, Homo sapiens
MVQQFQILENMEVSLELGMGRETFAASPFHHNPKVLGGQNGFMSQAQAPTDLCSLGTLLPASQLLLLQSWLKEAQVQLRLLLQRVKAISLGGLWLPYDASQGKVEEGSMRLAFFVVLGSIIPRVESFFPVDLLIDQGRNKV

SEQ ID NO: 929890 - protein, 138 aa, Homo sapiens
MFLDECTLLTLWNPHLVTHAIFMKWYVYTHTSQYKESSWPLNVHGNQGETTTYLNLFSSCPPPHGAQSSTEEREPEGSAKAVETDSVTPRAGIRHTRSSEFKDLKSLCNSLLGYFIRLYNTSPPRKRVWALLDTSCKG

SEQ ID NO: 929891 - protein, 170 aa, Homo sapiens
MNSIELAFETQACTEEVFVPPDDGGGLCPCLGPQIFPPPASKIQGASISTIGSILRSPHMQRTLIHTVRTSLSSVAPLVLPSALRAALYSCAGCALHNGAHCRQLPLTSQTLRICEADLLGKYYLLVVIEEILSWLLEEEFADPQSGAAQFQVVHGLCQSKNSLLLSVVR

SEQ ID NO: 929892 - protein, 140 aa, Homo sapiens
MFVCTSGNQRELARQKNMKKTQEISKGKRKEDSLTASQRKQRESRARQLIFRIGGLARKLDLTEMKRKMHEDMISIQNFLIYVALLRDVATFATTNNSAMWIIVLIPIYWCFHFYKNGFLKIEFLGNSYVKAKYNIETNL

SEQ ID NO: 929893 - protein, 211 aa, Homo sapiens
METGRQTGVSAEMLAMPRGLKGSKKDGIPEDLDGNLEAPRDQEGELRSEDVMDLTEGDSEASASAPPAAKRRKTHTKGKKESKPTVDAEEAQRMTTLLSAMSEEQLSRYEVCRRSAFPRARVAGLMRAITGSSVSENAAIAMAGIAKLFVGEVVEEALDVCEMWGETPPLQPKHLREAVRRLKPRASSPTATAKESCSRPTARGQGLFVQE

SEQ ID NO: 929894 - protein, 210 aa, Homo sapiens
METGRQAGVSAEMFAMPRGLKGSNKDGIPEDLDGNLEEPRDQEGELRSQDVMDLTEGDKETSASAPPAAKRLKTDTKGKKERKPTVDAEEAQRMTTLLSAMSEEQLARYEVCRQSAFPKARIAALMQSITGSSVSENVAIAMAGIAKVLVGEVVEEALDVCEMWGEMPPLQPKHLREAVRRLKPKGLFPNSQLQKIHVLGPRPEGKNSML

SEQ ID NO: 929895 - protein, 138 aa, Homo sapiens
MGNNPKNPNKSVSYSLWGRQLALQGSLQTSHPTPLQSTPVMSETLPRPNHFPTLQSPRPPNSPPSYPPRWGDDGENFYPLIICLVPLATKPAPILRQSRGPAKSHFTHIIPDLLTHRCIRSRDSRRQRHPLGKTCENS

SEQ ID NO: 929896 - protein, 139 aa, Homo sapiens
MIISLNIKPYELVRTISQKKKKKKQMRELQLLKSAEKKCSGNVVEGDGRGICRTGWEGFSEEKCAHCWSESERSSISHRIHKSIIKQAFTEDRYDVPGTVPGTVNPKSSPRYIPQVNRRPSSQARCGGEDSDIDDPDPV

SEQ ID NO: 929897 - protein, 155 aa, Homo sapiens
MLEKANVYFAIFGPYCLMRPREETTKQALFMISPVMQSSEGSPDQRMCFQGGSFTRAGLSTGQLECPPNMGLALPKVRDPRETADRSHSFDTEGTGHLFCHTLFVRSESLNQAARSREENQTPPFEASFQKVFKYFLTYLKIITPSYMFLPNSAS

SEQ ID NO: 929898 - protein, 134 aa, Homo sapiens
MGEAFLGPFFLGVELYAEQDYPVCPKQLWLRTKPGEEADKRDCLGNELLTSLCGTMDFSRSPFQGSYKYNLPEARTKEKPESVMRQQTGNVKRPNQAVHQQGVHGLQRAGTPLLRGSWKTLGKAVDACEPPFPY

SEQ ID NO: 929899 - protein, 142 aa, Homo sapiens [sequence omitted]

SEQ ID NO: 929900 - protein, 180 aa, Homo sapiens [sequence omitted]

SEQ ID NO: 929901 - protein, 154 aa, Homo sapiens
MGVPSGTAFAYSTPWGGRGSCVGQCGIAAWDVDILAVVGHVLQGELGSVAGAQSHGAGTPSQGGAPISSFCRDRGRSDLPKDLEKLHRFDIQSVGMVAVRCTPEPQVSHSSIHTLTPLTTGGRQDHGLQHLCVKLVVGPGAGVIAILGAGERVG

SEQ ID NO: 929902 - protein, 190 aa, Homo sapiens
MASWQRIQTSYSNLGDPSDGGRSFDWTLGLGSWWWSSPGRGNAKNKEWLLVTIVGCLVKDMKSKSLEVIYLFSLLIKKSEVIDSFPVASVKDEVLKIMSCKSRSSLASRPGSKHLLPLETIMATLTFVFSDPWRFLNMSYHSLLAFKVSTEKSAVRCTGALLAALGSNAKSQILSPCHVTVAGRDGPGVA

SEQ ID NO: 929903 - protein, 150 aa, Homo sapiens
MSAAPAVAERGQCRAWAMASEGASPKPWQLPRGVEPESAQKSRNGDLESPPRFQKIYGNAWIPRQKAPHRVPTGASGALPGAAVRRGPPSSRPQNGRSSHSLHGAPGKSADTQCQPEKAARMGAIPCKATGMELSKAVGAHLLHQCDLDV

SEQ ID NO: 929904 - protein, 126 aa, Homo sapiens
MWVLIGIELNLLITLGSMDILTILFLAVPEHGMSFDLFVFSLISFISMFYIFQCTSLSPFWLSLFLGISHGEREREKKKKKRKKKKRKKKKKKKAEEEEKGEEEEEEGEEGEEGGGARHFKRTDIV

SEQ ID NO: 929905 - protein, 160 aa, Homo sapiens
MGNMVRPVNSMSMSPLLHCFSHKVSALVRGNAVWNTVTVDNAFRESMDGSLGRNFACRIGKPISKLSAEDSRALLQNPRGLCCDSPVLACQRLQTASLSAIDTLVTIGFIGSYGPSGRAACTAAWAHCTAFSSFGPYPKLAAFQQKEYDLLKAQMIISSL

SEQ ID NO: 929906 - protein, 416 aa, Homo sapiens
MCPTEELIQDTTQRLFFLQVKEGILSDDIYCRPETAVLLASHAVQSKYGNFSKEVHKSGYLAGDELLPQRVLEQHKLSKDQWEERIQVWHEEHRGMLREDAVLEYLKIAQDLEMYGVNYFSIKKKKGSELWLGVDALGLNIYEQHDRLTPKIGFPWSEIRSISFNDKNFVIKPIDKRAPDFVFYAPWLQINKRILALCMGNRELYMRRRKPDTIEVQQMKARAREEKHQKQMERAMLENEKKKREMAEKEKEKIEREKELMGRLKQIEEQTKKAQQELEEQTRRALELGKERKHAQSEAEKLAKELQEAEEAKELELARQKKESEAMEWQQKAQMVQEDLEKTRAELKTAMSTSHVAEPAENEQDEQDENGAEASADLRADAMAKDRSEEECNTEAEKNERVQKHLKAPTSELANN

SEQ ID NO: 929907 - protein, 144 aa, Homo sapiens
MQDVGSHGLGQLCPCGFTGYSLFPGCFHGLVLSIYSFSKCTGQAVGGSTILGSEGQWSSSYCSTRQCPSEDCVWGLQPYILFCTALAEVLLEGTATVADFCLDMQAFPYIFSNLGGGSQTSILTSLQPQAQHNVEATKAWACTF

SEQ ID NO: 929908 - protein, 141 aa, Homo sapiens
MWRVAHQLTPAHQQATNQQNNVKFGQGSWRRAWAAEMLPSPKPPWPVPPLILYSEKLQAPPAEWQSSEGEKTQLHVGEEQLDFRGMLPILLRATFICNKFSAYIIFNSFPSVDGKAERAHCNTCTLGLWGSWLSPYCHGAA

SEQ ID NO: 929909 - protein, 147 aa, Homo sapiens
MSAQKGLPQLRCRLKPTIPKALDLELEALISHCNSKPVEDLKFLFKRQPQDNPSIYTIYKEPSTGNADLPQTIYIHSLQNNANYTCSKELNFTITTFTFESTLCTSGTFTRNSFISQMQLTETPHFPKCFQLFHENATIVPEIQTFR

SEQ ID NO: 929910 - protein, 163 aa, Homo sapiens
MEGQTLGPPGGNLSCNTVTEDLWMMWTNPVTFPAAAFSPSFCYIFATDCWALEANKRTSAKLLAQKKTGTIWRTQKKSVTLPRDLLNVFDQNTDSDISSEALAEVGSDGDEELVGNWNKGDSCYVLAKRLVAFCPCPRDLRNFELERDDLGYLAEEISKQQSI

SEQ ID NO: 929911 - protein, 161 aa, Homo sapiens
MGFAVLFILLCFHVLIIVLFIFLLQTCSRVYNAGPNLSLAALELGGLAFNIPQHRFPGANDVNGGGDDNVGVDGDDNIGSGGGEDDDDDGGGDDDYGSEDSDSDDSGDDDVDGNDDGDDDDDEENHGDSNTDSDGNDDDGDSDDDDDDDGNGNGDGYNYYL

SEQ ID NO: 929912 - protein, 142 aa, Homo sapiens [sequence omitted]

SEQ ID NO: 929913 - protein, 146 aa, Homo sapiens
MPVLRERRRSSAFVEQLLGPVHGRNTCSILGKGPNIKHDTSTHEARRSLPGSFRCLENMEEQEWRRIRKRKELTQRVVTEGLDSVPHINRSLTVGHTQDDVTQDPMTVNQTHSEALGIVLGEALQVGKANPIPVGVKLSQHELLPF

SEQ ID NO: 929914 - protein, 160 aa, Homo sapiens
MTTSYICIVLICCSLRVMCLLSNVLGWLNGDHQNADRNMDGEVQADKVLYRNEEVIGNWSSAEEKCEVGALCRVPTRALSNGAVGREPPLSRLQNGRFTIISHPLPGKVANTELKTMKRATRLHPTKPQGQSCTRPWGTTPWTSMSWMQDMESKELALQL

SEQ ID NO: 929915 - protein, 148 aa, Homo sapiens
MLARTQGDTYLEGAEIGTKFGHGAVKNIQSCYVLQESMMTFSSCKLPDKVEIIFHLVPMSSSSQAAHHKERPSWLSAQLPEQYPNHQNHLHPPFVFPPSHEKPNLRLSIALFSQGFTGNQTNRIYYKELAHMIMEVDKSKVCRIDVSV

SEQ ID NO: 929916 - protein, 162 aa, Homo sapiens
MWAVLPETGVLDNRNLLTHGSGGQKPHIKVPAGWVSSEDSIPSLPPASGSAGSGLWQHKVGLHTTLSLCVRLSPGFSCSKTNSLRLNPVEDMADDESKNKIIRLHYQKTPCSFDPEASRTSEEKIGAEELCAGDQKKKTEAQHEAKEENKSKSKTLSRHGVA

SEQ ID NO: 929917 - protein, 151 aa, Homo sapiens
MQWWRMSSTKEHIRLTDLAGIALSSAFPALSSKCYHLQLTSCVFVPPHITFCSQGSTPGQEAMNLQFHHFFQLLLVFVSPIFHGHVTRTQLLDELRRRYYNIFGAHNVRLEKGEQQLPTTIPSLPGLGHMAQEAPGCWAPPSNWVFFCLSV

SEQ ID NO: 929918 - protein, 145 aa, Homo sapiens
MSAYRSIISNSGSWKRLVSALETQVARGIDKLYNTLHSSEMKQASLHHSLSSSISGTAAAFLCKCKRLSQDRPARRTSMQMRTDEVLKPQECSERKKNRIWLEKILGGNSDLLLPEGILRRLHGIVEEAFTGQTSQEDIHADEDG

SEQ ID NO: 929919 - protein, 423 aa, Homo sapiens
MKEKGTCYLQHFSTLLPSSAAGLRRFVIIPQSFCQMWAIPCCGSTCLPRVALGPHPPGQFLPFMKTAIYALLPPPASQGTWMPSLEVDPNCFCPTHSQSLQAVLVHFHTADKDIPETGQFTKERGLIGLTVPYGWGNLTIMVEGKEEQVPFYMDGSRQRENEEDAKAETHDQTIRPREIHSLPGEQYGGNRPHDSISSHQVLPTTHWNHGSTVQDEIWVGTQPNPITGSVGSVSSMFLGFVPFSHLHENSLSHPTFCRPTQTAWSLWGLHTLSPQYSPGNLTCNCKQGTSPTGRQWDICVSIATARRILKTEPGTEDAWEGPVEMVSCEGYGEEEEEEEEEEEEEEEEEEEEEEEEEAAGEGEGEGEGEGEGEGEEGEGKGEGGGEEEEGEKDGGGGEEKVRREKEEGEEGEGRGGGKEEEGR

SEQ ID NO: 929920 - protein, 188 aa, Homo sapiens
MAELGQEGCGHLQENRGWGIGGGPSGSIDIECLLNAYGRNHCKKDVRKICPVHPGRQGLFAESNNAGWGRRRSWSQGRSQGLMVIDFRCVGSDWGGRRQRALLMAAGDTVAAMGVWGWGITGLQRRRCENPDPCSPPGTFTYHSQPCWSLTWSKADPLPHASAGPGLPCLGPFTQYSSILSRGLGPHP

SEQ ID NO: 929921 - protein, 144 aa, Homo sapiens
MEEQRQRIPELRERKNRIGASNVEEQATSKENAPKKGDLTLTTNSALNPAAFLTGNPNPKDPEHDCLDLIDYHTKVRPDLRETPFETGRHLFIDGSSRVVEGKRHNGYFAIDGVLAEIESGRLPNNWSAQTCKLFVLNQALKYL

SEQ ID NO: 929922 - protein, 148 aa, Homo sapiens
MRRESLTVKELQQGGQGFIGKREKALSSAKRIPNPDGRGLLKRSSKKKTCIRHTVDLLKETSVKDREERKQEEAVESLQTSKQVGVWLLIKGYRHVFEMPRWQNQDDETSEGSGNFRILACSETCSQMVSLLLPAPGPKFRFSLDLTG

SEQ ID NO: 929923 - protein, 320 aa, Homo sapiens
MNESSFAEQEIRKAGYAICTLNDTIESMPFSSGRSAQLAELIALTRVLKLSQGKAVNIYTDSNYSFLVLHAHVIIYKEKDSLPWEVAVIHCKGHQKEMNEIAAGSLDWEGPYTVLLCTPVKITGIDYWIHYTRVKAWETDRITSVDPEEHPKHQCEEIGDRKLKITKYAGAQCGSHFQHAGSSCRLNTKPRRYGIQASSPSQAQPAGLSGQSKPSKPELSPRQRAQRPRRLQAGKAASKEYWNMVTLPPVHRPMGEKTEVRTKQVEEGGYAVCLLSLLARSVFLCQMLASSPPALGHQTPGSLAFELWNLYQRPRDMVDR

SEQ ID NO: 929924 - protein, 149 aa, Homo sapiens
MVCSIGQRLVKGWYQLFFVYLVEFGCESIRSWAFLVGGIPEEGIVIKDDDSPMSVIFPDDLPVIQEVGDSLACSWASEVTSESYKLVSPELFASQALIIVVEFSILTVGSTHSDIIYFTKEKDSNSNALKIPFSPLIPCLWERFGFPPV

SEQ ID NO: 929925 - protein, 123 aa, Homo sapiens
MNGPKEKTIAWDKGPLSSGEGGDKLWEGTLRVVLRLVPNIGGRSTFMDQTAMYSVSPTADTPEGGPKAVFRERTLCPLLVKPWQTCWAGMTYPMCKYLENPTVLPHTQPEAAFSDLLVLVLLH

SEQ ID NO: 929926 - protein, 160 aa, Homo sapiens
MSEPVKGVSLHLQLVGTSVLREQLTSSFITKPNTHLAQEMELLKEDTGQVEQLQPSNEQQYRISKSQPKQVSHQPQGFSFSIITQLSLKARHGTQPGALSRELLAVVPTGVVLPEPMASLGEPNLGAREWILMVYKKEVAWDMADLLTLEMFAPQMRLQD

SEQ ID NO: 929927 - protein, 146 aa, Homo sapiens
MGVGLSHANLMIRQDLTTFSGLVWNSWPCYQRQIPQRQTHTEGRPCEEIQGGDGDVTGVTHLKATGCQGLPANMGSWERPERILPDSPLSGHRSSWRVVSFWIVTYPVNEACVTTIMENMQMRKKVSQCPTTLNSGSTPICFLIFV

SEQ ID NO: 929928 - protein, 147 aa, Homo sapiens
MLWMTRREELWPFGKPGPRASLSQSCDTLFGALWFLASPGFQVPLSSPFPGLQPRTEPAPVLVPEAVHPITATSMPGCAQWSDPVLAHSLPHPLLLLNWLTLGRCGIWVGSRNQAQPARLSWGNEPSGHKQNPSRGTTSHRGFWLAK

SEQ ID NO: 929929 - protein, 178 aa, Homo sapiens
MTLHLIASLAVGGSLEWSMALWQRQFPANSPQSVFPAAGEVSSSVLRGDLGAPPIHYPILKNIRNPDLQKEKSFLLKGLAGLFQHVQCARRQGNSSATPVGKSESRTPNHHFLLVAIIQEIHPTMEGKECSRPKNGNKRSRWKSQHCPAWGPKIMTSGKRCRSVEEFELELQGKGGLL

SEQ ID NO: 929930 - protein, 141 aa, Homo sapiens
MLASPLLSAVIISFLRLSPECEQILVPCLYSLQNSCEIQTSYLLPKYNGGTGIGYTCTFQKGATGKKKGVTGPKYLLQQQSYFLVPIFYFSPFSAAISEDHRLVGDMTVKSMTKKLFPQCILVRLSVHGHICPPQCPLQPD

SEQ ID NO: 929931 - protein, 160 aa, Homo sapiens
MAGKVGILHHKAPDAEQSVREVRMGLANCQSSEEGASLAARALPGGGVLELSMKEDWVKGQLGWENGWAYAWLAMNAGEDASCPVSRQKGGHSHKARTDGPLNSPQPLEGTSGENLFSECLHLQDPKAFSAIAPVPREMEGEKQTPPPLHSLWLCNSLDH

SEQ ID NO: 929932 - protein, 150 aa, Homo sapiens
MNISEPLISSKFYGQIIHPHYLQTSGNRIRQRHKQLDVKRNTSVEHTDKYRQMPTRWQAIDQRNDVEFGQGSRRGAQPLGGLTPGKKPPSHFISLLAPPSAESYFSQSCYSGNLLSSIRNRSYNMALTFMSKEHEADGKVYFSEIVSHRE

SEQ ID NO: 929933 - protein, 153 aa, Homo sapiens
MSRLTFLQTSSIPTSDPLEDPPLDFMGEHSPSFFIQSSAQCLPLQPFQRFWGPPLSLTKKFFAYTSCAAKKSHERLHWEEWYTPAQILCFFHGLHNQQTRRFPLVPGSAGPMPMEPSKLKFISLKFLLLVQQSEINLGCWSLVGGGISAIAEA

SEQ ID NO: 929934 - protein, 152 aa, Homo sapiens
MKVFRWKLGNIVGVTKNPANILCLCSRVLSLSFFSFPQFGGSKLPFNCGSDRQFYCMFRYSWYKLTWEDLKRDSWTLLHVDFILQQFYRKINLKTIYRTNYRTRIGDISKNLFPLIWMRADETMNRERWCGEVETKDGFEYSFRGKGNKLPD

SEQ ID NO: 929935 - protein, 189 aa, Homo sapiens
MVSSFIHAQGYFSQKLVNPARTRSISSRQQISFWPSVGLGMLSRSKDLESRAPGICLVNLSWSCNAWSWVRVDMGTPFSCHNWYRTGSCTSQVHWLQDQCSMSVCPKTPVIVAYHSNLFWTSGHLNQLVVKLARNQFPPTGVENPLLARSGLNVPSTNTSRNLSCVVLCCYRETLSSSAKTHTHFTLPS

SEQ ID NO: 929936 - protein, 322 aa, Homo sapiens
MAGTSERSLISSISQPKAIECFEVKKKAFLTHGRYHGSGATPPKTKDPKPETFCGQTGLPTMEVRINVSRQQVEKVFGLEEYWCQCVAWSSSGTTKSQKAYIRIAYLRKNFEQEPLAKEVSLEQGIVLPCRPPEGIPPAEVEWLRNEDLVDPSLDPNVYITREHSLVVRQARLADTANYTCVAKNIVARRRSASAAVIVYGGPRDSLVTGRGTAVPLGSDMWLVGERWVVDVDRVVRLQRQLWARLAETEPELHQPGASQRGRFLWSPWSKWSACGLDCTHWRSRECSDPAPRNGGEECQGTDLDTRNCTSDLCVHSESSLP

SEQ ID NO: 929937 - protein, 147 aa, Homo sapiens
MSNCFSNFLCPNLAFQNLTLSKFQNYAFCFLFTQCNEEPCKIASDEPPLKSCLSKWASHAAFIPSLSASFFIGNLQLRQEIKEKQDTFFSRWQEGDLLSEGERTTYKTSDLVRTHSLSREQHGGNHPNDSITCTWSLPSHMDMMRIM

SEQ ID NO: 929938 - protein, 238 aa, Homo sapiens
MHSYIGDYWLEEMKDRRFREMLFPKVEGSGKVFPPEVEPAIGPHQRQMLALCFSYSLQNGGARCYLKGWTGRWNVRCRELPAQPWSRGQSWAELDSQSQPQLHILDRQERFPIILLSRVSCVSVQTDTAVYLQAAMKLRATENTCTMVSGRSLFPQPKTDSFAGHLFSTARTLPLSVERGRGSAYGARRSDSAVAPGDQSSPLCSYGSQGKKSGSEDHKQTETLKLHDEAVVTVNTLG

SEQ ID NO: 929939 - protein, 140 aa, Homo sapiens
MRESLELPRDLLNGFDQNADNDMDNEIQAEVISDGDEELVGNWSKGDSCYVLAKRDWQNFAPALEQQSIQNVTWVLLKAFSFKRETEHKSLENLQRDNAIEKKIPFSEEKFKPATEICISNEEQNVNHQDNGENVSRACQ

SEQ ID NO: 929940 - protein, 156 aa, Homo sapiens [sequence omitted]

SEQ ID NO: 929941 - protein, 144 aa, Homo sapiens
MAFVKQEKRGPGVSAKRKKVEVGVREPESEARKLHRGKRACGPHQSLRERGTALEPALKPQLHSTQLDEDGKFPEVRNAFAICLAQVVYLRWSHHKQLCACLLMSIAVTGGEADYHPTGALLLEGISGPYPICRWAKARIYRVI

SEQ ID NO: 929942 - protein, 141 aa, Homo sapiens
MKIYSSALQEGELSSPWSTCMHQVTRRGPQGTCLSNCTQVRCQLPEVLPEQMSRCKIVMVRDVMTVLCQPCFSHKVSYSFVNIAKHFYYAFQRFSNLFKAFGFYIFAQMGKNGVNVYVEYTWGGEGVVIEAEETLQNRKQE

SEQ ID NO: 929943 - protein, 134 aa, Homo sapiens
MSFLPYAGFKRLTMPNVNKAVERPTHLYNAGGSDESRKGEDMNKCGQYVISNEKLSPTLGTGEHWASECIQKTSNTYTCLASCFLTALEVQYGPRSLFQYSTIRISLNEQTASVNLKAEHLQAPAELYSQQDRG

SEQ ID NO: 929944 - protein, 185 aa, Homo sapiens
MWLCSKSHLQKDGFGKAASPERRNVSGASDLRPADSISPNHTWLRHKPNTAAHIVAREVSSQTEFLWLTPRSPPFTVRTRRGSAPGGGRAVLRPPLRCAPGLRTPGRLGAAGLARPRGRAVPRAWERERRQPGLALPRAARKKPLAASIHLLACLKLFINSPRGAPAAAAPPAPRWSGSSARRTC

SEQ ID NO: 929945 - protein, 168 aa, Homo sapiens
MSGPLLLLPLTFGRPVFQKNSGWELWESPILVRQEEVGGILKETEVDELEMPEKSLGCSPGSQERSHGGGKLSNTSHDSWPQKSVSKLPSLRGLTLLPNRKPMEQNNLYSSPRMVDHYKETQRAYNERKPTKTPKKKQKNPMGCPLLLSQSDPVKIHLHQRSYRASQY

SEQ ID NO: 929946 - protein, 187 aa, Homo sapiens
MGLRSKTQAWAQILALSLTSCAVIVLGPGKVRRLCGGFYRGPCPDMDALGLGRGLPECGAGAQTMRSFNSVRLHGKGSAESEVVGSTAAPLGRSGMGAGGDQMPGHSRAGDEHMEQPLLMQIEKRLSHSRSPAPLGLPSSVHFNASRVSSAPVLQQTWHGVQKGHMPSVFSGFAKLVKETGLTTGTI

SEQ ID NO: 929947 - protein, 250 aa, Homo sapiens
MKQSSGICRLAFISHNISRESPEKYLENPLSSKIALSLGCYICCTDAEYSRPTPGSLATVSHVVTAEFNSQRRTVLQGSPSKEVKDLLNSSTSHPACQFVNGSTRNYATQTSRNRDKNDSRLLCRNYATQTSRNRDKNDSRLLCRNYATQTSRNRDKNDSRLLCRNYATQTSRNRDKNDSRLLCRNYATQTSRNRDKNDSRLLCRNYATQTSRNRDKNDSRLLCRNYAIQMTDDIFKETKDECGHPGILC

SEQ ID NO: 929948 - protein, 407 aa, Homo sapiens
MENIDSPWHELFRELCKINAFDTCDSLIIRGKEFSDSIHNTFYHMRRTREHNEVGWLLLSSLDKVKKGNDELRDSNSLPQKQKLSLKSSKIALRDLRPFTTVTVHWGKGNDQTFQGLLDTGSELMFIPGDPKHHCGPPVKVGAFRGQVHEKQFAFSWQGEEYTFIILPQEYINSPSLCHNLIQRDLDRLSLPQDTTLVHYIDHIMLIGSSDFEWGPEQEKALQQVQAAVQAALPLGPFDPADPMMPEVSVADKDAVWSLWQAPIGESQQRPLGFWSKALPSSANNYSPFETKLLACYWALMETEYLTTGHQVTMHPELPIMNCVVSDPSCHEEGLQMAQTLQELVHSSRKKNHGLLKCLLKAENTEWVVEEASPLAEPNQKLKFTEAFWVRAECKGGIMNLYRPNRK

SEQ ID NO: 929949 - protein, 162 aa, Homo sapiens
MVELPPSWADLGCKVNVVSRYSPVYLLPGVKHELLREFSLTLRRNVWPQFHVGNQPTLLAVLSNELLNTHYLRPNTGLSQWEALLTQVAEQPGGNKPVLEIWRTSWEKRQQPPDPSLFLSHQIYSEEEESSVHPNLNYCIQRKITTASHSTRIAQEQESHLT

SEQ ID NO: 929950 - protein, 191 aa, Homo sapiens
MEDLREIPLENPDWTLFIDGKEVAVMHCKGHQKGSDEIAEGNKLANQAAKSAARKPQSANTLEAPLIWEGSIREINFSILLQKQNGPFLADSLSSHQDGCSQRMASSICQPPTKENLLKTVKQVVNACEICLKNTSLNRWLLLHRAQRMGSYPGEDWQIDFTHMPKSRGTQYLLVSVDTFTNWVEAFRCQT

SEQ ID NO: 929951 - protein, 167 aa, Homo sapiens
MAPAFARISLPNKGVGLSGIIRKACEKSKAPPSQLSDWEKYLVTDCPRTPQTVTDLEDSCPGQESKTEKAAPVSRRQLTSWPSMVKHTWGSVRVTAWAGACPGHPQSCCWIICPIGSGNGRLAGSGAQQTPCWILWMDGSQRRVCDGGKQQWWTASKSSARDLIFNL

SEQ ID NO: 929952 - protein, 162 aa, Homo sapiens
MIKVKKNEGASRLHPTESSSLPNLSTGASDGPHPCLHCVYVGYEGLFSLPELQPSFWRAEACLPPYHVLYKPLYLAHSGSSQTIARTKNQTPHVLFLSCHVTSTSWLPFTICHEWKQPSPEVEIGAMLLVQPAELSPKQISFLYELPSLRYSFMATQTDQDS

SEQ ID NO: 929953 - protein, 150 aa, Homo sapiens
MRISFGKLTTFGNTWPPFSELSDSSAFSALVDQWCQIATFIEEAVYGSSRGTGPCGAEILHRQCAQSSSSEAVLQSYLYPLLITCKLRGVQSTKEKFRPLSQKTSFSTLRSKEYAGEMWHSQYWGFCYNRVRERARKGGEKQKTAQKVSQ

SEQ ID NO: 929954 - protein, 501 aa, Homo sapiens
MLPALKHRTPGPSVLGLRLALLAPQLADSLLWDLVIVGEVESVTHEEVCYTGKELFEFSNLYKQKSGEQAWEWILRVWDKSGRNIELDEAEFIDLGPLSRDFAFNVAARGVKKVLILYLLGDCWPFTRVTVHWRKGNDQTFWRLLDTGSELMLIGGDQKCHCGPPVKVGAYRVSECMIAIAILSSWQSPHTGSLTGRMRVIMVGKAKWKPLELPLRRKIVNQKQYRIPGGIVEISATIKDLKDAGVVIPTTFLFNSLIWPTRSNFPSAGKASNLPLLSYFRGIWTLQLCVIILFGENLTSFRFHFAITLVHYIDDIMLIGSSEQEVANTLGLLVRPLHARGWEINPTKIQGTSTSVKFLGAQWCGTCQDIPSKMKDQLLHLAPPTTKKEAQRLVGLFGFWRQHIPHLGVLLWPTCQVTRKPASFECDPEQEKAPQQVQAAVQAALPLGPHGPADPMVLEVSMADKNAIYSLWQALIGESQWRPLGFWSKALPSSADNYCFF

SEQ ID NO: 929955 - protein, 173 aa, Homo sapiens
MRLICLEILLLLLLLLLLLLLLLLLLEKSCLDALPTTIWLRSILVGFVVTSGDLAFFCSAYLEPRANFLHEFPPGRRAIPAALLDWSVERRTLGASGKVFGSGVMASALNSSPLTQWGGAMQGNEDEAKRMGGWDLEKTCGLFVGPKCGSTIWAACGDFTYVIALLKGFNQQC

SEQ ID NO: 929956 - protein, 143 aa, Homo sapiens
MCMSHLGILLDIGSWGSFLKIVIQKICGGAHEFASLRMLMLPVPEHTASWYTASVIIRFLKLLLKPLKQCALEAGFFEDLRNMAIEKNTQPYFPLSLPERYMTAWVPHTRLFTPAYLSLREFLIWEEEGIENAIKDPGLVWNR

SEQ ID NO: 929957 - protein, 141 aa, Homo sapiens
MFKFLNSPLDEGKMNPFSAGPFHLLFLTVKVPPQGNSPLSPSFSGLCCLASPSSHWECYGLCGSHPETLTVCLVGGGANGRGRGGHQGYLGQLHQTSKEKQDQTTLGCCINQPKEITDNFLQNLALFPLVKFDSEAAHTRV

SEQ ID NO: 929958 - protein, 185 aa, Homo sapiens
MAEQEQRKIPLVPENLLKKRKAYQALNATQSKQALLAKKEQKKGKGLRFKRLESFLHDSWRQKRDNLKMLCIVEPYVTWGFPNLKSVRELILKRGQAKVKNKTIPLTDNTVIEEHLGKFGIICLEDLIHEIAFPGKHLQEISWFLRPFHLSVACHATKNRVGFLKEMGTPGYWGERINQLIRQLN

SEQ ID NO: 929959 - protein, 129 aa, Homo sapiens
MLELARTLSPNSYHQHPSFSRGEKLKLREFLFSPASGSLPAFPTTAGPPIMSFHSMSFPHNVDEEKEGATVEFVWSPQAKSRFYHLFNVFLDCCSDNPIIPLYSQTFSDYILPCSIAHHSLSYGSLAFP

SEQ ID NO: 929960 - protein, 136 aa, Homo sapiens
MDIKKEIKGTGDSKRGGFPQLSVSLAVCSYLALEHKNLMGIPGNATLYGSVAGLFNWEKSQHEYLGHGQGKVCKTRSDLGTSKKDTGEKRERKNKGEGEREKKREKDERRGNAVTVPECGALRFSLACQQLAVAVG

SEQ ID NO: 929961 - protein, 144 aa, Homo sapiens
MVVGIGRLTGALCSSPCAAFHRLPECPDTWQLASPKKPSNDIGGPSGLEHDRMKQDEQVKARGSGWRLWTAGPGWYPRSAARMGIESKGHSTKNENSLLQEWHQAIHEGSTPMTHIPPSRPQSQQWGSHFKMRLSGAKQTISKP

SEQ ID NO: 929962 - protein, 148 aa, Homo sapiens
MAVSHLPTMVQETLKSDELVTERQLPVCQQSCKCAQAPRGCQSLFQRTMCRGSPWSRRMNLLLQESVTFKDVAILFTQEEWGQLSPAQRALYRDVMLENYSNLVSLGLLGPKPDTFSQLEKREVWMPEDTPGGFCLVFERAWCLIQAL

SEQ ID NO: 929963 - protein, 136 aa, Homo sapiens
MRIAVPPSQSCCGDETVMQVQWNGACANNETVFHCWSYRTVLTSEKEGNAKELDPGCCLGPERGQVPSTPSSSFFKYVYLPVFHIIVSIAAGLNLFLQTQCKKLMSIYFPHFQLDPSLCGNIHLNPSGGEFNLHYS

SEQ ID NO: 929964 - protein, 157 aa, Homo sapiens
MLQKTWKIEDPGTYGSGDTGGFQTQEGTPARYHFESPADCILPWDPTDLATPDSLSPIDLPLTQTLLLLAAASISNVGATGSYPPSPSAGYRTFRSTLRTGYPTSNYHLGPKCVLPVALLRLLPMKATPATWLGCSCWSSHPSIPLRAWKSPRPCLP

SEQ ID NO: 929965 - protein, 297 aa, Homo sapiens
MWNVGVGTDSGCQESRQSLSRTLACSQVKEAGPAGREAQMEGWEAPVSLFSGTYPSGSSGGDEPVTGGPSAARPGAPTVSAGSCPSVLLTLLPTQDLRSSRLLLAHSPQWVGGQSLLPKTSRQRPSPDHSQKEVKGLQTPVDLQKGTLEQKHITLQGTWSPHQRLTTGGTKAGKERAPIHAGRQPVSSAGPPGQWSVPLTQASKTRFFPMGAYPPLAPSQDWEQDLHQPPLELVEGFAQAWPKADPPWDGAFQGLPPSSSHYQSHNLQQAQGREILRAGHWNRKPVQRVWDFLMPKQ

SEQ ID NO: 929966 - protein, 182 aa, Homo sapiens
MLWVSLKMPALGPTSLCAGRPCLAGFTHPLLPYGPPWASDPFCERSSRQCPETMARAERWDMRAHRHSGSLHPALRSHSAPGPELQRKQGVATESGCLSWWVVAVLLASSQNGGLWQQSRCQTVGWWGGLGRQSGEGRTLLLALGAACRGHRGCLSRWGWKPPPAAFAKVTLLMMPYFSIAY

SEQ ID NO: 929967 - protein, 139 aa, Homo sapiens
MMAKPFPPALDELLPGDPRPSSLPGPADLIPAGERVHVSESSQLESLISGPRARAADRGENQGLRLLRPAATKHRTLDGLYTAETSLSHRTLGGLYTTETSLSQFWRLRRCALFLSIPPQLSLGGQMHRQPLRETSMPS

SEQ ID NO: 929968 - protein, 414 aa, Homo sapiens
MVAVGIESKGWSQKQGRLHRLEVMPPISDAMSTKGSVVLAYSGSLDTSCTLLWLKEQGYDVIAYLANIGQKEDFEEARKNALKFGAKKVFIEDVGREFVEEFIWPAIQSSALYEDRYLLGTSRQALHRLQTNGNHPVEGGQVYVPQHHGKWEQSEPSTSRSLHEDQDPAKAPNTPDILEIEFKKGVPVKVTNVKDGTTHQTSLELFMYLNEVVGKQGVGCIDIMENRFIGMKSRGIYQAPASTILYLAHLDTKAFTMGQEVRKIKQGLGLKFVELVDTGFWYSPECEFVCHCIAKSQEQVEGKVQVSVLEGQVYILGQESPLSLYKEEPVSMNVQGDYQPIDATGFININSLRLKEYHRLQSKEYWFLNKGLNFHFALDSMNDVVSPSQKMFCWENQQDFVIHRKKQCSSQDDI

SEQ ID NO: 929969 - protein, 150 aa, Homo sapiens
MLTRVPWSSKTLSCFSSTPSPASLHQDLETLLRQYGPYCLVTAMRSKKKMSSKHKKVQNEVTNADVEAAASYLDDLFKIMDEVGYIKQQNFHAVAAIDKNSSDGTGKTILKTFWKGLTIIDVNGIKNICYGGQNTNINRSLEEVDSNTHG

SEQ ID NO: 929970 - protein, 143 aa, Homo sapiens
MGNMIRPMNSKTMSTLAYVMCYKTNFLVRSNAVLNTMKKLILSLVGLTAKVLPGLEKVETRESWDFYYFLLASFVCHKMPKCRAPDLQGMELEHKAIEAVTISFLASNTGGPFFMRRLGNGTPYSLLPPTLSSDFSPKPLIGV

SEQ ID NO: 929971 - protein, 139 aa, Homo sapiens
MRPEQPDFGVTGAPTWVLLRGPHGACSCQWPNQPAGSRTHLLTPGLAAGPTWSLLLLAAKWPAGSSTHLLTCFLLQGVEHHGLSKWGTPVANPTKRSRKILHQTEASQQAGSLGTQMELERSRFRTVSVNGEEVSKRFF

SEQ ID NO: 929972 - protein, 170 aa, Homo sapiens
MGKGMCHFQVSCFTIPKSYGATIKLVHLGSNFQPCQSAGLAVALIRYDCRSRSLQKRPMLKESVCAKSLEIFPFNKPRRKDAMQIHPKCVPLGCGPSLLLAPSVQVWACDCVYSKKSRRQNPSDTKLKKEGVYSAGTSARLLSQEPSSLSEQFLSLLKAHNSEGVCLRGS

SEQ ID NO: 929973 - protein, 172 aa, Homo sapiens
MQKSPIFDHAGDCRLELFLFSHLGMLLWRNLWRDSLRPCKYPSSHQNVPLDLISIDEFCLIQPYKNAFLSHPVNLPGSGLVLSVVCTESCDVNCLWVSDLWIPAPVPGEMVECAVDSMRVLSFGESISYSSYGKGPVVGRALELPRLYSLCLPLPGWIGKHHQNPTVDMLVN

SEQ ID NO: 929974 - protein, 164 aa, Homo sapiens
MDGMCLGTEGRWAALSMWSILVRISQKVVINENWEPEGETKVSGRSKNRVINSTQFAGNGNILRMITNHIPQEKHLYTNVEHIINANPGTILLWQVSLFLTVIDSCAFSGLFVEKICDLERHNFHVNKHHLGIVLKCRFSRCELKYCTFDKFTDAVDSALGTTF

SEQ ID NO: 929975 - protein, 143 aa, Homo sapiens
MRRRNRKTRRYGVLDTNIENMELTPLEQDDEDDDNTLFDANHPRSVEFLGFFVAQAIVQNQKNFKSQSPTSNVLLDFRDKASVEPVQKKSFQCPGLLLVQLKDWQLVFVFSLQGLVVSSFVYKNVPFDERTLSFYNEEWNFYV

SEQ ID NO: 929976 - protein, 139 aa, Homo sapiens
MGTLMLSLWTFALELFSGGAHKVDPLHVQFTVGFVHLRQSNVSADLTRSGAQVVTLGCWPLPSCCATGLLMLTVEGVQVLGVLKKELDKMRKQSKDGMKGFIENKSTLHSVVVGLRIGAQSYRVFVSLNTLYLGYALCK

SEQ ID NO: 929977 - protein, 136 aa, Homo sapiens
MAVKVIRGSVLLTLSLQENGAENHRAEDPFVLSVRTTCPGASVAPPITDLVTQHKVSRTEEPAHHGWHRTIKLVSLEPPVLISVLFLPSRGSRASACHLSVLPLPTDLTSPSSINPSPTLFQTRASFLYTPHPTLA

SEQ ID NO: 929978 - protein, 145 aa, Homo sapiens
MVWACACVYVHACNMCLCMYACVHVPVFVAAMTKSQTEWLKQQKVTVSQFWRLEVRNQGGADPSRKRAFPQVDQKSSQNQNLFLKDEYLLAPQIRILIPNRKVLLVAVREKRGLGQQTSKPETGFAPVGKAICFEKQRSTGYLQI

SEQ ID NO: 929979 - protein, 126 aa, Homo sapiens
MFTQECDLCNFTSASGWLLSATNQTACRLPLHLHEALTTTLYPVSMSSTFLDSTHKNIHEHDSSCRYVDISETWVEILSCCCTFDLSFPDDMSGLMFPLARSSKASSQNQLVNVSTCQRILYKGFA

SEQ ID NO: 929980 - protein, 154 aa, Homo sapiens
MTSTKRMSTQKLHSKLTNIKDPREQNWMENEFDELIEVGFRRWVITNSSELKEHVLTQCKEAKNVEKRLDELLTGITSLKKNINDLMELKNTAWELCEAYASINSQIDQTKERISEIEDQLTEIKHEDKIREKRRKGNKASKKYETMRKEQTYI

SEQ ID NO: 929981 - protein, 133 aa, Homo sapiens
MLFCNICCSAVSAGNTQANTVWSSGPPANSNRPAAEGPVRRKTNKQKEIASTSTKRTSTPKPHLAEKLKIPKTSAPLLLQKIAAPCQQQNKAGWIMTDELTEVGFRRSVITNISELNEHVLTCHKEESHIQPN

SEQ ID NO: 929982 - protein, 146 aa, Homo sapiens
MAMRVLFWFHMNFKVVFSNSSGPSAAGLLEFAGGPLQTLLAWISAAVAAEQRILVNRKCCCLIVPLEVLPQRSTWPCEVSRLYWGVPPSYTSWGFPEWSYLSCAFTAFNIMTSNCSSVEFGDYLQILLIPMNQPVISGCNSEKQEG

SEQ ID NO: 929983 - protein, 157 aa, Homo sapiens; identical to SEQ ID NO: 766148

SEQ ID NO: 929984 - protein, 396 aa, Homo sapiens
MGNAGCKERSNSLNSAIDKMTKKTRDLRRQLHKAVMDHVSDSFLETNVPLLKDVDGLDCTASAIQGWAAWAIHIVTSEMDNYEPGVYTEKVLEATKLLSNTVMPCFTEQAEAAVEALSSDPAQPMDENEFINASCLVYGGIRDIRKAVLMIRTPEDLDDSYFEMEDFNVRSRMSIQTKDNQLIAGQSEQKAKTAEQVASFQEEKSKLDAEVSKWDNSANDIIVLAKQMCMIMMEDGQAWLHHHRPLPRLGLQASPACSTQPALTWPAGLPALHRPLLPPAQQLQQGQGRDAESRQGVHCPWNGQRYVPDLGNQGLMNAVVQTMKASYVASTKYQRSQGMASLNLPAVSWKIEAPEKKPLLKREKQDESQSEIKWASQKKHLNPVQALSEFKAMDSI

SEQ ID NO: 929985 - protein, 138 aa, Homo sapiens
MEAACCMPSPAAASQGACACTSAWSCPPHCRPHVWLCAVAGPHPRSHTPRCSVPGQAGRMNPVGPSKTRTEEPLATEVSSWQSDSPRIPGDVGNINRNIKCTCLFRSEISRLGIYSTDIHVCVERYKIVTEALFKIKV

SEQ ID NO: 929986 - protein, 203 aa, Homo sapiens
MQMYSLFLPVFSDGDEEIVGNRSKGDPCYALAKRLATFCPCPRDLWNFELEKDDVGYLAEEISKWQSIQEEAEHKSLENLPPDDAIEKFQRLYGNAWMSRQRCAAGVEHSWRTSARAVKKGNVGSGHPHSIPTGALPSGAVRRGLLSSRVQNGRSTYSLHHAPGKAAGPQCQPVKAAAMGAGGLKRLRYLASIPEKQHFSLET

SEQ ID NO: 929987 - protein, 314 aa, Homo sapiens
MGVPEKIKTDNGPGYCSKAFQKFLSQWKISHTTGIPYNSQGQAIVERTNRTLKTQLVKQKEGGDSKECTTPQMQLNLALYTLNFLNIYRNQTTTSAEQHLTGKKNSPHEGKLIWWKDNKNKTWEIGKVITWGRGFACVSPGENQLPVWLPTRHLKFYNEPIGDAKKRASTEMVTPVTWMDNPIEVYVNDSIWVPGPIDDRCPAKPEEEGMMINISIGYRYPPICLGRAPGCLMPAVQNWLVEVPTVSPISRFTYHMVSGMSLRPRVNYLQDFSYQRSLKFRPKGKPCPKEIPKESKNTEVLVWEECVANSAVIL

SEQ ID NO: 929988 - protein, 1517 aa, Homo sapiens
MGQTKSKIKKQGTSDLKDWKRIGKELKQAGRKGNIIPLTVWNDWAIIKAALEPFQTEEDSISVSDAPGSCLIDCNENTRKKSQKETESLHCEYVAEPVMAQSTQNVDYNQLQEVIYPETLKLEGKGPELMGPSESKPRGTSPLPAGQVLVRLQPQKQVKENKTQPQVAYQYWPLAELQYRPPPESQYGYPGMPPAPQGRAPYHQPPTRRLNPMAPPSRQGSELHEIIDKSRKEGDTEAWQFPVTLEPMPPGEGAQEGEPPTVEARYKSFSIKMLKDMKEGVKQYGPNSPYMRTLLDSIAYGHRLIPYDWEILAKSSLSPSQFLQFKTWWIDGVQEQVRRNRAANPPVNIDADQLLGIGQNWSTISQQALMQNEAIEQVRAICLRAWEKIQDPGSTCPSFNTVRQGSKEPYPDFVARLQDVAQKSIADEKAGKVIVELMAYENANPECQSAIKPLKGKVPAGSDVISEYVKACDGIGGAMHKAMLMAQAITGVVLGGQVRTFGGKCYNCGQIGHLKKNCPVLNKQNITIQATTTGREPPDLCPRCKKGKHWASQCRSKFDKNGQPLSGNEQRGQPQAPQQTGAFPIQPFVPQGFQGQQPPLSQVFQGISQLPQYNNWEPPQKIPTGVYGPLPEGTVGLILGRSSLNLKGVQIHTSVVDSDYKGEIQLVISSSIPWSASPRDRIAQLLLLPYIKGGNSEIKRIGGLVSTDPTGKAAYWASQVSENRPVCKAIIQGKQFEGLVDTGADVSIIALNQWPKNWPKQKAVTGLVGIGTASEVYQSMEILHCLGPDNQESTVQPMITSIPLNLWGRDLLQQWGAVTVEPPKPIPLTWKTEKPVWVNQWPLPKQKLEALHLLANEQLEKGHIEPSFSPWNSPVFVIQKKSGKWHTLTDLRAVNAVIQPMGPLQPGLPSPAMIPKDWPLIIIDLKDCFFTIPLAEQDCEKFAFTIPAINNKEPATRFQWKVLPQGMLNSPTICQTFVGRALQPVREKFSDCYIIHYIDDILCAAETKDKLIDCYTFLQAEVANAGLAIASDKIQTSTPFHYLGMQIENRKIKPQKIEIRKDTLKTLNDFQKLLGDINWIRPTLGIPTYAMSNLFSILRGDSDLNSQRILTPEATKEIKLVEEKIQSAQINRIDPLAPLQLLIFATAHSPTGIIIQNTDLVEWSFLPHSTVKTFTLYLDQIATLIGQTRLRITKLCGNDPDKIVVPLTKEQVRQAFINSGAWQIGLANFVGLIDNHYPKTKIFQFLKLTTWILPKITRREPLENALTVFTDGSSNGKAAYTGPKERVIKTPYQSAQRAELVAVITVLQDFDQPINIISDSAYVVQATRDVETALIKYSMDDQLNQLFNLLQQTVRKRNFPFYITYIRAHTNLPGPLTKANEQADLLVSSALIKAQELHALTHVNAAGLKNKFDVTWKQAKDIVQHCTQCQVLHLPTQEAGVNPRGLCPNALWQMDVTHVPSFGRLSYVHVTVDTYSHFIWATCQTGESTSHVKKHLLSCFAVMGVPEKIKLTWTRIL

SEQ ID NO: 929989 - protein, 142 aa, Homo sapiens
MIVSLRGLFSICLVLRDIECPQDNAVPPTGDERYWELVTYKCQLTLSCRSVGVCWRSTPDPLCLGISSSGCRTADIGELQMLLPDRSSGSFVSEEYLAVLDDNFQKSKEYSSEKKIDFIKLKNAFCVYYTYLTTELGLKQMW

SEQ ID NO: 929990 - protein, 170 aa, Homo sapiens
MTARVMKTTIQNMFSDCTLQALSKVSRHCLAGVARFLGSQLGLGWLQLSNSELTAGTHTLLLSFRDGLMGKEKENGIWMTGLGRASPECYKPVCPPLLAPGKAYWVQCGTILRTRPWVLDYYCNREINIFHGCAHQQKEAAQAEALPLAFQITCGVPSLQATDWFQSAAC

SEQ ID NO: 929991 - protein, 181 aa, Homo sapiens
MCLEKLQTPHTSESSWEGGWLLQFAGGLLQTLVSSDPPSPGGITSEGYKTANMVACSFLWITPKALQTITVLRLVLNAHHGHYSPLVATDVYSRPKTTLVNGWKILPELVEGVCPGAAWSWGEDNADTLLVATPGFKLGCTPNPLPLRPVQHQGLPEDCSPCDLTATEIRSRPQATLVSQW

SEQ ID NO: 929992 - protein, 263 aa, Homo sapiens
MKDKMKPVIERFRRRAYHTEEMAGAKGNRKMEQLVARGPVGVKGGFLKGGDTGTCLMEMILCKVETAVFSHTVEERLNTKLWCLAACQNNSKLHTCRLLASRDEVATDTPTISNNHPDQPTVINIESLSLFLALLLLLQIIVLEKSRERLTGQRAVIPAKAPPVTPVSLCLDEGGMEVSGLEEGEGRGEGGGGGEKGGEGLKRVRTCDPTGPFEHFLRVLLELLKEGSVSLRTASSSALSCHGLSLTPGRKSLSKNKFDAEKN

SEQ ID NO: 929993 - protein, 174 aa, Homo sapiens
MAMSHLYIPQKIDGDTSSWASLNPLHQMCDIACYLVAELLAGDNGDLLTHALVRVEVVAQARVVLFYDAPGRLLHGFGANEAHVGRSLVKGAKHMNKTHLRLQSSQPSERVHPFLLYEQQSWWLAAQDTELKKEEVYRPVASAGLLSQEPSSPGEQFLSLLRAHNSKGVRMRRS

SEQ ID NO: 929994 - protein, 142 aa, Homo sapiens
MEERFQWEHNMGRITHTHYCPSLHIKVQFFSRFNCLKCAKIGNLYGIRKTPMLFLQSKFEFSLYVGKIFLSILVRDLGKSQTACCLKHLTELGSTPVTEGLVASVLPWPTSLVLMLQGEQVDPYHAPPFMLRSSHKVKYSFL

SEQ ID NO: 929995 - protein, 151 aa, Homo sapiens
MIHSFWLCCLAAAELWASPLTIWYLLINGNHKQAAHPLLGPIFNLHHGQYLRDSKSNTGRGCMSQLHTCSQAGSELEPKEKELLSQDSHWLSLAPRERPHPAGIWQGLSRDSGSGSTQRKSPCLLNISSSFCGTSSAPSDVLRVLSQHFPP

SEQ ID NO: 929996 - protein, 309 aa, Homo sapiens
MWNSVATARRGQRTAQAVASEGASTIPRQLTHGFRPMGTYKSINKVWEPLRRFQGMYGNACMSKQKFAAGVGSSWRNSARTVWTGNVRLEFPHKVPTGAMPSGAVRRGLLSSRLQNGRSTESLHHAPGKATDTQRQPVKAARRGALPCKVTEVGLPKAMGAHLLHQHDLDVRHGVKGDHFENLRFNDGSIGFQTCMWPTAPLFWSISPVWNGYIYPMPVPPLYLGKTISLQPKELPLTLLTSVDLVPMNFLRVSLTPALYLLRWSDDFQAVYMLNQKPEVWRLLKMFLFITSCQQFDYDEQTCCNCTYV

SEQ ID NO: 929997 - protein, 258 aa, Homo sapiens
MSTAIAHILASRCHSPLKNPKFLLKVDYFDDVMSPRLSGFTDTHQRIKGALSMGFNLRDRAQPSQDPDLKERVNLTGAAASKTQRKAPWSWTQTSEEEALASCRWYLCGEHTKLVWETEGRILRTGIQQPLPEGKTIAGVIPTETGSKQEGASKHLLSLPTFHVPQHPCWQSWQSQNVVYIVRVLTSQSRALKGGFGIERQWLTHQLSGIPRPKLLGSGNFGPSVGMTEDEPIKVRDGYDEPSLIYQRDGILLAERSH

SEQ ID NO: 929998 - protein, 310 aa, Homo sapiens
MVTVGEFLPLRRSQPAGSEPVFHSLTVTRLLGLIHRPIAIFLKADPTNAWGPQLPSEASHEGAGEQADTGLPVLNKATVPQWGLCSAGCCLSLDYTGINALASWASGQILVGLKGLNTEKAKAAGAQRVRGGAGVGEQRPTPGYVTEEVSQQQSIQDVIWLFLKAYSHMHSQGDNQKLELMFKREAEHKSLGNLQPNHVVEQKNPFSGENCKLLAAEICVTKMKLNVNSQNNGEKVSRAFQRSSQQSLLSKTWRPRREKWFCGPCSGSCCSVQPGDMVPCVPATPAPAMAKKGQDTAWAMTVEGASPNPW

SEQ ID NO: 929999 - protein, 360 aa, Homo sapiens [sequence omitted]

SEQ ID NO: 930000 - protein, 138 aa, Homo sapiens
MRDASLNPANGPGPLASKEPGMEPAGATALQTCVIADFLVLTALAALSVSLSSTSNPPEGPEAGGVWLAPVANTAGCPLSNHPPHQVCSGEQPQVVNTSLVCKSAESERICDWKYLGSQLKEYKMLFDPDPKKCTRKY

SEQ ID NO: 930001 - protein, 184 aa, Homo sapiens
MDSTTDVSEIWDCSSRISSSYSCLRKLISSALPGKTPALPLVLEVLHQPLRVAKLRLQLQLLLAQSLQLPPKAVDVALEYVVHVAPSRLLLLQEAPLGLQHLVLLLQEPYLATPEAAAAHSGEAQGADADTRPTRVGAAAEGPGARGGHLVGLLHPDGHGGGRSGGRRAEPGGDSRRSGEAASW

SEQ ID NO: 930002 - protein, 268 aa, Homo sapiens
MGWLMGYGVTAFFIWAFSRVLSSCPASKKNELMLTAMDICALSLRCATEDPGVAMGRRPACCYRYCKNKPYPKSRFCRGVPDAKIRIFDLGRKKAKVDEFPLCGHMVSDEYEQLSSEALEAARICANKYMVKSCGKDGFHIRVRLHSFHVIRINKMLSCAGADRLQTGMRGAFGKPQGTLARVHTGQVIMSIRTKLQNKEHVIEALGRAKFKFPGRQKIHISKKWGFTKFNADEFEDMVAEKRLIPDGCGVKYIPNRGPLDKWRALHS

SEQ ID NO: 930003 - protein, 176 aa, Homo sapiens
MFIPLNSPFLGSGPPLLVLEPCVWYKDTCFADFALSCCPTCPSFFLFNKSAVLSKPLSSTLFVHSTPASDLSNAREAVSALVPLPMLPDPVHQKKQDKAGEKLSFSECGLSGNLVLAWFPCDSLEHKWCHRDGPNLSQGVLIYQERVLHLYCRILAKAMNKCALEKKFSLGHSQHS

SEQ ID NO: 930004 - protein, 477 aa, Homo sapiens
MLKDGFRTDRGSHSDLWSSSSSLESSSFPLPKQYLDVSSQTDISGSFGINSNNQLAEKVRLRLRYEEAKRRLKLNSKRNQLVRELEEATRQVATLHSQLKSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLVRAVSGWLAGWLAGWLAGWLTGLLCLWGLVYPELQEEAPPSKEP

SEQ ID NO: 930005 - protein, 139 aa, Homo sapiens
MLESFGLGLGVQAQVSDRTWSQCPCENLWRCGSSQPSAGTHEMLGQGLPDGEAGDGSAVIETSVAKFYSKRQTCQQAVHPQLPISFWPSVFQRSWEVGERGSAGQCCSEHSAHCLECRKWLLNEAMNYISALIKCSAYN

SEQ ID NO: 930006 - protein, 144 aa, Homo sapiens
MKDSEEAVKPRLSRLANFDMQRQAIRNWVHPNMAIPALFSLPLLQHVPDNMAAHTFPHVEHFICILKGGEVGVDKNVGKVRNVHRASSKHHSTLYLHEINFLSSQLTKQKSHKEIRDLKNIFNQLDVAYIYGVLHQTVAAEHII

SEQ ID NO: 930007 - protein, 156 aa, Homo sapiens
MSKTVDKSDNGPTCLTQPKEQTLSIGLNPSPGPWLAPGAIALLGGLLGLLGESGSRFPVQLPCPPSPVKQALLLSKVLACCYESKLGSRVPSQGTNALKLTITAEGEGEAKHVLRGSRRERTRKCHTLKPSALVRTPSLSLEQKGKNRPHRPITSH

SEQ ID NO: 930008 - protein, 312 aa, Homo sapiens
MEDYGVPRFYPERPHQKSVGFFLQSNAESDSTSRTCHAQAMLKIINYGDDGKSFKDQFCGHQGNDMYDEEKVKYTVFKVLKNSSLAEFVQNLSQIMEFPQDQIQLWPMQARSNGTKRPAMLDNEADGNKAMIEVSDNENSWTIFLETVDLELAASGVTLPKFDKAHDVMFFLKMYDPKMRSLNYCGHIYTPISCEIRDLLPVMYVSLEKALDELMDGDIIVFQKDDPENDNNKKIRLPQVGQEGEMKRDNELPTLTHLLRPLEGCLNVTIVIGYHSRALLGMGSAQGIMLPPGLHEGSYSSIFLPADDIFNA

SEQ ID NO: 930009 - protein, 134 aa, Homo sapiens
MYQILLGKYLGGEFLSCVTDCCADSGSSLGAGQQTVIIVTPCFHPLRRVLAGQRVGAEMSSRSKGLESGTPGICLVFYPIVFHKLVTKRVPKLQDKVPSTLPSYFLKEKDFDATGSQLASSLLPDSSLTKKTLQ

SEQ ID NO: 930010 - protein, 134 aa, Homo sapiens
MTSVETFTLNDVKTPFMYHLRHTSPTLTRVLSSHWGITCKFYGHHPTLLSLYAYSISPFLPPEASLTQRKGIRQTPKVLTNEQPQSVRKLILQGAHPQPMEDNSWEINLLPFLYNFSTSTMWRWYGNEIRVQLL

SEQ ID NO: 930011 - protein, 349 aa, Homo sapiens
MKNDQKLEMGSLPLGTINEREIQSHFQCLICSDTGMTLTKKRKKEGKKWKLHDEEAIELEPVTWPMNKLSGHVVELDENYGIKSLETRLFFLVQQPGVLKPPCCCHYKRVLLSLLGLGWMDLTLKVRGITSICLLKEGIYESFLITLHPHSYFASGANSLVGDIEEQTGNSKHHKGMSEILAAGPPVTGSEALEEKWFCGLGPGSPQHLSSLRTWHPVSQLLQLQSWLSQGTAWAIGLEGASPKPYQLPHGVGCRGAQKSRTEVWKLLPGFQRIYGNAWMARQKSAGEPLLGQCRRSNVGLEPTPCHRVPTGALPSGAVRRGPPSSRLQNGRSTNSLHHEPGKAADTQC

SEQ ID NO: 930012 - protein, 176 aa, Homo sapiens
MLRFGMYVLFPLAVILLPHLLLTSARPGLSSGVAARGFCWVIAVTLVDAMSGCCLSAEAVNTCPETSGTLLTHFDERISLESTKVDLLLVLFPPGVETLQSELRAITFFLHYCFCSSYTATCPNSINTWCWLKLVFSNMSADGRAPDEVRIHLEGSQGTRWLQSKLAAKTCLLKQS

SEQ ID NO: 930013 - protein, 134 aa, Homo sapiens
MQSFQIGDPKSSWGALSGRSKPESIDIKNEIACCIIPAVLDSPSPTRCPTIQFNADYPGLLPDSMGLKPQSHKIALTLDASRKSWVPRLPELLLDLAINSGILTTPPCLGTPFFHFQFHNLLEQLRELRKVLYM

SEQ ID NO: 930014 - protein, 141 aa, Homo sapiens
MFLGVRQVTHGELLKNALGENASEVVKGLEDPEPRNTAFSSLQSLGQRKPFQLKPKELSSSADSPMAGLNYNLDLSLGECRDILLPVITKELKELLEQKDDMQHQVLERKYCVELLNSILEVLSYQDAVSPPDDVDILDSD

SEQ ID NO: 930015 - protein, 214 aa, Homo sapiens
MPPDPTVQTNDQKRVLTAPPGYWGCLLSAPPTPDQFSQNTWDRGLGITAFDARFFFSVALQAGDPQPVTPCPGLTQPIQLTNYVIACTHIQRFRISCAAPKKNEDTWGIEGSENGFQWGGGGMVGGGGGALVPLPQDWKVVPSPSLPTPCVTGSGAFYRLRMGTADLFVSTQKKVKGKTPLKGGHDSVENQLGKAGEVRCEAHQKHQNFYQIQW

SEQ ID NO: 930016 - protein, 141 aa, Homo sapiens
MSTANEKILMMINQYQSDETLPINPLSMLLNGIVDPAVMGGFAKYEKAFFTEEYVRDHPEDQDKLTHLKDLIAWQAQSSPLLRHSPTLGSQQTTHQNTGVGSGGQELAGGPQPSGVVMPFIIQIMMFSLSIPSLGSRKARL

SEQ ID NO: 930017 - protein, 147 aa, Homo sapiens
MIKWSVTEASRVVTLKSCSHCKSYSTKQRLFSEPSFFQTGGGAPYPLRGYPSQESVTRLASEMPKEEFLTLWPLGRISVCSISKRAIDNENVLTIPPLTPPRLVAHDSTDPVAPYRGDLVHEDHFPHPYDFIQNQSAAPISYPPNCP

SEQ ID NO: 930018 - protein, 132 aa, Homo sapiens
MRPCEHLFCARHCAPGKADAELKETGACTPKKCPYLFGDDLHVPPYVQRLVELSACWSSELLFTELGPNPSNSLSPGEPIRRRGPGPPREVAAVGPDCELHVGRTVCVSDALSPSAPNSTRHIVGNQHILAE

SEQ ID NO: 930019 - protein, 134 aa, Homo sapiens
MGQRSKKTQYLRDSPLGKGRKRVVGRKREGQREREKEEKGGEEKEEKEEEEEEEKEEEEEEEKEEEEEEGGGGGRGGGGGEEEEGEEEEGEEEEGEEEEEVEEELREEEEEEEEDEEEEEDSFRRRGRNDTFRI

SEQ ID NO: 930020 - protein, 321 aa, Homo sapiens
MNDNGVTQYYIMNDNGVTQYYIMNDNGVTQYYIMNDNGVTQYYIMNDNGVTQYYIMNDNGVTQYYIMNDNGVTQYYIMNDNGVTQYYIMNDNGVTQYYIMNDNGVTQYYIMNDNGVTQYYIMNDNGITQYYIMNDNGITQYYIMNDNGITQYYIMNDNGITQYYIMNDNGITQYYIMNDNNAITQYYIMNDNGYYIMNDNGVTQYYIMNDNGVTQYYIMNDNGVTQYYIMNDNGVTQYYIMNDNGVTQYYIMNDNGVTQYYIMNDNGVTQYYIMNDNGVTQYYIMNDNGVTQYYIMNDNGVTQYYIMNDNMKRRHSVLYNE

SEQ ID NO: 930021 - protein, 208 aa, Homo sapiens
MGRWVNQSYTDGFFLLGIFSHSQTDLVLFSAVMVVFTVALCGNVLLIFLIYLDAGLHTPMYFFLSQLSLMDLMLVCNIVPKMAANFLSGRKSISFVGCGIQIGFFVSLVGSEGLLLGLMAYDRYVAVSHPLHYPILMNQRAWKKALATCSSHLTAVTLFYGAAMFMYLRPRRYRAPSHDKVASIFYTVLTPMLNPLIYSLRNGEPSAH

SEQ ID NO: 930022 - protein, 315 aa, Homo sapiens
METWVNQSYTDGFFLLGIFSHSTADLVLFSVVMAVFTVALCGNVLLIFLIYMDPHLHTPMYFFLSQLSLMDLMLVCTNVPKMAANFLSGRKSISFVGCGIQIGLFVCLVGSEGLLLGLMAYDRYVAISHPLHYPILMNQRVCLQITGSSWAFGIIDGLIQMVVVMNFPYCGLRKVNHFFCEMLSLLKLACVDTSLFEKVIFACCVFMLLFPFSIIVASYAHILGTVLQMHSAQAWKKALATCSSHLTAVTLFYGAAMFIYLRPRHYRAPSHDKVASIFYTVLTPMLNPLIYSLRNREVMGALRKGLDRCRIGSQH

SEQ ID NO: 930023 - protein, 144 aa, Homo sapiens
MTEEVSVSHPRFAREMSGVPAGPGPLSSCSPGPGLRCVWRCKTCAPRSRGEGPWAARSAQRRACIAPPPGPEPRRGGVLSAPERSRVRRRPKNLKESRKTALIIEHLKVPRGSCERLTKNTAMGSPGGPEDAKWTQEASVATQQ

SEQ ID NO: 930024 - protein, 151 aa, Homo sapiens
MSGAWDCEDLSDTGVSLKPESAVEPLESGSSENNTESWSIGASLELGAVGSRLVLLQGCPGTGKDPNPGATGTSFTPGFTEWAWCWGLLEFSEGPLQTLFAWVSPAKAACSFFLEALSQKSTYQMSVGALLYEVHFQLGFCHLQLKLSKST

SEQ ID NO: 930025 - protein, 146 aa, Homo sapiens
MGLSVLGLQGPFPNPNAANSCLSPEVSLAALPPRRLAHPQLWTRSSPTPMATCTAPRMTGSDASSEISEAEGRVVGVWGHSRQRGLASGRKEKIIYEGWRWGDGQCVWGQEHEKRCVRDDAGGASRGQATQSFLGQVRSLRFYPKQ

SEQ ID NO: 930026 - protein, 261 aa, Homo sapiens
MLTRAVALNPSDIMHAFKAQVSPAARKAGDHRVNFLLMEDPEKKLNQKSDGKPRKVRFKISSSYSGRVLKQVFEDGQELESPKEEYPHSFLQESLETMDGVYGSGEVPRPQMCSPKLTAQRISVFREGNAYTLAGGQPRFNDYKANDHKHKLWVVGVLGRDGETQISQRICYVRKKFELMPLPIIDFGKIIIYTNNLKIIRTPMDKRDFVRKILQKEEEAEEESLMNKEESYGGRDQHDRPLVEAESTLPQNRYTQVRWGA

SEQ ID NO: 930027 - protein, 188 aa, Homo sapiens
MDDLTLLDLLECPVCFEKLDVTAKVLPCQHTFCKPCLQRVFKAHKELRCPECRTPVFSNIEALPANLLLVRLLDGVRSGQSSGRGGSFRRPGTMTLQDGRKSRTNPRRLQASPFRLVPNVRIHMDGSSRIICTVTPGVSVKKWTRKAVAWAIGILRKSKLHSLKSYLEQALESKCWQQCPTSPCSEEE

SEQ ID NO: 930028 - protein, 158 aa, Homo sapiens
MVSSFIHPNLTARHLLEKNKGRQSSRTKNLSLVSSSSRGNTSTLRRGPGSRRKVPGQFSITTALNTLNRMVHSPSGRHMVEISTPVLISSSNPSVITQPMEKADVPSSCVGQEMTSQMNCNYGLKTMALENNSGLDLKILRVTTQLYGSQGCHEKWFT

SEQ ID NO: 930029 - protein, 136 aa, Homo sapiens [sequence omitted]

SEQ ID NO: 930030 - protein, 131 aa, Homo sapiens
MDIPHMDTEALKKLNKNKKLVKKLAKKYDAFLASESLIKQIPRILGPDLNKAGKFPSLLTHNENMVAKVDEVKFTIKFQMKKVLYLAVAVATMQTQLIYVAFMWTLFLTTLTLGARGTKANMRMLMLLTEL

SEQ ID NO: 930031 - protein, 134 aa, Homo sapiens
MHKQLNFRGRLSVFFSFIVTYKDFVTVIQAPQHPRDCRVPSKLSCPSQCQPVNFPPYPRSAIPQTTSQFSFEKKTKMTIIRNEKDITAKPTDIKNNHKKPEDDFEARPNKNLVFASPLDIVDALESSSLDHGFS

SEQ ID NO: 930032 - protein, 155 aa, Homo sapiens
MSIYTANSKVCVPVLFLKPEYSKESLRDSLQSGFTLFSCLIFTITLSQKVKTLIISLLQTRKLRLTERSRSLNLEIVHATQINCQLFLAYPCALITLSPDATCCIQLIDMEHNNVDVIRLSRFHVCRTVGHTFVPSSIWPPSRDLDEAVDTCGWK

SEQ ID NO: 930033 - protein, 166 aa, Homo sapiens
MERNQAKRLKIAKTRKPLLQRIATLPAREQNWMENEFDELTEVGFRRWVITNSSQLKEHVLTQCKKATNIEKSDGENGTKLENTLQDTIQENFPKLARQANIQIQEIQITPQRYSSRRATPRHIITRFTKVEMKEKMLRVAHQINSRSLSRKPTSQKRLGANIQHS

SEQ ID NO: 930034 - protein, 176 aa, Homo sapiens
MTKRGQGTAWAVASEGGSPQPWQLPHDIEPLSAQKSRIEVWEPLPRFQRVYGNSWMSRQKFAAGMGPGWRTSARAVQKGNVGSEPPHRVPTGALPSGAVRREPLSSRPQNGRSTDSLHRAPGKAADTQHQPVKAARRGPIPCKATGAELPKAVGAHLLHQHDLDMRPGVKEDHLEL

SEQ ID NO: 930035 - protein, 280 aa, Homo sapiens
MGSGEWKMERGDWEQNFFQASLNQINHRGMTQRQKNIKKGEKNTIVTSYNRNFTGRNDTNPKTMPSIISPEIVTALAIARTLSSTQRPTALWARMARSSSWRLQTQYELPQAQFDPGQDTYQHPPKDSSRQHVDVSSTSQHLQLVEPFDKWDGKDLEDLQILIKVKGKCPTDHISAAGPWLKFHGHLEYISNNLLIGAMNIENSKANSVHNALTQEFGPIPDTARYYKKHGIRWVVIRDENYREDSHGEHTALEHHLLRGRAIITKSFARIHETRACRAC

SEQ ID NO: 930036 - protein, 272 aa, Homo sapiens
MVRQGATSAHVPGGTDTLLGQGPSSPVPQRKERKEGRKKGRKPATKPRPSPTTKANTKRAPERPQSQRPHRAHTRPPGPTGPHVQTNRARAAPPQHTTQTTTRQATASATNHKPHPSHTATTTGGDTTTTHKPQPHASPPSHPASQTKPRPPPTPRPPATPSHKTTPATNNDHTRPGHGTTPATPTPPTTPHEGHPPTATKPPPQHPTTTKEGRKSERHDTAREKPQRQDIPTPGDTRQDRRERREDRQQGGSEREPAHGGAAADPLFLVSQ

SEQ ID NO: 930037 - protein, 137 aa, Homo sapiens
MGLEYGLSFLCSWSSSSRGMGWGADATVLVFCASGGEPLCSMTPPVCPSPSWSGSLNSTACLFALLVKACGGGEGIQLLKCARITRSIPKICDSVCAEPSKVLASATEKGLVVQNAFNFTHCIRRGRRHIMMIMAMG

SEQ ID NO: 930038 - protein, 161 aa, Homo sapiens
MLDWVTKRHGSFRYENRLKRLELFILKGTQTAAYESRSNVKAGVSTLCPTDPLVRLLKVPFDARQSSFQNTERDFSLSNWAKRYQFLVAIGSSWEHLYRAAGVPIGGCGTHSKFADSVDVEKRLGVKVAEHGLLNMSEIPPGVPEQLVVEGDMVKALWFYG

SEQ ID NO: 930039 - protein, 355 aa, Homo sapiens
MSFTTHSTTSSTNYCSLGSVQLPSYVAQLVSSVASVYAGAGGSGFQISVSHSTSFWGGLGDLVGIGDIQNEKETMQGLNDCLASYLDRGHYFKTIEDLRVQIFASTMDSACIILQTDKAHIAADDFRVKCETELAMCQSVESDIHGLRKTTDDTNVTQLQLETEIEALKEELLFMKKTHEEEVKGLQAQIASSGLTMQVDALKSQDLAKIMADIRAQYDKLAQKNREELNKYWLENSLREVETRYAMQMEQLNRVLLHLKLELAQTWAEGQHQVQEFEALLNIKIKLEAEITTYHHLLEDEEGFNPGDALDSSNSIQSIQKTTTHRIKFPEDIASALVHKENEIQVLSNGIVQLK

SEQ ID NO: 930040 - protein, 173 aa, Homo sapiens
MLPNVYFAVISADRCQRASYHESQGGRDLQRSTLSKGAKRSNKIELSEIFLRSVAVNRLGVKEENSKIEERMETESCCVAHAKAQYLFTGTISCIVHLELLDSSNPAASTSPVADTIGMCHYTRLPHRFLLFLGPAAYYSHGKRQKRKRASPNAHFKPVLTRPLAFTDRKILE

SEQ ID NO: 930041 - protein, 158 aa, Homo sapiens
MLLRAIFRNATLKHISSNLIFSILQKVLVVWMEDQTGHSSSSSQNLIQSKALSLFNSVKAKRDKEAAQLKLEANRGWFMKFKERRHLHPVKIPWSETSANVETSASYPEDLAEIPEGDYMSGVGSFQWICGLADFKNEAAELHSVTALKDGTDSKSGQ

SEQ ID NO: 930042 - protein, 146 aa, Homo sapiens
MLLRKKDTDRCKADSFEGGGRRSHTKKCGQLLEAEKRGPKRSAADLTLETIKARRQWDDTFKVLKQQQQQQQQQQKQKQICDPKFLYPVKQVFKNEGKIKTFPDKQEMREFAARRPVLPEILKETHQTEASKPKWKFECIQENKQD

SEQ ID NO: 930043 - protein, 147 aa, Homo sapiens
MEIKATRFPKRVRSEKKRQEEDMKKHPSPSCLGGVRDDQVGTEDFHPPGGEHMGSLDFHSHSAVKICSSSSPLDWESAKGKGPWDEGQKKSSYKFFSPVESHEDAHNSPSSNVGQHMQSIGHQGSSPQLWSPGFFIGCQSCTHSVLL

SEQ ID NO: 930044 - protein, 196 aa, Homo sapiens
MAHVYICNKPARCAHVPPLDSWSGVGDGSSGIGATTGTQVFCVGVAGGCDGHYDRHAQLAFHSLRIPSGCQNLLSLGPLKGQRVNILWEQPPGSDLSCWMALSHMCHSSSQLYPSGNYCPSTSASASVTTELSEENREMSASSPETKQCQPLSRAQALSNQTGLGKVGTPKVTYSQKRKIRSQGPQNMPFPGLSGK

SEQ ID NO: 930045 - protein, 136 aa, Homo sapiens
MLAIIIILPKAISMKGISTGNNNITIKKEKKKEVEKKEEEEEKCGRKQRQHQLLLYLQQAIEGKVMSSSRTKYELAIKVYPHICLFFGCVVNLLCVQDPLSPLCFIPVELVGKENQCIHEMHIACCYVKSPLLPTL

SEQ ID NO: 930046 - protein, 211 aa, Homo sapiens
MILQRALYIGDSKHQEHDVANGRYSTKNYQVNEKKKVDVNMTAELPLSCSSGHTAYGVTLVHKEQYLAAAVHCCFKEDRKRWKSLELPRDLQGSEYRKMFESLELPRDLLNAFDQNADSDMDNEGQAEARGPRRKKWFCGPGPGTFILATLATAVAKRGQGTPRAISPESVSPKPWQLSHGIGPKMMILTPDLKCSSRIPKCYNSSIGFLR

SEQ ID NO: 930047 - protein, 124 aa, Homo sapiens
MIHTDYNSNNCLPDEDEGLVGNWSKDHSCYAKRLAAFRSCPRDLWNFELERDDLGYLAEEISKWLSIQEEADHKSLENLQPGDAIEKKNSFSGQKFKLAAEICISNKEPKANCQDYGENVSRAC

SEQ ID NO: 930048 - protein, 138 aa, Homo sapiens
MSTANVADVAESLQNVVKSLLPHHFWHSLSLSLTGWHWVTCLPLNPSLGPGGWDTETVVENYSQRGCSLAGRGGVHKVLGEELLRLIVQEKEFHKIMSSVKAGTDHFHFFCDSSVALGHLDVYVRVWAQRPDIPVFLY

SEQ ID NO: 930049 - protein, 153 aa, Homo sapiens
MQETMMAWTWPTGISLDCMTRPRPMGKGYKGRTCVGNKGSCTPLFRCVLMATGQGGTPLRKSGLSLPCGVSLQGTPASLRGTIQRALLGRQLPWWNALPEQHITGPCGGLTQRLNTRKELGLGLKEQQHKRLAKARKDQQREKKAIYTNSKLI

SEQ ID NO: 930050 - protein, 170 aa, Homo sapiens
MVVALIGMLPLGCPIRWNRKKSNTEKCGRALVSLKEQPVAMRDHHYRSTIYENKAICACFGACRLPTNGAVFTIPALSAFTFAIFTGPVLNAAGVAHALVTRCACPALFTAAGSPDADACGPWTNSISITWELVRNVDSCALVGPSELEDLGMGLRDFVGTSPPGGFDTR

SEQ ID NO: 930051 - protein, 136 aa, Homo sapiens
MHVNGDLCGAARFQMVGTTLQSVTFGLVKSPTHLYSCILQVSGCLSLNFTFLMTQHHQDWRDRAFESSDAGPDVTPRVFSFYRPKKPRRCCISERLSVLTKVTQLQTSGTCEKALFPGDRCSVILTQPEVGTTSLQ

SEQ ID NO: 930052 - protein, 188 aa, Homo sapiens
MLSATLAIPGALAYQKLEKTVLQEEPETVNVNHVAPTINGMGAFSMHWHGQRFGAGTMKSPYWVLPSAHHTIQTNRCLLSTGLTDDSCHLIFQVDGYNIRHCGDGYPKSPDFTTTKSMHVTKLQMSPINLYNKNLKNKKCQGNKKHFSCFTYSKSDNADSNCHLPSTCKLRHCVKPLCADCPPCSQRP

SEQ ID NO: 930053 - protein, 137 aa, Homo sapiens [sequence omitted]

SEQ ID NO: 930054 - protein, 295 aa, Homo sapiens
MCENHPGHVQGAEWGWQGEDNMGKRTRFTTRFTFSTNYQSLGSVQPPSYGVQLVSSAASVYAGAGGSGSRISMSRSTNFQGCLGSGGLAAGLAGGLERMGGIHKEKETMQSLNDCLASYLDRVRSQETENQKLENKIWEHLEKKGPQVRDWGHYFKTIEELRTQIFANTVDNARIVLQINNARLAADDFRVKYETGLAMRQSVESEIHGLCKVTDDTNVTRLQLETEIEALKEELLFMKKNHKEEVKGLQAQIASSGLTMEVDAPKSQNLTKIMADIRAQYKELARKNQEELDKY

SEQ ID NO: 930055 - protein, 173 aa, Homo sapiens
MIGTTAASMSAARFYRLFFCSTMVDVRLVFIQPLLCSSHGGRNHGSIISLSPHHLPETEVNVRILQMRKVGLKRTEETRLRSEPACWQESQDSNPGLLTPTSDSFHILPGPALHARPLSAKEKTFAMFCVLEGKPKEFPTTRCWHFKYWFMGFLTSSLKQYVCTCVHADTNTL

SEQ ID NO: 930056 - protein, 157 aa, Homo sapiens
MGGTVGASALIEFKDAQNNESQKRRTPVATGLPCLGFTEPFPYSIALYGIHLQQQPGSVVPATTSSVPNVRSMGNNWNWPGVGHLLIVCQRAGSREDGDEQPSHRKHWLAGGTLILGQSSSIGKIQVACLPGKPLGLEESTGVWESELDINPCSTTS

SEQ ID NO: 930057 - protein, 136 aa, Homo sapiens [sequence omitted]

SEQ ID NO: 930058 - protein, 161 aa, Homo sapiens
MRPLAVLHTKRSAWVLLKCRVQGPSPDKWHGHLQRQSPGISTFPNSLGIDGVHPGLRIHYCPHHKTAQLFEICEKAVRVAIGAESAAVIHGVSALWCPATFPGFVGNNFMEPVAEWMEGIWCKGIIHFIFHWVCYLPQVTNKNSVILLEKGNGLSLWTIES

SEQ ID NO: 930059 - protein, 187 aa, Homo sapiens
MIKIWQNGKQDAICKQGNQTVPHQNKREGNPAAKQATQFPDRGKLLFWPKPWLRETVSSETTRQTEVDRWNNYLESTTNGKQNKKTEKGNPVPNPAVERKEFIGLNYSYCLLASIVFSSSFIFHKYGENLIQCQLNNECRFAVEVTGPNWIFNAETAVWVEELGRGHMLWPSLGAILPEFRGLCCIT

SEQ ID NO: 930060 - protein, 154 aa, Homo sapiens
MCQTREETDHPSVPVNTSPPQRPGCTPVSYGSCTETLRMPNFHGDFMATMGRMALSLFESYSRASWAQCITELPILPTQPAASLLLNPDMKPRTWAGDKSKESYLCPSWDLPGQPSMPNSFLSSYSLQETPHRSCTSCLVGPYAQFSRPAQRHV

SEQ ID NO: 930061 - protein, 185 aa, Homo sapiens
MEGVLREMIAWALIYKLIISLLYDDFFSCDYHIFAQMNSRQEIKGDKMFFINLQPDVLLVRIWLHGKDIINMDELRALLDGGNNYSVGNEQCLSHAYSTNDETGSKGAVITGEDVCLEAHFTHIPESSAGQLHTSCWAPPGYLGMNDTPHSLTDGPITIATNWTRASGCCLGDTRTQLHCSQCSH

SEQ ID NO: 930062 - protein, 137 aa, Homo sapiens
MDQTFAGGPLQTLFTWVSPVEATEQQRLLPAPSSGSFIPEGHKPDASWSSPVSVVDPCWEVSPVRRHGGGIPEESVIVGDDSSIWATGPEDLLVGQDAEEEDKTLHTLFNCHLELIIALNKTDSRYAKDSFNIQLIF

SEQ ID NO: 930063 - protein, 257 aa, Homo sapiens
MSVRETGGVARGRRKPGRGGEALKKEGAVTSNAAGRPRMPEQTCGPSFGGEAVIGSLLERGKERCGGRGGERERKPAGAQGEAASDADHPVRARDWEHRGQLPLRGCQWEMQETCPVGLGALSFIYMSLGKSYARCLGLMIDMTDGKPALMEPCAWDGRGVKTRCTERQGPEQTDSLIHVGADDSLFAVEETEGSEELNHLPKGKLARDEAQPSPRAPYGSPEQQDLQPGAFLASLAPHSCHSSAAQESRGDPLNAL

SEQ ID NO: 930064 - protein, 127 aa, Homo sapiens
MVQAAVAAEGWLGGWTCGSPKSPSVFPPSHSKQEALFSPLSSVQSQTPSWVGSWVLEQTVVMLHRVRQERVPEMDSPCQGAERGDSVHSCLWTTLLPKEQKLSLLSEGLTVILLLWDPVSTPINGKC

SEQ ID NO: 930065 - protein, 266 aa, Homo sapiens
MDGRRSRHTDDTDVLLRIHHVIGELPTYGYRRVWALLRRQAELDGMPAINAKRVYRIMRQNALLLERKPAVPPSKRAHTGRVAVKESNQRWCSDGFEFCCDNGERLRVTFALDCCDREALHWAVTTGGFNSETVQDVMLGAVERRFGNDLPSSPVEWLTDNGSCYRANETRQFARMLGLEPKNTAVRSPESNGIAESFVKTIKRDYISIMPKPDGLTAAKNLAEAFEHYNEWHPHSALGYRSPREYLRQRAYDSDKDDDDSTEAVS

SEQ ID NO: 930066 - protein, 168 aa, Homo sapiens
MVYTSPCCYKKPSRKTSLGNQRWVYTKLRQKPTFGTLQPRLFVFYSIPGDVKYDDFITAEIVLRKWHLECGRREGGKGGWVRNEKKKGGGEKYQKMGETEISSIQYCEHKSQKEFCMKKSPHLLSKGSNEPFESSQMCSESTLSKAWCQCRGERLSCVSGTKKDESLG

SEQ ID NO: 930067 - protein, 163 aa, Homo sapiens
MVILETSLYTIPILQMKGPRLIDTLSQDHTVSSKWQNWDANPGLSDFKTSFSAYQYLLSFANNWQLKSELKDHSYKQLHVLVLFKPTNYTHNCRPLRTAIVSELLTIVSTAPCKVTDPEEVNPSTWPLTDNTNSGFCTLRGHDEQNNMRLNQDQEKIKQLRDM

SEQ ID NO: 930068 - protein, 173 aa, Homo sapiens
MEQVGRGLITQDDDHDDGGGGGDGNGDDGGGDGGDGDDDDGSGGSGGGGGDDGDGGGDGGGGDGDGGGGGDDDSGGDGVVKEDYPYFNTTGGDLWDSVGFKSLFCDSRPLAAVEVAGSEKDDWVKWCKDSLRIGTGNLWRSPMLLSCSQKEGSLKSRGVRPLGANKNQLSQKL

SEQ ID NO: 930069 - protein, 165 aa, Homo sapiens
MCSGYVMLLLPNAPLPSCQMPLYPSPSSVQRKSMGTISEPIWRTNDAQQYHVLGTTEMTVMSIFSFHQDPSLPHRPYPLSSKEVNASSMTDFTYYQLSYMEAENFSMPKSWSRSVPVVFTYVYQCMGMKTFWENMQETAEGGCLKQGGHFASFNSAFLIWASALF

SEQ ID NO: 930070 - protein, 155 aa, Homo sapiens
MLMPDDQRRNSFILKPSPTPHTLSVEKLSSTEPKPVSGAKRCFGGGEPEQQKKETVDAAFIMRFCKEQVRVGLGHCRDGCERGRVDIDWWEGREPGAVSFDPDSAQSSGTISVSGSICPLLPAPFPIARAKAQETAMNDMLQGEDDKAVISFNVM

SEQ ID NO: 930071 - protein, 148 aa, Homo sapiens
MRRNQHKNSGNSKSQSGFLPPNDHTSSPASVLTKAEMAKMTDIEFKIWTGMNVTEIQEKVKTQSKDSKDYSKMIQELKDKMAIIRKNENDLIELKNTLQEFHNAIAIINSRIHQAVERISELEDWDAKLDKEAKPTGMLSSRDPSHIQ

SEQ ID NO: 930072 - protein, 150 aa, Homo sapiens
MLKPLPGMLFFPGSLWLANLNLQSFIHLDFTIELVIAGPGFAHWGEGLTKCTDKSRLGQNADGFLPNMLKLSKSKFNQNLALPFNWKDGHSLVLRKLPINDHLAWFIFLDSEAKIEFYQFYAIVKTAKEYSSLKSDHADFKSWPCHLLAV

SEQ ID NO: 930073 - protein, 129 aa, Homo sapiens
MQSAKVGATEMTLMELRCTVQSLEIDLDSIRNLKASLENSLREVKARYTLQMEKVNGILLHLELELAQTQAEGQCQGQEYQALLNVKVKLEAEITTYRRLLENGEDFNLGDALDSSKSMETIQIPLPAG

SEQ ID NO: 930074 - protein, 152 aa, Homo sapiens
MKFFCWFWGFWSWLLNIIRPENAKDSNSNSMENIDDLWHELFKELYKINAFDTPDSPLMRDKEFSDSIYDTVDHMWRTKEYNEAGWLLLSSVDKVMKENDELRDSVSWLQKQILNLKSAKIAMSHHLISCRERAKIVEIQTQALIMRVVDLQ

SEQ ID NO: 930075 - protein, 244 aa, Homo sapiens
MGTVSAFQLLQNTSLPGMAQCRHFISCRTGLFRRWPSVDISARAEQAIRDASPRSCSSSFLPISPVSIEHLPQILKHSHPGAGDETYPKSRLGCASVTGPRVCLMHLPLCCVTAQGEPPGARPAPWIRLHILSFSVNSHHARHRTRDFRVDPSDLESLDACIQRTLSALYPPFEATAATVLWQLFSVAERCHGGDGLHCLTSFLLPAKRALQHLQQEACYVKNALSAELNQLEHSKTRYVCTYR

SEQ ID NO: 930076 - protein, 226 aa, Homo sapiens [sequence omitted]

SEQ ID NO: 930077 - protein, 189 aa, Homo sapiens
MWSLHARVCRYLLLLKARMNAVGVGAMWTVVGEAGGPHSEGLWVLVLLPCGGELRSKQRLGGNTQSLQNRRSSPGACSRPAGSQRHILPQARLLPGICTALVLNQTATAELSTYLRLFDEEARVQNGAGCARCFVNGAFRAGSAVNTDRPAFLELTLAKSGRKPRGHLSKCRTASGNIQQPVMKRFSAG

SEQ ID NO: 930078 - protein, 143 aa, Homo sapiens
MPGDLGAGPALEPPSTPFSCPSSGHTHLLLKGSRSGLLLELPGHPQATLAGPSLRTMTSAAVSLRSEDVTSSLTSDHRAQWERGDVLEPLEYHTETLALVLECWFGVPLCQHVDTKSLSVNHPESAWGLTSEVWDINQGAEDP

SEQ ID NO: 930079 - protein, 170 aa, Homo sapiens
MGKKQSRTTGNSKKWSASPPKKEHRSSPAKEQSWMENDFDELREEGFRQSNYSELQEEIQTKGKEVENFEKHETNRRPNLRLIGVPESDGQNGTELENTLQDIIQENFPNLARQDNIQIQEIQRMPQRCSSRRATPRNVIVRFTKVEKKEKMLRQPERKIRLPTKGSPSD

SEQ ID NO: 930080 - protein, 459 aa, Homo sapiens
MKQANHLRQSLEGELPQRTKVPWVRSPQPDDPTTGLMVPGQAPAHVINLTEPRVCLIIEGQEIDFLLDTGAAFSVLISCPGRLSSRSITIRGILGQPVTRPEAHKGLQNIVKHLKAQGLLRECSSPCNTPILGVQKLNGQWRLVQDLRRTNEAVIPLYPVVPNPYTLLSQIPEEAEWFMVLDLKDAFFCIPLHSDSQFLFAFEDPTEHTSQLMWTVLPQGFRDSPHLFGQAQAQDLGHFSSPRTLILQYVDNLLLATSLEASCQQAILNLLNFLANQGYKVSRSKAQLCLQQETQRANTHLVKCEPEAETAFKTLKQALVQAPALSLPTGQNFSVYITERAGIALGVLTQTQGTTPQPVAYISKETDVVAKGWHHCLRVVAAVAILVSESIKIIQGKDLTVWTTHDVNDIVGAKGILWLSDNHLLRYQALLLEDGASNMNVHGPQPCHFSPRGWGTHRA

SEQ ID NO: 930081 - protein, 215 aa, Homo sapiens
MWSPVIRCLHKSTLAKIKSIHICEHVTHWEPLFSHGGPSVECTPEEYSPKITCYPSRKRSEKKVSLLPSSFWYDPELGGRQCGCPPAVSPPWFLGPGTLLNVPPMVAEGTSEQKERERKTALSIERRLPSRKNQLAVDTPVFISRLEEAVSDLHSVHRLVRSELTNMITSWSSKIGHLQVEEQGSQWWISSSPETSTVGKLTVQPLVCGQRPKKW

SEQ ID NO: 930082 - protein, 193 aa, Homo sapiens [sequence omitted]

SEQ ID NO: 930083 - protein, 148 aa, Homo sapiens [sequence omitted]

SEQ ID NO: 930084 - protein, 136 aa, Homo sapiens
MPEPPTPSVGSCATRSLPDERPHPLHGAQSHHHPRAEECGCTARDWQAAPPAAPVRDPLGEASWAPESSGNLENLYLRDCKHTNQCPVKTDHSALPISRMWVGPDKRVKAGCPIQQWQAARVPFHTVEALFFCSLQ

SEQ ID NO: 930085 - protein, 128 aa, Homo sapiens
MRADFLYLHPPQAKCCQTNKLYFIEGRDIKLGHNLSGLTTRVDQQLQRIFNFCSGRTPQGEHTLPTLQTLLLRLQLVTQDSSSLWEGEGRERPRICPEEVEGDGTASEQRFQIPENLQEYKNIHYLTR

SEQ ID NO: 930086 - protein, 157 aa, Homo sapiens
MLCDADLVGEAQLWFTECHCTAMLADLTRICPLELVRNLFMTVLEKDVRYEVLLQKAINNKTLVGQVTREAADWPLGVAESHTQQESGVLESSVLWKSSRSSGTFSPTQTFFSRPSVEQSAPERENRFRLKHVPDNVSAALHEAALLQPTIVGLIAS

SEQ ID NO: 930087 - protein, 171 aa, Homo sapiens
MGKMSPGHVRDLPGTHFHHRPGGLGGKNGFMGWAQGTPALCSLRTWCPVSQLLQLQPWIKGAKNGRSTNSLHHVPGQATGTQRQTVKTARSTAVPCKATGVKLPKAVRTHLLNQCDLDVRHGVKGDHFGSLSFNDCPIGFWTYLGPVAPLFRTISPFVMGVFAQCLHSHYD

SEQ ID NO: 930088 - protein, 152 aa, Homo sapiens
MDDFEWFKTSVEEVTADVVVVARGRHEAEFQVTAEDKAGFQQLFQGLFGEFFIIIFSCKRVLTKKRSLLVPPMSVQILREADIKTVLYVQEIYWVGPKSNDERHSRQTKEEEATRQPWCLTNYDPSQVNLPYPQPLLKNPTCADDEVLAPLI

SEQ ID NO: 930089 - protein, 497 aa, Homo sapiens
MRKRRKGCKKWEILNTTVSCQENIKVLEKEVKGDTLEPVFHQTGTLGKSKENGDEGMSASVNEKQNSSFLPKDKKQHPCDSKIHRKKGNDDPPLAVSHQLEKVLPMITFNDYGESLSENITLQNLLGTVEDFKPAKGKFITEVKRGDFNVQIEIKKNFVCKPGIQSCFPKHKNILVEELKPEVLSKHEGEIARTDRPLLKDSKDVEKERKINFDIPGNITSDSHVQQSTEGINYLPSTITDIFPLKMAKTSPLVLHLLSLENVEKDKCQIIPVVNNAYHRDFEDLSNENRDKVCFQMHFSANTAESNCAVCASDNLFLIEKTLTNDVDLHGNQDKENLGLTSFKQEPAQCQRIASTGPNTEEDENKNDSKENYCYQIHTLMPPQKQALKVGKKGPSEKEPFKKRTNSRVLHLGPSLNETVVVCLLTDSAAKKAGLQIGDAVLAVNGTEVTSVELAEAVNLAMKGRWASYRIQSSSEGAESCHTEFQCGRGHLQVFES

SEQ ID NO: 930090 - protein, 163 aa, Homo sapiens
MHRDHPLNYSKCMPLGTDILTLVVGSDISRCPSTPWPTCHGYLYKRTHSGIVKGWRKRWFVLKYDGCLYYYKHNKAGNSDLMGELSLNPLDGRAADFPGQEKVNVAKARVQGGRQRRKKIRLKRNSDHRSIFTLLCWVRSPGDGMAHNSDRRLHFEQRIKFGA

SEQ ID NO: 930091 - protein, 328 aa, Homo sapiens
MDPLGAAKPQWPWRRCLAALLFQLLVAVCFFSYLRVSRDDATGSPRAPSGDGARHSDCHITADRKVYPQADMVIVHHWDIMSNPKSRLPPSPRPQGQRWIWFNLEPPPNCQHLEALDRYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 930092 - protein, 359 aa, Homo sapiens; identical to SEQ ID NO: 904586

SEQ ID NO: 930093 - protein, 155 aa, Homo sapiens
MSSSARGWGNLGPGNRALLQGAPDAMELRELTPWAGRPPGPRRRAGPRRRRARARLGARPCGLRELEVRVSELGLGYASDETVLFRYCAGACEAAARVYDLGLRRLRQRRRLRRERVRAQPCCRPTAYEDEVSFLDAHSRYHTVHELSARECACV

SEQ ID NO: 930094 - protein, 146 aa, Homo sapiens
MTWRATPTASLATSLGSQRLRAQRRGRKQICTQNCYNIFPKITNFQQKILRHLKKRESVTHIQEGEKSCKNCLERGADVRFIKDFEIAITNTSRELNETMFKEPISRINSLGNTNLPQTENMSSSGLYKAQFYYTENRRRGAVKQR

SEQ ID NO: 930095 - protein, 135 aa, Homo sapiens
MAGYSSETKLPEERSGSNICCSPISAVLQPPLLIPRQTGSALDLRQTPTDLQLRVLTVRRKTNKQKGHAHQNNICMSPSSKTKATEQSWMENDFDELREEGFRLSNYSELKEENNQCREVLKGPDGAENHGTRTT

SEQ ID NO: 930096 - protein, 184 aa, Homo sapiens
MELPPHCHMVAKMKQVTIGSPDINMSFNHCLPFFDHGTHFITGKIHAMEVAQAVFALNIFSNQLEFSKCNFIILQISKTHFKHTTLETIRCNFGSLGPGDERLSNISYTEHSRCFHIIPIFLRKLINHFLLGSLFAAFRKALVLANCHGAGQRAKKVIYFYLLMRRYSKGSKKAWDFRNLHLIH

SEQ ID NO: 930097 - protein, 169 aa, Homo sapiens
MSQDFLLPGRPLVGILLIILQGKGPYTRLPSQGTIVKIHLSYKASVIRLQIDMLSPLFSLWLNWSTSLFSCDQGMGSNMPHEECPPSGSGVHVQVCYIGKLGSQGFVVQIISSARRISDSRNLTSKVGVTWADTEGEAQPKYERTAGWVEAAMQWSEERKCGWKLMSLT

SEQ ID NO: 930098 - protein, 170 aa, Homo sapiens
MPGDLPRYGAKRALLTHVLCTGRLGSLRLLIQVSKLALDASLIAYEKLQLQQLSYHPRPATGGSTIPLPTAGMLSILTTQFWFPGSGKMPATFPSVFPSQRLQASPPVSSKFSSLVWVAWIPSGRRKNRKALFGFHSWSYLNKMRTNLASDIPLTQYILQNNKADMRKKI

SEQ ID NO: 930099 - protein, 136 aa, Homo sapiens
MTLRVIQHFEPQFLHVSNPIDLSCGNFLAQLPGLPLSLNVHCLLNSDSPAASMAFSCPTRVGGGFGSNFNISLSWGTVTQSHSTRPKSIQTSPTLTNRTPTCNDLQRLQAAAHCMGLGGSRWRQKLMKILVHITVQ

SEQ ID NO: 930100 - protein, 139 aa, Homo sapiens
MGMATPPTTLHYHSGQWQALTLFNHHPWSLGPVVVGVRAWRGLSTDQWPGLGEVKKSFQEEVAIECGGLEDKQAGRERIWINKFDLEERGAQWGSRPENHRRACSACPMTLRGLFFRLDVKFKGEDIFEVIWQGSARTK

SEQ ID NO: 930101 - protein, 131 aa, Homo sapiens [sequence omitted]

SEQ ID NO: 930102 - protein, 134 aa, Homo sapiens
MNPPVGWCTENTPYGMPGKPPTGLPLEALAGKEPFVFSVPFQCHLPMKLNVFCICGHLNLQDFKRQLRILPHNNTDGDPDLATEPGGTGSASEPVTGSTDFPKPQTSDLQEVCIGIIDCLEQDAADGYLIWHTF

SEQ ID NO: 930103 - protein, 142 aa, Homo sapiens
MKAEAWTLSFTEKQEWKIPLKTRQISKGSQREGESDWVSWNLNPEILSALTLRASCRQGYGLFENYFIFLVIIIHFRHSHFHLPKNVDVQTGVGPWVSTVFSGVSGVPKTFFFLSKTWPFVDVRKFDFEVLSIFCKIKEGKS

SEQ ID NO: 930104 - protein, 251 aa, Homo sapiens
MVPAPPQRGSGPSQAGFTLLPLAGWNSKSMGLVADTRADTTSVPAEALLFQGASSRWWVHRLAGFRCEAADLRGEKLQTFAVSVTAHKSSVDPKHEQQQDLLQRVKELNFHTVERDSGLPLLATQEPTEAGGGSGMAGRRSRALPCGEAAEARQEFECSAGGPALLGDPAHPPQLLARVLSPSLPRASGAGWLLPVQGPLSLQPPGTLAGLQALRSLVPARASPSTPPHRLRELAPASAIPGRGSHSTVAG

SEQ ID NO: 930105 - protein, 167 aa, Homo sapiens
MNHQFNPGPADGRKGRFDTEKQIQVQVGHLLTAIKAGPFTDVSTLEAPRRRGNTANITEDLAVKTENTTYPTEDFAQPPLSHLLPKRQKEQWGLAGALPCPPATGPADSGLLCPHNVSLLRHSPSQPASPHPPAKVTVATSPSLLKMHEGEGLQLYNIYFIFLSCVL

SEQ ID NO: 930106 - protein, 132 aa, Homo sapiens
MVSQPPPLSFHAPSSATLRLPPRRIQNADFTMSLPAQSPLKAYRKAPAYRITSRLSKWPCVMWPQPTDQTHTHLCAPSAPVPIYTIFLVFAYSVPDTKNTNHTALPPGTYVLKEEIMEKQNSCPPQHEQCHR

SEQ ID NO: 930107 - protein, 148 aa, Homo sapiens
MDRPLGEERPGREPLLAELDRGVLESFSHIFVLSELQTLEASGTDESWPCHFLTVSWSKAPEILVDRGDRRIFGSDIWSLIPVPDTELLIPWNFLGNRSIFCSIEATLGGLLDSLRMRAGFQGTNAVSRGWELSASPLTSKEERGTES

SEQ ID NO: 930108 - protein, 225 aa, Homo sapiens
MVVPAARGAGERYHGNLLNGDRCQDGGKSGTFRRTCTWLKRQALGCGFFPDTVGQGWWHHSKEKKVRSPTLALGALLRTGHSNFWGGPIMLVFPGSQMAAVDSPTGQHLVLTEPWKVSFLGLQVTREDEQPITQEVKDRGAVRGTLGQAATLRGWDPKVGPGQPGNGRIRASDGFLRKVALSTALKDGEKLGGRAVGREETQQAASKPETSAGGWIRQYLCGCNS

SEQ ID NO: 930109 - protein, 161 aa, Homo sapiens
MSSLPNGETRETCDSTPAGLDRKGCSEGVEGARAQLLRGDGIGAERCGSCPRGGGRWRVGPRQWQVSQQVEWGYWRGDLNPADSCEPGEVAPSVGDKAGASVKQDLQKVRCQDVNIFRGHSSACHSWSFMPAVTKRELREDEEHLCREPEDRDREAQSSHV

SEQ ID NO: 930110 - protein, 148 aa, Homo sapiens
MNGVCNLKDDVSGALRRALFRHTFYCYLHFHAIALRPREVGFLLQIIQLINELSAKKAVPIFTLATGPFPQQDIIVFGLGMGMTLKQLLPCDNSRILLVFGSCESVCHTSGSVMGLFLIPKCCRYCEGSLANTQQPGNMSFAPGGLKL

SEQ ID NO: 930111 - protein, 150 aa, Homo sapiens
MFAVLQSLLVVKSMKMRKDKCKKAENFKNQNGTSPPKDYNSSPAREQNWTENEFDELTEVGFRGWIITNSCKIKEHVLTQCKEAKNLEKRSACPLWKCTGSNCGGMWNTSCQSPWVVWLLGSPHAGQLAQQATDRLADIVVQIPSVFWVR

SEQ ID NO: 930112 - protein, 139 aa, Homo sapiens
MQKGARERVSARPGRPLWALHQQKQTLGVNCAGAQVGVLATLKPHRACYSALLAPLSVDACVLTTQLGSCLLTWGNCPPPVRAQCQCDSLSEYLHLVGPELLSEYKKNEVVFSLKSGCLVPKDKPSLFPRIRQSLFSAD

SEQ ID NO: 930113 - protein, 205 aa, Homo sapiens
MPAGAIGLLLALDKIQTTTPYSYLGTLANNTTIVPQKVTICRDQLKTLNDFQKLLGDINWIRPALGIPTYAMSNPFAILRGDPSLSCPQQLTKEAETVLQLIEKQVHKTQIDKIDPENTLDLLIFSTQHSPTGVIVQEQDLVEWLFLPHTNSWTLTPYLDQITTVIGNGRTRIVKLHGYDPGKIIVPLMKAQIQQAFIVLLGKPI

SEQ ID NO: 930114 - protein, 140 aa, Homo sapiens
MEATVTLLGGGEVVQGKLLLQRREREEAGSHPSSRGSLKCGLNQEGKGGFWGSEEDWALVILAVFTQKQRPAGKRRAICTWIVPDFLKQREGALTEPLSEIERHPFLTLTASLFQKSFSRPPAREEGQESCQQENSALEN

SEQ ID NO: 930115 - protein, 151 aa, Homo sapiens
MSCHSLLICKVSTEKSVARHQVRLPSRTFWSFIALVGPEVSSKSEILESKTLDVYLVFYCTVTWLPLKPQDTVIPSLSSPFQRTALSSMPYSFSGLPPAAPRDTLSTTELLLGVGEGWHQRFRTVFLLQCLFQQYKVNTRSHSQRKAELGD

SEQ ID NO: 930116 - protein, 161 aa, Homo sapiens
MIAGAALTSVSPVAVATGVHHYDCVWDIYAVPAISLTHGGDALLKRTMDDGLGLVFLLSSSLWSQDLGGSRSPGYPENGSGYKSPDVLTGAVVIEKLQEDKSHWMDMMEEEGDRRQVGEGAVLAAVETADVTRGQGHWLADYCSCPGRQTDDHSCVGSGRP

SEQ ID NO: 930117 - protein, 483 aa, Homo sapiens
MIGSLGWFLPCCSPDNNKMCELDILHDSLYQFCPELHLKRLNSLTLACHALLDCKTLTLTELGRNLPTKARTKHNIKRIDRLLGNRHLHKERLAVYRWHASFICSGNTMPIVLVDWSDIREQKRLMVLRASVALHGRSVTLYEKAFPLSEQCSKKAHDQFLADLASILPSNTTPLIVSDAGFKVPWYKSVEKLGWYWLSRVRGKVQYADLGAENWKPISNLHDMSSSHSKTLGYKRLTKSNPISCQILLYKSRSKGRKNQRSTRTHCHHPSPKIYSASAKEPWVLATNLPVEIRTPKQLVNIYSKRMQIEETFRDLKSPAYGLGLRHSRTSSSERFDIMLLIALMLQLTCWLAGVHAQKQGWDKHFQANTVRNRNVLSTVRLGMEVLRHSGYTITREDLLVAATLLAQNLFTHGPSGWTWTISGRLGECSRQDMFSCEWEKKPNEKWCQQSRHHYVKFNAQNQTRGYLSWTSYSDYSTSNTTQ

SEQ ID NO: 930118 - protein, 137 aa, Homo sapiens
MLNRSGLLRYGWGPLQSLGTLDFPEPEGVFSEGCKTAQIAACPSWELCPGKDIWQKKFLSSKAFKRAVQKGDVGLEPPHRVPTGAPPSGAVTRPPSSRTESDRSTYGLQCVPGKATDNASPQKQPHGYVFFSSMKMD

SEQ ID NO: 930119 - protein, 173 aa, Homo sapiens
MLEAASVQELALKTVTVTRALVHTTSTPLPWLPTPLKIEGPGEDGTALEMGLGWGIAPREVRLEDPRTHGRWQRVKKRQKAQDDTSGCVLCWVDAGSYPLPTADSDAFLCVARVVPSICNRLPVRPHETGCGASHLSLRHPPAGDPFKRFLQGHPGCHAEDRMQGKVVPGGSR

SEQ ID NO: 930120 - protein, 164 aa, Homo sapiens
MEASTWVKDEAMGETPAHTTQASCLLGWKSRNFPSIPGSIKAPTEYSGTSHKTLDPDTSCLKEPTASRAPLSGPQSPLELFELANPNPAQLASPLPSHSPCPSSFHPLTDSGASPYGPVVLSNRQKADVIKRTEGVRSKEHGVTLKHSPEQEFLTWATGNLHNP

SEQ ID NO: 930121 - protein, 133 aa, Homo sapiens
MEKAKALHIESQEAAGTVWKHLDPGSFTPAQKGELSGRGASGLGRALPVDTFYLIFIFHVNEVFPMSLGHIIFFHFALSVLDKAFGSWGLRAVLADTPETLPYDTEPVSPQTLIPVEVCIFEVLVRDHEKEGS

SEQ ID NO: 930122 - protein, 166 aa, Homo sapiens
MTSISNKYRIFLTSQKIPYAPFLSPPRASGSNLRGSLTLWDLCSFALHNKSPCCSLFVSVSSLRAVTLTRKMESRSGIQAGVRCRDLGSLQPPPLALKQFSSLSLPSSWDYRRLPPRCGFLFEVSETTNPPAGTNSRHTLTVKLDGLAKIRTAREAPSECVCPPGK

SEQ ID NO: 930123 - protein, 215 aa, Homo sapiens
MTFSTWTSTLHESSFQGKQNNILGMGGKSFEFEQPGQRLLIPKRGQEMAELLAVMGSCGPGHQADWMWSPITPRSLLPPPCAVLLVDAASLKTMPCVSIFFMGLNSVKGIRGDQQTWVDSLVVDIGICFPVEGAWPLCPGSAGHCLAESRGWLELCSLQRYAPSPPPFLLPAQAWEEQLVTFKLSVCPPYGFGLSGSVKGDRVLELSVPQSRFTV

SEQ ID NO: 930124 - protein, 151 aa, Homo sapiens
MVFSTGWLSEKFDHLKPSSLNLSKSFSVQLCSVAGPSAAGLLEFAVGPPQTLFAWVSAAEAAEQRILLNSKCCCLIVPLEVSSQRGTQPSSLPPCSWISDCCASNEWDPPSQEREFPDPLGFPGEVMPHPASAHARWAVPTVLHPLSDKPQ

SEQ ID NO: 930125 - protein, 177 aa, Homo sapiens
MTRDWSCSSAQSSSSKVKQSDWFFMQMLNPISIHWVESPNRGLQSFPLVPESPANPHWGKPVEALKLPETELPVGGMGCHLCCLAALTLAVSRLWRVCEDQGLVWTPSREQPPHRKLSTLFSMQVLVLTSPHWAGPPTWDSSTTTLPLPDHCSQRQPSISPRRKFQSQPTTSSPLQL

SEQ ID NO: 930126 - protein, 158 aa, Homo sapiens
MRIKTFMNIYFHLIIIISYLEAEQLLNSNITGTTLISPICSCHHCWPLPLGPKHKPLAVTPIPPAPGWSYICIFPEDRLPCSQLLLTAATSGGVEATDSNPTAPSPPQQDSHRALALSVGSLTPRLPLLPSLEHSAKALGVTQSLLTTAQCLYAPPGA

SEQ ID NO: 930127 - protein, 151 aa, Homo sapiens
MELGWLRASQRPHLHLSQCGPPENSKCAASLPLEKASSSTTASTAPKRGQRMKKRPGTRIGKSTNPPSILDCSAAILKKMRSAGGLEAEPLPGFPDACPATSSPLWPRLSYLGLLKASVQTLDLTLCDWNRTAPLCLERGHVRARLVLSAV

SEQ ID NO: 930128 - protein, 151 aa, Homo sapiens
MLSQSTVASHPRPGSATADSRVITEVELYDIRQTQDLAKPGNSTRCFPPTPKDANWSTKKGTAKARRALSERCHHLVPGSASCSMPGTNSSAVEADNMNTSPRQGRRWVIVLPCLGNHTFSTDQCKRGSGDPPCEPTTPGPWVSGTELCRF

SEQ ID NO: 930129 - protein, 309 aa, Homo sapiens
MKGKKEKKEKKKEKEKEKKKKKRRRRRRKRRRRRRRRRRRREKKREEEEKKEEEEKRKREEEEEWRKRGRRKEKRRRRRRRRRGGGGGQGGEEGGRRRGKKKKKRRRRRRRGRGRRRSGGRGGGEEEKKKKEEEEKEEKKEKKKENEKKKKKKERRRRRKRRRREKKREEEENKEEEEKRRMRRRGRGRGRRRRRRKEGGGGEGEEEGRRRKEGGGGEKKKEEEKRKREEEEWRKGGGGEEKKKKEEEEKQNILLAASFQNYYQNIYKVKFLSLIILNHVQFCDIKYFPISVLSPSPRPTSRTSFILST

SEQ ID NO: 930130 - protein, 153 aa, Homo sapiens
MHELPVAAGTNHALGGQKQQKCIPSHFCRLEVQSQGVHWVGPPSKGSRKGAFLPLPASGGPRDPGLAASSIPASLFTLPSLLPYTQESDLQVCDVAQESALSRFPQLILSQDSQWQLEQQGEVTFIIWLGAEASRLETSDAGYASRSRRRAMA

SEQ ID NO: 930131 - protein, 146 aa, Homo sapiens
MKIKFSPWMKIKFSPWMKIKFSPWIKIKFSPWIKIKFSPWMKIKFSPWIKIKFSPWMKIKFLPWMKIKFLPWIKIKFSPWMKIKFSPWIKIKFSPWIEIKFSPWMKIKFSPWLETQLPDTFSNLLPAAPAQRFQKWCLLSTSSIRD

SEQ ID NO: 930132 - protein, 134 aa, Homo sapiens
MNGYETIDEVCITGPVPGSVAWLPLVSSSVSTYPLSLQHAVPSVLLTECIPPTPTPIGISWARVRGGPGQMVRGSGRVHPEVTLHKAEPHLAPGCHPIGPLFLLFWRLQIKQKIIFMENVSSEMLASLAGWFLS

SEQ ID NO: 930133 - protein, 185 aa, Homo sapiens
MSTDSLGRWCNCCRDSKIHSAFALWRDRACCFENVRSPHGPRLQGLGVAFVALSTGSLRLILLKLPRRAGIEADRDGPGLEMSPRHRVNFGSLPLHPLWDRHLFDLSKDMLTGKKSCEQEKRDKENELTSPGTPGSWYQQGTQRPATVLRTINPADTLATDFWLPELTHSCWIQASSTPLWSHRH

SEQ ID NO: 930134 - protein, 253 aa, Homo sapiens
MQLLTSAVIAHPLFHGLFAFPLLLIPMDDTASRCPSATGKIQSSLSDLFHYRVTVPSQRGLPQSASKFALPRESISPCGPSLICPRWKRQGYPVRTLCLKAIVLRLSRGEPSVSRTPGVLLLLTIPGPADSAHRLALTFSVESTEGTEEPTPSMIDPGIHGEETEPCAASPQQIFISLHLGSTALGEVKPPKSCQGEVDWWLKGPALHIKRLWDVAVQVAAPEAMEGPPMPGRPVGNSPALLTSAPKLLKARG

SEQ ID NO: 930135 - protein, 254 aa, Homo sapiens
MGVCYTHYFITQESASQQQDAAWRMMRASGSSPEERAFESRQHSFAQRAHFERLQRRPVFLAATKHLLEAETKCQAGESSKEQGDNHTVLNNSNGNPSLQPFVRGCLIGKGPGSARLGDVSSSALTFSVESRPNHDGLKRRVRSNSDILNHTFRARKHKEFHCPGTIQLTYFLWLFFASAHAWRHLDSPYTLNDGPLFGCTRVYISTHLLKDIVIASSFGNHKQNSMYRFCLSRHHLLKRLFACLYCLGSPVKD

SEQ ID NO: 930136 - protein, 167 aa, Homo sapiens
MNNAAVIIDGHVSVWTEDQKQQIKAAPDHHYGKKQGGCLILMKGQKENKVAYEFGEKKYQRASRVMDIGPSTYLFVKFLCHQFSNHTSSKSLTIQPNHWLQPMNQCIIVHLAISPSMQRAQPVALLEVLPTGKIWLHHYPSVMSWKGTVVLQLSTFRWCLHILQNHL

SEQ ID NO: 930137 - protein, 151 aa, Homo sapiens
MCEHDSEPCLRNGTTHPKHPSLQDSGVPESQFATLVDGRRQADEDELHNSAKLCLIFNVEQFGECSVTSVLVSDVCEGHLPADEWKRSVCMGKKVSPESHAAELGLQEASISTITRSSPKELVHPLLHEDTVTRCHLRGMTPCQTLNLMMP

SEQ ID NO: 930138 - protein, 162 aa, Homo sapiens
MNPQQTAAALQERDLTVERKTNRKQQQQHQQKVPTKTSSKGQHPQRSKLDKVMEMRKNQRKNAENSKGQSASFPLNDHNTSPARAQNWIEDEMEKLTEVGLRKWVITNLAELKEHALTQCKEAKKHDKRLQELLTKMSHLKGNINDLMVLKNTAQEILMQTQ

SEQ ID NO: 930139 - protein, 165 aa, Homo sapiens
MSPADPSKTQAKEFLATGFQPEKRHSKDSITLWLALINYIKSLFNSIKAQRGEETAEGKFEASGGWFMRFKERSRLYSIKAQIEAASVDGEAVASYPEYIAKIIDEGGYTKQRIFNEDEIAFSWKKMTSRTFIAREEVNAGPLKFQNFKGQADYLVRGLCSWWLS

SEQ ID NO: 930140 - protein, 188 aa, Homo sapiens
MNILAVQIKRVLQNVLGFQGEIGLNKGLQALCKSKIQQDSQILSPKMISLDFMSHIKVTLMQDLGSHGLGKLHPCGFVGYSTPPGYLRGLALSLQVRSNPSPATWTFSFPSEDVRFEAADDLPFTPSHFGHSQFFGCLLEPAAAIHFLQSVHGFSQLSWDVPAVGHGPKVHDVPPPQAALSIQVGASN

SEQ ID NO: 930141 - protein, 178 aa, Homo sapiens
MCFVKQMLEGSMLVKSHHHSLTSSTQGHKHCGRPQDKIDRSLAALTQKIRKKIQISSIIIEMGDITTDTTEIQKIIEGYYEHLYVPKLENLEKTDKFLEIKDPPRLNQEETETLSRSVISSEIEMVIKTCQQKSPGPDGFTAEFYQTFKEELVPILVTLFSKIKRKYSLNHSMKPISS

SEQ ID NO: 930142 - protein, 154 aa, Homo sapiens
MPHSSWMQDKNSGKDATGNRGFWPENLHPKDPITLIFYCHKILLFKNIPNVFIHSTLDRCLVYLCCYAKMPKTGVLPGIESVRQLRMARVVVLCFIPCKHPLMFHKLASEILSKRDLLGAKNSKPVNPGRLSQGEQRILYDFCIPDFIKCPGKN

SEQ ID NO: 930143 - protein, 140 aa, Homo sapiens
MGRNQSRKAENSKNQSTSSPPKERSSSPATEQSWMENDFDELREEGFRQSVITNFSELKEDVRIHCKEAKNLEKRLDEWLTRINRVEKTLDDMNETKREEKFREKRVRRNKQSLQEIQDYVKRPNLRLIGVPESDGENGT

SEQ ID NO: 930144 - protein, 139 aa, Homo sapiens
MQGMQKRHGGGGLCDFLGDSSQLIGHLVVGLAPLQTDSACSFLVGENSGGCLVCFKTWSLDLLSKHTANNACRHSGQRKGSNLDEIGDYTLSEVIQKWKTKHHMFSVIRGSSAMRTQRHKNDTMDFGDLVGKGAFMVYV

SEQ ID NO: 930145 - protein, 136 aa, Homo sapiens
MVESRYQNHHTRDMNLPHLASQEAWISFTVNAPPLNHTSTLPPGPGDTAEENSWNTSAGNCYPLFGKVSPKIHLKSAFAQLPFLLCCYANDPVTPTPDILLQAQHPLQLVLIFTEKKMRVPTCLNFVYLVMELSVE

SEQ ID NO: 930146 - protein, 143 aa, Homo sapiens
MVPCGKLGEKLMYMDAEDFEIQVMRVEPHDWHQCFYPRGLPHSSLWPSAPRGTGEGTRGLPNSSLCPSASEDTGEGTRSCKTVSLKRAKGLRVKNDQVLNLPAVPNDPAISLLGIDPREMKTYVHTETSTQMLIAELFVITWI

SEQ ID NO: 930147 - protein, 156 aa, Homo sapiens
MSLGTRNFSDLILWILTVSQNFIFDRLDSLEDYWSEVLKNVSQLTFVCCFSHDKTMVVDFGDEYDRAVGYKSFGYVSVSTANAHCDNARVSVRTQILTLEKLRFRVVSATVQCRVFSRTGENVDFLQRLAPRLISHKLYLPSVAFTTWLRFQSGIG

SEQ ID NO: 930148 - protein, 172 aa, Homo sapiens
MSNEVCCQNTDVMKTTPKTKVGNKKTHINIVVIGHVDLGKYTATGHLTYKCGGINERTIENIENEATEMRKNSFKYAWCEYSKLSSVNVVSSLVSLCGNLKSAVNVTTEVKSVGRYHEALSEALPKNNVGFSFNNVPVKHVRCGNVAGDSKYDPPMEASGFTAQMIIRKLPG

SEQ ID NO: 930149 - protein, 139 aa, Homo sapiens
MVGSVEENDKLHSFAEKVSHIQTPTYFCGQTLTFRVETVGQKIQYGVFAEKQNGYDSLQQDQAICMSTNGEVFVNGKEMTNELTSVTSVCTVTFDTEAVTLGTTNNNEGRNFKLRNILLYSLRKCNPNTNNGYHVVLIS

SEQ ID NO: 930150 - protein, 149 aa, Homo sapiens
MLNRSGERVTLAALLKDPCETSQKCLPWGPREPTGLFLLLLRPLYFAWLSKLSQLQEISCYLNSTIWNRYQPNRENCILYRTLVYSVCYSLKSLGVEEPSSNNLITEGSEKGGVMEEDCEGLYIGDYWESTGNPVSFRSSCPMVKCTDF

SEQ ID NO: 930151 - protein, 135 aa, Homo sapiens
MAGLQGKIIFSLDPLSSSASILLRTTSITQPKCCLLTCHAPYPLPIKTPNPMFHKQMSRRASEPHGREGEKRRSIQTWRGVRLGMVGEEIGCGMAKLQGKIIFPLHILSNFSSIPLRATLYHSIKSPHSPLIKSV

SEQ ID NO: 930152 - protein, 139 aa, Homo sapiens
MDRLSVWDGSHGGTALQVRLHPGKLAKGNTGGYGTCKGEVLVEVELAGSLSAKAPCAMVGLPHWCSPLIRQSASAEATVQAPRAPKTTLQACMARLGPQERPAVQGVLRSDQSRLTGKTTLQSSDPTVPLGSKSPMGAN

SEQ ID NO: 930153 - protein, 142 aa, Homo sapiens
MGENVLSCKSMRGVLEKVEEGGRRRVRKRGEKGETGERETGRIGKFIVEEVFSPLRLEVLQGTSISCAEKAVIKEDLQGEWTAPAGEFTASQLKVADESEGLYYVPYPYQGEQKLANEDNSFRSFISLAMIPEKFILPSFTN

SEQ ID NO: 930154 - protein, 205 aa, Homo sapiens
MSVVRFDQEESEAGPREMKTLKSRGKQGKKWKEQTGIKPTKANCRIVIGSICIGHANARGSPSLKINHLTDFLPKTKETQQEENSQSKEAGSGLSCVIPPLTTRVIAAHRSLNGACQKSALRGATSASSKRLAFPLCVNAAQTLKAKLDLPQCPGCSLFFCPIFYPWNLGNSIVTFFRGGCSPHQTTEPAGTLILNLAASRTVRK

SEQ ID NO: 930155 - protein, 158 aa, Homo sapiens
MVWLCPHPNLILNSHVLWEGPAGSQTIQAVRGSLSSCLKVFSFSKRVSYITCSPFAAVVELLLSSALERIYFCLMKMKSDVRDPGYLWEPHDIIMHLGALQLTSKPPWEYRPYRHSSEWLLQLQLLHLHSRKQEKGKGGEMCGQIHKQCLEHMVASQC

SEQ ID NO: 930156 - protein, 360 aa, Homo sapiens
MKLPEEGSGSNICHSAIFAVLQPLLVIPRQRGSGVDLQQTPTDLQLKDLLEGKLTNRKDFHTKTPSVCHYHQRPKVDKTTKMGRNQSRKAENSKIQSAFSLPKECSSSPAMERSWLENDFDELREEGFRRLVITNFSKLKEDVQTHRKEAKNLEKGLDKWLTRINSIEKTLNDLMELKTMARELCDACTSFSSQFDQLEERVSVIEDQMNEMKREEKFREKRLKRTKPPRNMGLCEKTKSMSIGLPESDGENGTKFENTLQGIIQENFPNLARQANIQIQEIQRMTQRYSSRRATPRYIIVRFTKVEMKEIMLRAAREKGRVTHKGKPIRLTNKRVSGSLGRNSTSQKRVGANIQHSQRK

SEQ ID NO: 930157 - protein, 144 aa, Homo sapiens
MCLQDKECQGLQAANRCSSFTQPTALNPSQEQEHTGEQHPGRIRSHEPIEDSKCGDFIANESGSQQDGELERRWSGKGKSSVLIQECVASEEWKTQAGPDKHSSNSEALEIYSKSNESGQVCMGCRPTEYLGVQINFQVEWIFY

SEQ ID NO: 930158 - protein, 157 aa, Homo sapiens
MVGGGRKCLFSLIGHGISKAYSVILSSPMGWSRGSKIAFLLAGMAEGLALLAHLMAELHVPVRQDSLRAPSQISWLVAQGCGRLYQGIGKPITETVPRKKAFLGAAAKENERSGSRSSPQPSKIRLSYSRKKNVTMCGKQEFGKGLSWLFRLFFGSI

SEQ ID NO: 930159 - protein, 141 aa, Homo sapiens
MENWTLKYTSQKIQKCPFSETSFEAVVASLLSVIVILHVFISSSRSVVVKGDNASVLSEEIFKYLLLSRIQTQDKVQRLCVQVCNMGKLCVAEVWCTNDSVTQILSIVPDSNSHSDWCGYLTLISDHEHMSMFVGYSYVFF

SEQ ID NO: 930160 - protein, 138 aa, Homo sapiens
MVENVDSVRRSNQSGLVVVVRDPGLQRHDHFVTLASQKMDHCSRGREHGQPTPTPEVAHFIPTQDSLSRIGTYVLLTARGLGHVEKHTHIAVSFLACVAKPKMSSGLGWISDGLGYPKEEPRKHLELVITVRTDESKK

SEQ ID NO: 930161 - protein, 192 aa, Homo sapiens
MEKEFLTSGGTSVKYHKEIMKLLHAVQKPKELAVLHCQSHQKGEEEKAEGNHRADAEAKIAARQNLPSEIPTEGPLDRKIDGSSQAIKGKRHNGYSDGGHQATDGLTNGTPNELNSKLLLRTPGSLTGLESSPLEDTTTAGPLLRPYPAEVARVVIAQFPTVVGVSCLEGGLRGEASWTSGSGGGLEELFCS

SEQ ID NO: 930162 - protein, 135 aa, Homo sapiens
MVVRVLQRNRTNRTNALEALSPWEGSYTRAFGAEEPLRHGFFGVSVLFVFSWIHPKHDHHWTTIEFEEPSICERSFATNENGGQRARFSCQSGIWWQQPCQVPWEPRSAQHKFLSHPCCFAFCQAGKRKGMVTVP

SEQ ID NO: 930163 - protein, 168 aa, Homo sapiens
MQAPATGLDNRSKTLSQTNKQTNKQKTAKAEGARSRGPRNKIPGAPSGAAVWAAHLAAALLAKAVASKLLRAVILRPPCSGKGTECQSIAQNFGFQDFSSGHFLWENIKAKTEVGEMAKQYIEKSLLLPDHVITRLMMSELENSRGQHWLLDGFPRTLRQAEALDKNL

SEQ ID NO: 930164 - protein, 147 aa, Homo sapiens [sequence omitted]

SEQ ID NO: 930165 - protein, 137 aa, Homo sapiens
MSQLFGQSAVLWTITATCAASQITPHGNCGQQDVASYEPNCNDCNFSSESGHPAELPGSKLALAGEICFLQRVCEFSWLSWYVPVVVPGAEVQDVSLHTLLCFFRFSSMRFKRRETFDKVTMCQHLYFKVIADLCLW

SEQ ID NO: 930166 - protein, 150 aa, Homo sapiens
MCGMFRFVTRELPEARVSDAVSCSHHVDKTALLQRWSTYLKPEEPSGKWHYDRKQSGYGGQTKPIFWKKAKTTKKIVLRLDNVIFTDSLQRYLHEEQPGEIELVSPSGAISRFVSCPVIRVCVRACVCVHARACLGFSKYQLLLEAYLLP

SEQ ID NO: 930167 - protein, 137 aa, Homo sapiens
MAMSTWLLPGGSGGINLFQSHSNSENLQADDVIYKKNSFSEEKFKPAAEICISNEEVNISHQDNGKNVSRACQRSFQQSLSSKDWRPRRKKWFCELGPPPPLLHATWDLVPCNPAALNVAKRDQDPGGTAEEHQELS

SEQ ID NO: 930168 - protein, 146 aa, Homo sapiens
MKNIQTRGDIRSKDYKEVKRSGKSISGEEQVEEVTRANATGRGEPRCFVNSKGPSVAAAGEQGKTKNNATICLLSAYDLEAPSPLQVVLPFLKESMFILNMLIDVSRLPKMYKAKLCSDRLGHMSSQSLSPWAVSQACIFNLGKIN

SEQ ID NO: 930169 - protein, 142 aa, Homo sapiens
MWKLLEDNLLNSCFCQNPSCGLFAYCLVGSNCSLLLQLLSQSPEVIDHEGSALMKELMLFLQKWVYRKGMSFDPFFSLSHAVFFLHLPPRDDATRRPLPDASTLILNFPACRTMRKKYLFFVNYLVCGILLYQYKIDHFLSQ

SEQ ID NO: 930170 - protein, 148 aa, Homo sapiens
MDAQQDRPKSQDCLGLLAPLASAAEVSSTAPMSGKKHRPPGPLFSSSDPLPATSSHSGDSAQDTSLIPAPFTPASRDAGIRRMFRAREQQDALVLYQQDAFWVDPTATLLSGRSYCHPSYGHMSESHVIKETKGNHHKYKLRKVLQGF

SEQ ID NO: 930171 - protein, 171 aa, Homo sapiens
MLGKRYQKLPVNPSDLSFPRVEPDALRSFRWIKTVDLSSDLASGAGVHPTFADSVAERLKYLSQDCIPTRLDSIMTLTHQHFHILGLIEAAGVSYRNVSPGTTTPNTHPHPCLPAQGQQTHTPTQQHAPANCCSSPHHGFSVGFIIQKRPQGQGKLEQACTGSQFKSMTSA

SEQ ID NO: 930172 - protein, 141 aa, Homo sapiens
MAGQVAGGSCRAASHPWTLHLSLKQSWKELLTGNFAVNGREKVRYLAVKMDSSKSLSWLELVPMWFTAVVQKEHPGHRTVIFFSVLSSILGQIRAGGEGRVCENFQDIRDFPALESRGHRKAIWEQRLGWRLLKGNGVRGQ

SEQ ID NO: 930173 - protein, 494 aa, Homo sapiens
MIYLKCDYPVTILVLLSGGEEDRKMWEGLELRRDLLNSFDQNAGSDMDNEVQAQMVSHGNKELVGNWNKGHVRDLHRPGGLGGNHGFYGPAPGLSAFCIFGTWCPACQLWLKGTNVQLRPLLQRIQAPSIGDLQVVLDLWLHRSQAVQKGNIGSEPPHRVPTGALPSGAVRRWPRSSSPQNDRFTNSLHCAPGKAENTKRQPVKVTSNYPSNGSCGGPLIKDVNNREGRRRAESGNVHKNKKNFPNVLRNLLLMSPCIGLSLVSILEPIPLPQNGKQHSAISGIMDVKDRRHRSLTRGRCGKECRYTSSSLDSEDCRVPTQKSYSSSETLKAYDHDSRMHYGNRVTDLIHRESDEFPRQVFLFKTQDTDHKTNTLLTYNQVLQTQLDDSTDAQGGKELPASKSDGGPESDLVQLPQLAHSSIKCKNLPSPSRRNEPGVPMRSLRKLGQIVPIFACFQHRILLCLLLLWLLLLSMQITCLASIMLDPPGVKEENC

SEQ ID NO: 930174 - protein, 143 aa, Homo sapiens [sequence omitted]

SEQ ID NO: 930175 - protein, 123 aa, Homo sapiens
MEKFAFMSMANRSDLWNTVDPNLRRHYQDGGRDSKYIMDLIMEICGISSCMSQTPEATPCPDEHMCEDKDICPQHWGQEAAAAAQLKERKEEKNPAGRWMYSQTPGLGMQKTGMECQERSTCG

SEQ ID NO: 930176 - protein, 180 aa, Homo sapiens
MSNLSITLILTNWYFSSKLVLLISLFDSFSECSCYNSNSGAVDSARAWAAFSLTEQTLAMGDEHLCCAGGTAERQVELLVAWSQECGPDFKHIMESYQKQGGAAGTINPGSAKSVHCETCAEGKPDVDARERGQEGKCGMGTLRTGPCVRLDVLLCVGGGPNSRGSEPRKAGRVCSWCRG

SEQ ID NO: 930177 - protein, 154 aa, Homo sapiens
MVCIRFSALPCLGCLEVTRCSFLKGTGQIQERQVSYGESSHGVHSQITVSLVNYYKDFRFFLKVIGGLKTKVCYELPYIFKGYTGCYTDDRCWSQGRIRDLTKQLTISPVERSIWCKADEKWSEPGHTLKIETPGFVVEHERNRGIKDGFKDLK

SEQ ID NO: 930178 - protein, 131 aa, Homo sapiens
MIHTRALLQLHTVTTLLNNVEQSQPDTNEFTLCDSIYMKLKNRQTESLEFKSGNGSALGGGDWKLTLEVRAPVMFPDLGAGYMGTTIFNKTRTQSHLLPLAFAGPSRGGWLEKCRAEKEPGQGSEAALEMA

SEQ ID NO: 930179 - protein, 160 aa, Homo sapiens
MKTFMMIHCHFMNNSICGSDEVHGPHQPYDNPESLDLTSQIEYRSSFQSKSGKLLWIELCPPVYRLKSLPPVLQNGTLFGHRVFTKQLQKRLLSSRIALAFRAWQASFDVEMQSIRNWVHPNMEIPTVFFLSLPQHVPGNMAAPTYPHLCRTSWCPAFAY

SEQ ID NO: 930180 - protein, 165 aa, Homo sapiens
MSKQKLAARVKPTLRTSTRAVRRENVVLEALYRVPTRTLPSGAAGRGPTSSRPKNVKSTSSFHPTPENATVTQLQPMRAALEAAPCKSSEADLLKDLGAYLLYQCALDNTNLAIEKASRLRFLASQYVPVVVLGAKDSQKCESSRAALSDQMGAADFSPVFYPSS

SEQ ID NO: 930181 - protein, 355 aa, Homo sapiens
MVSPKYHWCGGRKPTELKYDVGGGERFDSLTDLEEHYKKNSMVETLGTVLQLKHPLNTTHINAAEIKSRVRELSKLAETTDKLKQGFWEKFETLQQQECKLLYSRKEGQRQENKNKNRYKNILPFDHTRVVLHDGDPDEPVSDYISANTIMPEFETRCNNSKPKTCYIATQGCQQNTVNDFWQMKFQENSRVIVMTTKEVDRGKSKCVKYWPDEYALKEYGVMRVRNVKESAAHDYTLRELELSKIGPGNMERPVGQYHFRTWPDHGVPSDPGVVLDFLEEVYHKQGSITDAGPVVVHCSAGIGLTGTFIVIDILTDIVREKGVDCNIDVPKTIQMMRSQRRNDLGKLSNDILEK

SEQ ID NO: 930182 - protein, 166 aa, Homo sapiens
MERYQSIAQGLGTAVLIQVGINQCPLNSMLLFPLNKGRSDYIFTTKFSESCLARAKEKEFMFNAISNKNGLLARWPNKNSSGLQLPARPTQKTGYFCISNRGIGEPPHPTPRTSAKGSREGLCYRAQILCFSQFFCNLQTRRFPRVPSPPGPWVSSTKLGGCSGRH

SEQ ID NO: 930183 - protein, 156 aa, Homo sapiens
MKYQQELWNKTTDAMKRVEEIKQKRQAKFIMNRLKKNKELQKVQEIKKSQAKHPSYPSPSCRQRKAAVRENGTAITTGCGHGRRFLKTSHFYKLLPRRSISDCCTSSEEGSVEVGPTKPGMGEYFLVYWLLRPWEKCSIWAGSVPFFQKAKSGNIR

SEQ ID NO: 930184 - protein, 161 aa, Homo sapiens
MRRLWKMFLSIPSPVARVCRHEQTGWSNPLASRRHAWELMEVGGVRSTPSSQIMHTGTGKKVFSGADSGQAGSVSRSPDGAPLCISSDRQGRLISRPHIRSGEKAWALGHQWYMLVQSVVRGTTLVGTGRDSTGQRGPVLRLTDDAGKHQLWLARGSVAVP

SEQ ID NO: 930185 - protein, 356 aa, Homo sapiens
MNLAVAHSLGPHCLYALFTPEASETTNPPEETNNSRGIALTAVTLTAKVSSFTPEPARPRTYQKEETLNTSEHQKEQTLDTPPLRTANTHREGGRHSDPNSWTACSNSGELILGHEFVLWLLNVKNSLHWAWFTGTDAMDWAQTELETALQASVARLGPQKRPADQGVLRTKQMNIISKSSIKPGQKIYNMSLEHLVVPELEDMLKTKSKHTDKLKGEKPTSLTSVDWHHPIEGLNRTKGIRRENLPLLSHCLSQDIGILLPAHWELHHQPPGSQAFRLGLNYASGSLQTADTQCQPAPERSQEWAISCKATGLELPKAMGTHFLYQRGLNVRPGVKADHFGALRFDCPTGFWTCL

SEQ ID NO: 930186 - protein, 159 aa, Homo sapiens
MAGGSTCTPLFIVSVLFLILLLLQVNPYGSSFIIDFTNIFTSLLSSLKKFKPDSIFQLIPGKRINVAVSVGIDHATYIVATQASISEWVVTEHTDDLTSAIGLCKSDYSDYCFECAAHYGNHIHIDFSFHCEVWLTEKSDHRALQRCQGSLHKFICQSW

SEQ ID NO: 930187 - protein, 139 aa, Homo sapiens
MPGRERGKLKISDSEGGESREWDVPEAEEKCSKEEEFKRAEKITEVIIKPLLMSHPMTFHQAINDAAKPILGTAKPVPNMNRAGKYTPQNLEKGPYNSGSQQKMVSKEEQIIGKFNKGTVVSCYKEPPNGQTQWNSVNL

SEQ ID NO: 930188 - protein, 164 aa, Homo sapiens
MTMEAKDLHAAGVVCQERSYDEGLQEAPCLGIQICPASMRGQVGAPGKASRQGATQIGQALSPGQDGHALSRSNTTQKLKPAKGAWQALEDEPPWPYSTTTLPEPNSLGSIQAGILPLPPSQPTLPASLSVHGIVGCAPEFQRSVGSMYQEKPHSEGEWELRFS

SEQ ID NO: 930189 - protein, 137 aa, Homo sapiens
MQLEDWLSLTQLEHWHDWASLHVLFSSQPELLRIVAAAFQEGADNVSGPLVALTHKWHNTNSAIQVTRPAHIKELHSLHGTRRLEAKGMFPPRILPEPISSFGPCSRHQDLRYFYPNGLSQPPEPTWASSLHLFSWS

SEQ ID NO: 930190 - protein, 148 aa, Homo sapiens
MASSGRWTWTHQTHSYLECKLNMRRSRKNTGASPVNGRGSTSSTLYFQRGDVARVQSAGLLEFAGGPLQTLFAWVSPAEAAEQQILLPAPSCGSFIPEGHLPDASKSSPQSLNAVLGDLLLSSELAGRNVEGKTVSDSKSERTGDFSA

SEQ ID NO: 930191 - protein, 198 aa, Homo sapiens
MEEEMAALIDNGSSMCKAGFAGGAVFPSIIWCPRHQHVKGGMSQKDSYVNDKAQSKHGILTLRYPIEHGIVTNWDDMEKIWHHTFYKELCMALEEHIWLRPDPLPHEEHGYSFTTKHGYSFTTTAKGEIMRDIKEKLCYRNLDLKQDMATTAYSSSLEKSYKLPDGQETTFNSIMKCDMDICEDLYANTVLSSSTTMP

SEQ ID NO: 930192 - protein, 140 aa, Homo sapiens
MPEDVDKISDFTQYPSPEFGYTLGSHYCSFRNEKTEPARGYKPARCFDKTLVKWRMEPGYSLCGILTPSELSPDHLAGEYFVPSETYVKKRIIVITSEPCSHFVKYRIVLIYECDITAAASLLPTHEVSDREYQGKKQKH

SEQ ID NO: 930193 - protein, 1034 aa, Homo sapiens
MRTWYMQYDVDNSDTVRWKQQHKRTLRPNSPILHPLLLAANGQRLKGEKEAKRALLDARHNYLFAIVASCLDLNKTEVEDAILEGNQIERIDQLFAVGGLRHLMFYYQDVEEAETGGVNLVSGKIKKPKVFVTEGNDVALTGVCVFFIRTDPSKAITPDNIHQEVSFNMLDAADGGLLNSVRRLLSDIFIPALRATSHGWGELEGLQDAANIRQEFLSSLEGFVNVLSGAQESLKEKVNLRKCDILELKTLKEPTDYLTLANNPETLGKIEDCMKVWIKQTEQVLAENNQLLKEADDVGPRAELEHWKKRLSKFNYLLEQLKSPDVKAVLAVLAAAKSKLLKTWREMDIRITDATNEAKDNVKYLYTLEKCCDPLYSSDPVTNQIISACKAYITNNGTASIWNQPQDVVEEKILSAIKLKQEYQLCFHKTKQKLKQNPNAKQFDFSEMYIFGKFETFHRRLAKIIDIFTTLKTYSVLQDSTIEGLEDMATKYQGIVATIKKKEYNFLDQRKMDFDQDYEEFCKQTNDLHVGCIIKFLLTVVCLFFPFCIMPLIITQSEGRGIFIMENELRKFMDVTFAKIQNTNQALRMLKKFERLNIPNLGIDDKYQLILENYGADIDMISKLYTKQKYDPPLARNQPPIAGKILWARQLFHRIQQPMQLFQQHPAVLSTAEAKPIIRSYNRMAKVLLEFEVLFHRAWLRQIEEIHVGLEASLLVKAPGTGELFVNFDPQILILFRETECMAQMGLEVSPLATSLFQKRDRYKRNFSNMKVPGLPKLKHHGNEEMVEPHADYSRRTPLRIERKALLVGFSFWVSSWSSLVEEAVNELVNMLLDVEVLSEEESEKISNENSVNYKNESSAKREEGNFDTLTSSINARANALLLTTVTRKKKETEMLGEEARELLSHFNHQNMDALLKVTRNTLEAIRKRIHSSHTINFRDSNSASNMKQNSLPIFRASVTLAIPNIVMAPALEDVQQTLNKAVECIISVPKGVRQWSSELLSKKKIQERKMAALQSNEDSDSDVEMGENELQVF

SEQ ID NO: 930194 - protein, 170 aa, Homo sapiens
MRRENSYGLVLGSVCKEPCDVIHLQVSQLWIPAPAPVEETSRLVKIVTKFNWKFPSPCGLSPIPLAALSKDPCETKSGMASLETKSAHRTLPAASSTSAFHLTLSVHLSSRFRSEDECSGADFPPLTLWALGVSQLSHGAGSSKPLPSKGVWILSAFLGCSCSSSWSKSS

SEQ ID NO: 930195 - protein, 141 aa, Homo sapiens
MARTTTKDSAKSTTLHKSHCNLKILLQGHLSINCLSDFRLTGWGALTIMAEGERNVSHGGGKKENESQAKRVFPNVRFIHYHKSSVGETIPMIQLSPTGSLPQHVGIMEVQFKMRFAWGHRAKPYLAPTNNRCQPIALCQD

SEQ ID NO: 930196 - protein, 144 aa, Homo sapiens
MCAMASRLLLPCCLPQTSGTKRHSSGYLSSLADCHPNRLPNTSQKGKVNFKTPHLCQAALMKSNRNSFKLSEGKRMRYREDVGRITSKGGRNSMASQKHPASSTCQWPQYDPLLISASLCITLPADLGFDMHTAEACYPMTSKF

SEQ ID NO: 930197 - protein, 151 aa, Homo sapiens
MNVAKSVVVRKTRGESDPNQSRRKGFGAEGRAAAGVAAHSVSFSLKVTSMVRREQGRSGGGELRQVGRFDLICRVQVKPGDSEEPGVQSAIREKKRMGQRRTKSPTQHPNCPLYARYQRARHTITIQGQALCQCSFQGHLREPPVTDLEAS

SEQ ID NO: 930198 - protein, 131 aa, Homo sapiens
MFYMLKPFLALDNSDIAAKSKGIGLNLRLNVRVVRVWPWFPSYRCEVMRLQGHFMPSQMLPLKSAVCSVNAWILLEHWNGLKSRTFPFNNLKKQLHTISIFKLVPHTIKQGSKKSRLLTLEGGPFSDPGEN

SEQ ID NO: 930199 - protein, 143 aa, Homo sapiens
MDNSGCSALRAATIATKICSLTPETRGTTNPPEERNSECVKHQKEQIPDTPSLKTVTVTAKVRGFILEVSETKNPPILDTVDVLASVMICVHISAETVAAGVFVQHDFQLASHHTLKLPIHTYLSSELGSRDSRSEFLPSKSS

SEQ ID NO: 930200 - protein, 337 aa, Homo sapiens
MQIQHTTASLIAKVATAQDDITGDSTTSNVLIIEKLLKQEDLYISEGLHLRIITEGFEAAKEKALRFLEEVKIRKEMDRETLINVARTSLHTKVHAELADALTEAVVDSILAIKRQDEPIDLFMVVIMEMKHKSETDTSLIRGLVLDHGAWHPDMKKRVEDVYILKYALAKEHIVTLHRAKRRNIEGLTLASGEVALNSFENLNPDCLGHAGLVYKYILGEEKFTFIEKCNNTRSVTLLNKGPNKYTLTQLQRCSAGAVEVAMAEALIKYKPSVKGRAQLGVQAFADVLLIIPKVLDQNSGFDLQETLVKIQAECSESGQLVGVDLDTDDAVLTVIN

SEQ ID NO: 930201 - protein, 472 aa, Homo sapiens
MGKEKTHINIVVIGHVDSGKSTTTGHLIYKCSSIDKRTIEKFEKETAEMGKGSFKYGWVLDKLKAERERGITIDISLWKFETSKYYVTITDAPGHRDFIKNMITGTSQADCAVPIVAAGVGEFEAGISKNGQTREHALLAYTLGVKQLIVGVNKMDSTEPPYSQKRYEEIVKEVSTYIKKIGYNPDTVAFVPISGWNGNNMLEPSANMPWFKGWKVTRKDGNASGTMLLEALDCILPPTRPTDKPLRLPLQDVYKIGGIGSVPVGRVETGILKPGMVVTFAPVNVTTEVKSVEMHHEALGEALPGDSVGFHVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCAESFSDYPPLGRFAVRDMRHTVAVGVIKAVDKKAAGAGKDIQLSLSIHGGLIPGPLMNTKI

SEQ ID NO: 930202 - protein, 194 aa, Homo sapiens
MIVRPPQPCGTHLVAAGIPWIVAKGKELEAARSRPVWQFRNCGLNEAAGTPSAQGCGPVLVCGLLAGELPAFKEMGSAENGSKPMTLRHLEAEIHSVSGTAKVASFSMAGVSRVVILSVCVPCHPYLLVASLTLACSSRRGHWKESSGAEKGGEWTIKGSQVLEAMTAMAFCAAGPSGAPVSLAAIWGGMPPGR

SEQ ID NO: 930203 - protein, 134 aa, Homo sapiens
MYNAFKGRIENTELPAADSGRNDHWQQGTMWKKSRDYEFVDPYNEDIVDNDGYWSNDKSNENHLGASIVYQAKVVGLKETESVIVGSGKSDVPRAGRREEPSGVCQARADAAEFAWEQRGRHAGRPQQPLNLWW

SEQ ID NO: 930204 - protein, 139 aa, Homo sapiens
MLQGTLPHLGPRSHCGERAAAITGWDLGGGGLAFLFYTYKGLFTLSRCQRTKTQVALVAEVEAEKACSWGLSADGAPSNEGKSLLRGRSGECVPASGRAADENIYPGKKEEVSGAITPIELSSHDNTVPSGIIPAEGPA

SEQ ID NO: 930205 - protein, 212 aa, Homo sapiens
MKELKDAGVVIPTTSPFNSPIQPVLKTDASWKMTVNYCKLNQVVTPFAAAIPDVVSLLEQINTSPSTWYAAIDLANAFFSIPVQQEKALQQVQAAVQAALPLGPYDPADPMVLEVSVADRDAAWSLCQSPIGESQQRPLGFWSKALPSSADNYSPFEKQLLACYWALVETERLIMGHQVTMRSELPIKNWVLSDPSGHKVSHVQQLSNIKWK

SEQ ID NO: 930206 - protein, 147 aa, Homo sapiens
MAVIAWERLWASERQKSGTGEAVMKRDCVGWCASAGVALLELSDSQARSADKGAMMRVPGSTLVEHLRLHCRQQLSLPAQVSMGVMGFSAAWSLEVHGGSGLLLTCSTHPFPRSRWGLGMSPSDQQTCAGHPAFFPFSPHVSSLCPL

SEQ ID NO: 930207 - protein, 147 aa, Homo sapiens
MSRQKSGARMEPLWGKDGTSTRAVQRGNVGLKPPHRVSTGGLPSGSVRRGPSSSRPQKGRSMNSLHHAPGKAAGTQCQPMKAAMGAVPLRATGAELPKVLGAHFLHQHSLDMRHRGFPEPSVICTSDLHRSQYQMCCGEVSALSFNI

SEQ ID NO: 930208 - protein, 707 aa, Homo sapiens
MSGGKLLIVRQSSYPTGGPEVLQNRDDAGPVISGGPEVLQNRDDAGPVISGGPEVLQNRDDAGPVISGGPEVLQNRDDAGPVISGGPEVLQNRDDAGPVISGGPEVLQNRDDAGPVISGGPEVLQNRDDAGPVISGGPEVLQNRDDAGPVISGGPEVLQNRDDAGPVISGGPEVLQNRDDAGPVISGGREVLQNRDDAGPVISGGPEVLQNRDDAGPVISGGPEVLQNRDDDGPVISGGPEVLQNRDDAGPVISGGPEVLQNRDDAGPVISGGPEVLQNRDDAGPVISGGPEVLQNRDDDGPVISGGPEVLQNRDDDGPVISGGPEVLQNRDDAGPVISGGPEVLQNRDDAGPVISGGPEVLQNRDDAGPVISGGPEVLQNRDDAGPVISGGPEVLQNRDDAGPVISGGPEVLQNRDDAGPVISGGPEVLQNRDDAGPVISGGPEVLQNRDDDGPVISGGPEVLQNRDDAGPVISGGPEVLQNRDDAGPVISGGPEVLQNRDDAGPVISGGPEVLQNRDDAGPVISGGPEVLQNRDDAGPVISGGPEVLQNRDDAGPVISGGPEVLQNRDDDGPVISGGPEVLQNRDDDGPVISGGPEVLQNRDDAGPVISGGPEVLQNRDDDGPVISGGPEVLQSRDDAGPVISGGPEVLQNRDDAGPVISGGPEVLQNRDDAGPVISGGPEVLQNRDDAGPVISGGPEVLQNRLV

SEQ ID NO: 930209 - protein, 127 aa, Homo sapiens
MKSYINIKAHITLSNICEYGPASCAASTPSPPHGGFRRRAHRFALRQTSPACLGSPLSPQVTSASQFWLGGILGTTMRLERVLPERWDSPYSLVSPRILLSALHTVPVCVVPLFVSMCSHHLATTCK

SEQ ID NO: 930210 - protein, 194 aa, Homo sapiens
MEGAGAMEGAGVIVILVLWKVLVLWKVLVSWESWCYGRCWCCGRCWCHGNPGAMEGAGAVEGAGVMGILVLWKVLVLWKVLVSWESWCYGRCWCCGRCWCHGDPGAVEGASTMEGAGVLVILVTGALKVVGAMEDAGAEEGTEALEGAYAPSYAARPGCFQPDDRARLSNNNSNNRRTSVSGLLLNKQQQVKQK

SEQ ID NO: 930211 - protein, 187 aa, Homo sapiens
MASHGFSNSILRICYVVGTALSTVNPTGEKMHPYPKALTFWWKHREQRNTSMYKALGGHVYKKNRAGNCSIPVPGDPHSLRTARSFKIAKPGTAQMSTESRMCEKTGLPSSGAVMKVKLSVDDINPSLSTVFHRIVGLKQKSVPWDFPWDFPALKEGTATELYEQPPLPSNRGPVLDMLVHLTFLLG

SEQ ID NO: 930212 - protein, 252 aa, Homo sapiens
MQDDGRPGLGHMKKRLGNSLSITQDRAQTYTLAYKRRSTHVIPVSQMHRLTLGEAPPKSHPAELRDLGQVPFFSGPQVFSWASLPGFCANPGGMQASGTVGHPMEEPPFEDNEMAKQNCSGTKWLITHAGVILAIFIHLAPQVAARPLSDLDSLRTHQAFATGSMEWPEPRAGWILGEDSGLAQEGRPPICAVTCFQGGGWKSKIKVLVGLASGTVSKSVPTANRIPRTEWLQEQEFISHSSGSPRSGCWQI

SEQ ID NO: 930213 - protein, 145 aa, Homo sapiens
MAISCCPSFLLSSAPGGRGLASHQRVLFYNCKPQDVPSVDLMRKSRVPYYNTPFMGASSNNVPCVFITPGPSVYGEICVENGNQTKSCICQDAVRRAQRHIRDVPAKGPESALDHEESSGKPNLRDILQKIWPIVLKNSPGIVLD

SEQ ID NO: 930214 - protein, 217 aa, Homo sapiens
MMAPGQTLFLPLVETNINPEVWAIQGKIGQAITTTPVGIQLKDPTSFSNQRQYPLKPEVRKGLEAIIDNLKMQGLLTPCNSLCNTLILGEQNTKGKWKLVQNLCLINEAVVPIHLVVPNRYTLPAQILEGTKLFTVLDLKDASFCIPLYHDSQYLFAFEEPSNQTTQLTWTVKVLQNIDDILFCSSPEEISQEDSKALLNFLASRGYNVSKSKAQLC

SEQ ID NO: 930215 - protein, 184 aa, Homo sapiens
MCLEKPLTLNASPSKQPGEGTVPCKATGAELPKTMGIKHDLDVRHGVKGDHFGALRFDCPAGFQTCMGSILPLRGNKLNRFSSAKRNFTGRILEAQRTEENESSQPGLGNRTSKVLPWKSQSPCHCIPHRKAKAQEYILIDSSSCGPQMSSKPGQALEATSSVSGSGTDCGRGATTQGPAKPKT

SEQ ID NO: 930216 - protein, 145 aa, Homo sapiens
MITSPSSSPQPALGSEHSTYCLHEFDYPRYLICSMSAFVKYQSTQLMFDMHRLNLGMPPERGHYYLSHSPAAASLPHTVLLQLRGGLCTCRSLKKLCLGVQWKSEAIEMNPSIGQIDYVILTIDSPLRLLVLTQVYNSHCVNNCV

SEQ ID NO: 930217 - protein, 144 aa, Homo sapiens
MMVSDCLFSHYTNGLQKLKISCCWEPVKDYASSSDSHSQRGILKVNFDQCQSHYNVFAASKKTTFEGENTHLNSSPGLLAVTDTSVPLLAKEKDIPLNAAVPWGISELGLPTSKNAYLLNSSPPPTLREPKPKPTAGTLPRFPQ

SEQ ID NO: 930218 - protein, 170 aa, Homo sapiens
MRAREPEDYFFRVPTGALPSGPVRRGPWSSSPQNGRSIKSMHHVPGKATDTQCQPMEAAERGAIPCKATGAELPKVVGAHLLHQHDLDVRHGVKEDHFGALRFDCPTGFQTFMGPVAPLFWLISSIWNDFIYLMPVPPLYLGMPFAFHHDCEASPDTSNRRNSEIQCVKW

SEQ ID NO: 930219 - protein, 144 aa, Homo sapiens
MKVCSFAPEPGRPRTHQKEETRNTPEHQNKQTPDMPPLRTVTLTVRVRGFILVVSETKNPPIPDTLNKCDAISTIEPMGSGTCKGIKISRGPESVHMTPLLQAQKTIEKTSALNKTTTKDLHRIHCIPLLPPPEQVLDSMAERP

SEQ ID NO: 930220 - protein, 135 aa, Homo sapiens
MFLTIAAADLSDPILYSNVTLPRNEVYFFSLEPRWTLIGRLKRSTQTQQDDITGMHERECAGKSLVLSLEDLHCQSLGDPELDKMSPRTGEESVEQKSEKGLEEKDSRSPDPDSILFLQRNHRAQALDVRGDELD

SEQ ID NO: 930221 - protein, 264 aa, Homo sapiens
MEDSYKDRTSLMKGAKDIAREVKKQTVKKVNQAVDRAQDEYTQRSYSRFQDEEDDDDYYPAGETYNGEANDDEGSSEATEGHDEDDEIYEGEYQGIPSMNQAKDSIVSVGQPKGDEYKDRRELESERRADEEELAQQYELIIQECGHGRFQWALFFVLGMALMADGVEVFVVGFVLPSAETDLCIPNSGSGWLGDEGLVVSDGGEKVFMGKFLNLNNHELWVQGGGPCHMVLGPPDQALCLNTRVLRLKNTVIITFPELLILSS

SEQ ID NO: 930222 - protein, 176 aa, Homo sapiens
MKSLCAFQLYQRWGLLTVPTKASSAMVVAGGSGIQHRYMLAGQVKQNPPMQTHTSKVMWGLTVGLWEARVWGGNVRAAAWPQEPPHWSSPLVRHGPLTQKPQCGPPGHPRLPCEQAWCARAAALPRLHITVCQTEGPVEWIHEAQVGITVLLIRDVTPGGPAVKFLSLYSLYFSAG

SEQ ID NO: 930223 - protein, 158 aa, Homo sapiens
MLFGQAYVVCHGFPWLGKGNPQIPCASWVRQCPALLWLTLHGLHPLSNQSQCDEPGTSGGNAEITSLLHQSRWELQIGAVPIWPSSVSSLLNWRKLMKSVSCPIKVVVMAGGTGFQLVIICECLTENLSPMTVTAGPLLRRKVTAAMPLGLVISIEDG

SEQ ID NO: 930224 - protein, 200 aa, Homo sapiens
MPKSKGILGGLRIQKDVGNLGIPEDLLNGFDQNAVSDMDNKVQAEVVSDGDEELDGNWSKRDSCYALAKIPAGFCPCPRDLWNFELERDDLENLTQEISKWMCPDVIMGGSGRVPHEHGEGTEAPGCTANKEGAHLCQQSWMDVFDCATGSAVYTQSLWDAGQETGQGAQLGRDTRQPEATCGIDNPLVLHQCTESAGAG

SEQ ID NO: 930225 - protein, 148 aa, Homo sapiens
MAKRSQGVVQAVASEEASSKLWSLPHGIGALPSGAARRGPPSSRPQNGRSIDSLHREPGKASKTQCQPMKAAMGGVPHKAPGAELLMALGAHSLDQRVLDVWIQLQLPSHGCGLGHSCALGLPEVAPAPAGLEMPIPSAQPVPTPGAH

SEQ ID NO: 930226 - protein, 122 aa, Homo sapiens
MGSQTGSTKLEGTGIHTRMLTACTWPVLITTPFNPSRRGMGELSKGYVGKGGFKGIPYVSCANTRLPENVPVVEAGSVFASYSFQTFFFHLNKERPSPISLEVPNSDIQNTDVCKASMSPST

SEQ ID NO: 930227 - protein, 135 aa, Homo sapiens
MDQSAGCGPLPHCGSFVLSLFAINLGTAHSLGPHCLYELLTLTKNVCSFTPEARETMNPPGGTNNSRCAALRAVTLTAKVCSFNPEPARPRTPKKEETPNTSEHQKEQTLNTLPLRTVTLTARVRGFILEVTRLN

SEQ ID NO: 930228 - protein, 149 aa, Homo sapiens
MNVFFYYYNSLYVPLYSLPVLRGKYTMDKITKLLYVHWLPLRVRCSLCLYSYTERNSNVRLLEEIRIPESKTMCFEDKNLLPELHPSLRVSLYICEFRIHVEASFSVFQLGCTLELPGELSKIQLHKRMPGMSSALPSIGGTLSWPPQV

SEQ ID NO: 930229 - protein, 158 aa, Homo sapiens
MGRNQSRKAENSKNQSASSPPKERSSSPAMEQRWTENDFDELREEGFRRSVRTNFSELKEDAQTHRKEPKNLERRLDEWLTRINSIEKTLNNLMELKTMARELSKLSFLSKGEIKSFTDKQMLRDFVTIRPALQELLKEALNMQRNNRYQPLQKHAKL

SEQ ID NO: 930230 - protein, 146 aa, Homo sapiens
MMGAAPVLFSAAFAHVCSLTKVHSLSRLTVGQKLWFLFKWVMAVDHVALKFPGLPQSGWHVGGPDERAIAFFFDGTGWLQWARMESFPSPRIIRDFFSSTYCRNMVKLLEMILNNFCKQIPLQQFICKRGNGHANDEYKFLCLVRE

SEQ ID NO: 930231 - protein, 189 aa, Homo sapiens
MAEGEANMFFFIWQQERDMPSKMGKASYKTIRSHDSLTVKKRAWDSLDKVIKENNELRDSNSQLQKQILSLNSAKIALSESLISCRERAEIVEKQTLAPIMGAADLQQKVHAQPHQLSFVKVKPLIEKVWDSATSKVDVWEDPDEAGYTELVNYDESILPEETASPSPVVATSPPDPCCYQLFHLCLRV

SEQ ID NO: 930232 - protein, 140 aa, Homo sapiens
MIPEEPLLKHEGASALRPSLHKGGGWGLVHSAVSDKISEVRADQVLCRLNWSGLPVALKGKPSTGGCPGLHSQPQLPGRLTFALALDPATTEGLQCASPYYTEARGSIKDLTTYPMEQLEEDLRREFKTEGAARAKALRR

SEQ ID NO: 930233 - protein, 151 aa, Homo sapiens
MTRSFQRTHQKLSRCWHHAACTACRAAHGKIEQKVQRFRIYSRPHIHIDFSTVNIPHQSEWCICYSLLTTLTHQYHPKSIVYIRIRPWYWTFCGFGQMSSDRIIFHSLDVLQFIHLPAEGHHACFQVLAIVSLDAINIHMQVFVWKYFQFL

SEQ ID NO: 930234 - protein, 199 aa, Homo sapiens
MGCPQDAVPWVSQVEEVSPHWGPGSWSGWHSGAAECCWVKSHLSQSAWLLSQNPTNSGLKQQTVISYSSGGWKSKVKALVTWFLREVTVYEKVALTRHGICWHLDLRLPSLQNYENFVSHLLCLPNAAKSSLQPQRACLLHFSPSAHPPQNPPKKWRGEKWNKLSQQDRGKKGSACTQVEGTSQAWPDADVCSRQKTSS

SEQ ID NO: 930235 - protein, 229 aa, Homo sapiens
MGRKAGETTHNINNAFGPGAATERTLQWWFKKFCKGDRALKMRSLVAGHRKLTTTMRPVIKLISYNYTEELHESMRCTENCNACSWHWSTERAQFFSTTMLVEHTFHIPRHIPQPTPQKLNKLGYQVLPYPPYSPDLSPTSYHFFKHLDNFLQGKHFHNQQDAENAFQEFIKFRSRDFYTTGINKLIYHWQKCVDSNGIFPPKNWGINPPFLFAMRFGKENEGEMLTVI

SEQ ID NO: 930236 - protein, 150 aa, Homo sapiens
MERNQSRKAENSKHQSTSSPPKEHSSSPAMEQRWTENEFDELREEGFRQSVKTTFSKLKEDVQTHQKEAKNLEKRLDKKLTRINSIKKTLNDLMELKTMARELCDAYTSFSSRFDQVEERVSVIEDQMNEMKKFRERHKDSPQEEKLQDT

SEQ ID NO: 930237 - protein, 135 aa, Homo sapiens
MPDDWKAKAKHSSDNNKTPQAIHLSLFFNKHSPFLSQCLEFELTTQPNNFAALSLYLELFFCHILVQGVRNRALTDFFFNLAEELSLFQLHNIPFEHSPTEHVFRGTSASSVIYISAVTTFPEKPEFSVSMEHTK

SEQ ID NO: 930238 - protein, 146 aa, Homo sapiens
MGQRAKAGAGECRLVLANVYKESCDVIHLQVFQPWIPAPALVELAGERSGLCESPWMKFDPSLDVQIWGAIFQNSWYFPPLRKDTILRTFVKCKRQSPRPCKHGLHVASAVMAAVEVLGLGITPLFLLTSKFWSTARVEIKDELLY

SEQ ID NO: 930239 - protein, 200 aa, Homo sapiens [sequence omitted]

SEQ ID NO: 930240 - protein, 156 aa, Homo sapiens
MGCGYARHTWYHEAVSIEAGLTWLLSQAGSGGSCCSRTVVLSLIRHKSPFLYETFLLEPKKSKRKVPDDSVPGEDPVSGLQTTAFLLYPHMEKRVFSCLFLKWHQSHHDRPTLLTSCKPNHLPKVLPPNTITLGLGLQPRIFGGVTKEPLGMPKSS

SEQ ID NO: 930241 - protein, 272 aa, Homo sapiens
MAHVCICLLEFAGGPLQTLFAWVSPAEAAEQQRLLLVPSSGSFIPEGHPPDASQSSPSGGTEVGDPLEEAVCPLAELEHCARRSAAFFGASRQERLSLLKLHPQPPLPLGALSLEDGSFICKPLTGAAAFLSEIPCPERRNLERQSGYSSFAELRWAPPSLNFLVALFTLVIRQGHLSLLKLHPQPPLPPGALSQYMGVLSISPLLGLLPFFQRCFAQSVENWQSAHSSLAEVQWALPSSNFLAALFTLTPSLRVKNGPWTDRGQKTEAKEG

SEQ ID NO: 930242 - protein, 144 aa, Homo sapiens
MHCLKSVPRYSTLGEVLKTLLQRWLLQPCPWLVARLLGKSSLYCLLEIRMEQLKFLLYSKSADSLGCFGGGKGRRFYHVVLQEREESPESNQRSCSKSASQADSLISWTLLGEAEEQRRMAGEERDRCTASSSFKHVSWKFRGI

SEQ ID NO: 930243 - protein, 167 aa, Homo sapiens
MRGLRPRELIVPCFWNVPSSSLIIHFLLSTFDYPHPKGSLFQEPFYDSWRLPSSQEEEFQLQGEQELGTCPWAAAAVALHRLLLPRDAINRWATDLTASCDVIRKPTGATAEPLVAASFMGLSSIILDGKATGIVTFFPSGDSGSLTECLELRVLSICCNKPGNKSD

SEQ ID NO: 930244 - protein, 152 aa, Homo sapiens
MHNVLIAEPYKFQQCQGCKLLLKPIIPCLISSDLKASNGGNLTSPRFKALLQLLDRDADKWNADRRKQKATKNVELLCNSGHLNVPTLCQALEKGRGCDVTAPPMTQHQGTARNRHVEALATGTLLYSETTHFSQLRHQAAGELENQNRLNV

SEQ ID NO: 930245 - protein, 167 aa, Homo sapiens
MRGLRPRELIVPCFWNVPSSSLIIHFLLSTFDYPHPKGSLFQEPFYDSWRLPSSQEEEFQLQGEQELGTCPWAAAAVALHRLLLPRDTINRWATDLTASCDVIRKPTGATAEPLVAASFMGLSSIILDGKATGIVTFFPSGDSGSLTECLELRVLSICCNKPGNKSD

SEQ ID NO: 930246 - protein, 484 aa, Homo sapiens
MLQRIWLAAMKLLGIKAPRGKPGISLVHQTYTWPCQTLPRSSCPLPHPWPWLFSSIPSLYLPDAISTTTPKLGQPKVSSDIAKWFREFSTMTIALLGFAIFLLHCATCEKPLEGILSSSAWHFTHSHYNATIYENSSPKTYVESFEKMGIYLAEPQWAVRYRIISGDVANVFKTEEYVVGNFCFLRIRTKSSNTALLNREVRDSYTLIIQATEKTLELEALTRVVVHILDQNDLKPLFSPPSYRVTISEDMPLKSPICKVTATDADLGQNAEFYYAFNTRSEMFAIHPTSGVVTVAGKLNVTWRGKHELQVLAVDRMRKISEGNGFGSLAALVVHVEPALRKPPAIASVVVTPPDSNDGTTYATVLVDANSSGAEVESVEVVGGDPGKHFKAIKSYARSNEFSLVSVKDINWMEYLHGFNLSLQARSGSGPYFYSQIRGFHLPPSKLSSLKFEKAVYRVQLSEFSPPGSRVVMVRVTPAFPNLQ

SEQ ID NO: 930247 - protein, 176 aa, Homo sapiens
MGTDSSKKGLTDADPALQTQNWRCGGLELEELEVWRPRAGGIGGVEASSWRNWSIACTTLKCPNAFLGHMAGGHTPCGASAMCCGCKHRASLRDHPDNSGSQLFKRARPRAHSHLPTRSHSNPSREESMLMRKLKFREAGRLLKVTQQQALRMDLNSCLPDSQVRPLDPMLCCKWG

SEQ ID NO: 930248 - protein, 208 aa, Homo sapiens
MCRFVTQKNKKMPFKILLLTDNKPDHPRALMQMYKEINTIFMPANTTSVLQPMNQGVISTFKSYYFRNTFYKAIDAIDKDSSVGYGQNKLKIFWKQVTIPDAIKNIHVHGRKSEFCSELQLSRSQVLIISSWQKFMVVETRKRMNLIERLKMFLGDSGFKGGIGSQEERTNAGGSNSNSQATKKAMGDDLGDRSYVLHFGCCVLVHLI

SEQ ID NO: 930249 - protein, 135 aa, Homo sapiens [sequence omitted]

SEQ ID NO: 930250 - protein, 402 aa, Homo sapiens
MRKQEEQMGKQEEQMREQEEQVRKQEEQVRKQEEQVRKQEEQVRKQEEQVRKQEEQVRKQEEQVRKQEEQVRKQEEQVRKQEEQVRKQEEQVRKQEEQVRKQEEQVRKQEEQVRKQEEQVRKQEEQVRKQEEQTGEQEEQMRKQEKQMLKQKKQMGKQEEQMGEQEEQMRKQEEQMRKQEEQMRKQEEQMRKQEEQMAEQEEQMQKQEEQVRKQEEQVRKQEEQMRKQEEQMRKQEEHMRKQEEQMRKQEKQMGEQEEQMRKQKEQMRKREEQVRKREEQEERLWVEYEKMQEEEEKVRGQVEKMREKKERMGEQEEKMQEERCSEPCLPPSKYPCDMSHAGSLKPAREAGKGYSHDNRTAQQITQLPPGMKNTQEHPGLGSTSCILFFYRGDKKKIKIINI

SEQ ID NO: 930251 - protein, 150 aa, Homo sapiens
MVNFLFFLLEMSVCFQNRGISQERYCLDKVCCGSGFLSGCLPYGLWLRLSDHLLGSWTSPCEHVHPPSSQENKREMERQRQQGQLQPGGARGTALCSSVARKMAAIHFEGGEFTPGSREERILLPRLALSLPQSSSENYHVTLSNENVVT

SEQ ID NO: 930252 - protein, 141 aa, Homo sapiens
MTADHHIVLLEEEINRSMTDKFQKLEFLKLKKRERQNISVVIFNSGHFFNKYGKVDLGVLSSPFKGSDRQQEEQEREGFLEAVTEQHIPRQKRVVEMISYSTYLIIKKISSFCSGISSVIKRSRIPGGMLKLTGQFLATIA

SEQ ID NO: 930253 - protein, 144 aa, Homo sapiens
MDCNIQGRRGGVRVGSLPCKRQSTTDFSRTYLEREELKPAMNRRKPGFLETSPKPSNFSEFSEAPGGCLHFNGKSSESSGNFSQFYFLIERQKPWLDAATIQGTPRIASNYHKLENKHETDSSSELLERINLKTALFQIPGLLN

SEQ ID NO: 930254 - protein, 152 aa, Homo sapiens
MSNGAFWPRYYTFPTVFATHRPGDSFGRHLPAGVDRHLIQESSNWHLASAPLERSCQRKEQAAIFAILQPLLVISRQTGSGVDLQQIPTDLQQRVLTVRRKTDKQELHQHQQKGYPHRNPIRRSPTSKTKERLFSSKGQQFLTSKGTKLDGE

SEQ ID NO: 930255 - protein, 157 aa, Homo sapiens
MLSLMVLGEKSALTAVLGHSYIAITKYRRLHVLVCFHAADKDIPKTGQFTKERGLIGLTVPCGRGSLTIVTEGKEEQVPSYIDGSRQRENEDDAKAETPDEAVRSRCTGSIAPASASGEVLGFYSWLNAKREQASHMVRKGTREGSGGGTPLCNNQT

SEQ ID NO: 930256 - protein, 150 aa, Homo sapiens
MKAPITESCSVQVIYCYAMKGTQCHFQCTLFIEAVTKIHSVSRGGAMDFTSWWEKCERICGRVLKPPQEHIRKKEEEEEEEVKEEEEDEEVKEEEGEEEEEEKKLLVFQLDSFSPLCPPMTTRLLRTISLAWKSSVKLSCSHFWSHCPKS

SEQ ID NO: 930257 - protein, 151 aa, Homo sapiens
MAVRASLHSTLGLSWNNSMKEAEATLLQGSSFEMQDKRFVFVKWGDGGVFLSSPHGLPLAPYRGWHIAFAQRDTSLLVSETVHPILWVLIFGRRTSTIYHEEDRGGGERRGGEGKGNGVFLKKWLHYGNEYAKMSIKHTEFESSYVLTRPQ

SEQ ID NO: 930258 - protein, 159 aa, Homo sapiens [sequence omitted]

SEQ ID NO: 930259 - protein, 200 aa, Homo sapiens
MGLDLIPNSVTQMGPNPIMSGILIRKGKRHRRASSQVHFRARSDTREVYHGKMSLQRQQGPTDTLMLGFSLQKSKRVHSNCSIVPSVWHFLRTVPETRTVFRQAAQSGQHNTPGTIKRNKPENADIQIFLPVLGLLISTWALLKADEMLCPVCIHPILAPCCRSHREVFSIRFFQASMFEMHTQFHSILTGSPPRWIGHW

SEQ ID NO: 930260 - protein, 158 aa, Homo sapiens
MRKDDDDDDDDGDEDDDSDDDGDDDDGDDNDDEDDGDDDDHDDEDDGDDDDEFSRVPDNPMVPGWRVWNTRSLPEFRGNEGGPPATELFCDVKTNHLKDFFLRCLIGQCSMDEIQFYDNMLSQLLEKYVISPCTNSLCSLVDTPLSDLTSGTDVFLVV

SEQ ID NO: 930261 - protein, 170 aa, Homo sapiens
MVEKSGVGTSKQSDSHIFCSKPSLSKIHRQHSQEGSQWTLAMIAGLAPGPSCILGVPQKSQLLPEFVVENQCVSLHRLPPVSNVHIQHIEITLPCQHIWIEPTVQEQHSSLQQLYLGSPPNSGQDEVSGGAKAPVEDRGVLLIGLNRSELEGSSVNHGGFLEYPFGHSLK

SEQ ID NO: 930262 - protein, 259 aa, Homo sapiens
MEWNGTERNGMEWNGMERKGMEWNGMEWNGMELTRIEWNGMEWNGTERNGMEWNGMEWNGMEWNQPDCRGMEWNGMQWNQPEYRGMEWNGMQWNRIIRNGMERNGMEWNGMEWNGMEWNGINPIAIEWNGMECNGMEWNGMELNRIEWNGMEWKGKERNGTERSGMEWNGIVWNGMEWYGIEWNGKNWNGMEWNGMEWNGMESNRVQGNVMERNAMEWNHPEWNGMEWNGMEWNGINPCAWNGVEWNGMEWNNHEWNGM

SEQ ID NO: 930263 - protein, 389 aa, Homo sapiens
MEWNGTEWSGMEWNRPECRGMERNGMEWNGMEWNGIDLIGMEWNGMEWNGINPNRMEWNGMERNGTDWNGMEWNGMEWNGMESTRLQGNGMEWNAMEWIQLEWNGKNGINTSGMAWIGMEWNGINPSTGENRAERNGTERNGMEWNGMEWNGTERNGMEWNGMEWNGINASAGEWNGMECNGMESSGMEWNGVEWNKPECNGMEWNGMEWNGTTRMEWNNRSECNGMEWNGMELNGMEWNAMEWNQPECNGMERNGMEWNGNYPNGMECNGVMNPNVMEWNGTEWNGMEWNGMEWHAMEWNQPSAIEWNRMEWNAMEWIQLEWNGKNGIDTSGMAWNGMEWNGSPEYRGWMDGCMEWITVWMEGWMDGWMDGWMDGWITRCIDGWMDTR

SEQ ID NO: 930264 - protein, 1452 aa, Homo sapiens
MEWNGMEWNEMEWHGMQWNQPEFNGIEWNGMEWNGINSIAMEWNGMEWNGMEWNGMELTLLEWNGMEWNGIEWNGREWNGMEWNGMNPNRMEWNGMEWNGMEWNGINSISMEWNGMEWNAMEGNGMEWHEINPNRMEWNGMEWNGMEWNRMESTRVQGNGMEWNAMEWNHTEWNGMEWNAMEWNGIHPIAMEWSGMEWNGMETTRMEWNNQYECNGMEWNGMECNGMEWNAMEWDHPSEMEWNRKEWNGMEWFQPEWNGKEWNQPEWNGMEWNGMEWVQLEWNGKEWNQPEWNGMEWNGMEWNGMEWKGMEWNGINLNRMEGNGMQRNGMEWNGMEWNAMEWDQPEYRGMECNGMQWNGIIRNGMEWNGMQWNGINQPECNRMQWNGMEWYGNYPNGIECNGVAGEWNGMECNGMESSGMEQKGMEWNQPVCKGMERNGMEWNGMEWNGMDSTRMEWKGRESTQVEWHGMEWNGMEWNGMEWYRIEWNATKWNRMEWNGIESTRVQWNGVEWNGMTWKQPEWNGMKWSCNGMEWNGMEWNGMEWIQPKWNGKQWNQPEWNGMEWNGMEWNGMEWYGIEWNGTKWNGMEWNGTEWNGINSIAMECNGMEWNAINANRMEWNGMERNGMEWNGMESNGINLSAGEWNGMECNGIGMAWNGVEWNGMEWNGMVRNRMEWKEMEWNGMEWNGMEWNEPVCNGMESNGMECIGMDSTRMEWKGMESTRVEWHGMEWNGMEWNGMEWYGIEWKGTKWKGMEWNGMEWNEHNAIMEWNGMEWNGMKWNGMEWNEMEWQGMEWNQPECKGMECGMEWNGMEWNGFNPNGMERNGINLSGIAWNGMEWNGMEWYGIEWNGTKWNGMEWNGMEWNQPECNGMEWNGMEWNGNNPNGMECNGVEWNGMEWNGMEWNGMEWNAMEWDQPECRGMEWNGMQWNGINQPECNRMQWNGMEWNGKYPNGKECNGVGMAWNGVEWNGMEYYGREWNGTKWNGMEWNGMDGMEWNGIEWNGMESNGIEWNGMDGMEWIQLEWNGKEWNQPEMEWKGMERNGMEGMEWNQSECRGMEWNGMECNGVEWNGMQWNHLDCNAMEWNGMKWKGMEWNGINLNRMEWNGMEWNGMEWNGMEWNGMQWNGINQRECNRMQWNGMERNGNFPNGMECNGGNGMEWNGMEWNGMEWVQFEWNGKEWNQPECNGMEWNGMEWNGMEWIQPKWNGKEWNKPEWNGMEWKWNGMEWNGMEGNGMEWNGMEWNAMQWDHPECRGMEWNGMQWNGINEPECNRMQLNGMEWNGKYPNGMEWNGNGMEWNGIERNGMEWNGMEWNGMEWIQPEWNGKEWNKPEWNGTEWNGMEWNGMQWNGMEWNGMEWNGMVRFEWNGKEWNQPECNGMEWHGMEWNGMEWIQPEWNGKEWNKPEWNGMEWSGMEWNGMAWNGTELTLIEWNGMEWNGMEGNGMEWNGMEWN

SEQ ID NO: 930265 - protein, 168 aa, Homo sapiens
MEWNGMEWNGMAWNGINPNTMEWNGMDRNGVEWNGINPSAGECGMEWNAMEWNHPEWRMEWNGMQRNGINSIAMEWNGMERNRMESTRVELNGKDWNGVEWNGMEWNAINSIGMEWNGMEWNGMEWNHSIAIEWNGMELTRIEWNGMESNGTEWNGMEWNEMNERTNE

SEQ ID NO: 930266 - protein, 508 aa, Homo sapiens
MEWNAMEWNHPEWNGMEWNAKQWNQLDCNGMEWNGKEYIGINPSGMEWKGLEWNGVERNGMEWNGMEWNQLDWKWNGMEWNGMEWNGINPNRKEWNMEWNGTERNGMEWNGMEWNGMEWNQPDCRRMEWNGMQWNGFNLNGMERMESTRVEWHGLEWNGMESTRVQGNGMEWNAMEWNHPMEWNGTERNRNGMEWNGMEWNGKEGNGIEWNRMEWNGINASAGEWNGMECNGMESSGMEWNGMEWNGMEWNQPECNGMEWNGMEWNGTTRMEWNVMEKSSECNGMEWNGMELNGMEWNAMEWNQPECNGMERNGMEYNGNYPNGMELNRINPNVMEWNGTEWNGMEWNGMEWNAWNGITRVQSNGIEWNGMQWNGFNLNGMERMESTRMEWHGMECNGMESELEIEGNGMEWNAMEWNRSNGMEWNGTERNGMEWNGMEWNGTERNGMEWNGMEWNGINASAGEWNVMECNGMESSGMEWDGMEWKQPECDGMEWNGMEWNGHTEWID

SEQ ID NO: 930267 - protein, 140 aa, Homo sapiens
MSCGISELPAQTYRESGRTKLDRGALGSHAYISPVTSISTRSKLETGGSCRAPRDVLGYEVEKLLLLNVLCWKGGLASIPNLEEWVNECTKCLEIFLGMEQTGHCCTKISAQKGRGDSSCSSTQAVAPNVWKYVAQRTAE

SEQ ID NO: 930268 - protein, 125 aa, Homo sapiens
MLVDDVGDVTITNDGAAILRLPEVGAMAIRRALKRDLKCIAETSGGTVLSTLANLKGEETFETAVSGQVEEVVQERICDDELILIKTSKACASASIILHGANDFSSAVQTELSAMMELLYIFTVQ

SEQ ID NO: 930269 - protein, 160 aa, Homo sapiens
MAILVYNCTNSGFTFSFSFQLPARLAYRDNRPQPNTAITSFHRIVSQLLQIFSALYQFPEATDSLSATVAAAVPVPARLMAAREGTATKLWQRACGLSPGSPAQRNAEPHLAEVIHLLITVINSWIANAQTSRLVNFLGSLTACNAYQLHKASINDSSLP

SEQ ID NO: 930270 - protein, 203 aa, Homo sapiens
MLEAASVQELALKVCGAWLPSPALLAAPSSQRQKYRSHTGHLGGSRLGCTENGSQFCGTQTRALPLSCAHLTAMATLWCYCCCAHFIAEKTKARRGTKPSGGPRAQGQLSQQLRPRTKNFNKKQKTWRKRRSCQVYKLCQLPATSEPSTTLLGNTLSKCLPARPAVCQPPASAPSLESPLLPHHLISSRGTRNPELCVKLPDF

SEQ ID NO: 930271 - protein, 208 aa, Homo sapiens
MNNIVFVDGVCGHKVMLSEWFLEAPLTWLGGNSLHYPIARHGVRETGRRETPQHSKLPPKKMSKNSSSVSQNYAIFLACPADWGLTSLAAYPQTQAAVGEKDIRTNAWRLEERPIDIINSETHTQPSLIVITLAQGPRPCTRYKKASGSWEELEEPEPVLAVRGFKELNRRGVSRLFHCMLYDVTPFKRLQCNSVISTGVKTCKKGKP

SEQ ID NO: 930272 - protein, 140 aa, Homo sapiens
MGDFFSAPHIRAKERELKVEGAEELGLWSSPTSDACATGAPARPTEEPAHALPFSSVQTSATGTVGHPVCTTAAAAKQMPVLSFIPAPRPQHSRRYRKDEGRAGSRGAGEKQCTHNSPRVGPLAPGHTWTDRKSEKVDII

SEQ ID NO: 930273 - protein, 364 aa, Homo sapiens
MNRKGPGNAFGTWAHLAFFLRSSAKLLFTPGKAVFTRQTKAEDFHHTGNLSTSCCWIDVFVGEDGALQWAGRYFVRSASWSDSASRPILTFPFSLHKRYSPVQTLKTAVMEQTGHLARGTDTGTGLGHLLLFISRKAPAAPPQHNAAHTSHETRRLLPPVPVPTYGLCHHQEVDKSGAMVAHLDSRVLLYCRAQSCTSKVTTSDPGFFPNNSVLDPDFESGTDAVDWWNQNHMSAISQLENDLKNLHAQMCPEFLPSAGFVVLLTSRMKLQTFTVLQLLKVAHPEVFIPPGGFVVLLASEVKLQTFTVSVTVPKRRPKEGAAAKFIAKTKRTKLPQYGRVPERFAAAGSRGQLLFPYLVPPMSC

SEQ ID NO: 930274 - protein, 147 aa, Homo sapiens
MKQDPHLSPYTKINSRWIKNLNLRPETIKILDNNIRKTLLNIGLGKDFMTKNPKANATKTKINRWDLIKLKSFCMAKETISRINRQPREYTDGQQTYEKVLNITNDQGYANQNHSALTPYSHKNGHNKKIIDAGVDAVKREHFYTAA

SEQ ID NO: 930275 - protein, 169 aa, Homo sapiens
MGKTKMTRVWSRPPANCSSPVEESKVDKPTKIRKNQCKNNENSKHQCAPFPPNDHNTSPVRTQNWVEAEMTEMTELGFRMWIKTNFAKLKEHIVTQCKEAKNHDKTMQELTAKISSLKRNTTDLIELKNTLQELHNAITSNNSRIDQVEERISEFEDYLSEIRQADKDR

SEQ ID NO: 930276 - protein, 142 aa, Homo sapiens
MKKQPKGYGLHCHRAIITICSIICIKDMYAKVSGSVNMPNLTWGLFHGLSRQKTHQQLAVKKGLHAVEIQEECGPLPILVTSSRGALSKDPETNDEVPDIKLDWKDVKTAQGEKRSLCMLLLTVLVWDGALPRYCLGKVVIS

SEQ ID NO: 930277 - protein, 174 aa, Homo sapiens
MNVEAISRVIAVCYHDNQPLQSPARSPARLHQLSCTRGEDGGGLWQPSEWAAAVCHASFSQGRAAAVNSSADSCHPERAIHLVEVSSPVTSRCPSFSCSPFNDRPMCRICHEGSSQEDLLSPCECTGTLGTIHRSCLEHWLSSSNTSYCELCHFRFAVERKPRPLVEVSKWGTS

SEQ ID NO: 930278 - protein, 368 aa, Homo sapiens
MWVGPNKGIKAGHPSQQQQPTHKEVSKEISKGPQKHLGYRLCPLQAVGGEEFGPIWVHIPFSLSDLKQIKADLGKFSDDPDRYIDVLKGLGQTFNLTWRDVMLLLDQTMAFNEKNVALAAAQEFGDTWHLSQVNDRMTAKERDKFPTSQQAIPSMDPHWDLDSDHGDCSSHVITLPESWVCLTIEGQEIDFLLDNGMAFSVLISCPGLLSSRSVTIQGILGQPVTRLINEAVIPLNPVVPNPYTLLCQIPEKVEWFMVLDLKDAFFCIPLHSDSQFLFAFEDPTDRMPQLTWMVLPQGFRDSPHLFGQALAQDLGHFSSPGTLVLQYVDDLLLATSSEASCQQATLDFLNFLANQGYKVSRLKAQLGL

SEQ ID NO: 930279 - protein, 163 aa, Homo sapiens
MAAQSGCTQTHIQNGSEGMVFLSLDPQAVYVGTHDSRSRWADSWSPTWLAQVPVVAVVDQMSEQLLRALAVHVVETMGIVVAGQSLGSQVALLNVNSGQNGLEECTNARGSRLSRVIPSFTSSVLRPGEGREFYNFRFYVYIFNPFRDWLYNFAPKLNLKKNY

SEQ ID NO: 930280 - protein, 152 aa, Homo sapiens
MTQLLQLWLKGVNVQLGLWLQRVEALSLDSFHVVLSLWNVRSNNSLHCAPGKATDTQCQPMKAAGREAVSCKTTGAELPKTMGTHLLHQCELDMRPEVKGDDFGAFKFDCPTGFQTCMGPALIVSGRDGIWYTSGGICLSKEHVEFTYGDKT

SEQ ID NO: 930281 - protein, 186 aa, Homo sapiens
MQKLWEKCSIQGSQAPLLQVCWSLLEVHSRPCLPGYHQWRLQNSKDCCLFLPLEALSQRGTCQMPARALLYEVFVNPCWEVSPSQDSRGDALPREEESREAVWLQRLCQAVMGSAQFKLPGGFIYNVWGKPPTQAPEMADTSPPTKLEHLRSTLDCCAGSENFKPVDLILLVSVGRLKLPVKGSKL

SEQ ID NO: 930282 - protein, 158 aa, Homo sapiens
MSAGGCASRRLFFQGRLLASCLAGSGIAGPRKTTNTRLNRINNRQSSLISDFKRKALNNTINYDVSCGYTLSGSVNFGSYSWWVHYSDPHSGMKHILQLLGVLPAESPLPSTPHVDGLAGERATPPLLLGQPPPLMDYDSQATLIHHIVLTACNRIVN

SEQ ID NO: 930283 - protein, 193 aa, Homo sapiens
MKNEFDKLTEVRFRRWVITNNSELKEHVLTQFKEAKNLDKRLDELLTIITIVEKNINDLMELKNTAPELREAYTSFNSQIDQAEERISEIEEQPNEIKCDIKIKEKRVKRNEQSLQEIWDYVKRPNLHLIDIPESDKENGTKLENTLQDIIQENFPNLARQANSQIQKIQRTPQRYSSKRATPRHINCQIHQG

SEQ ID NO: 930284 - protein, 149 aa, Homo sapiens
MCADNRNGECPMHGPLHSLRRLVGTSSAAAAAPPPELPEWLRDLPREVCLCTSTVPGLAYGICAAQRIQQGTWIGPFQGVLLPPEKVQAGAVRNTQHLWEAMEIQYEKQTWYPEPSCDCWGWGPEAWVCKASFDGGGAECMSLQPSSPK

SEQ ID NO: 930285 - protein, 166 aa, Homo sapiens
MHLAGRLTLKKANKAYVKHTKLFLSNLSLSACCPFWREEYSKFSVDVVVFLNKKVVTALRDSGIGENPCGDGTGGSSTHCIAHCYMCHQKVMTSCGNTNDVSNEPLIAEIKKGFMEEMLIVSLPGTKARGNSFSTYPSFEDPHPAATPSEPSSCVVIWQGALLCIT

SEQ ID NO: 930286 - protein, 146 aa, Homo sapiens
MSVRISSSLKKLLKVNNGVNFKEELKLSDEDSEEDRKMWEGLELPRDLLNGFDQNTDSDMDSKVQAEVVSDRDEELVENWSKNHSCCAKRLAAFCPCPRDLWNFELERDDLGYLGEEISKWQSIQEETQHKSLKNLQLDNAVENKK

SEQ ID NO: 930287 - protein, 139 aa, Homo sapiens
MFWYSCKIQPLLQRSLHASVLTAQIVKHVTNMHTEHRLPDVCYKLDGCLHLPVPTLISTKCKSLMKMHFLLPCPQCVDWEPYYILPLCVSPPLPTEKLGARRNTRGNRKSTYCNHSYLKVGSGSDNQRGTYCSCLQDFP

SEQ ID NO: 930288 - protein, 166 aa, Homo sapiens
MQHVGSHGLGQLHPCSFAGYSPPPGCFHWLALSVCSFSRHTVQAVSGSTILGSEGWWPSSHSSSRQCPSGDFVEIRNEWRSGKQSDSLKDCFQSSCSGHLSILSLTLFTQTNWLSSVYPEAGHGQLFSTENEPSVSEKLGLLVRVLEPQRENLFILAKEGLSPYPH

SEQ ID NO: 930289 - protein, 157 aa, Homo sapiens
MAVFQTLLVFDDVGSFEEYPSGKRFSPNARSAGTLILGFAVSKTMRNNCQLFKDIGMGKDFMTKTPKTMATKAKIDKRDLIKLKSSCTAKETIIRVNRQPTEWEKSFAIYPSDKGLISRICKKLKQIYKKNKQPHQKVGEGYEQTLLKRRHSYSQQT

SEQ ID NO: 930290 - protein, 130 aa, Homo sapiens
MLLVPLKMTLESSFCPPCEAALRSQQSETQESSLIRTQLRWHSAVGLPASRTAWTREQRAIQLWMCAILFFKIKEGGLKGDLETITAATFSKNPEGMARWAMVASILISKDRNDAQRSCVGGPSSEALGE

SEQ ID NO: 930291 - protein, 138 aa, Homo sapiens
MPQAQVALKPKTQSFPLFLHPLAKAEQSYPVATITRGPWGILPDYCQCSLKAQGLLNQSVVSNVWPRIHPSGKWTLLWPGPRVKSWNQVPQDMTWYSIPLWPSWYLRSASLRSPSKALAVLPGYRCCLFRVQDSSDSR

SEQ ID NO: 930292 - protein, 152 aa, Homo sapiens
MVSTFLFLHVSVSRICPLDVLTLSTSQVARKRSQNGERLGQVTPHKRNEKGEKKETRKPRAGERGRERVQEVKWDTGREVSPGELQGHQYTKGDMAALINIEFHCESVSEYVRYGLAVSPPESHLEFPRVVGGTQGQIPLHLFPSPPEGYMN

SEQ ID NO: 930293 - protein, 144 aa, Homo sapiens
MKDRRQQRETPLKFSDFYWLLSIPSHYRLAIQTVLTSLPFKEHPSASADLVRLTIMRTAQERPAPMIQLPPPGSLPQHVGIPGDTIQVEILVETQSNRITLLQLSFSDINRNVSIVSPLRKTLASVIGHTCFIMEKNIHQLLFA

SEQ ID NO: 930294 - protein, 150 aa, Homo sapiens
MSFYWRDSKLPLSLGRSSDDVCDKGLELETLGIYLVLSSTEAVLAPILQDKVLLTLPSPFHNQRNLSPWPSPPQSCGEYSLAIADGSLMAQGFFCQLAVNAARPVSLPSRGLCSPLSQGRSRNLVQESQLRIGSPKRLLVVLPHCGQAGT

SEQ ID NO: 930295 - protein, 189 aa, Homo sapiens
MGVCADWFGSEDRKMWESLKLPRDLLNVLDQNSDTDMDNEVQAKVLSDGNEELVGNWSKCHSCYALAKRLVAFYPCPRDLWNFELEGDDLGYLVKEISKWQSIQEEAEHKGLENLQPDDVVEKKNPFSGEEFKLAAEICVSSWELNVNHQDNGENVSKACQKPLQQPLSSHAQRRKWFYRPDPGTPCSV

SEQ ID NO: 930296 - protein, 188 aa, Homo sapiens
MGKKQNRKTGNSKKQSASPPPKELSSSPATEQSWMENDFDELREEGFRRSNYSELREDIQTKGKEVENFEKNLEECITRITNTEKCLKELMELKTKARELREECRSLRSRCDQLEERVSAMEDEMNEMKQQGKFREKGIKRNEQSLQEIWDYVKRPNLRLIGVPESDGENGTKLENTLQDIIQGTSPI

SEQ ID NO: 930297 - protein, 165 aa, Homo sapiens
MSKSLYRRAAYHVWLWRGEVRNRVEGQGTTLDRVLQGVQLKGFPARPPQLLLSDTPASVLLLQTGQVASISSHHSSQHWLNAKWTQKTDSLGSVSGFLCVKFQNENVALKRCSPGCKFTLPTTDVRPLQDLRHVRTAVRTASRESGNGLSPDTKPAGISILDSPT

SEQ ID NO: 930298 - protein, 144 aa, Homo sapiens
MRTETKKDKGENKTRKYFPERGGRISRSTDEKEDREEQKTIKRSTKDVQLGICKDLSILELSAPPSAETAAVTASLEKQNPPSRLNKAPVPNAGVMEMCDISDREFKMAVLRKHNKPQDSTEKKFRILSVLFEKTQPEGEKEIV

SEQ ID NO: 930299 - protein, 138 aa, Homo sapiens
MHVCHTGALTQIFQLEGREYECGYHGTTTKSSRDLDQVSTKQGPVKCAEPASPLPSYCILSGGGLGGLSHMLGRELRKGAAATDAKLFAPSLGPQVSHIVGVQPRCRAAQKEPDTRRGWPSVEVDGAAKSDSRVRDRG

SEQ ID NO: 930300 - protein, 140 aa, Homo sapiens
MILNEHLPVMDLLPVNFKFNLCALLLEYGSGAFKYFPFASRHDVKLCLGTALERRCRRKGVLRLGSGVLASHVPLAWAFSPAVDNWGMGGFFSTKLLKHSQMLRYMVPTMSSCTHLRKFWTGVLPGKKNWIWLFSRRIQR

SEQ ID NO: 930301 - protein, 152 aa, Homo sapiens
MISENIWSFREEKKFNFREEKRISTCNKHSDRERHRNACSTKRQKFFLSFISVPRTLPDKQWRLHASAEICMQSPIRSLSSRPPLPMWQVGSLLPQDGSRNAVQEKECLCGHYSWESTVTPEGSTVQGLTQVSAHGTASWILLMFIQGPMAP

SEQ ID NO: 930302 - protein, 201 aa, Homo sapiens
MMLSMSGSGCCPWTAPQTQPFHTRLQLYLVHVSFIHILLDEDKFILRLCTLIDLILVLVLEVLHQPLHVAKLRFQLQLLLAQSLQLPPKVVDGLDLLLLLGAHGLDVGVHLQVKGTQQALVERDGGDASHAAGPTIASTQTTQEAAAAAHSGEAQGADAGTGPTCVGTAAEVLGARGGHLVGLLGHPDGQGGSRSGGRRVG

SEQ ID NO: 930303 - protein, 145 aa, Homo sapiens
MLLLLLVLDCTVRPIGLYPSIPHYILTPLKIPLSLLADLEKLKQMGARVKQDEEVQRCSGLIAGAVVEVQRNSSSVSISGIWQMENCFSILHSTKRLQMTSIFWSICWLSHFELLFPLCFEKTLSLAFIFLPALPNDNVLITLKE

SEQ ID NO: 930304 - protein, 308 aa, Homo sapiens
MESSSNEIEWNHRITSNGIIVEWSLMESSNGLERNLESSSNASEWNHHRISSNGVIIIWNRVEALNGLKRNHRRMELNGIIKWTRMESSSSGIKWNHRMDTNQIIVEWNRMESSNGLEGNHYRMELNEIIIEWSRMESSSNGEIIEWDQLESSNGIEWNHRMDLNRINIEWNRMESSNGLEWNHLMHSNGIIIECNRMDSSNGIKWNHQMESNGIIIKRNRMENHQMDSNTIIEWTRMESSSNGIKWNHQMDSNEIIIKRNRMESLNGMEWNHHGMETSGITEWTRMGSSSNGIEWNHLMNLKGIIIK

SEQ ID NO: 930305 - protein, 226 aa, Homo sapiens
MNGIEWNHRTESNVIIIELNPMESLNGLEWNHRMDSNGIIIEWNRMESSNGIEWNHHRMKSNGMIIWTGMESSSNGIEWNHRMESNGIILEWNLRKSPNGHEWNHPMDLSGIIIEWNRMNGIQRNHQMDLNEIIEWTQKESSSNGIEWNPNGIERNHHGIDSNGIIEWNGMESSKKGIEGNHQMESNGIIEWNGMESSSNGLKWNNLRKESNGIEWNNQMDSNGII

SEQ ID NO: 930306 - protein, 441 aa, Homo sapiens
MESSSNEIEWNHRITSNGIIVEWSLMESSNGLERNLESSSNASEWNHHRISSNGVIIIWNRGEALNGLKRNHRRMELNGIIKWTRMESSSSGIKWNHRMDTNQIIVEWNRMESSNGLEGNHYQMELNEIIIEWSRMESSPNGGIKGNHRMGSTGVIEWNRVESSNGFEQNQHRMESNGIIEWTRMESSNALEWNNHRIEIIIRWNQMESSLNGIKWNHRRERDGIIIEWNQIEALNEIEWNHNRTQLNRIIIEWTRMETSSNGIERNHHRMESNEIINEWNRMESSEKGINDHQRESQEIIEWDQMESSIGIEWNHRMDLNRINIEWNRMESSNGLECNHLMHSNGIIIECNRMDSSNGIKWNNEMESNGIIIKWNRMESLNGIKGNHGNHHRMELNGIFEWIRLESSSNGLELNYRMDLNGIIIEWNPMESSSGIEWNHH

SEQ ID NO: 930307 - protein, 487 aa, Homo sapiens
MKGIEWNHRTESNVIIIELNPMESLNGLEWNHRMDSNGIIIEWNRMESSNGIEWNHHRMKSNGMIIWTGMESSSNGIEWNHRMESNGIILEWNLMKSPNGHEWNHPMDLSGIIIEWNRMIRMESLNGMEWNHQRKESKGIIEWNQTESSNGMEWNHHRMDSNGIIFERNRIESNGTIKWTPMESSNGIEWNHRMDSNGNLLTDSSGIIIESKRMESSSNFIEWSHHHMESSGSIEWAQKKSSEYGIEWNHQMDSNGIIIKWNRMESSSSGIKWNHRMDTNQNIVEWNRMESSNGLEGNHYRMELNEIIIEWSRMESSSNGEIIEWDQMESTNGIEWNHRMDLNRINIEWNRMESSNGLEWNHLMHSNGIIIECNGMDSSNGIKWNHQMESNGIILKRNRMESLNGIKGNHANGIERNHHGIDSNGIIEWNGMESSKKGIEGNHRMESNGIIEWNGMESSSKGLKWNNLRKESNGIEWNNQMDSNGII

SEQ ID NO: 930308 - protein, 248 aa, Homo sapiens
MESSSNEIEWNHRITSNGIIVEWSLMESSNGLERNLESSSNASEWNHHRISSNGVIIIWNRVEALNGLKRNHRRMELNGIIKWTRMESSSSGIKWNHRMDTNQIIVEWNRMESSNGLEGNHYRMELNEIIIEWSRMESSSNGGIKGNHRMGSTGVIEWNRVESSNGFEQNQHRMESNGIIEWTRMESSNALEWNNHRMESKAIMVKWNQMETSLNRIEWNHHMESNGIIVNAIKWNHRMESKGIIEWN

SEQ ID NO: 930309 - protein, 444 aa, Homo sapiens
MKGIEWNHRTESNVIIIELNPMESLNGLEWNHRMDSNGIIIEWNRMESSNGIEWNHHRMKSNGMIIWTGMESSSNGIECNHRMESNGIILEWNLMKSPNGHEWNHPMDLSGIIIEWNRMIRMESLNGMEWNHQRKESKGIIEWNQTESSNGMEWNHHRMDSNGIIFERNRMESNGTIKWTPMETSNGIEGNHRMDSNGNLLMDSSGIIIECKRMESSSNFIEWSHHHMESSGSIEWAQKKSSENGIEWNHQMDSNGIIIKWNQMESSNGHESNHLESSNGFEWNDHRMELNGIIEWTRMESSSNGTKWNHRMDTNAIIIEWNQMEPLNGIKWNHHRIIKWNHRRMDSNGIIEWTRMESSWNIRMESLNGMEWNHHRKESQGIIEWNQTESSNGMEWNHHRMDSNGIIFERNRMESNGTIKWTPMESSNGIEWNHRMDSNGVIMK

SEQ ID NO: 930310 - protein, 554 aa, Homo sapiens
MNGIEWNHRTESNVIIIELNPMESLNGLEWNHRMDSNGIIIEWNRMESSNGIEWNHHRMKSNGMIIWTGMESSSNGIEWNHRMESNGIILEWNLMKSPNGHEWNHPMDLSGIIIEWNRMIRMESLNGMEWNHQRKESKGFIEWNQTESSNGMEWNHHRMDSNGIIFERNRMESNGTIKWTPMEIIEWTRMESSSNGIKWSHQMDSNEIIIKRNRMESLNGMEWNHHGMETSGITEWTRNGIIIKWNRMESSNELERNHHQMNEWNHHRISSNGVIIIWNRVEALNGLKRNHRRMELNGIIKWTRMESSSSGIKWNHRMDTNQIIVEWNRMESSNGLEGNHYRMELNEIIIEWSGMESSSNGEIIEWDQLESSNGIEWNHRMDLNRINIEWNRMESSNGLEWNHLMHSNGIIIECNRMDSSNGIKWNNEMESNGIIIKRNRMESLNGIKGNHGIIIECNHMESSQNGIVRNHHQMELNGIINWTRMETSSGIDWKCRMDSNEIIIEWNRMESSKGLESNPKMDSNGIIECTPMESTSNGPYRNDQMDSNGIIEWK

SEQ ID NO: 930311 - protein, 164 aa, Homo sapiens
MEMNGIIDWTQMELSNGLKWNHRMDSDVIIIEWNRMESSNGIDRNHYRTESNGIESNHHRMESNGIMIECNRMESSNGIEWNHHRMESNGIIKWNPMESSSNGFKWNHFRIESNGIIEWNHHQMESRGITELNGIIIEWNRIESSHGIKWNYHQMESNDIIECT

SEQ ID NO: 930312 - protein, 190 aa, Homo sapiens
MESSSNGIEWNHRMESNGIIHRMKSNGMIIWTGMESSSNGIEWNHRMESNGIILEWNLMKSPNGHEWNHPMDLSGIIIEWNRMNGIERNHQMDLNEIIEWTQKESSSNGIEWNPNGIERNHHGIDSNGIIEWNGMESSKKGIEGNHRMESNGIIEWNGMESSSNGLKRNNLRKESNRIEWNNQMDSNGII

SEQ ID NO: 930313 - protein, 532 aa, Homo sapiens
MNGIEWNHRTESNVIIIELNPMESLNGLEWNHRMDSNGIIIEWNRMESSNGIEWNHHRMKSNGMIIWTGMESSSNGIEWNHRMESNGIILEWNLMKSPNGHEWNHPMDLSGIIIEWNRMIRMESLNGMEWNHQRKESKGIIEWNQTESSNGMEWNHHRMDSNGIIFERNRMESNGTIKWTPMESSNGIDDRMESTAIIIHWNQTESLNGIEWNQCQVESSGIIERNRMESLSNGMEWNQRIELNRITNELNRMESSSNGIEGKWNHHHMELSGIIVWTRIIIEWTRMESSSNGIQWNHQMDSNEIIIKRNRMESLNGMEWNHHGMETKSNGMIEWARMESSLNGIKGNHHRISSNGVIIIWNRVEALNGLKRNHRRMELNGIIKWTRMESSSSGIKWNHRMDTNQIIVEWNRMESSNGLEGNHYRMELNEIIIEWSRMESSSNGGIKGNHRMGSTGVIEWNRVESSNGFEQNQHRMESNGIIEWTRMESSNALEWNNHRIIEWNHHMESNGIIVNEIKWNHRMESKGIIEWN

SEQ ID NO: 930314 - protein, 136 aa, Homo sapiens
MESSNGIEWNHRMDLNRINIEWNRMESSNGLECNHLMHSNGIIIECIRTDSSNGIKWNNEMESNGIIIKWNRMESLNGIKGNHGNHHRMELNGIFEWIRLESSSNGLELNYRMDLNGIIIEWNPMESSSGIEWNHH

SEQ ID NO: 930315 - protein, 937 aa, Homo sapiens
MESLNGHEWNHHLVATNGIIEWTRMEYHRMELKAIIEWTPVELLNGLKWNLYRKDSKRMIEWPRMESSVGLKWNYRISANGIIEWTRKESLSNGIKWNHQMESNGSSNAIDQNHHRMESNGIIKWNRMQSSSNRIEWNHHRIQSNGIIKWNHHRMESNGIIIKWNRKESSSNGIEWKHHRMESKGIIIEWNRIHHRMDSDGIIIEWNRMESSSNGKYWNHPMELNGIIKWSRMESSSNGIEWNHRIESNVIMIEWTRMESTSNGIEWNYQMESNRIIEWTRMESSNGIEWNIEWNHHRMVSNGIMEWNQMESSWNGIERNHRMESNGIFLERNRMESSNGHEWNHHRMESNGTIKFNRMEPLNGLEMNPLIECNKRESPNALKWDDRIASNCIIMKWNRMESSHGLECNHQMDSKGIIIKWNRVKSSNGLECHHRIIILEWNLMKSPIGNEWNHPMDLSGIIIEWNRMESSNGLEWNHLRMESNEITIEWNGMESSSNGKHQIKSNGIIIEWNPMESSNSIKWNHRRMDSNGIIEWTRMESSWNGIIEWNQTESSNGMEWNHHRMDSNGIIFERNRMESNGTIKWTPMESSKGIEWNHRMDSNGWNHQMDSTVMIKWTRMESSNGIEWNHRMDSDGTVEWTRMEIIEWTRMESSSNGIKWNHQMDSNEIIIKRNRMESLNGMEWNHHGMETNRMESSNNIEWNHCRMECNGIIKWTRTESGSIEWAQKKSSENGIEWNHQMDSNGILIKWNRMESSIGLEGNLYRMELNEIIIECSRMESSSNGGIKGNHRMGSNGVIEWNRVESSNGFEQNQHRMESNGIIEWTRMESSNGLEWNHLMHSNGIIIECNRMDSSNGIKWNHQMESNGIIIKRNRMESLNGIKGNHGNHRMELNGIFEWIRLESSSNGRELNYRMDLNGIIIEWNPMESSNGIEWNHH

SEQ ID NO: 930316 - protein, 574 aa, Homo sapiens
MELSSNGLVWNHHRIDSYGIINGIQCNHHRIEPNGIMKWTRMESSNGLEWNHHRMEQNGVIEWNRMESSSNEIKWSHRMDSNGIIIDWNRIESSNELKWNHHRMESNSTNGIIEWTRMEYHRMELKAIIEWTPVELLNGLKWNLYRKDSKRMIEWPRMESSVGLKWNYRISANGIIEWTRKESLSNGIKWNHQMESNGSSNAIDQNHHRMESNGIIKWNRMQSSSNRIESHHRMDSDGIIIEWNRMESSSNGKYWNHPMELNGIIKWSRMESSSNGIEWNHRIESNVIMIEWTRMESTSNGIEWNYQMESNRIIEWTRMESSNGIEWNIEWNHHRMVSNGIMEWNQMESSWNGIERNHRMESNGIFLERNRMESSNGHEWNHHRMESNGTIKFNRMEPLNGLEMNLESSNGFEWNDHRMELNGIIEWTRMESSSNGTKWNHRMDTNAIIIEWNQMESLNGIEWNHHRIIKWNHRRMDSNGIIEWTRMESSWNIRMESLNGMEWNHHRKESQGIIEWNQTESSNGMEWNHNRMESNGIIEWNGMESSSNGLKWNNLRKESNGIQWNNQMDSNGII

SEQ ID NO: 930317 - protein, 138 aa, Homo sapiens
MYPHCIYSRHRILVLLIQVTCPGIWAFGCMLFLTYAHVLALLVGQGVFPELSLGMDSHRLPDDQPIFDQLPDLLTRVGIGDFIDLIGVQPDLLLAPVEDTRGEPLLKPKHTHGLYLIHIRSLNYHLYDKNPEMDIFIS

SEQ ID NO: 930318 - protein, 153 aa, Homo sapiens
MPPLYLGKEDKMWESSEFPRDVLNGFDQNEDSDMDDEVHAEVVSDRDKELIGNYVISERRNQNSVHRIRARVVGGHNWKDQPNKEEWIRVPLKEAVWPCCGKAAVLCWGFFPHMGGPFLIWRDHLGKFLSLSGPLWLHWDNGENCSSYLWVAV

SEQ ID NO: 930319 - protein, 151 aa, Homo sapiens
MDATCLDQLGQGDPNPLVLEELKTHTQKYRGVKWEIRGLTPFRAESPEQRFTHIFINSKPVISIVSIDIRLIKSFELILRSVCTVSSDVTHLQIPQPWISAPAPVEVVGETQKIKIPKKYYFTSVRMAIIKKTEDNKRCEGCGEKRNLVHC

SEQ ID NO: 930320 - protein, 157 aa, Homo sapiens
MIKENEFDELTEVGFSRWVITNSSELKEHVLTQCKEAKNLQKRLQELLTRITSLEKNINDVVELKNTARELREAYTKINSQIDQEEERISETEDQLTEIRHEDEIREQRLKRNKKCLQEIWDYLKRPDLLLGSLKETRMERSWKTHFKILSRRTSPT

SEQ ID NO: 930321 - protein, 251 aa, Homo sapiens
MGKQFLGRWRGKEGGEQQEWREGFAVVMDMFTHVDIFYAGFKRKAALYIIVDGSKVKYVLHMCEQTRMHLGHLKAEAREGFLDVCTVEVDLRHMSRVEPLGWGETTEQRWIRDGCQWGQAGASYPPGASMPNCDLMSSGGLMSMQELESLWDLLSTRGLVSNVHLESSVHLGPDVFLGPLCPLGPYAHLEGVDIWPQGAIGSRVRTGLDVYIRHEVYTQAPGALNVTDGLQAQGGYQGFRRTPRPHVDIRS

SEQ ID NO: 930322 - protein, 147 aa, Homo sapiens
MDLSPTCCPARQHRILQAPQSASTQLLPVLQHLLPNCYHPTHARPARTPVLPALHSHPCHAPPAPCFYLRSAPSSSVPCQHPILHMPSPAITLLLLEPGSYSQPTATHAPPLQRQPLPEPCSYPHPALPVPHTTHAPPHQHPNITHT

SEQ ID NO: 930323 - protein, 156 aa, Homo sapiens
MASVGCECPLQLGTTAHGQTLGPGAALLTDTPADRHMLPTGLKFLELAKQVGEFITWKQVECPFEQDASITHYLYTAPIFSEDGKVALQPSCLLGHGTLGAYVGSAKHSTDCVGVYVCAGVTDTGTSQPYVFRDCCVPGNNLAVNTDKTVALLEPR

SEQ ID NO: 930324 - protein, 206 aa, Homo sapiens
MHQLLQALHQKLAALRQGPEGLVGADKPISYRTKPPASIHRELLGVCSDPYTLAQQLTHVELERLRHIGPEEFVQAFVNKDPLASTKLGGAPRQPSPESPESLDVRDVGVTHPAREEEWARNQAVGRAARVGQDPGQGGGWRAPWRAPGPRAPSRCVSVGAGALQRPRGEARVAARCPGWDTAHAPGFRSRPSGSPTSRVPVPPTG

SEQ ID NO: 930325 - protein, 261 aa, Homo sapiens
MAVQVDEDYTCHPLATGPVQLLFPVTFPLRSGEGYVAHDGFTTGPHHHPGAEATQSVVSCCGSQMDGEDADEVLNPGLAMEFNPQQRVSALGRLRAVCDGPVYGCCWQGVRSSHSQWEALRTWLRKSAGFQGSLVSRVLQDSSLGRGLWLAAQELLWPAKGRVCMLSQEDARVLWGYSSPGQEPWGKEPRLGTPLHLHTPIKKCSSITVSKAAASGHQLSVSVQDCPGSNTEIPTSQGTPQSWTNRNTCHSGCRLFPCILV

SEQ ID NO: 930326 - protein, 283 aa, Homo sapiens
MNPICSAICFCKQSFIGTQPHSFAYGLSTATAKLSCNKDDMAHKTSVFTIRYFLEKVANPAVAIRNYCPPTLTSLQPSSFSKPQIHIQVPMYLSTAEWGVHWHLSNQAQPCSSPPQPAAAFVLKASLGAPGALQGWIHGACHASFPPSPPQQLWDPVYESASCLRLMQEENARGSKPQGVKARPWPAQLWSQDCPHPAAASCGHRHFYTSLPCLHISGHSGLRALGLLLFQQHVVPTQSQCLLRARQEMDIHGSTVTEGLQAVKTLATLRPPQDGRANGMGKL

SEQ ID NO: 930327 - protein, 250 aa, Homo sapiens
MPAHGFIPEAREMKGTEWLGLDHMPSQLSQTNATPSPSGTRAMSSYHGQERKDKWALFSEGRTDAGQAEAAEAMALDSCSRAEPWQGSRKEARGSALPVVCCGPAGQIAQALTEELLLGLLGLRKVKNGADEQPVSLGKLLGTAQAREMSRVWPWSGSFNKHRNAGSWPEGPEPKAGLLAGLRGLHMAGLGFSHHLLLVWSVFQDGGWVPGVEPWAAGAGRWGLSPPELPGSLCVETLSSLKQSPCAWQP

SEQ ID NO: 930328 - protein, 270 aa, Homo sapiens
MALANVDGNEQGSKQTTLARAESIKAGGHGWIWGGCSDNVEFGERISKLFVDSLEKGKDARALMNLHNNRAGRLAVRATMKRTCKCHGISGSCSIQTCWLQLAEFREMGDYLKAKYDQALKIEMDKRQLRAGNSAEGHWVPAEAFLPSAEAELIFLEESPDYCTCNSSLGIYGTEGRECLQNSHNTSRWERRSCGRLCTECGLQVEERKTEVISSCNCKFQWCCTVKCDQCRHVVSKYYCARSPGSASPWELETTVRCDCAIALQPGQQN

SEQ ID NO: 930329 - protein, 152 aa, Homo sapiens
MYDWQFLLPIQTLAQFSAPPLSPDSLVFSRNGPQRVLPGFQHYSFQVKESMEKDTWCSQSFPNSTLPPKLYSSGSLCPARPSQTQTATALQVHGRDSPVVVKVQDPLSYIVENVEAMTWRMEMGWWSMVASSEQAAIESGPKDVKPPQQSLG

SEQ ID NO: 930330 - protein, 255 aa, Homo sapiens
MTSSPIIAAKHITQHECYSAIKGTKDIISQVTRKREERRREELQPFGGPRPESSPNQGCDSPFEASWFLESPSSRAPPHSPVPAVEAACSVPVKIINTVLNQCLSLHTSVMGSLMVLLFGLKASVANDTFAQILLGSTGPTRPGRLCLAHTTVLDPMLLKRLERSGEGCENEQVWGPGTVHSQVHCKVLLLLAPGDLVVSGSLETLGTTGPQSRSHSPGSGSSQLFSPSCSLQGGEKTQCQAELYPAAMRITRKN

SEQ ID NO: 930331 - protein, 135 aa, Homo sapiens
MRNSRASGRAGGEHATGSECPGHQHPGAKAGNCKLSDKEDMFHFVDDNKPTSCNPGINGWGEENEALFKQPSATSPEESPSQDRAPLKGFSCTSLRQFKTGIWFLILTQLPPTHGNQRLQAQTWIQVCILDFLFV

SEQ ID NO: 930332 - protein, 151 aa, Homo sapiens
MVRFALALGSNIAAPISVSCAYETLPPVRWPILPVTTWTFLMAETTPQTPKHSCIMFGKDGPIYPNLEATEGQFRFPHKRFLVMYHWHFTSNQTSLLNEGKTPCAGQYAKSIVIAPDLSDLAIQSLRNRHTAFHMERTQMVELIYTPTNCV

SEQ ID NO: 930333 - protein, 152 aa, Homo sapiens
MAGYPSEMKLPEERSGSYICCSAKFAVLQPPPLIPSKHGLDTQQTRSGVDLWQTPTHLQLRIMTARRKTNKQKGHPHQNPIWEKQSRKAENSKNQSTSPPPKEHSSSPAMEQSWMENDFDEMREEGYRRSDLSELKEEVRTQCKEAKTLKKD

SEQ ID NO: 930334 - protein, 129 aa, Homo sapiens
MLSFQRSGARPPFQSSVDGRVMGIYCGRKADRNLHHSATCLRKAFRKGHPARPHENWIEVQELEGHSGYSSVTGLSRCPLSSRHLPIPTNGLAAKVIQLLSRCFPLGVLWLLLLLPTAQLSVDLTFKLL

SEQ ID NO: 930335 - protein, 178 aa, Homo sapiens
MGWCFAGRGSTSGPVTLKPDDAVEKKNPFFEKKFKLLQKFAKVARSLMLIPKTTGKMSPGHVRDLHKSPYHYRHRGTGGKSGFVGQAQGPCAVCSLGIWCPVSQPLQPWQKGANKQLRLWLQRVKMYGNAWMPRQKFAAGVEPSWRPSARGVWKENVRLEPPHRVPTGALPKWSYTYH

SEQ ID NO: 930336 - protein, 180 aa, Homo sapiens
MTNVSSQSLGLNLKPHPNLSPLISLSASGSFHKLWRHFMPTFRTLIPQIPQQSAVSWIAGRQNGEMVINTTSVNKHFLLHARPYVRSWELNVSIALNDMPMRSKGRPSCNEHLREVLQFRHKQLQKLCRHFRFKQVWLKLPRSLQQLARLPICELPSYRPQLLDFKNTYTLKSLTDTRRA

SEQ ID NO: 930337 - protein, 147 aa, Homo sapiens
MGEKIVQASHKEHIEGRWCPRDWVGINKWLKNGEERLGDTDVVKRPISKFPGAGLWQHLPLRSGEKVADSAFLSPDTIGRVGTFRRNFKEVKTELFFTSGCPGLVSETSGLIEIPQRGEITVSDVLKPNAHGSIRGEWYKEQEEQAP

SEQ ID NO: 930338 - protein, 148 aa, Homo sapiens
MAHVSICLLEVHSRPCLPGYHQRRVQNSKDCCLFLLEASSQRDTCQMPAGALLYEGDPLEETVSPLAEIERCAGRSTALSRAGRQKCLSLLKLHPQLPLPSGALSQGDGSFIYKPLTEAATFLSEMPCSDRRNLERQPGCSGFVVLPV

SEQ ID NO: 930339 - protein, 152 aa, Homo sapiens
MPDACVLKALFGLVNLKKDTPLLPHSLTSLPASHLAFILHSPHCCQGIVQKHKSCSATVLSKTLPYPLTTLDDVYALNQSPRGHPLYSPCCSPAPYFSHPDHTSCTSSDELFPFFSPGLHICCSCAWNIPFSYGHSPPLLSHILDRTLSKAV

SEQ ID NO: 930340 - protein, 169 aa, Homo sapiens
MTCPSLDQLGASWGQTGSPGCKSLPVLSLLPSVTISADSASTVCPAAAKPTELCFWAVLSHFVARTSAVTLLFPEEHLQLIHVLHGAAGGAARYACDMRVLTHVSQHHKNSESFQNLQLSSNTSSTIIIVIKNKKEKGKATDLTVGKNNSLDGNSLDGKRVVVVTIEIT

SEQ ID NO: 930341 - protein, 136 aa, Homo sapiens
MNELHGDGQITQCLYFGFPSKLAECDRAVQKGNVGSESPHRVPTGALPSGVVRRGPPSSRPQNGRSTDSLHSACGKAADIQPQLMKAAERGLYPANPQRQSSPRPWVHSLLVYIIRDFSISITLALLVQAFSLKNQ

SEQ ID NO: 930342 - protein, 200 aa, Homo sapiens
MGFPLWFCSLAGKELRSFRGEEAFQYLEFSVFPHLRGLIYLWSLMLVTFGCSFCVNALFVDVDAIPFCLLVFLLAVMPLCCRSAGVCYRSTPHPAVEGAEEPKLLPVPSSGNFAPEGHPPDASQSSPVSGVCQTLLGGVSQSGGMEFRDPLVETVFTLAELQRCAGRSTALFRASRQERLSLLKLLPQPPLLPGALSRGR

SEQ ID NO: 930343 - protein, 147 aa, Homo sapiens
MLRFSPLIFTFLGHSEGKKGQKKSGPLPALTVKAPAAFLLCILNTGCALWLSCYGVSDLLFIRGTFLECAYRFIPFRDGPSLNMLYLYSKCTANWHCDSFSLSPSFLIYKMGMVIPNYGLCKYPFILARICISELGPSKEKPANQKN

SEQ ID NO: 930344 - protein, 134 aa, Homo sapiens
MQALPKEFGKPSRQINDCSFQKSATANPGEGRGSNIQCYHITTIKDLVFSSNKRIQKPTRELERCTEGNWMFQCGAQQLLSDQEYTFVNPLNNQSGEARSRSQLLPNYTLTIDFCFSSPKNTSGYQCFSKVSTN

SEQ ID NO: 930345 - protein, 242 aa, Homo sapiens
MGASRAQCPRVQVGVGSHAAAKRWLGKLRRKRRWRRAREAGSRDPLPSAPLPDPPAPAESPKELDLGAQRERWETFRKLWGLSCEGAAKVLLDTFEYPGLVHHTGGCHCGAVRFAVWAPADLRVVDCSCRLCRKKQHRHFLVPASRFTLLQGAESIVTYRSNTHPALHSFCSRCGVQSFHAAVSDPRVYGVAPHCLDEGTVRSVVIEEVGGGDPGEEAAEEHKAIHKTSSQSAPACPREQEQ

SEQ ID NO: 930346 - protein, 150 aa, Homo sapiens
MVPEVSGHRPVCSTTGLLAPRASLGLQRPAEEAESGALFSFLLRGRGTASGRDPGLKPLALDLGRLGWLCCLLQQAQIGRSWKAALDQRGGSIYRAHTFLLPWDENNLIFIKADSIPRVHSGPPAFFYPLTVGELHPTPGFLYTESSQVS

SEQ ID NO: 930347 - protein, 137 aa, Homo sapiens
MRPSRHKWAHRKNRKGSLMAVYWNICRVLIRRTLSKRPSSLLRTTGNSLKFNNCVKLNLQRLHLSSIIHSLYDTLLDWEIQPSNCLWSEVRVQSRTTFPVSLTSLKNTWNLNLPCRGAKAANTPGQQTDLQNFPQRD

SEQ ID NO: 930348 - protein, 174 aa, Homo sapiens
MARGLWLSHHTSNLEIQVLVLSVLWRKSNSSSTVEEHLQHKERANRKPLVFVLTEKRLNVYMYNQIIPKMPFPWSNSIQITVFVCEKPSENIFKPNDLMPGFCKTICAQDQNLCHHRICAFPKSSPGMFFNNMASLPHLSHFLGLDPGQPADPWPPTSHIRKQEVRETGKVVLD

SEQ ID NO: 930349 - protein, 144 aa, Homo sapiens
MVRQAVFGGTGKHGVCGLNVPQSYSNGGGTCLESKRVPWAPLIPWPDRQQHQEPAIFIYLTMENSINHNLAEYTSKMSGPESNGNVNRKNSDPANIMILLGRRKETSQERTNTISEALKELHPFPRKSQAVAAERNADIENSSN

SEQ ID NO: 930350 - protein, 144 aa, Homo sapiens
MDKQRMPLAELIALTQALELGEGKRVNIYTDSKYAYLVLHAHAAIWREREFLTSEGTPIKHQEAIRRLLLAVQKPKELAVLHYRGHQKGKEREIEGNCQADIEAKRAARQDPPLEMLIEGPLVWGNPLQETKPQYSAGEIEWRT

SEQ ID NO: 930351 - protein, 161 aa, Homo sapiens
MVFFPLLDAHCILGKLQWTTLEASLLGSTPWKYHTRRVGPLVFLTDMNELKKNLIKGTRALLERFGGAWIIRQFCLEEKLVKATGSPCVWLCAECHIPVPSVDKDVALCLWMPVCAEAGLSEGRKQSLPLWLLPRDPCILHTLVSHHWLSGDNVSTVLETV

SEQ ID NO: 930352 - protein, 127 aa, Homo sapiens
MIKILIGFLATLRNQSGQAQWLTPVISVLWEVKAGGSPKLRSSRPPWQDGETPSLQKIQKLARREEEEGERSNFPEISDAWLNSQAQKQTIISINSVLSYIYKTYTCDDGGRFQISEKMKEICAISR

SEQ ID NO: 930353 - protein, 134 aa, Homo sapiens
MAQRHQATSRTRTKHTSLTTHNVAQTAYRYEQVRDVMTERSATKRNDVQVGPLRQKRRDSHEPYKSKGQECPCLGKHPSLCHHEWHVVKPELSPVVYPKKQGYLGEVIVPNIYIATLKKIEVLLIRMKVRMDYT

SEQ ID NO: 930354 - protein, 141 aa, Homo sapiens
MIVSFLRPFQAILTCDTFAMKITVIAVATQWSMPYSMKRGSYINYVYTRFLETDKVEVGGGGETQVKLSPCSVVVVRGKKLKWQCTSGCKCKQSFTQSVNKEQGFLAGAPGRWAHSSWMKGSGLLALLIAAAAAAAAAASI

SEQ ID NO: 930355 - protein, 131 aa, Homo sapiens
MRCASQGPRKGCADVEAIQAKKGEEFVDEKLEASRDWVMRFKERSYLYNIKVQGEAANVDVEASASYPKGLEIAAATTAFSNHQPYQSAAINNEARFSTSKKDDSLLKTQMIVSIFSSKVFFKLSLNLFIC

SEQ ID NO: 930356 - protein, 151 aa, Homo sapiens
MTFIFTVFDLTSVLFKYSYSCFLLVSVCLKYLFQFFTQSMSVLISEVFSFFVMGSNIILSLGEVCYYSSFEAYFCQLIKVILRLAAGLFEFAGGPLQTLFSWVTSAGAAEQQMLLPDPSSGSFISEGHLAVYLIQSSQPDLVLSVVGLSRD

SEQ ID NO: 930357 - protein, 133 aa, Homo sapiens
MADTPLSTKLKCPRSTSDCCAGSENFKPMDLSLLDSVVVGSAELDYLAPWFQPSFQGMNSSVLLAFQVPLWHEKKKKLLQLAWCLPKQPPSFVLETQGPGGSLKTKLCFHKALQTEARQLKPQKKITATYLHT

SEQ ID NO: 930358 - protein, 139 aa, Homo sapiens
MRSPGQWNWALHRKEVEWWGLTAVNNQHKKWPKTLHSTRNSIHLAEHNLQGLFHDTLLNRNPAAYMDVLVHGCRQNWAGAAVISRLDQLLTRSFSSLPHVPFHRPASHMAATSPRDSIEREREHTDVSTFLCPVSVTHH

SEQ ID NO: 930359 - protein, 140 aa, Homo sapiens
MSPDSLELCGSRVGRSSVLAILAIRIWIFRRRVPTSPVRPLEGFRNTHRDGEEWLRRIYLSFPVLLTIADSGYLHLTMTHCVSGFWRPREVYLIRKDDLEGIKKLSNSLIHESKRGPIHMNVLNYFPSFKTALCMKLFTE

SEQ ID NO: 930360 - protein, 134 aa, Homo sapiens
MTRASRRRALGVSTAGNQYYLIVGKLLYLSAVSFLTYKPVKQYITTRHIKLRTAGLHCCQRMLGTQTWMPAGTRAELCKTGTCVAQGRRIREGVPLVKGLMLVIELQLVLAVQESYPAVAGYFYFSGETGKLEF

SEQ ID NO: 930361 - protein, 161 aa, Homo sapiens
MGPRSSLQDWQPSPQPSGPSWPEGGPYWGPNLAHPGLCLLLPFKALQLGPNPAPRLSGHQGRREARQWKQITRACWDRGGGLLGPLRVQTAEMPERVATAVPRELQFHKLRRGRVPACLWLLPTPQSGRPRSAAMGQRVSAASRRADTACSCPPERGQGGS

SEQ ID NO: 930362 - protein, 166 aa, Homo sapiens
MLPGWVEKDHQETHTTKPFSLFCDEELEAQRDYVIAYGHTNNVVKAPREIVMSRLPQLISGGAGSLAAEAVLLTTLSCCLNFINPSLGTFTVCTLEQFTSYSSTLSDLTPLTNSYLLDSLCHPCLPSLTRVIKIGAWLMVIDGPEADHSLPLLAHGKYLLFVTEEQ

SEQ ID NO: 930363 - protein, 144 aa, Homo sapiens
MCRFVTWGNCHRGLVYRLFHHPGYTHQQFCHDSTPNKGDRVIYNLMRPPYCCVQFPLAGTGPHILCLSRLASNLELFKTGKGRGEQKKEQVCRFKEVLQLLLLSIPKVLPSQDDFKAYEFLDHLGCLHSNLHFNWSRPVTMISH

SEQ ID NO: 930364 - protein, 156 aa, Homo sapiens
MWEGLDLLCVVLGNRARTRESVELTVMQISAHHKQEPANTQSSLSIEKVAFGGWKSLSYPLKSHLLATAYSTAGMSLTLLLNFQEERRHTVYYFSSQGLKVKLIDARDEIAKEVQCVLWWLDMDEAGSRYPQQTHTGTENQTPHVLTSISKHSAKL

SEQ ID NO: 930365 - protein, 159 aa, Homo sapiens
MGCLGSILLPTSFVTLISSSNEDGGAILIWGSEFPGTEDEHGKAKQSLPSGKQPEALTRSQGDASTSFLYSVQNPDSYRLSLQRQTSPPSSCSKKGLRASNDGHLCLSASLNLEDGLPGAKVSLAWKAHETPRKHPKEVRAMLEGALIQKHKYVGSGAI

SEQ ID NO: 930366 - protein, 138 aa, Homo sapiens
MAKPRPDPIPNLGFFALVEDGKINDIQATKMLNNNKMDALPEKMASEKVEKPDTREKKPESKKADASGNVTKGIGRYSRPAMCSRKARTKGSIQRLNPRLKRRSFLQLLQNQLVVTRMVVPQWLNFTRCLAIIYRRCV

SEQ ID NO: 930367 - protein, 136 aa, Homo sapiens
MIRIPLNVPHQQVSTYPPDASSGSPFRFPFSFVPAYSLPGAGEQGAALAQVDRAVNGSCQQPPTSSGQTKHSEACQGFKAVEPGEKQDSKRRRHSSKRELGKAGVPRPIQTTCSSASSSVKLGFPNMPCLETDTTY

SEQ ID NO: 930368 - protein, 139 aa, Homo sapiens
MFVASLLKSARPRTHQEERATPVAPPLRAVTLTAKVCCFTPEVSKTKEETLDTSEHLKEQTPDTPSLRTVTLTARVHGFILEVSETKNPPEGTNSGHNSRHLTLNICDEQGWVRRQFCSGHNLHIQGWPVPQFHHISTF

SEQ ID NO: 930369 - protein, 136 aa, Homo sapiens
MILFLEIYLNEEKLSAVSGNGLIHGVYCSLSSLISRGEMIKETHIEKHQSNSDVSADTQIGTVDAFKVQTTAVMQDEETESRRADRKGSKGSNIKASYETALDSIFGVFDVYTFEVIDSLLCSPPFLVLFLVGIEQ

SEQ ID NO: 930370 - protein, 149 aa, Homo sapiens
MWLSGGLLHHTALPSSPCQLPVQKEVEEHLGYWKLFMQNNPGSCFGNNPKPFEPNEHRRQLAIHCCGCRQRSPYGDKKRHPQDETPFSLERDHQEGKELPSQRVLISKLEVEESDYKRDTLGVRGKERLCLAGTQWTGEEVGAEVGIEQ

SEQ ID NO: 930371 - protein, 159 aa, Homo sapiens
MLLLFSPSLPCQSAALPLFCSSVLELEPSGEQEPPWVPYWIRSAVDTLPDLEGWKSAMGASLNQKHSRHPAGSGGVEVSGGTWGAYFSDENVLQAYLGDIEGSVPEHNKGKMNAKILKQYFEILKSGIGRSQHQLQEGSLKENGSRSKRHKETFPWRRR

SEQ ID NO: 930372 - protein, 219 aa, Homo sapiens
MSKRSSVGKLSTRKNQDDEADSDEEEDECEKLTSDSECEGQLLEEIKEKKGKLKKKLIPYDWDTLTKSVLTTSQYLQFKTWWSDETQSQTKENTQAQPPVPVSFEQLMGVGHNWGRLENQAVMEDVAIVQLHFVCLQAWERINVTGEKYPSFSSVQQGPKEPYIDFIAVLQEAVYKVITDKTAQDVVIQLLAYDNANAECQTALRPLRGKAYLAEYIKA

SEQ ID NO: 930373 - protein, 140 aa, Homo sapiens [sequence omitted]

SEQ ID NO: 930374 - protein, 158 aa, Homo sapiens
MIKLAQFGKRTAHFNCSSHYPDLIHEAFLQDNKQPGRGRRETAISESSTNLTFNVSLSTDLTVGERSRCQHPSHLKKRLSLVGCCGRHEDAHSAFLLQGAMLTGRVSAGPLDPALHSGHSHAFLGMLQPVPEHGRNSAGRNQRWPQPLAVPAILLVWF

SEQ ID NO: 930375 - protein, 144 aa, Homo sapiens
MRSCHVSYNPGGLQSRTACLCWGVPAKCDPHWVSSELKSSEMAPAHTDREGCYDIGWSPEKHKQVGNTVLPEAPQWSFDWDSKIKHPPNSEQFRKHNQTAPRQKVKNDQCSEYQEDSPPAEVEEERCWQGVDTQGLRNGRGLLN

SEQ ID NO: 930376 - protein, 143 aa, Homo sapiens
MRNLRDTSVKSTVNPTMADQLTACTMHLEKAADTQCQPVKAAGRETIPCKATEVELPKTMGTHLLHQHDLDLRHGVKGDHFGALRFDCPTGFGTCMGPVAPLFQPISPIWNSCTYAMPTPPLCLGTKSHLEFPCVGGTWWEES

SEQ ID NO: 930377 - protein, 147 aa, Homo sapiens
MFGNITEGWGLADQLQGIHPSVGWRVGKKPSLMKARSSHSSICCLVSVLALLLQIGIGDIIHQEQQQQGVVCNKSTLTGCHGPSEGHLDGRACPESLGVSQTRLVLMVTSSPIPPLLFCDTSWYTAYHDVRIVPAQDGVLSRMSGMQ

SEQ ID NO: 930378 - protein, 206 aa, Homo sapiens
MQHPLLFPCRGPSPCCFSTRGPHTPQIPCCSEYINTHPSCPLPLHLRVIPVLAFGCKCLTMSLPDFNPQQVSDYLTVKSSENEGHRIPHCVSPICCARHLLSPDPGSCSSQPNQTHSWGLRSWFRLPRGSICSKSPFVKGTGVELHTGPGIKGKQEKEEREKQGKWDNRKQEEPGEQVEGITRSILTYNGAVSQGPPPSIHRPHKS

SEQ ID NO: 930379 - protein, 138 aa, Homo sapiens
MLIFSSQIFWAMGIFLHFEWTDMLGNISKGPRADGVIPAVLRPVTEVNAGSGGLGAVPNQIVISSCSPSALQVQITLEIHVEKAAKSKAELFCWRELHLQKTGWASLVRERKQTFLCPLKTETLKEGKTKDGSKSGSK

SEQ ID NO: 930380 - protein, 139 aa, Homo sapiens
MVTTSVGITKNPQITQSPFLQAECLLKMLLDKLNALNVCDMVEVDFAEQVYFQTGDLQNGQLLKLYWFNHQVRGDLLQQPSETSTPGTEAGRVGACGPPCTILLPSSPTLLLLPMHPHLHEFALKKPHVYLLPFFSLLM

SEQ ID NO: 930381 - protein, 140 aa, Homo sapiens
MRGSPQTPEEVKRDPAGALEGAWLTNSLILDFRPPELRENESEFVPWGIHSQCVALEGSTIHLGHSHRPHWPFRTLSTAPQRGPHPAGMRLEGCCAPKNQAFVHSCEGLLLPVQPSLLRGVLSTRQNQGALHPGTGTSLC

SEQ ID NO: 930382 - protein, 171 aa, Homo sapiens
MGMCNGLRVRLSGEDLRKGQSGQKGRVKIGGVLLEPWEEGVGQSLALPLVVPVLEVPVSTRRPRFSTCVLGDQQHRVEAKPVGISYVDIEVLKKLDRNKKLLNKYDAFLASGSLIKQIPQILGPGLNKEGRFPSLLMYSEDMVAKVDEGKSTIKFQVKKGLCLAWLLVVSR

SEQ ID NO: 930383 - protein, 149 aa, Homo sapiens
MIAVEANIGQQGQVGMQSGSQEEVSIKKIRQLVGTQPITVSQRQNTGQWDRVWQDRSVPAVLKEGENTGPVILLQEVGSHGLGQLCTCGFSGYCLPPGCFHGLVLNVCGFSRCTVQAVNGSTILGSGGWLSSSHSSTRQCPSRDSIWGL

SEQ ID NO: 930384 - protein, 154 aa, Homo sapiens
MTLLGLASVVASTKCLWVPSRLPGFCLYTHEQSPWLDFLSLTLLGRAFLLGELRPNGVICLMVLCFMAGGTSPSLGAWRKDERTSVQSPAWIPCLSIRAVIFLELEASADIDSSISFLHFKNDSKEDCLETTSALVLVGGWIFSTPILQEWKKE

SEQ ID NO: 930385 - protein, 185 aa, Homo sapiens
MSLLVLVLNIYSDSFYLMASTTDAEKMLHKPKDCRPRYLSKATSFLEHLLRCSLLGAVSEHRKSCKKYPCCSPGTHSMDGTCIERRRQWYRDASGEVIYSGSGTVYYGRIRSWEDIWQHPWPLLNGYCFHNIYSQYELLLYGMYKRVHYLNTVEKKDLLGTKADEYLSWVALDTTMLGLWSVAQR

SEQ ID NO: 930386 - protein, 156 aa, Homo sapiens
MEWYQLLLVPLIEFGCESIWSWNFLVVFLLTVRTLRCRSVGVYWRSTPDPVWLGVSSGGCTTVDIGEPQMLLPDRSSGSFVSEEYPAISQAVCWENHYSPQSCDTGTFKSAEVIAVFCLSVPCPQRLSLQSDPSKGPDLQACLHGCKWAPSSRYLE

SEQ ID NO: 930387 - protein, 141 aa, Homo sapiens
MILKVSYGFRKKIMCYPAGEMPSSICYMLRTSDQCVVSPKPGFTGPEIKGEETGPPHYYPLAKKVFPECQIEATLSSQEATHCSPLHSFFHRQFTRWQLPNLKTAGEQKTARLKSKDLYLDLATESFCFEKFPCQVRKVIE

SEQ ID NO: 930388 - protein, 136 aa, Homo sapiens
MGLPESQTAAIVIYLLDLASQQRLAVAAVGDAGVIPRLMELCSQEDYGCLCCVTQVTREVGKSWQQQASFSSYTACSPKGQSHSQHAPPTAPAWVIIPGQLLVIKKMVISNCSLAAGKSFKNDCPYLVANVLAFQR

SEQ ID NO: 930389 - protein, 146 aa, Homo sapiens
MKAASQESVPYKATGVELPKAMGAHLLHQCDLVAKGTCLVSDETLDMDFSVNAGMSKDFGGLLEGHDYVLKCEEMGCEKGQGQIDMTSTFILPRIMNVWYFLTPAAFPESQSKSSFLTSHCLLRFYFDKKSKKVVQNFKKHYDFER

SEQ ID NO: 930390 - protein, 184 aa, Homo sapiens
MSIFNHSKIRQVIHFWVSRNGVANGLQSNMPKFYCDYCNTYLTHDSPPVRKTHCSGRKHKENVKDYYQKWMKEQAQSLIDKTTAAFQQGKIPPAPFSAPPPVGAMIPPPPSLPGPPHPGMMPAPHMRGPAMMPMMGPPPPGMMPGGPAPGMRPLMGGHRPMMPGSPVIRPPACPMMVPTRPRKT

SEQ ID NO: 930391 - protein, 170 aa, Homo sapiens
MLRPSHGAGHLCTEKGPVQAAFVGSRITAGFGVCGNILLPTVPTCLCPDLMYRTVNRKGSQSDPKRGFLDLTQELGPPISSCDLECLNLLGMQPNRSQPHLPSPYSRWSCSGLNASDKARRWTTKLNVACVFSTESNDITKLLPYENEEAIKEYALKKYRKIIYRNVSGS

SEQ ID NO: 930392 - protein, 151 aa, Homo sapiens
MWPHSDLTGRHLAFSTKWGIFCRHGEYHLPPLANESQEPRLLLWRWAALIPYQLCPSYQGTGTEKQLEIQPCTGSCAKASSLAFTLPLHPFLFFTFSSSVPPQQAWMGLSSQVPQESLALLLYTARIKRLSTRGGKEKKQKGNKGNEWALP

SEQ ID NO: 930393 - protein, 211 aa, Homo sapiens
MMLVKISFLLGMVAAATAAGHRCWTRDAAARGLWSDRGSQAPLLQVCCSLMAVGSRAYLPGYYQQRLQNSKDSCLLLPLEGSSPTGTSLMPAGVLLYEVSVNPLPTVGKTAYSSLSNGGRPCPPPSSSVPGGLQTAVLAAYEGIPWSVDCKNHEKSVVSGLDSTIPHGFPWMGKGGPPPPLLALPTPQLKGNGHSPKGPRLEYDCGYRSKD

SEQ ID NO: 930394 - protein, 257 aa, Homo sapiens
MEKENGSRMGTSEELESREFRRLGRAYALAFAERGALVVESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQMTKTFC

SEQ ID NO: 930395 - protein, 139 aa, Homo sapiens
MQFYFNHQYDHIQKDEEDDEVCEERTLKDPSGPQRKRWPLRAAASALLGDKWPCLLSPGSLHPLSPDFTLPPPALAPPEPRSPDAGLAQGRLTASLRPIPSPGPSPGLGPAVLRYKYQSMVELKSNRVGRTFAILVIKS

SEQ ID NO: 930396 - protein, 182 aa, Homo sapiens
MVWPSLARGILLGPRENLGWPAPPSFCLSSKQMWRKGESENHEQTKGVILGAEAVIEISEWSAFGYAPPTAMVPGEVTKVPGYGVDLTEHQPTWSKLEFFCVWTSVPYGTRVIGSQHQVVGVTKSGRVKGMRKDSLREQVGPGGQSENGGCEGPELWKPRLFIGDQTKKQVMRIFPSKSESL

SEQ ID NO: 930397 - protein, 174 aa, Homo sapiens [sequence omitted]

SEQ ID NO: 930398 - protein, 144 aa, Homo sapiens
MGRLLGTWHSIDDGSSGGGTISCCDELGRPVSRPFSWFLQVHNGESMHQLLWVEMGQFSGPRQSVQSHSPGDSRSCLWCLESSVQAVALCLIVALVLAQSCVVFWRFVPERMAFKTASGAFPEVQTLMSVFLFQHATTVSFVCH

SEQ ID NO: 930399 - protein, 145 aa, Homo sapiens
MIEDMRVEIFSEIDGINEKQSQLQEIKDTLRETQNVLESLSNRIEQAEERTSELKDKVFDLTQSNKDKEKRTLKSEQSPAEVRDYVKQPNLRIIGILEEEEKSKSSSKHHTVTVTDTLGCLPNLLPILPSAIRLSFRSRIGGQGL

SEQ ID NO: 930400 - protein, 139 aa, Homo sapiens
MQKPHLKDHNSSPAREQNWTENEFDELTEVGFRRWVITNSSKLKEHVLIQCKEAKNLDKRLQELLTRITSIKKDINDLMELKNTARELHEAYTSINSRINQVEERISEIEDQLNEQGRPTFNFRKYREHHKDTPREEQP

SEQ ID NO: 930401 - protein, 151 aa, Homo sapiens
MDVNPQPLVTTGFNLYLYPSHWEEVRSARPQVGPEVSSGSQGLEYKILEVYLVFYCIAAQLALKLHGAVLPTVSSPFQKREEYHPIAPANPGHKENSQTTTDVPLRPKEMFTNESSAPGTVHSSIMNSCLSESQVQFKTIMEKVENYINYT

SEQ ID NO: 930402 - protein, 137 aa, Homo sapiens
MSVDLPFWGLEDSGPLLTAPLGSAPVGTWCRSSNPTFPLHTAIVEVLHGLLPGHPDLSIYPLKSRQKLPSLKLLSLVFCSPAGTTPHGICQDLGLAPTGTRQGCVSTLTTPVQIALEVLARALRQEKEIKGIQTGKE

SEQ ID NO: 930403 - protein, 155 aa, Homo sapiens
MKARLVMQLSSQAIQRSPNCGQPRELVPFIPAAPALAERGQRRAQGMASDGARHETWQLPCGVETVGAQKSRIEFWEPPPRFQKMCGNAWIPRQKFAAGAGLSWRTCARAVRKGKVGSEPPCRVPMGHRLVVLWEKGHCPPEPRMEREFSFTDSL

SEQ ID NO: 930404 - protein, 144 aa, Homo sapiens
MSVLLKGLNIDAFSRKPFLIALEFGRMCSGWISGEQVWMKGVVRCSKGHLRRRTGECPCPVVAKDITGDLGDNSSSTAMGLKSKASDMKRPQHEHLANLDLQLDLRLSDLLISHCDAVVADASNTPGAMVHSERVLHAKDQLVL

SEQ ID NO: 930405 - protein, 161 aa, Homo sapiens
MLDTGNTQIIRAASQPDSLRIKEIGAIEFYYKTVVAQIKTPVGGVERCDSIGQTLRIDRICSLIGYRDARKGVRIMPCLFLAGSVGWIVIVHLGGKNDFRFGHELSFRGMKNPCGDRKRVVTEVGREISLYLEREDFEEEKPAIEIRLEEKQVDRIVRFCK

SEQ ID NO: 930406 - protein, 149 aa, Homo sapiens
MKIIPNFQDCSSSSTLLLSIDVAGLHKQDYSILKDSQLLVLELNPPSTLEMPSFSEITVPAGAACQMNKRALAPSSGNNQVEESLVSTDIWWSLRGQHPSILNLKVCTWEPGTNPDDSSRIDSSSPSSPGPPTFSMQLDSASWRERSRI

SEQ ID NO: 930407 - protein, 138 aa, Homo sapiens
MVQGGHGQVHAGKVAQGEAASGAAQVSWCMFMGPTLLEHSAGQVVHQHRSYDAGPQGTRGCLASRHIQAGSQKRPADQGVLRSKWPQRREDPLKDNANIMGIIGIKGRNKKIIKCYPIPFFILPKIQKRSNDNPLSKH

SEQ ID NO: 930408 - protein, 163 aa, Homo sapiens
MQKSPAFCIGLAGSCRLELSEVRSPQAWTSTVPGAKKVGDCCFRSLGMSTICNCDKLKIQMQSSEKRKSCKGKTVNLQRSSLLKFLKMTKKESEQAFISVPRLYSMVCHNIYSFAYTFNFLASSSFIVLTWQNASSSDSQISAGSVPALTQGNMAADYTFLVH

SEQ ID NO: 930409 - protein, 185 aa, Homo sapiens
MHAHAYTHLCQLPAYKTWSSVLSIILTTTTITITTTTIITTTITIASIITITTTTTTTVTIITTTITITTTITLSVSPSPPSPQPPPSPSLPPPPPLPPLPPLPLLPPPPSLSSPPSPPPPPPSLPALTTTITSPPPPTPPQQQQLSGYFYCPVAPDWVTASVNPTGKYQVLVWSLRVERIRTYT

SEQ ID NO: 930410 - protein, 234 aa, Homo sapiens
MVPHYGIPEGKDSTSCPSHAPECLVKCWIHGYAQGIVVELNLSELKRGIKGNPAGGKAAENLEKMKRRVGLGKGEQKQRMKYTFFYSGIVSDVHVTERPARVGILLDYNNQRLIFINAESEQLLFIIRHRFNEGVHPAFALEKPGKCTLHLGIEPPDSPRVKGTKCQQHLPSGWKQLWNKGENHHNGKNQVLDRWCLNCVSEYWNSMEVPEGQCGIQQEGQVGIHSNPYLISSH

SEQ ID NO: 930411 - protein, 137 aa, Homo sapiens
MHQLPAFIHWKILGPSSSGSRLGNQRERALLGSSCRSSHRVCLLLTTFSQIVTIEGDSSCLSPLSQLPGVLDTEAHQPGPVGSKQHRHRPALFYHLLWTQADRAGSVQNITISCKVMAVGKGWGVGSGELSEPLIGS

SEQ ID NO: 930412 - protein, 168 aa, Homo sapiens
MRLSRRVVAQIPTAGIQPVYSRCQILEIVAAAKLKWSLTKKLYGREREVGRAGATHGLESPGGKFPDVLDFILGISVVQWKKCELWSQPDWVQILALPLTSFMTLSKLLCHFAPQFPHLIYGDDDNGTYLTKLLWMKSVNSCRVLRTVPGTCKHSRSLRCNFCTKTKI

SEQ ID NO: 930413 - protein, 140 aa, Homo sapiens
MENSFGAASMSRAPDWALEMQQGVGLRSPLPSWDLESELGEHRACLLNTTTVILKQNPPGLGKHQDTGMRQSSHGGSQWQCLEVHILGETDWHKHQPTRVDSAFTLWLMGGEEIGEVVPKHRRILLFKQLVPLTMQINTS

SEQ ID NO: 930414 - protein, 152 aa, Homo sapiens
MICLGAVFIGSIIRGGSLNYLDMKVYSLHYICEEFACDIFQYFFFPSFSLLFLWDSNYRYVAHCTTGHRSFVYFYFLYFYLDSSHCPTFKFTHLFFSRVQSAVIPIQGIFLFSYFIFQNYNVHLALFYSLFYFFFCRDFPSAYFTFIIAVLT

SEQ ID NO: 930415 - protein, 141 aa, Homo sapiens
MGKAEPEVEDSNDQNCEELLMDRRVKISSFRAVSSKVEDWLNRKEVEIDMKVTNELREWQDCSRRTLTPALNPSNFLLRTGHREAESGLFHKASNGRTRKVQGPLDFLKDRSCLGKESVLSANVHMFLCNLMTTLVEAFEH

SEQ ID NO: 930416 - protein, 260 aa, Homo sapiens
MLEVHSRPYLPGYHQQRLQNSKDRCLLLPLEVSSQRSTGLMPARALLCEVLNGKVSGYAFSNSPLFLGLSTSIIPGLVILFNCHKLMQMVSHSLYLGYLTPPTSPPSDDEEEFDLSLFSPQKEEPGDDPLPLPPILEPVYINSSTKLLPPLPEEDVWHSPEWLLSCSSRPFGLLPSSKPTVSFDAPGPLLSEVWNPASPQSTSQCPHSPSLPLPLHNGCGLGSGKLSLESRKVYLKWALVRGVCVRMLLLFDQTLMSEKT

SEQ ID NO: 930417 - protein, 325 aa, Homo sapiens
MNALKLSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGKAFSFLFPNIGVWTITHKLAFSATTCEYR

SEQ ID NO: 930418 - protein, 227 aa, Homo sapiens
MLLGLSSSLQKRPHGEALRRHANNQYQCSSHGSGPTWKSIQASVRPLNEGSQLEVGMESPGTPALWAVQAWALNSLLPEGLDLWKSKEESSGSGQAQDLELGGQWEVCDRCQGSSSRVLSRPQYEWVIIGVSMDTDDLITTSPRELSSVGPDIRQETSAHPKSKRLAALLDLMKDTVVQAPTIKVNLLVNYLRSGQAVYQMAGGHIAFSGAMKLPELSEGCLEPFPT

SEQ ID NO: 930419 - protein, 153 aa, Homo sapiens
MGRDLVLASKSVGLVGPLTPSIPGPFSGHLVTGRDKEEHHTKDVPTVAMVVSKPSPYPPLIPPNRPVFRALRLRLLRTSHGKRLLCNFFRRHSGNKSHLTGTEGMREVGWPDQERSQQKQTLEPGLHFMGRTDLTKAGLHGDPVPMLGTNCIS

SEQ ID NO: 930420 - protein, 170 aa, Homo sapiens
MTLAHFASLCQTVCIYTYKTVMIFLWIMDCWNEVSAGKKLVRSTAGRHEASQNEERITGCPCVSVETLPTKGKIEHKALDRTLCGTLPMFLRYRLNCPGWAVGSARFTDGQTGVGSIRVASSGLQLVEQLLKQSEYPVLCWIIQLGFQTSPGFRVNSLTFSGFEDPDMVC

SEQ ID NO: 930421 - protein, 197 aa, Homo sapiens
MSNPWMRTPHICTWLHVHGSSAGKASLWVIEKPNHDPRRGLPLPCVLVCQYLEDKVYKAMCKGCICPWAGTWLDKYLCLQKVETAAVLGQGIKYLPTANFHVRENLSVLDNFSSHSHNELLASCGKKFCSRGSRCVLSRKTGEPECQCLEACRPSYVPVCGSDGRFYENHCKLHRAACLLGKRITVIHSKDCFLKGA

SEQ ID NO: 930422 - protein, 151 aa, Homo sapiens
MTGTLIPDLQREGIQNRWREGTDAELKGETPHDHQGHLNLKGMMLKELAEAKKFFETNLNTDATCQNFWDTTKAVLRKKFIPLTTHNKKLERIQIDNITSQVKQCEKQEQTNSKPSRRQEITKIKAKLKEIEVRKTFKRSANLGVVFLKKI

SEQ ID NO: 930423 - protein, 150 aa, Homo sapiens
MWQRVYLLLRGNSINDVVRNLLKKWVNTLMAEAMSRFLPLTTKEGHRKVPLKLLVESAIFCMKYIHKKYENSLFFCITFENFPDQILQLDNSDASACVCEALLTRIPSGLHSISKERHWIKEKAAEVERTQISNILFHIGYRVLFVRGKG

SEQ ID NO: 930424 - protein, 141 aa, Homo sapiens
MSTRLCGHRTHPCTESSFEDQTIACAVLEARSTLRFCSFIGLSGFSQHKLGFYNSELGLMVCTITIRILFQTVSHFTLYQDRLGRELRDPENICYTKSKLMVNRMQFLIAEVHPDAENYKGAIGGSCQLGTDSTGFQKVRL

SEQ ID NO: 930425 - protein, 165 aa, Homo sapiens
MFTGNGPVSQSVRGKDGSGCSKAVAYGSEQGWTARSLKHPLLSELDVCSGPALSQFMLDAGLQGAPVSLTHQPRSGCSHLSFLQQTHQNETRRLLAASHTARSLPAGCAGMDGPRNQQRPGCGCGGVTGREEGNLCGYRQEVDNTTQSYFLEESKPAEFPETLNK

SEQ ID NO: 930426 - protein, 417 aa, Homo sapiens
MCMVIKVAVVRGHMPTILAAGWQVYVLRLACTQAVLCTGHLRPLALPIFSCSDPTILQHSARMTPPPQTPTDSVAPPPVLWLLPWFWAPPPVLWLLLWFCGSSSGSVAPLPGSVAPAPVLWPPHQVLWPLVQFCGSSSGSVTPPLVLWLLLSFCGSSPGSVAPPSVQCLFIRFCDSSSGSVAPPPVLWLLLWFCDSSSGSVAPPLVLWLLLQFCGSSSSSVAPPSVQWLFIRFCVSSSGSVAPPPVLCLLLWFCGSSPGSVAPPLVLWLLPWFCGSSSGSVAPPLVLWLLLRFSGSLSGSVSPPPVLWLLLQFCDSSSGSVAPPPVLWLLFWFCGSSSGSVTPPLVLWLLLSFCGSSPGSVAPPSVQWLFVRFCGPSSGSVAPPLVLWPLLRFCGPSSGSVSPPPVLWPLLRFCGSS

SEQ ID NO: 930427 - protein, 154 aa, Homo sapiens
MAWGLFAARRKALMPSSSYRPCEEKTSDGRNCRERGDCDFIPVGKDNADVLSQWQGVSGTLLTLPPCGHEEVSIPFPSMQFLCLHQTWSTHKPCTAKCLAEKQAITFGKSLCAILEDLNEFLERVPHAERLTSELIYLLVILQFFLEYGCLPPG

SEQ ID NO: 930428 - protein, 143 aa, Homo sapiens
MAKIRQRCSAAQGYDWIRDRKLAWDNRFPGSWNAKLFQAQLANIFPRNKNTLKCKGSNSDPLVLCEVRQAKPPRMEQLETNRTGNNQRLNGILRSTGKMQVTSSDRSVVKLDHSSPLTLPHSICHSPHPGSLRNLPVLKASAL

SEQ ID NO: 930429 - protein, 139 aa, Homo sapiens
MEAGEGSGMAGCSPEACPAGRQLRPGEKSTGGPSTPSAAAGLGAKSFIARGRQGRPAAPSVGPAKPTPTRNSSWPASTPRSPGSRSRLSLHTSLQAEGAGSGLGQPRKGLPQCSGGLKGSSSAAKVGAQAEEVPRVSEG

SEQ ID NO: 930430 - protein, 139 aa, Homo sapiens
MFNNMNGTRGSYLDVDSWQMISVFVAEGRGGFGNFLPSDSEVAAPLTIPFTRGCPPNMSSYKEKILGPVLVGLETETLDKVIKIINNNPYGNATDILTTNRATTWKHSHSCGGSQRSLWTNFQKILKAIHHLFSGDSKQ

SEQ ID NO: 930431 - protein, 164 aa, Homo sapiens [sequence omitted]

SEQ ID NO: 930432 - protein, 151 aa, Homo sapiens
MTSSQNYYSEGIYRMSPSSVTSFAPNLQPYHDDPVESVNTIKACWSFFQSLDPWSRVHFNKQRSYMLKMSPEGGKGVTLTDNCGKSIPGSGSSEYEGPKGGLGLEGDLEFTVDMYEVTIKINEESSRQLDINICSSSELESSSSCWWRISS

SEQ ID NO: 930433 - protein, 150 aa, Homo sapiens
MLMCSISVIRGSFESKCQNVSGKLWDGGRSWGCRCLSPDEHQWRGLLHPWAQSRKRSVSSVSPPSSSPTHTQGALGTVPVLRSTHPKPPLKSKMAARLRRCFQLFRTPNLTETSRVKQPDSMSEHPSQLFRTPNLIGSAGLNKLILCQKI

SEQ ID NO: 930434 - protein, 134 aa, Homo sapiens
MAQPCVPGYRGRFPGTQCGRASSQISLDTGSGISVLGSMPLGTLCFGVTSLKFSKPLGCLGPAGAIIDSEAGCPKPRPGLIWALAILALGLLLSVKAQVPVNPVHSCSDYGAPEGGGGGGRSPLSCVLPAAAAR

SEQ ID NO: 930435 - protein, 139 aa, Homo sapiens
MWGDILSLFKSLNLNLVRMAGDTPHLNSRASGRKPVDDEKCMYLAEDEMEKALSSSCSKGTLTSCLPKLLMYGVLDFESFHFRTRQSSWAFKWETYVISPESRGGKLEDRGHFPRKQKGPLLPPIPRSSSLVPSTFNCN

SEQ ID NO: 930436 - protein, 138 aa, Homo sapiens
MRCVCPWSQHKAPELHLHQLPNVNEGTEEKDGPGGPPPPHLSLSPTNHSPPPNSIATPSEAFSGFSNLRNHSLVQIIQHFRSIPNCLTKELAVFYPVCGVPFEDCWGLWTIQRSFHGKDQASWVAMIYCQVAAEVIDL

SEQ ID NO: 930437 - protein, 333 aa, Homo sapiens
MNAKQLFLISFKLKACSGQSLAFDSLRSYQVLVYKQLLCDSGYNSYLNLPADFYSPRLGKTEDPDFESPKEAEQLQKLSIKELGFETTDECMRSHFEQWGTLTDCAVVRDPNTKHSRGFGFDTYATAEEEWMQPCMQGTQEIPSCGNGYNFEVRKALSKQEMASALSSQRGQSGSGNFGGGRGGGFGRNDNFGHGGNFSGHGGFGGSPGGGGYGGSGDGYNGYGNDASNFGGGGSYNDFGNYNNQSSNFGRIKRGNFGGRRSGPCGGRCQYFAKVQNQGGYASSSSSSSYGSVRGFSLLPGNSLAGEESQRSDRKATGYNRFVNSAKHSGGRA

SEQ ID NO: 930438 - protein, 156 aa, Homo sapiens
MGPDVTHPHPHFPSMVPHPSSILNLFQNQALLFSAPLPLPIFSSLPPLRISSSSISDFPFTALVGTSPCKSPYWQTCREVWRERRERELGLRMALEGQLEFRVGVGLVGPTLGAAGGPYQPRAMRGLAPGPAAAEGVLGPTAVPAHQHCPRFLTGP

SEQ ID NO: 930439 - protein, 167 aa, Homo sapiens
MLLEILDALESLSNRIEQVEERNSELEDKVFELTQFNKDKEKRIRKYKQSLQEVLDYVKRPNLRITGIPEEEENSKSLENIFGGIIEENFHSLARDLNIQIQEEQITPGKFIAKRSLPGHVVCRLSKVKTKERILRPVRQKHQVTYKGKSIRLTADFSAETLEARRD

SEQ ID NO: 930440 - protein, 218 aa, Homo sapiens
MPAINAKRVYRIMRQNALLLERKPAVPPSKRAHTGRVAVKESNQRWCSDGFEFCCDNGERLRVTFALDCCDREALHWAVTTGGFNSETVQDVMLGAVERRFGNDLPSSPVEWLTDNGSCYRANETRQFARMLGLEPKNTAVRSPESNGIAESFVKTIKRDYISIMPKPDGLTAAKNLAEAFEHYNEWHPHSALGYRSPREYLRQRACNGLSDNRCLEI

SEQ ID NO: 930441 - protein, 135 aa, Homo sapiens
MAHVYIGIKDNRLGIIKIKMTYPENTEFSSPQKSVNFWYVLVMNDEHTERRYLLFFLLSWGLPAFVVILLIVILKGIYHQSMSQIYGLIHGDLSPVGCMDSISTPELIIVARRADNIDYPGHMPMARAKAGKMRY

SEQ ID NO: 930442 - protein, 131 aa, Homo sapiens
MLNSWTLNCNKKIEHILFCAYKRSTIEDEHSFIYLTNMYKRMEIISGMFTIFALGTLHRIDVQKYNQPINQTNKDEQEQFGFFANRVIRTGKCDWINTGKINNENPVESLPSDAGSDMEPNTRAFGSLLRG

SEQ ID NO: 930443 - protein, 150 aa, Homo sapiens
MTCNPLGRHWSILTWRCKGCCAPRQDVVWWELCSQNGAMMQLLGSQSVCDIQYELLVWKNIIIWTPDVIWMENEVGSRGNCVRNNVVTMWHTCGSAEGPTEARGPEPCHEEALSQANEVGFYFEGLVMSKRRVGCTEPRSLEKVSCRESA

SEQ ID NO: 930444 - protein, 161 aa, Homo sapiens
MIVRPHQPPEALEFRVGVGLAGPALGAAGQPCWPQAMGDLAPGPVAAEGVLSPPSSARPPALCSIPRRALAAFLRGRARDLQPAMPEPPTHSMGSCVARASPTSTTPYSTAPSPIDHPRAEECECTAQDWQAAPPAAQVRDPLGEASWAPESGGDVESLYV

SEQ ID NO: 930445 - protein, 140 aa, Homo sapiens
MCFHLNFRPCVSIPVPEQWNNFSPEMNTTSILVGPLVSNLEITHISNLTCVKFSNTIDKTNSQGIRPVGTAINKPSVMRVRNRKEGNMGKWSECQVDQRDTVMGARCGIRNNVGGQTEVWARNNDNCGRPNEDLVAVQPR

SEQ ID NO: 930446 - protein, 136 aa, Homo sapiens
MVEGKKEQVTSYADISRQKKSLCKESPILKPSDLGRLIQYYKNSAGKTHPHYSITSNGVPPKTCGNCGSYNSRRTVGYIENWKIFVANGEVLAQLASIQDFTSISIYFTGTSKHFTGTFKDFTGTKNHLLILESYL

SEQ ID NO: 930447 - protein, 171 aa, Homo sapiens
MSALNKSKQLQLFQTTHSWATSAGKSPSCSYIAYLCLSIPFIQQKSRRMAEWCGREKECLNIERNLAGDSQSENQLLDGHIPGQELQIQKAVALALCPCEKVEGPLSCLTLKPSVDGKAKRTHCNTRPLALWESQTPTLDATVWPEPRGTCPSSCTCPSVDSPSHKAFEHA

SEQ ID NO: 930448 - protein, 336 aa, Homo sapiens
MRKQMVLKFMSYQRINGARSTVPKRPFIKVREDTDLSEIIHPHGPSESTWRTFVQRGADGRGGLGSGPHPWGDAGPQRLWLHGAGIAVRAKAFGFSVIFYDPYLQDVVERSLGVQRVYTLQDLLYQSDCVPLHCNVNEHNNHLINDFTIKQMRQGAFLVNAARGGLVDEKALAQALKEGTIRGAALDMHESEPFSFAQGPLKNAPNLICTPHTAWYSEQASLEMREAAATEIRRAITGCIPESLRNCVNKEFFVTSAPWSVIDQQAIHPELNGATYRYPPGVVGVAPGGLSAAMEGIIPGGIPVTHNLPTVAHPSQAPSPNQPTKHVDNREHPNEQ

SEQ ID NO: 930449 - protein, 217 aa, Homo sapiens
MTLSIMGHLEWARGCQTATGIYWDLLFVQAGGEDPAGVSIAEAFPLSWEGGGGPSIGPGHSYWELQGCKRILNSNGGIDKETKGLLKKPLLFEEKNPVATRTWEGMDPCEKRAALGTICVHGAFCVRVPSIHCGTELLEVTAESCVTTGFQNWRRQLRTARTTGKGGKTFQKGRNHRRGSTKIIVNSTQVIGGPLNSHEWVRLQGFQQKATGKVWKN

SEQ ID NO: 930450 - protein, 135 aa, Homo sapiens
MNHDHWLCGGPPGSWFHGHMAWPYELTFRGKDVYLFNKGKVLWTIRLVHMTSASFCQCWGGEIVLQQLQSCVSACWVTGRVAQDSLTPQPLGVWVLWRAFSQSQRTVLPMWWALLLAVAVAQRGDAHSSPWKPCW

SEQ ID NO: 930451 - protein, 143 aa, Homo sapiens
MEEVEGRGNYYSGRSVAFGSRRADGVSSSPGLETYSLKSQEEPVFHLEPHGRKIMMPQLKAAGGQQQVDGGRLREDITPSLGVNSFIQSRTAMEESTILMPITEVLSTVLSVESLLYSKAGTPISGPRLKCLHDHGARSPKNG

SEQ ID NO: 930452 - protein, 168 aa, Homo sapiens [sequence omitted]

SEQ ID NO: 930453 - protein, 153 aa, Homo sapiens
MGIDYEVEATACHLQAAEPGKQGCLKLDAISTTETQFSRDQTRRKPGPVRGREKNVSSTEKGRGGGKGGEEGKKEEEKDKEPRTCVNALRFWAYETGWMGILIPETEDIGKGLNPYFGEDEIKMLMGRTWFQRKIDGRKTRTIYSPCEVPEKN

SEQ ID NO: 930454 - protein, 134 aa, Homo sapiens
MGPSMRIKRQNGGKCCLNPTAYLCYIKANKGRVLFLDLDSEKNNRRRPEGCRCGSKWPSSIDRAPALLAVDAGGQLHILALLNSGGGMSLARANEMWGRSSKSQFLLCDTQFSQSADSVGSTATSHGGHIILCS

SEQ ID NO: 930455 - protein, 193 aa, Homo sapiens
MISGKTGIISDTRIYDTGTTFPEQNSTSYGLMKALSAYGRDGKWRCENEVTSKWSSPSSAALLEFAGGPLQTLFVWVSPVEAAEQQRLLPAPSSASFIPEGHPLDASRTTPEAVSPLAELEHCAGRSAALFRAVRQKRLSPLKLHPQLPLSPDALSQGDGSFIYKPLTGTAAFLSEMPCPDRRNLERQSGYSG

SEQ ID NO: 930456 - protein, 162 aa, Homo sapiens
MPLVALGRLGYGLRSFGNVHSYNQRTASGAADRGHQRGNLTLEEEAERQLGFRGEKPTLPTRIWDPPSVDTQKGYHTGLFPLLAGGSHPPRRGKGATELIAHCCPWLVELREHCNMPSGALGSQAPLPGHCHGACTEFVSAGTKVASRFLQSLTCMFPPARG

SEQ ID NO: 930457 - protein, 148 aa, Homo sapiens
MSNLIVIWLNWIQDCYEPFSTVCGISAGLNLSELFNHITFSILGQKQQNDQASIPQNSCYLYNLPKSLSNTSKHVNSSITLAFQSGLIDADVLEKQALKNCAQAIEEHGTMNRGSKPKVLKMISRETSGNLNHQLPLVHTEETETQKK

SEQ ID NO: 930458 - protein, 161 aa, Homo sapiens
MEGREVAYSQIPSSARYLLESHSDCKYLSGMTGSYGSFKRRGSVRIGVGHRHEVLYKEGGRKHFDTEEGNVTTDARGHMAGFEVGKRGHEPRCARNTGVKGRDVKEIDSPIGFQREYSLADSLIFPQTSVLQNWYNINEEILIVLQKNVKFGDYNVLMKKS

SEQ ID NO: 930459 - protein, 134 aa, Homo sapiens
MGHPESQTAIIVISVLDLATQRSYWAPGRYWGISAKSPVMLSVFRSFSHGYKHLLWWSSGIEANERGEFQEDSAVLKTERLRGLAEQALKCKVDCASVSAFLWELSRAKVRKAAGMLWAICNHSHNYQVFFDQK

SEQ ID NO: 930460 - protein, 147 aa, Homo sapiens
MLLGNLCLHKNLHRNIYSSFIHNYQNLEATKTSFSCGYMDAKWVQGISCLRSNRKFLEHEARGLKRGLKYGAVGVKLLLSPGAVTRCADTFAAAVDDMNLGLSRAPANPFDPSVPWTAWRLLMCWTNRPIAGACSLLCLAQLLLDRN

SEQ ID NO: 930461 - protein, 146 aa, Homo sapiens
MVLLASSWTRRKRDRSPDTDSAVASFLDFPVSRIGLSSILQRIPSKIEVCVESHSLNKESKAAELLGRMSEVHLLTFARQGDCLEIKNVQMHLGQNQVGCPSKIPQDPSLFGRLSWEQKGLGQTPINFIRGSTRCKRLKKRVGPSE

SEQ ID NO: 930462 - protein, 495 aa, Homo sapiens
MHGLALWAVTPATAARRTCLLASGEAKETLAQMYNTVWNMEDLDLEYAKTDINCGTDLMFYIEMDPPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNEGSAKFVFGFLEQRSPLFRTLV

SEQ ID NO: 930463 - protein, 271 aa, Homo sapiens
MFKQQTIQEVTWVLLKAFSFKRETHHKSSEILQPDVIERKNPFSEETFKLAAEICISNKALNVNHQDNGENVSRACQRPFPQLLQPWLNGAKVQLGLWLQRVQALSHGNFHMVGPVGAEKSRIEVWKPLPGFQRMYGKAWMSRQKFAAGAVQKGNVGLESSHRVPTGAPPSGAVRRGPLSSRPQNGRSTDSLHRAPGKATDTECQPMKSAESETVPCKATRVELPKTMGAHLLYRHDLYVRHGVKGDHFGALRFDCPGGFQTCVGPLAPLL

SEQ ID NO: 930464 - protein, 141 aa, Homo sapiens
MSHHTCSAFLFFKAGEGQSLLFSSIIYCKSQQTFSVKNQIVNILGFVGHTVFIAITQFCHGSRKAATDNFKSHLKDRWEILTYHFNGTQYGLANGGGDGGGNDGVCKHSRTDSCNSTLIICASAQGLGVEYNQPWAKFPIS

SEQ ID NO: 930465 - protein, 149 aa, Homo sapiens
MVQKCTSSLAGFGTLMDILAQLRVPRAFLKGLLPHIIKEAPGKRVGTTRSRPQVSDFTSAKLSDGDEELVENWSKGDSCFALAKRLAAFCLCPRDLWSFELERDNFGYLAEGISKQQGIQEKAQHKSLENLQPDDLIQKKNPSSGEKSF

SEQ ID NO: 930466 - protein, 152 aa, Homo sapiens
MAVGSMLICPCQQQCEHGGVHAFQLGWGAGECVDAGLHPVILSCSSFGAKMGLRRGGGVRPLKFVCAFTLAALLAQEWGACLHGSGCLHEHIHASGNDGTGPLAFTCAFVLATMAMAGWKNGAVGLWACTDIGNGYAEGRLEGSVGYSCQQQ

SEQ ID NO: 930467 - protein, 142 aa, Homo sapiens
MVLGPQLCSLAPGGCAGRGEVFPDPGQSTLMTDAGESALLDRQQWDLCSFTCASSSSKVAGCLHIDWVQGTHRSGAAVFLHALMLAAEVGQSVTGTFTDPVTWPLEILVYVLILIKCLALPSIPLSLSSVNLIGTEGSQVPR

SEQ ID NO: 930468 - protein, 252 aa, Homo sapiens
MIVRPPSHVELLKDTTPILLNEFGSPSMERTEALSDNLCSMSCEWICCERERRLRQAFAFQSKMFREGTKTYAEEIGGRESQRGAGQEGQCLAFTLKSKPVVFVKGLLFSDTKPASFPGLVEPPVNAGLNRLVKSVSTYTAVGKAWFLCRKCHFSDHSAFDSCGSAFIRSSQYFNSPKAKTDCVSPICTSNYSGLAFMVLGMAGFLPEISLTIPRPIKLQAAIFRRDSEWEQGVCVSVEANIPLSNLYFTFL

SEQ ID NO: 930469 - protein, 155 aa, Homo sapiens [sequence omitted]

SEQ ID NO: 930470 - protein, 194 aa, Homo sapiens
MGRNQRRKAENSKNKSASSPPKDHSSSTAMEQSWMENDIKELTEVGFRRSVITNFSKLKEDVQTHCKEAKHLEKRLDKWLTSINSVEKTLNDVMELKIMARELHDTCTSFNSQCDQVEERISVIEDQINEIKREDKFREKRVKTNEQSLQEIWGYVKRPNLRLIGVPESDRENGTKLENTLQDIIQENFPNLAR

SEQ ID NO: 930471 - protein, 171 aa, Homo sapiens
MVHLATVVFPDAGITARPRSPLYSPRFPMDVASCEPNCSDCCLFSGSSHPVSLPGSGLVLGVVCTESCEVNHLSVVQLWIQSLSGGDDRRVKWTLEVEESRQSQASPGSHGNQKAGLTLIVPPLTALSLFPDGYYTLASAKPIPRNQVHQEQRPIEQDSKITNNDQRVEST

SEQ ID NO: 930472 - protein, 152 aa, Homo sapiens
MALQGASPFTQYSSLLLLPCEEVPTSMTISKNMEASLELGNRQRLEEFRGLRRDRKMWESLEFPRDLLNGFDQNADSDMDHEVQDEVVSDGDEKLVGNWKKGDFCYALAKRLTDRPIENNCKLWKKYKDQLHEGTGDETKTDFGGKLAYEQS

SEQ ID NO: 930473 - protein, 198 aa, Homo sapiens
MLGQPVTSKEMQQSLQHPNSRSPKLSGQWRLVQDLRLINEAVIPLYLVVPNPYTLLSQIPEEAEWFTVLGLKDAFFYIPLHSDSQFLFAFEDPTDHMSQLTWMVLPQGFRDSRHLFGQALAQDLGHFSSPGTLVLQYVDDLLLATSLEASCQQATLDLLNFIANQEYKVSKLKAQLCLQQVKYLGLILARGTRALSKE

SEQ ID NO: 930474 - protein, 164 aa, Homo sapiens
MVNSVVFFEITRDGKPLGRISIKLFADKIPKTAENFRALSTGEKGFRYKGSCFHRIIPGFMCQGGDFTRPNGTGDKSIYGEKFDDENLIRKHTGSGILSMANAGPNTNGSQFFICAAKTEWLDGKHVAFGKVKERVNIVEATEHFGYRNSKTSKKITIADCGQF

SEQ ID NO: 930475 - protein, 136 aa, Homo sapiens
MSPTAGSSCGLARLLSLLRNEDHTVRDGSFDHFSKAISLSVDSFPEDSVKAQHKRHSFRLYYEQTSKSLAKKYFQLGWQLNSTGHEISNIETIAAHLLPDADYIHFCLTFPHLKCVPSVSAGGYTSQPAGWPVCRS

SEQ ID NO: 930476 - protein, 251 aa, Homo sapiens
MTHTAASIKLFSSASGLPSNSFLDKAKNPRRLSPLWGSPALHQYNQKIAIGVFLKADKILDLRNQNKMLKTFLQNQSMILMNKNKGQGFLRARLQQLLLSSGSSHLVGATGLQAGAGEGLQRGNSQFFDCLTVFAMASHFFQRLFEFFWFSWYVPVVVLGAKVHNPVPFYVQNPISPFGSCISHQNGFVRGTEILGYCRNPGGTNRLKAFCILYLGYCSLQRCNLKLRLGAALLLPGCEVQQFSASNILRQ

SEQ ID NO: 930477 - protein, 163 aa, Homo sapiens
MEQKPCQCPLKGRAGDRMRTRLESIQSLGFDDKSHRCSVFTSIPQTLHYQSPNAEAQETELSLYFLHFACATALQVVENIAHAEPLTKAPSTQTGLQQRPLNSSDIHLSAGGSAPPSFPQACLVPWAGTYASHSIWFLIFSLVKPSLQLLYKALWDRTHMPCP

SEQ ID NO: 930478 - protein, 172 aa, Homo sapiens
MLNKFTNYLHCHLPCSEQQPVAQAFAPLSISGMERECRECEALTLTKFKNMAFRKYLLLDKCKSPKVPIPRGNENSQHPHVPPESVISFRPTGTQLPASHLRTKLRALKCTQRKMTLSPDGTGTSRLQQLHGAGQMRWDTEMCSRAACREQQMALDSCPRPVGLYENISGLS

SEQ ID NO: 930479 - protein, 208 aa, Homo sapiens
MQPLLERVCAQPSRAGCWWQVPAPGPSQGQPWCVAEENHLSCPVHGAAYSDKDSAANGRALHAQAWLSGQPPEKRTPQPQPLRPLLATHQFAVYEIRTKQKTAKASGSQFPSTSRHHASVGRVRDRSVTQVAPFSTTPKALAVVASCVRELFCQVARPVIMAPLMCQCGHPNHAPPRGPSPSSAGPPPMSSVVLIITPVSFLCVHSPG

SEQ ID NO: 930480 - protein, 197 aa, Homo sapiens
MGKRAWEKDSSCSHHDATMQNPRGSVASVGSEPWTPVPGSSKEGGTECVTEAKSGTGPPWLARAETPDFSTEFGGHRTGRDRLQGFSSSLLRAPQGKSLEPGPPGDSRAEPSLYLQDLNSAVGPSALTPSKRVMVEDMKQKSARISSSNFEDQVSAHPLPFRLVFGGSWAASGAGGSVAEDLPCTAATGSPPLLLLA

SEQ ID NO: 930481 - protein, 157 aa, Homo sapiens
MGRNQCKTAENSKKQNASSPPKDHNSLPGREQNWMENEFDKLTEVGFRRWIITNSSELKEHALTQCKEAKNLERRLDELLTRITSLEKNINDLMELKSTARELYEAYTSIKSQIDQAEERISEIQYQLNEQDGPTFKLRKYRERHEDSPPEQQPQDT

SEQ ID NO: 930482 - protein, 144 aa, Homo sapiens
MPNLDQLQAWSFLRREWNLLLEACAQHRGQALRLRQAHVTLELQTQVPRWETVCQRPPDLQPRGQAGLGVQSHCSNHQSCKEFLGFFIFPSKKLSSALKKCCFLLWLLLPDENADLGIQVKGGPQSTLSLCKRTPLLLSVPESA

SEQ ID NO: 930483 - protein, 135 aa, Homo sapiens
MELGWGFSCPSYQGTVRNRAFPIAWRGLSVGFTDLAASAHCEDLKLEQPPYLALLLSCSLAEIHIRAVASLCLAWSPGRPWLCPLPVLRAAPAWPLLLDYCILEHRAVNSLCHHAKEHIDSCPWKRPWAAAWPEH

SEQ ID NO: 930484 - protein, 144 aa, Homo sapiens
MSFHSFGIRDTSFIEGLRPKNGRSTNSLHHAPGKATDTQRQPMKAAGGRLYPAKPQGQSCPRSWEPTSYISVTWIISNVSFHYLMASIIFDEKSAVNVIYEFMYMMSCFFLAVFKMLSWSLSFDSLFAMYLGLSFFVLILLGVR

SEQ ID NO: 930485 - protein, 143 aa, Homo sapiens
MWTVCVAFLRPAVLLMSWSTEVDSPGNTPNKGWSKPWPAAAFTDTSGAELRALTVSCSVAEDTHIRPAEPLPSIRCETQLLSKNASSMRIRNEISNCERHFICHPPGKPNTQKQLYKVVLFDQTQNITKADETGNRIESYLDL

SEQ ID NO: 930486 - protein, 163 aa, Homo sapiens [sequence omitted]

SEQ ID NO: 930487 - protein, 152 aa, Homo sapiens
MGCVAHPNLSVPSRLQPLAWEGPGGRWLTMGGLQEEQHLGSGSGSGTESCHSPLRTMEARKIAVGPMKKATRVAAGTANADWLDGARERSPARAWRPPSSDSPCGSRKPLTLRRMEDGLECFPGTGTLPRPLTSPFLPENPLFMCYFCRRFR

SEQ ID NO: 930488 - protein, 159 aa, Homo sapiens
MTAWISFICWDSSCVAVFCSAGTPPAPSPNHTHTHTHAHACAHTCAHTCTCTHTRTHTHFIGSSCSGQLLGFVITAADGCEDPDLVRMMVLCVFKSATSLGLSPLYTGCEDPDLVRMMVLCVFKSATSLGLSPLYTGCEDPDLVRMMVLCVFKSERINR

SEQ ID NO: 930489 - protein, 128 aa, Homo sapiens [sequence omitted]

SEQ ID NO: 930490 - protein, 129 aa, Homo sapiens
MAILAGGQGFLRARLQQLLLSSGSSHLVGATGLQAGAGEGLQRGNSQFFDCLTVFAMASHFFQRLFEFFWFSWYVPVVVLGAKVHNGTVPYRDAILSSDWVQLFFYRDVKYSNSVLQIYCGSNVSEHFE

SEQ ID NO: 930491 - protein, 155 aa, Homo sapiens
MAREKPSGIPSVPLCVGLAGLMNHTGIFNHQSSPVNGSCYLLHEKRKKKKKEKKKRKRKKERKKIEEGEGKGGEGDTGLETFTCPPGHTDHAPVVQEPKRKTPWSLTAICERSRIYSAEYIPGAEENSKLGKARGSAGDSPAHMVIPISSPDLRR

SEQ ID NO: 930492 - protein, 145 aa, Homo sapiens
MNAITVQEKQAVLKELLDKKQSEDGAILGPGETIKLNKIYAPLDSRQCRTMALKSRENELSHTFTLAISLEVLSGSLREMSTNTAQRSCCTEEVTGALLNAWDTGAGTGDEEREGPGDTGHPLAGETAGRMWDIQMRSQEQGLHP

SEQ ID NO: 930493 - protein, 159 aa, Homo sapiens
MPRPVRVFLWLFSNSQLQEPHIIQVNNNHILEFPAPVHTINALVATASCKLFGITDSSQCSSYLLLRKQSLPSLNSLVSPEETLDLHGKITPIKGSRPRPGPQSSPSPPSSKNNSARPLFLPAAGSGQGLSKKKEKEKALLPVSLVLDTDGQGLPTQMP

SEQ ID NO: 930494 - protein, 205 aa, Homo sapiens
MVTGLRGPILSAPPKVELALPGLPGLRLLTSALNLAATERAGTGCRVSVRVCWYLAGYFLKILCSPPPKSSRAPQGKSLEPGPPGDSRAEPSLYLQDLNSAVGPSALTPSKRVMVEDMKQKSARISSSNFEDQSAQRGAGTEERSAGVSGGPGWEPCGGFCPGAIKRFLDTQGLHGCGRGEVETVDEEHSGRQLFLSELANESKA

SEQ ID NO: 930495 - protein, 156 aa, Homo sapiens
MKAGSLSTICSGMAAVQADVCPRLGVPAVLGTHFLNRGNQRVLSLWFLRLVPGQQTTGGAPKGAPRNLGSPIRVHRVGSPLLCTLLSNVQRKGVRAENLATFHPSFPGTVMLGVCLDQGRHSFSYLMCGNSGVELLLFVCVIIDTCQHVCVLEGGL

SEQ ID NO: 930496 - protein, 158 aa, Homo sapiens
MAHGACAAVAFQPAPLALRCRGLLLFLSSVFSPPYRQLLAFVSTFHPSKWLPENYLMNSYQSTAKVHVIGMRATCVSESVWDFRAACNCSLTQPQPTDTSSVVKTEQVLFHSVQFNLNRDPHVHWDPDLGSWTEDAHVLCAPVLQVVAHGHLQYSSPL

SEQ ID NO: 930497 - protein, 144 aa, Homo sapiens
MPTALMPMNHESLEAVGEKSCGNETPVEWYNCGSDDRLRSCPSSQDEQTPLMCISYFLHVSVQTSPPQIFNGHMWPVAMVFNCEDEDIPLVRKHSLGSDAGAAPAYGCDFRHRPILLEPRLPQVKNEDFHRGNSGPHSGRDHQL

SEQ ID NO: 930498 - protein, 152 aa, Homo sapiens
MLVLTPLALLIVPQNISAHGDLSQATTAANPDLTHLWIRAMDLPFCSLAESISPLSAANPDPIHLQIRAMDLPFCSLAESSSPLSAANPDPIHLQIRAMDLPFCSLAESSSPLSAANPDPIHLQIRAMDLPFCSLAESSSLLFAGKYHLLHS

SEQ ID NO: 930499 - protein, 156 aa, Homo sapiens
MGVRDHGQDNRNSLLGLIPFGQPQAVTTRMTATLWKELAASGPSAWASVRSMGRKKGTNVLSKQCSVYLLPGPVLNPPGPHRGSMQILAIHTGCSWSQDAVLQTLAMVLLAGSSPKHRAAPLEGKSLRWCCSCLPVKSFQSPHKHGLSTYCLPSQG

SEQ ID NO: 930500 - protein, 430 aa, Homo sapiens
MDWNGMEWNQPEYRGMEWNGMQWNGIIRNGMERNGMEWNGMECNGINSIAIQWNGMELTRIQWNGMEWNGTERNGMDWNGMEWNGMERKGMEWNGMEWNGMEWNGMQWNGIIRNGMERNGMEWNGMEWNGMEWNQLDCNRMEWNGINPNRMECNGMERNGMEWNGMEWNGTEWNGMEWNGMEWNQRECRGMEWNGMQWNGIIRNGMEWNGMQSNGINSIAMEWNGMERNTLESNRVEWNGKDWNGVEWNGMEWNGINSIGMEWNGMEWNGINPNRMEWNGMERNGMEWKGMEWNGMECNGMESTRLQGNGMEWNAMEWIQLEWNGKNGINTSGMAWIGMEWNGINPSTAEWNGMECNGMESSVMEWKGMEWNGMEWNGMEWNGINSIAIEWNGMELTRIEWNGMEWNGTERNGMDWNGMEWNGMERKGME

SEQ ID NO: 930501 - protein, 145 aa, Homo sapiens
MATLIGQTRLQIVKLCESNTDKIIVPLNKEQFYNKPVRNANKDASTKTKNLNQASSTHQVCWSLLGVHSRPCFSGYHQQRLQNSKDCCLLLPLEAFSQRSPYQLPAGTLLCEVSVDPCWEVSPCQEAWGLNEMVKDLEEVNTVEE

SEQ ID NO: 930502 - protein, 140 aa, Homo sapiens
MTDTPKELTAAEQLSSAPFSQGFRASPRHLRRRVAAAAAARLEEVKPVVEVHHQSEQETSVRKRRIKKSSRVQPEFYHSVQGASIRRPVWPLYCYKAAPLSFSNLVPCWPQCHLSSETQGSTRSWSSSPSHILSTLFCVL

SEQ ID NO: 930503 - protein, 145 aa, Homo sapiens
MRRISGGPIELEFRKMMRNRDGEESNKQRWIIDCEYLSFRRTERGEGGGIDGNGNGNGNEEQRPLRCKAERSCHEHTAPWDPLQSYLLETVEGDANDSMWNLLQSWCSCRQPRMINKNTKMMKHKNDKSQLLHIFYPSTRRTTPF

SEQ ID NO: 930504 - protein, 142 aa, Homo sapiens
MEPILCRPLLSDSGCGEKQGWVPFGPYQVHCGFLEFSPQRLIRHELLEALRVKPHLSDTQVPEDDSATAEGLLCFNNLASLIIFHCSDITLFLSIHPLIDIWVVTAFGFMSNIPMNIHIEVLMWIYVFDFLGYLLKNEFVRL

SEQ ID NO: 930505 - protein, 150 aa, Homo sapiens
MTSLLASQTYHKLCPTSNTGDYNSTCDWGEYAEANPISQVAPLLAAFGGEKCYGSKGQKEKEKQILPPDPLNAHGHFSTTQHEEKYDAEKVLVERNRSFTWFQLNEQKHITIWCPKNNKRKSVKRSSEQLVHVSSWDKSEASFATESSGN

SEQ ID NO: 930506 - protein, 140 aa, Homo sapiens [sequence omitted]

SEQ ID NO: 930507 - protein, 206 aa, Homo sapiens
MWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQRLDHATFDVPKLPQAPTPRSLAVTTISAGTVSRRK

SEQ ID NO: 930508 - protein, 141 aa, Homo sapiens
MFAFLLSNVSPSELRRTNLRVLAPCGFSASPSFGGLVPPCLATSHQVVKRRMFAKGFTAIFPPEGNSLSGNRTGREECREQCLRDANGCKHAWRVMEDACNDSGIKNKAAINIHIQDSDKHKLYFTYEIVGSHGIQKPCTR

SEQ ID NO: 930509 - protein, 167 aa, Homo sapiens
MERKARCLGDSSRAPRDSSPCFTVMPAPAHSGREKLLVNFCVAHRSKGCRGPDSPRNKKGRCSATNTAFKSLTKPTKPTRRPPTGNTTSPGATPPASTPPVAITACCLVPETMARVPRLEPTRVSVGWVTHISSKSSILVPCMLAELDISGVPQTQNSGPPPDLSLE

SEQ ID NO: 930510 - protein, 155 aa, Homo sapiens
MHHLASWASLDHNFSFFPDLTRSNPIIPAGNGPQTPVGNFCGGSPGRRLTAFVQHKSTAAVPAVAGDKHCKSHEVYGVPWFSRAFSIAGALRDLQDLSQSAHNGQYKSGKSFQESKYPIIHHKTHSQLIHQCGTGVLNVWQAETESCFFAETGVH

SEQ ID NO: 930511 - protein, 141 aa, Homo sapiens
MIYDLFRKRKVISFGGCIAQIFFIHVIGGVEMVLLIAMAFDSYVYSRPCLPGYHQQRLENSQDCCLFLPLEVLSQRGTHQMPARALLYEVPVGTYWEVSPSQDTRGSGTHLRRQSDPYQSSNTVLGDLLLSSEPSGFSKML

SEQ ID NO: 930512 - protein, 166 aa, Homo sapiens
MARSGHQLLPGASKAHVCIPAASPQELRAAGTICAELGLSRPGSPPFQQGSPTKERACQPQVQVWTSLVAAGPWVQAWISLAAAGPRVQAWTSLAAAGPRVQAWTSLVAAGLQDCRTSGASVDQLGGCRTSASCCKDTEAQDLLPAPEHHPAFAHGHGSLQLPGPL

SEQ ID NO: 930513 - protein, 165 aa, Homo sapiens
MQRGRRSSCRSQQGVGRGDHGQVVKSKWHPPWHQPEQVPSFPKGRAGAGPGDAGVSKGWGCAPSWVCVKSSRHRSLSTSARPCASRTSQQTARNCWVLPPTCRLKTSAFPHLTSGHLSKEPALAAPSERCPGFLQKSSCERGTFPKGSVVDPSFCSELPARVSPG

SEQ ID NO: 930514 - protein, 352 aa, Homo sapiens
MFFCKRHRRSLRAHGHCHFSPLKGTAVLRVLKGTAVLHVLTGTTVLHVLKGTAVLHVLKGTAILQVLTGTAVLHVLKGTVLTGTAVLHVLKGTAVLHVLKGTAVLQVLTGTAVLHVLKGTAVRCMLKGTAVLHILKGTAVLHVLKGTAVLHVLKGTAVLHVLTGTAVLHVLKGTAVLHVLKGTAILHVLKGTAVLHVLKGTAVRCMLKGTAVLHILKGTAVLQVLTGTAVLHVLKGTAVLHVLKGTAVLQVLTGTAVLQVLKGTAVLHVLKGTAVLHVLKGTAVLQVLTGTAVLHVLKGTAVLHVLKGTAVRCMLKGTAALHSFKVTAALHGLTAPPVSTCSQGTTTLHPLK

SEQ ID NO: 930515 - protein, 431 aa, Homo sapiens
MQTRIQIQMRIHRCRCRSRFRGRCRYRCRCRYRYRCRCRYRCRWRCRYRHRYRYRYTDTDADADTDVDTDTDTNADADADTDTDAGTGADTDADKETDADEQTLSYICMCIFLEQTLSCICICIWLCIYICICVCICICICVCICICIYACICTCICICICICVCVCIYICICLCIYICICVCICFCICVCICICICICIYACICTCICICICVYVCIYICICVCICICICVCICICICICIYACICTCICICICVCVCICILSVSVSASASVSVSISVSAPASVSASVSVSAPASASVSVSPSASVSVSAYVSVSMSVSAPASVSASASVSASVSASVSPSVSAPVSVSASVSVSISVSAPASVSTSVCVCICICVCVCNCICISICICICVCVCICICICICICICICICACVCVYVCTCICICICICI

SEQ ID NO: 930516 - protein, 287 aa, Homo sapiens [sequence omitted]

SEQ ID NO: 930517 - protein, 139 aa, Homo sapiens
MREDTLQISPQPEISVFGFGKRVMKDMVMKDTVMKDMVMKDMVMKDLGDEGHGDEGHGDEGHGDEGPRTLVMKDMVMKDTVMKDTVMKDTVMKDTVMKDLGDEGHGDEGPWTLVMKDMVMKDMVMKDLGDEGHGDEGPR

SEQ ID NO: 930518 - protein, 475 aa, Homo sapiens
MEVPEGRRLGTLLGGRSGALAWSWKRVQDTHRVQPGHRRSLRAHGHCHFSPLKGTAVLRVLKGTAVLHVLTGTTVLHVLKGTAVLHVLKGTAILQVLTGTAVLHVLKGTAVLHVLKGTAVLQVLTGTAVLHVLKGTAVLHVLTGTTVLHVLKGTAVLHVLKGTAILQVLTGTAVLHVLKGTAVLHVLKGTAVLQVLTGTAVLHVLKGTAVLHVLKGTAVLQVLTGTAVLHVLKGTAVRCMLKGTAVLHILKGTAVLHVLKGTAVLHVLKGTAVLHVLTGTAVLHVLKGTAVLQVLTGTAILHVLKGTAVLHVLKGTAVRCMLKGTAVLHILKGTAVLQVLTGTAVLHVLKGTAVLHVLKGTAVLQVLTGTAVLQVLKGTAVLHVLKGTAVLHVLKGTAVLQVLRASARGGRGTWLEPRRLDHGKDLRFLSVLSHRNPGLGKGCDLSGSASLCAMARAGDPVLLARRPPGSRGVRF

SEQ ID NO: 930519 - protein, 312 aa, Homo sapiens
MDQKNGSSFTGFILLGFSDRPQLELVLFVVLLIFYIFTLLGNKTIIVLSHLDPHLHTPMYFFFSNLSFLDLCYTTGIVPQLLVNLRGADKSISYGGCVVQLYISLGLGSTECVLLGVMVFDRYAAVCRPLHYTVVMHPCLYVLMASTSWVIGFANSLLQTVLILLLTLCGRNKLEHFLCEVPPLLKLACVDTTMNESELFFVSVIILLVPVALIIFSYSQIVRAVMRIKLATGQRKVFGTCGSHLTVVSLFYGTAIYAYLQPGNNYSQDQGKFISLFYTIITPMINPLIYTLRNKDVKGALKKVLWKNYDSR

SEQ ID NO: 930520 - protein, 160 aa, Homo sapiens [sequence omitted]

SEQ ID NO: 930521 - protein, 145 aa, Homo sapiens
MLNSSWLGSLPFLAAGPQCNCHTPSESPTPGGLHSALGQITSSLTGERCKQVTHSIDLTDRGLSSLVTGQKHGCFAPLDDCSSSLYSPKSPLVPKPWGLEDKSIGPVQVRFLHDSCMLSRGPYRDLSIRGLPVHHCWHLFTFPRV

SEQ ID NO: 930522 - protein, 222 aa, Homo sapiens
MAPSLTLSISSKGDVQKRADPPYMRQLNNLTKQNTGPSAAGLLEFAGGPLQTLFALVSPAEAAEQQILQNGKCCCLIVPLDPLEDAVCPFSDLNFHAGRTTTLFKTVRQGPLSLQKFPLPFFQICPAPRGGVYRGRQASLSCSGLHPVRASRPLCLPTQASAMGGALPPALLLPSSSISDCCASNEQGSVGMGPSKPGMGYNLLVCCLLRLLEKCSFRVGVS

SEQ ID NO: 930523 - protein, 138 aa, Homo sapiens [sequence omitted]

SEQ ID NO: 930524 - protein, 137 aa, Homo sapiens
MGSEQSLWVELILSSYQVDPARCPVLRYLHTLAGDYMIYFQPCESQELFGLPVEACHCDVHPSSCPPTSHGDDGTKRWHKGAEELQQLRRQSQHTEERRPGWPLRPVAECAQARNQLLLCWAIETWSCDKSHALVED

SEQ ID NO: 930525 - protein, 162 aa, Homo sapiens
MSTHCMVSPGPPLKTHCLSRHPLATQGSTRGLAGQGELEFVLLAVSWLIKSFAPDPGDCLMSPASIHGTVTDVCFTGYEPGTDLPFHIQISFPAYTMGCGNRQKVGDFPSSEETLGNVKIFELSGTKSPNSDANTCHLNESYLTEAWISVIPCITIIYTHNF

SEQ ID NO: 930526 - protein, 143 aa, Homo sapiens
MPLLPRSLPSVQVSLLNSGLICATSCCTASCDHLSGVSYSTGSIIPTCLAHAGIHASVHPINTSQTPITCYHPSKLGSAASFPVWLCKGHCKEVEGALCTSEVTVDYDNFLVHSDKMNGATEQCLRRSKSEETDVTPGEASNG

SEQ ID NO: 930527 - protein, 153 aa, Homo sapiens
MSLRRRQLCQHLDFGLLALEPGDDTSLLLEPCRLWCFLTAALEGGSRAPASISGERGPLQASGVPPDLRPVLLWQRMVFQLPELRHPSSRMMTRKNRWDAYTCSAIQEIISLFFPLNSERDTFKPECNLIKGVKAERTVGQHGGVETEHEPSA

SEQ ID NO: 930528 - protein, 143 aa, Homo sapiens
MASPKPMFFEGCALVLVVFKDWRSGWDLVVATVEQEEGERGVQGSSLSSGTAAHPSAGAPEHHTLGGEDELVWETGTQQSWRSSSGTWTKSGQNEPIFGVSSPSWEGDCKGERKLKAKVGAGAAAQPHPGSSVTHFPGGEASI

SEQ ID NO: 930529 - protein, 142 aa, Homo sapiens
MLQRVKSVTTNKGLIKITCFSGNTTKGKSRTTDKGPTKITRQRAKAELLEWECYLQGIHVFSNTSNTKLFSRVVAFLQLVMNMFLLKLSPGTHPSTYCFYESYCYLLLVPYITGVISVDLTIFLSFLGNLISLVTILVFSSL

SEQ ID NO: 930530 - protein, 217 aa, Homo sapiens
MCSHEEDLIVPLMSSHKLSGEQLWKQNPKDIHTLAQFISAYSLADPEKGTALSKHLPSSDSMSLKVDVEALENSPGATYIWKGGKVTRDSQPKEQGKGDLKKKKKGKLPKNYDPKLTPDPERWLPMQECSFYQGRKKGKKKDQMGKGTQGATAGASSELDARKTVSSPPTSPRPGSAATLSASTSNIIPPRHQRPAGAPATKKKQQQKKKKGGKGGW

SEQ ID NO: 930531 - protein, 164 aa, Homo sapiens
MGRQHNSISLSDVSATVMAVGYLSSESCPPYARQTTGDHDGTHYAADNNSPYPLWFTAVSRLLSLPALESPKVPCEEGSPQCNTASLPDRGQTASLSRTLIHSSSLGCTSQSGLLPLQPVFYRNISNFPLGQSPRGVGQAAMLAVLASLSVQPLEPGEPIPRRD

SEQ ID NO: 930532 - protein, 140 aa, Homo sapiens
MLWFLQTCRSTTLMILDKVWGKFSRLPGHWVLLWLRKGPEMPLKSQVLESGTPRACSVLYHPAAMLVPKGLDVYLDIAAGYSGPKGFSVSSSALELAYESCSPYGLDCHLSLLRDGEYFGFQWCGLWALKFRPLELAIPL

SEQ ID NO: 930533 - protein, 139 aa, Homo sapiens
MDQSSVTYYIEGFEESFNVWILSTKEFTFALILCFIYNFPNAICILTHSKLKTLNWIILRRPLAYKNNLYHHKLVCAILGKKYHIEKQEQFAAKLHFWNQPDYNVSGKTNFWIPELPGTSSHLHKQTESGGRLKMNYGF

SEQ ID NO: 930534 - protein, 287 aa, Homo sapiens
MIFRKLFGGQISRDLECPKDRKMWKHLELPRDPFNGVNQNADSDMDNEVQVEVVSDRDEELLGNKKAFREAPPITGPEAKWKKNGFMILAQGSPALCSFLTPDILPCVPAASAPAVDIRGQLRSWLQRAQAPSHGSFYVVLSLLEENKSFRQMSKQDKRAVREPPPSEEGWVTVRPEDVLGPQSAIPGVLGCVGQLLEPRCPISLAPAGEQGAAWSYRDGCRPSPAQAVMSPSVGCCPFPQGRNSNSLESRQRSCGPGRPPSPELDRLKQILAKRLLKICMAPGLRP

SEQ ID NO: 930535 - protein, 139 aa, Homo sapiens
MIVRPFRPCGTYCKYWPTCRYGDECTYHHLVSPWKAFPNCTFPEKCLFVHQNCKYIANCTKPDCPFTHMGRITVLPPNPVAIMPAPPSSSQLYHYFLASKETECHLYHPKHCRFNIQCTKPGCAFYHPIVTVLPLHTLE

SEQ ID NO: 930536 - protein, 157 aa, Homo sapiens
MFSWMVLMLVDVLWCLDIEESGPQCSTWVSLLVFRNQGLFSEQMNAASTGSFPSKYQVPFWPRVWIEILSWSQGLKWGSHYSDQVLCPLWLSWYPRCKTKSSHSSLSSPQVKGYLLDPGGVQLGVRGGVMPALPGLLQLLFQYVTCPAMYPLSLSLV

SEQ ID NO: 930537 - protein, 176 aa, Homo sapiens
MVFSDTFINMMAVQKGNLGLETPNRVPTGALPSGAMRRGPLSSRPQNGKSTDSLHCAPGKATDTPCQLMKSGRSGAEPCKATGAELPKAMRANLLHQHDLDVGHGVKGDHFGTLRFNDGTIGFWTCMGASVTTIAEGIQPEEQDVSSGTHIFKSKGCSFKAPFGSREQSFPDNQTC

SEQ ID NO: 930538 - protein, 221 aa, Homo sapiens
MPIAKFSWSGSSSNVSGEEDVKGFLSSRADKFQRISPRDKSLEDEELSDQPWEVDNDQLRAIIKADPLTTTREVAEELNINHSKVVQHLKQNGKVKKLLTSIGQWEGPSSSSRQGPTAPRTTNASKVEQIGLRSFVSPAIFSPTDYYFFKHLKDFLQGKHFLNQQNAETKAEKAFQEFIKSISVHKLETQNGHCKFQLKSEFEVLIWKSLAKLPGSHGWFL

SEQ ID NO: 930539 - protein, 134 aa, Homo sapiens
MPWNGCGHKVLRVVSTPLMHARALYYKNGKETSSNLKIFQIGIHRVCSRAGRSSNKNSLMMESQSRARQDLGCMLYSANICIYGTSKMGGDVMKLWAQDSKKEMCIPNMSESDDHLDSCPATNSLIHKPSSFTN

SEQ ID NO: 930540 - protein, 159 aa, Homo sapiens
MPNLHLVAKKAFCVCVYARVRALAHMHIKLQRPCEAAVISSMRSQQQALPEQSGNKTFTFLPDASPSIKSIPGGGKTLFVKPNSRKQSSACHHMREKGSKISGDSYKDTNPIHGNFILMTSSNSSCHRKTPAPNIITLESGVSTMHFGETQIFNHAFFY

SEQ ID NO: 930541 - protein, 151 aa, Homo sapiens
MAQFKSKSLKTKKANSAAFRLWPKAQKPWGSHRCKSWSQQNTMLQEEEANILLADQRGVMETSYLQKMVEPYYKILEAASVIHLWGPVKGSQQHCYLSLTPQTLLDLLGHMAQVAEQLAQQPGPVAEPSPILGPTQNYQPSQKMGQSNTPK

SEQ ID NO: 930542 - protein, 154 aa, Homo sapiens
MSGPSWFLLNQSIYKVAMVVCNIERLCNETLKSQNLFKILTVNPITVFRPKNEGGGWLINYSKIETELKVMFWLLGFLQAIIYKSNIFKFLLLPKENLKDRMLCLTLLYIPQSILRTRKGLLGQKMIVVLKDQKNSVIILKNKQTLRTSSAMLF

SEQ ID NO: 930543 - protein, 140 aa, Homo sapiens
MESYVAFQRSQWTFLKDNLKKEVEYSVIDCADEIEKKQSLSIQSFGIKHMQVVIATITIIYLQNFFIFSNRRNSILIKRYLPILSFPVTLGNYHSIFCRCEFGYPDTPPIVTLFSIVATPFNIPTSNVQEFQFLHILANT

SEQ ID NO: 930544 - protein, 173 aa, Homo sapiens
MRTNQCKKAENSKNQNASSLRKDHSSSPAREQNWMENEFDKLMEVDFRSWVITNSSELKEHVLTQCKEAKNLEKKLQELLTRISTYTSINSRIDQEEERISEIEDRLNEIKCEDKIKEERMKMNEQSLQEIWDSVKRPNLHLISVPESDGENIIKLENTLQDIIQENFPDLAR

SEQ ID NO: 930545 - protein, 168 aa, Homo sapiens
MRCEGDKGTSRELFLFHYLHSFFLRRSLALFTSGDRDTSKSWCLLPFCPSNDKLRNPGESDLGTAAILEFQPESDKNDSTTTAITNLEEKPNKSTEDSSLPSHAKPGAYPLNGMENRGTGIPVAIHSNKKYLIEYHAGEVDKFRKMQVVWPDAGSNCWHYSLTSYAEK

SEQ ID NO: 930546 - protein, 195 aa, Homo sapiens
MANLLLPFGRRLLFHLHHKHTWYFLLHGAQALLGEPNKQERKKERKKERKKERKKERKKERKKERKEGRKEGRKEGRKEGRKKERKAKKTKKKKRKKEKEGKKERKGGGGRKEGKPLYTVGGYLNWYGHYRKQCRSSSKKLKIVLPCDPAIRLPSVPEGNKISTLRRLISVSLCLQREGHSFTPGIEQARLERES

SEQ ID NO: 930547 - protein, 160 aa, Homo sapiens
MVTQAALQPPPLGLHWVRPKASTEMGLAQGTLQPLPGYWLCSLKTLGIYNQQIAKPARLVFFPSGCLTPWPPPPQACGEYYCRCLLKAQGLFSQLVVNAARTGIHHSGQWAPLWPRADPEIPSKSQNLELGTPRARLPLLLVSQWVAFPLSPLDLGPAQH

SEQ ID NO: 930548 - protein, 139 aa, Homo sapiens
MSRCPVVTSHSVEHLLCLVVGLLFSWRVIPLSIRLQRHGEVSKVLTSHLLAVRGQQITSCILTVLCRCEWGIGVAGGSFDGKTSKALSLAHRCPGMQRLTCVDYINYIKNTLALGLLVGLSQWGHLQETGRRTECKSQV

SEQ ID NO: 930549 - protein, 370 aa, Homo sapiens
MTDNELSALVVDNGSGMCKAGFGGDDAPRAVFPSMIGRPRHQGVMVGMGQKDCYVGDEAQSKRGVLTLKYPIEHGVVTNWDDMEKIWYHTFYNELRVAPDEHPILLTEAPLNPKINREKMTQIMFEAFNTPAMYVAIQAVLSLYASGRTTGIVMDSGDGVTHIVPIYEGYALPHAILRLDLAGRDLTDYLMKILTERGYNFTTTAEREIVRDVKEKLCYVALDFEQEMVRAAASSSPERSYELPDGQVITIGNERFRCPEAIFQPSFLGIESSGIHETTFNSIMKCDVDIRKDLYANTVLSGGSTMYPGIADRMQKEIITLAPSTMKIKIIAPPERKYSVWIGGSILASLSTFQQMWISKQEYDEAGPPI

SEQ ID NO: 930550 - protein, 148 aa, Homo sapiens
MDPKITLRIKILMALLGKTRKLPKIYGEVLCILHPVSSNGNILRDYRTLSKPRHWHWYNWQSLFSFQGSVSSLICPRQEDLTLPDLFSAFLGTNEGSNWGEETNQRFGDVSQVILRTADPVGTQVLVYNADGFEHTMKMPSQKSFKSH

SEQ ID NO: 930551 - protein, 169 aa, Homo sapiens
MQGVVRVAKDVRMSIIWSLPSEAFCLKQYPRNPECIQLDYVWKVNMAELWSLQLTAKWKQSCSSYVIDNFLVSAFPELSRGCKLGVKEQYWSSTIIRKEQQMKQQTARVVPVPCKASQGPQQSELQPFSSPRLLEDATVWHRGNNAERKQLHDILLTETSSKISGSREG

SEQ ID NO: 930552 - protein, 170 aa, Homo sapiens
MSSSRFINAPISTLYLAYLLRDCKHTNQHPVKTDQSALCKTDQSPSVKWTNQQDVAVTLTTKVCSFTPEAGETMNLPGGMNNSRCATLRIVTLTVKVCSFTPEASETRNPPEGRNSKQVQTLEGTNSGHITFKNCNTHCEAILRGHMENRLQARFGPQAVNLNIFWFTIG

SEQ ID NO: 930553 - protein, 163 aa, Homo sapiens
MISYSADLRGLSSKGRNVSTRRQNNDSTELDVKIATGHFGFLMLLTQRAKNIPVCILTDVIDPDYQGKIGLLLHNGEKEEPHFVVQAGMQWHDHNTLQPQSPGFKQSSHLGLLSSWGYRSTKERPCEDTGRRQAPTSQEGSPHQKLSWPAQWSWTCSSRTVRK

SEQ ID NO: 930554 - protein, 152 aa, Homo sapiens
MQSPTIIAFLTPRPWILCAMWPLLEDHVGVILAIHVCHFTLFSASSNDMKLKPSSVITYLILGSYEGAFFCVKMGVTTGTWVYSLKVVSRFQKVEEEIKKHGSNNMGLSENLTDCAAAGNGDDGLIPQRAENLKISNFLGRRMKSIIDLTCE

SEQ ID NO: 930555 - protein, 151 aa, Homo sapiens
MVDTPPPSSSIPGQSQTAALAARFSSQWILACWALWAWDPLSQALEEISWSAGCEGHGESAVSGQECTVPPSTVSHSFPWLGEGNPLTPCAFQSGPSAAGLLEFAGGPFPTLFAWVSPAEAAEQQRLLPVLSSGSFVPEGHLLDASQGSPV

SEQ ID NO: 930556 - protein, 280 aa, Homo sapiens
MAQRLLSLSSVTCLLPLHFPQALDTVVQSNMKHQPFIVVNKHNVQVEYKGETKSFYPEEVFFMVLIKMKEIAETYLGKTVTNAVVTVPAYFNDSQHQATKDAGTIVSLNVLRIISKPTAAATAYRQKVKENKVIITNDKGHLSKEDIECMVQEAEKYRAEDEKQKDKMSSKNSVESYAFDMKAAVEDEKLQGKINVEDKQKILDKGIKIINWLDKNQIQKKEEFQHQNLEKVCNHIITNLYQSTGGTPEGMPGGFPDGGAPSAGASPGPPLKRLTKSAQV

SEQ ID NO: 930557 - protein, 126 aa, Homo sapiens
MDSTEFNVKPHKCCALPVPSTENLHWHCLCQEMGVGWQLCFKTVFPALSNDSFNDMKLKPEIKSTDTPPHTRISNTGCSLKHFCMAGSFFLGMNSSEHNLVGGVGSALQTQVQELDTEHCGQMGHA

SEQ ID NO: 930558 - protein, 153 aa, Homo sapiens
MGPQWASSRAPRETCECWQWHVEQANPQAARWCIWVLAVAGKAGYSPGSWRGFMNASAGGSKALRSACFRALCFVATLPGLLDPCSLGYRTLSGLEYWGSSHTAASSWHHNTEALQVNVGECQQGSRTKKNGTQISLSRHNFRSFIPFQQAKW

SEQ ID NO: 930559 - protein, 196 aa, Homo sapiens
MRFGWGHKSKPYELGSSSRKLPMLEESWDEDFSFPNCSHEDTFSSRGFMLAEESGLAAIKYEGFKLEWDSVEGIQKAIMDLVDEFKDEFPTILRLSQSNQAVCVNAVLKKVKNIFQEEESIRQNREESENCRKAFSEPVLSEPMFAEGEIKAKPYRSLPEKPDISDYPKLLANKQSNNIQVLHSVFDQSAEMNEQI

SEQ ID NO: 930560 - protein, 140 aa, Homo sapiens
MFSRRNTGKTLVTRTQGTKIAPGSLKGRVFEINPKLTELSEKQEFSYWYAGVYQIHKLAGSLSIHSLADSPLQTFNLVPFSGFVHDLEEVNFLFLDLMWIPNFEVAAKQLHDMWVPMQNENVRPSSPKIIKNCKMAIPEH

SEQ ID NO: 930561 - protein, 152 aa, Homo sapiens
MLGKIGKKPEEGGIMLIRSLGLHLHEWIDADIKALGISSWPYIPGQYPQTEPLDLSQCQTVPHSSSRHQPCMANPISSLYHVQAIINSPQLQAAPTVGRPHWPLASFVSQSNAGCIFLGLLVQPSAVPSTGYPKFLAVPCWLQLPQASDAPK

SEQ ID NO: 930562 - protein, 189 aa, Homo sapiens
MEHISAPAERDPPPRSGSTAHFRSCHRLSDCQRPLTAPLWQVRQNYHPDCDAAVNSHVNLELHASCVYLSMAFYLDRDDVTLERFSRCFLSQTCAVAASAFLTSGNQSVNTGESGLQAMECAFHLEESVNYSLLELHYLAMEKGDPQLCDFLESHFLNQQVKAIKELSGYLSNLRKMWATGNRPGRVPV

SEQ ID NO: 930563 - protein, 158 aa, Homo sapiens
MKSNGETGERHHKEFKFNLSQIPEGEVVTAAEFRIYKDCVMGSFKNQTFLISIYQVLQEHQHRKGSKPVHQELRHLLPLSEGKGEKGLLYFGNGALCQPSGVSLIVLIVRLQKCATEQRKFMGPQSDSVAESGWKLGSPHPRICTDPAAIFFITDPDL

SEQ ID NO: 930564 - protein, 214 aa, Homo sapiens
MAGKWKKAVLALGKKDLTNVPTFLQSSLDAVAKPASDSLSVLKLFAAPITEEPHRQLRKHSDGKVTVFAELLVARGLHARPIDDEELLLEEQMLVQLLLSEAQSSGSIAIHRVTAIACMEIPKLHGRHQGPGVTVLSLTSYGRTIECSLQELPSPQMQALGPLRVSRNGNSADGVFAAKANILKARGPKQLSGVTSFSSKRLKRLHISAPQTPH

SEQ ID NO: 930565 - protein, 147 aa, Homo sapiens
MPEQRYRWHVDSPEEIAHRSQFIPSLCWVSGESGAGWGQDAEHTTGAPKTNLLTVVQDKSSTEGDAAASAKAAVTADKGSLFTVTHLHVPPPSIFAPVGQGITSGGSVSKHMLNQRVQWGGLSKSLLDHITLEGHYQHVIANNTIIM

SEQ ID NO: 930566 - protein, 264 aa, Homo sapiens
MHLVVHFAWKEKWPDVGLYTDSWAVANRLAGWSGTWKKHDWKIGDKEIWGRSMWRDFSEWSKTVKIFVSYVSSHQQVTSVEEEFNNQVDRMTRSVDTTQPLSPASPVIMNKVATVTGMEAKKGLTVLAGVIDPDYQDEISLLLHKRGKEEYAWNTGDRCLLVLPSPVIKVNGKLQQPKPGRTTNGPDPSGMKIWVTSPGEKPQSAEVLAEGKRNTEWVVEGSHQYQLRPHDQLQKRGLEGEKRDLKEPKEGETGQKGGSCQCRF

SEQ ID NO: 930567 - protein, 159 aa, Homo sapiens [sequence omitted]

SEQ ID NO: 930568 - protein, 215 aa, Homo sapiens
MKDFHLLLMGQPVVCSLPDPRSKPWVIGNPPMKSNGETVEYDKEFSPRQRHHKEFKFNLSQIPEGEVVTAAEFRIYKDCVMGSFKNQTFLISIYQVLQEHQHRDSDLFLLDTRVVWASEEGWLEFDITATSNLWVVTPQHNMGLQLSVVTRDGLVGRDGPYDKQPFMVAFFKVSEVHVRTTRSASSRRRQQSRNRSTQSQDVARVSSASEQDSQM

SEQ ID NO: 930569 - protein, 215 aa, Homo sapiens
MPFGFYFTSDQKLATALVASVSLLSLTVWAAVYDICAYAVETLFIGLIDMGSHVEQGENRTQEGHEQETGKRRGAKVDKNWQENLKRQATGDQSNCNCNMRRLLTNQHCLLEPNSHDVKSPTHMQDHIGFQLVMVGVFTLWRSANITNQILFYGLFIVRTRGLQKLSVKGQIVYILGFVGHTVSVATLNPVVVVQRQSWISHERGYVPGFIGKAR

SEQ ID NO: 930570 - protein, 186 aa, Homo sapiens
MPLFQSSLQLSTFRILLIGAILAWKEQDGEVNTELQGIFFNSGLQHHPSPRAPDFIHSLTSKVVEHLTVWSSLRQEQANGGILGDVAGGSRHCTIRDAFLPNQIQQPVQMSLLLPQQNPLKWQPMTQTSHLLHKKPPTLCPAVFIEADGVQAESCPSHWGPGNCGLAFLTPEVTKMENKPKISWQS

SEQ ID NO: 930571 - protein, 171 aa, Homo sapiens
MESTMSDISYCHNFAKVVSIVVSRGHLAQPHRLIKEDVAAQRSDATCPWPHSLSGREPGQSLGHSQYCVHKTTEYMPEKAGAQIPEITTDMWPPKKEVLWIEFTLSLHGCKGRACPTAQALGAGPDRCSNGLMSHHTLGASRGSVEPRVRYTGDLQETGNCMDLGGLIGAQ

SEQ ID NO: 930572 - protein, 135 aa, Homo sapiens
MVAVFAPWELTNTTNQSFFSPGDLVVKHLPAHNCFWSIVGLDHFLRPTLLYVTLFREEKLGKRRENQEKCGMKLQTDYFKSRHSAGLGSGCVSDALFLGRTQLSWQQQHMKIPNLAFHITWRKLAGQECLSNAGN

SEQ ID NO: 930573 - protein, 140 aa, Homo sapiens
MGTFSAVWLPLQGKQKVGTAGLRLGFGKRETVSWAKIWKLKEGVRRKNQLRGKGPACHGAQVVLSKQAQDGVLGEAIGAKHQGAGRFYKMPPDTAMAVDRVFLQLLVLKVCVWPLRPVHGHHAQLGRLCTAQYLPGKGFG

SEQ ID NO: 930574 - protein, 144 aa, Homo sapiens
MLRGGKVILEIAHQIWQCEGLYDLMRLMLAWLTELVYVEGWGRGKMCKCLALPRDLLNGFDQNADSDMDNEVQAEVVSYRDEELIGKWSKGHSYYALAKRLVAFCSCPRDLWNFELERDDVGYLAEKISKQQSIREVTWFFLKM

SEQ ID NO: 930575 - protein, 184 aa, Homo sapiens
MLKKTALHIDDNVVLQNVDPNRGHFAISHVSFGQSQPTCFQNTVEVLWQDRSKAINRPMNPSGLRSWASLNGTPAGKCKHESKSTEPRLVGAQDEGIQVLRFVLCETAFRCSKVRQSARYGRPLSSTLSKRTSSGTSTINLCRSQHPDYYQHLGSVCFECLSLSSLPNSYQLKPPRHAHKMSCH

SEQ ID NO: 930576 - protein, 135 aa, Homo sapiens
MSRDIVGCYNWVEWSVLRRCSSNPQCDCVWRQALCGEEEETPGLSLSPHNKEKRPNEDTVRRQSSAGQEEISHQKPTQLKPNEGERRSSTSRCYFKAANEDPTVGSSRRSTDRPGSKIATKSVKLSPEAHVVAYQ

SEQ ID NO: 930577 - protein, 134 aa, Homo sapiens
MASSKKHSCIRMMFIHTNSTGGHQPHADSSPGVTPVLLSSHWQMKLSTPEPSWGPGHLWKPEQELELKLELQLKPRPGPCQDEHLNQQTSGKGDLLPGCEWATSNQWKTWTEQKDSCLLSKREFCQKTVFGLHL

SEQ ID NO: 930578 - protein, 162 aa, Homo sapiens
MKLCPAHRNMSSWGARWNMHAKPSLALGASALAPILAVLEEPFGPPLHCGSPFLGWPRPEPAPSTCGEVWRERRGREPGLRGACGPARVLGGRELGGPLTQSGRLAPPARGSEGLSTWASSCLPSPIDRPKAEKCGHTARDWQATPPAARVRDAPGYDMDEP

SEQ ID NO: 930579 - protein, 225 aa, Homo sapiens
MLHEAATNRKQTNKTNISTQNNNLALLQNPNDHLAYMPEEIWGLKWRRVGSSAGATAPALLSRPMGLRLPVPARFRSPASFTQWIPHWGRKWSCLSVPRRAPALLSPWMVDGTGRCGAGGGAKPLTARGRRGQLAAPSAGPAEPTPTRNSRWPASAAPSPSSRPCFSFHTSRQAEGAGFGLGQLRKGLPQCSGGLKGCSSAAKVGAHGKEVPRASEGCQHAVTSH

SEQ ID NO: 930580 - protein, 174 aa, Homo sapiens
MPCQSLSVPPARTFEASHALVSSHPASLAVGTPALLPALPCPGISSAYPGLPFLTPFLPYCLHFLESSTQCLLPEERSHNIYFARYFRLNGQNIEDEDSPTNLSFWLGHWTSAFGRQGKVRWACSLVDLFEFHSTLASILQTYKLFLTLSHSSHPQCGVWKEEEPEKNVCEVLA

SEQ ID NO: 930581 - protein, 139 aa, Homo sapiens
MSPNYANWTSCKFRLSLTTCDCSDLDLAHLMQLCCQCKLHIRFHIKNNVKCQGSRPGHGWIHPFPKKKADTTVGISKRKRFHIGNLVTKFLLKLEKQGKCGVSRNPELQKAATSFTGSSAQCVILVCAIYGNPFTNSPS

SEQ ID NO: 930582 - protein, 180 aa, Homo sapiens
MAPSETVANHDTADSPKDPPPPPFFASRPITRLKSQQASKGKVQSVTHEYTTLQKNYLHFLIYISRNPGNMHGNGEWFVRGVPASLKSSMIILLNRSDLLVGTTDIQLENLNPVGIIGFWDGRSQDAAVIPESCQRQGGHSYHKKQQRQSKNQNSLTYVNLRHLQINHGVPRSETVRKPI

SEQ ID NO: 930583 - protein, 171 aa, Homo sapiens
MYASVCMHCLRRECATWQVDPLAPVKELQLMVHGAERNCPAEPCQNHKITYGQPLSFSVKGRATLNIRLGHLAPWFFYLTSASQWLCLWTLTHVLWTRVVNHSRSSLDAVAKPASDSLSVLKLFAAPITEEPHRQLRKHSDGKVTVFAELLVARGLHARPEFLVGFAVISS

SEQ ID NO: 930584 - protein, 136 aa, Homo sapiens
MYAECKSEEGLVASTQISEDAWESLGFQAADGCRGGAPQTASLLGQCRWGIVGLEPQHRVSTRALPSGAVGMGSLCFRHQSGVGTGSLHFETGKAKDIGLQPFSNPHETIPIREGPSMVKKETKCLKKKGFGILGA

SEQ ID NO: 930585 - protein, 134 aa, Homo sapiens
MMSPKTQRGACHGGSGVRSIVLNPPAYQRAPGSHPCQRGRTDDLGETSPQLLLGSGHSLSLEWTHTALMRPPKRQDTSQATAAALRGKRTSSPPGGSLFLSERRGAPPSTCQSFIRGRMEEAAVDRFAHTPGWL

SEQ ID NO: 930586 - protein, 239 aa, Homo sapiens
MGGADPETPPAFSDLGLGCPMLALIGSIGHLPAKGPFEGNSTVSALGLLHTEALEERGRKSLSQGLCSQVLGFLICQKEKRQRKHTHRALELSATPWFPALTGPQQHKAAQGTAGKPARLGAPQGPLSSHLQGSCAMEFSGGALETTGPVAPQPFPFRVLKCPGLVEGWAQERGKWQQQCANSLDIECEREEWRLVLRLQKHKPAWSIASLSKTGVEDEKRATGWEGNLCGGGALNMLP

SEQ ID NO: 930587 - protein, 146 aa, Homo sapiens
MAAFSELLADKSQDAPPVKMEVNPEFEEGHKRNGDGKSHLTKINLDKSSPTTTDPPAPKIYPFELMSKPFQTGPSLGMLTHCNPSSPSYLSVTLLNAGNKNTLTEVILMSDAGSEPLFYVALILKSLNATEQPLSKASLVQDFIVA

SEQ ID NO: 930588 - protein, 263 aa, Homo sapiens
MHIAGATGASRRISRAVESHGNTADKNDSALCCQRSLPVCEEQGSQFLAPLDQGSPTSRLQTGSNLWPVRYWVAQQETGRRRRGRGRGRRRRRRRRRREGEEEEEEEEEEEEEEEEEEEEEEEEEEEEEEMNQQGNIIATFEPFPFKFGIHHEGPIPGLVPNWGIFGSGHSLTPVQGLSPTTASSATVDLCCTKAEDPEDPLIAAMSRLMLRRTPTVMSNTSQTQPPMCGQIKKLSQMVEENLRKAGQPVTASEWETFLSIYP

SEQ ID NO: 930589 - protein, 175 aa, Homo sapiens
MDYYKKLVPEKWDIPMKIPENVEAALKLGKEQRLEQFGGLRRRQENEDTSEATGPEGASCKKPWQLPCVLTLHVHREQELRLGSLCLDFIRFNETPGWPGRCLLQEWSPHVELLLGQWGREKLEPPHRVSTGALPSGAMRRGPLYPRPPNDTSTNSSQNASGKAAGAQHQPVKAA

SEQ ID NO: 930590 - protein, 144 aa, Homo sapiens [sequence omitted]

SEQ ID NO: 930591 - protein, 165 aa, Homo sapiens
MSPKHEIDSSSSFPFLNLALTRTTEVNGTSVGDYKISLPFPWTHSTNPGQAGNTKGLQTSCLHTLSSWVGNGKRLCRIVYQIAVAPAAWGQKATDRHGRRQTAGLKERKAKQTMHGGKMAAPVPANMSPWFKCGFEGKLRSPNRPSKMRLSYVLIPEPITDHRRN

SEQ ID NO: 930592 - protein, 222 aa, Homo sapiens
MSSRCCVLLCQWQWKKRSPRSSLTMAPACEKQLCWDNALRAIFPSIIGHPRHQGVMVGMGQKDSYVGDQAQSKCGILTLKYPIKHGIVTNWDDMEKIWHHVFYNELCVALEEQVVLLTEAPLNPRANREKMTQIMFKTFNTQAMYVAIQAVLTLHSSGCTTGIVMDSGDGEMATAASSSSLEKSYELPDSQAIIISNERVQVLCVDRWLHPGLTVHLPADVD

SEQ ID NO: 930593 - protein, 164 aa, Homo sapiens
MIILSELHVAKRDHIVSKAWNSKDSNPVAQLYVWRKQVLDWDCQARKKTQSMDKRFRGSEDRFICVEGLSQGKALALSFACVSRWRPLNFQWIQSLTKDNVLFSSPPKEEEPVRNILEKFNTISGSKRSDNENGYNTNATMTPSLKKKAKRLCNFDDGWKDTYY

SEQ ID NO: 930594 - protein, 310 aa, Homo sapiens
MTTAILERLSTLSVSGQQLRRLPKILEDGLPKMPCTVPETDVPQLFREPYIRTGYRPTGHEWRYYFFSLFQKHNEVVNVWTHLLAALAVLLRFWAFAEAEALPWASTHSLPLLLFILSSITYLTCSLLAHLLQSKSELSHYTFYFVDYVGVSVYQYGSALAHFFYSSDQAWYDRFWLFFLPAAAFCGWLSCAGCCYAKYRYRRPYPVMRKICQVVPAGLAFILDISPVAHRVALCHLAGCQEQAAWYHTLQILFFLDNCLHLAVFSDVLFTHIPTLHEVGNIFPCSKAVTLKLPLLPVTPATSPTLLTTL

SEQ ID NO: 930595 - protein, 154 aa, Homo sapiens
MQNDEKIDKIKELFLSPAKWPTGKSNHDTNFTYRMLKNCAWDPPALRTSRKNPGSYSECESQVYRVFLPKRSRACLKNSKLDELRKFNRSFPETLRIKPWTQFWPMRHKENLLVMALEKHLLVKETVYGPFCFILPPELNANVKVGFEAVILRP

SEQ ID NO: 930596 - protein, 228 aa, Homo sapiens
MLVCIRMAVLLRAVLNSELMDENTLGPVKAARREAVPCKATGVELPKTMGTHLLHQCDLDVRPGVKGDHFGALKFDCSTGFWTCMGPVGAKVIVTATMQLLLHQPNTWVWSGESSCGMSGNLAGDQESSCLTGVTSWAATYWHRTDDDTGTHIKGHSSNHKTTHPTGWPNLDFCPEEGLWQDEQPQPVGSSPHSLIPLDFLRKWRVWACGTFEHGYQGHSNLPENMFS

SEQ ID NO: 930597 - protein, 934 aa, Homo sapiens
MNKILKMIVSFTIGFQNMVKNTTCDWSLTRTSPERLGTRALTGEDCKCSLRAQFCSMLFFSWQFDCTDLWETCVRCFGDLQPPPANSPVLVHQINLLPLAQETGLFYVDEIIIADTNLFLEGCSLSKTGHPSDKVLLGAHPNPDVNTLFLTCHSSVPTEGTEEGSGLVLVTTQRRQRTSPPLGGHFRIQLPNTVISDVPVQISAHHLHQLLQNNADDFTSRYLNASDFTVKEDLYTCYEHVWTLSWSTQIGDLPNFIRVSDENLTGVNPAAATRVVYDGGVFLGPIFGDMLATANQHTQLFPKHLPIFCRVDLHIQYLTEVFSIEPCCGSLLGGTILSISGIGFSRDPALVWVLVGNRSCDIVNLTEASIWCETLPAPQIPDAGAPTVPAAVEVWAGNRFFARGPSPSLVGKGFTFMYEAAATPVVTAMQGEITNSSLSLHVGGSNLSNSVILLGNLNCDVETQSFQGNVSLSGCSIPLHSLEAGIYPLQVRQKQMGFANMSVVLQQFAVMPRIMAIFPSQGSACGGTILTVRGLLLNSRRRSVRVDLSGPFTCVILSLGDHTILCQVSLEGDPLPGASFSLNVTVLVNGLTSECQGNCTLFIREEASPVMDALSTNTSGSLTTVLIRGQRLATTADEPMVFVDDQLPCNVTFFNASHVVCQTRDLAPGPHYLSVFYTRNGYACSGNVSRHFYIMPQVFHYFPKNFSLHGGSLLTIEGTGLRGQNTTSVYIDQQTCLTVNIGAELIRCIVPTGNGSVALEIEVDGLWYHIGVIGYNKAFTPELISISQSDDILTFAVAQISGAANIDIFIGMSPCVGVSGNHTVLQCVVPSLPAGEYHVRGYDCIRGWASSALVFTSRVIITAVTENFGNVSAAVCGAPCRVLANATVSAFSCLVLPLDGNFTFSLPELPHKCLANGPMEPSESVGWVDVAWQP

SEQ ID NO: 930598 - protein, 151 aa, Homo sapiens
MEPTVKKILVIIEATGGDRIQEECADEEEEDVCLGLTVFVLLQLHSSGLGSGAGLESGNRKYYNILNFVRQCGVRTTAVCAKPGGSSKKDEKLKDLREAEYKKGVRRLPFLKSLDLFPLLPGLLLLVVGVLFNYLYVLTLVFTSNVAQVSK

SEQ ID NO: 930599 - protein, 138 aa, Homo sapiens
MAPGPIELRAHAILVSDGGELRIGSEDKPFQGRAQITLYGSSYSTPFFPYGVKFLAVRNGTLSLHEPERRRHGAVLQLTYCSHLASFSVKLCPHGGRNGSPVTPDERECLFPNGCLTSEQISTFPHHRLTLLLRFSSP

SEQ ID NO: 930600 - protein, 285 aa, Homo sapiens
MKGQMYLWNTYMLDTVKGIDIVTVNEHRATAHALDTVLALEDAVDWNPGDEVVIISGTGVKGAKPMEEIVTVETVQDTDLYLKSPLRYSHNFTENWVAGEHHILKATVALLSRSITIQGNLTNEREKLLVSCQEANAPEEEPSQVQLKGVQFQVLGQAFHKHLSSLTLVGAMRGAFSGNEEQLHVQILARHEDIRREQETSNSESFIQGCTVRNSFSRGLSMCGTLGLKVDSNVFYNILGHALLVGSLHKLSGSVHATYSSLATFSLPDKSFCLSSLSANQYFLI

SEQ ID NO: 930601 - protein, 148 aa, Homo sapiens
MPCLLSAFYARCGGYHDEQDGMNFDFMGSYDLLGMSVKLLTSTSAPESALKWSLPETWQGVEEGWGGYNNTIPGPGDDVLILPSLLGIARSRFFVCLIVVVVVFALSHLSKVTTIDLGLNGNAMSSTLISLKSDEENSSIAPSLDLKQ

SEQ ID NO: 930602 - protein, 191 aa, Homo sapiens
MAVQPRWSQQGSMPVPRPRLFLPVITTHLLLSYLKLITKHSRNLHKKVVSFSATFLADCLRPYIPDTICASFIIGEGHTGEMEVLIGPCSKVSIRFLTVMMKHDNIGEFEIIDDNRAAKIVVNLTGRLHKCGVISTRFDVQLKNLEKWQNNLLPSHQFGFIVLTTAAGVMDHEEASQKHRRENPGILFLEM

SEQ ID NO: 930603 - protein, 199 aa, Homo sapiens
MPSRSQRDLRDLMIRSPLENETTDQKNVQLPWPEKENIKFPKEAMRENSKSESIVDTGNSIRIALCLYVGLEVNKQDPLMGCHGHFKSAAQEEVIIFQNTSEQFKPVWKFWATNSDLHKYFFKKPHKHPKPRFTNPKISECWIKGSHHQATESLGAPGISPVVWNPGSREDEVVLPLGRTEGSVPAILGPLVKEVRIII

SEQ ID NO: 930604 - protein, 148 aa, Homo sapiens
MPWSHLIKEEKAVNVLEHSCCGNESHHRAWLLWHHTETVAKLKGRSGVKESLADGQEKGAGKKWRKPHSVELRPGSANSMPQLCKGISSLPVTDSHSRVVGVCQSLQLVLHMERVKVKGNVRKLSLTLEGIFFYRFPGKALFPFNRLR

SEQ ID NO: 930605 - protein, 135 aa, Homo sapiens
MGHVCTKTMKKAAWVIIEKYYMHLGNDFHTNKHMCKEIAIIPSKKLHNKTAGYVTHLMKQIQRGPVRGISIKLQEEVRERRDNYVPEISALDQEIIEVDPDTKEMLKLLDFGGLSNLQVTQPTVGMNFKMPRGPV

SEQ ID NO: 930606 - protein, 138 aa, Homo sapiens
MTARVALRAAWASHALLSPLAIMLILKILKSIFMQRTLSTAGVTPIWALDASRLSQLQKAAALRREEEKRRAGWAGTNRFSNKWAKNYLTLLACDQHAGSRSRVRRLDAGWRGARAVRWPAVPVPGACVITQSPNWCR

SEQ ID NO: 930607 - protein, 184 aa, Homo sapiens
MEMANPFDHEGLRDPVLVLLWSCTWALVLLPPSGSMDAGAILFSTTYPAPCSDEDMDEAGNHHSQQTITKTKNQTPHVLTHRWELNNENTWTQEGEHHTPGTVVGTRHGGTSGLGLHLLMLASVFCDARPGSLPTTFLITLCKLDSNLVLQWGTDGKWKEGRKGGKDVPAYFQFLLSSFQQKRQ

SEQ ID NO: 930608 - protein, 140 aa, Homo sapiens
MAHVYICNKPARCAYSSVLAVVDQPCLIMDPTMAYCSTSVSATKWDNSWASRLLAWMPVFAVVSHWNWFGACESPYMSEFVEAPSAESFLNLLGGLRIINHVKKCLISAKLFVLDAVQVKEDLQVPCEEEVESLDLGKEG

SEQ ID NO: 930609 - protein, 157 aa, Homo sapiens
MTYLQVHFCYSVENEWAAAKSGSREGMPQFIAEGRAYPVRLPFIQFEYNKKLEEFTHPGFQWYENPGLTGLDYREEKLLGCRIERTEVEEKRDRTDLMQHSNLWCDFHHRAAKPGMFDPFGALEGECFENRSLCFANHEPEIFQASLDASKLQSYIK

SEQ ID NO: 930610 - protein, 144 aa, Homo sapiens
MSYRPFSCCLKGRRSSKCPGGNLNFLFNRTIVVSPGGSSPLSGTETSRPAEHNVMERVEHKVLVPDESPPLSAPSREFWGSGPSAAGLLEFTGGPLQTLFSWVSAADTAEQWILVNSKCCCLIVPLEVLSQRSTRPFSVKGHPN

SEQ ID NO: 930611 - protein, 143 aa, Homo sapiens
MGSEPQYRVPTGALPHVVVRRGSPSSRCQNVRSTDSLHHAPGKAADTQCKTVKAAKKWAVPYKATGVQLPKTIGTHLLHQHNLDVRHGVKGDHFETLRFNDCPIGFWTCMETVALLPIVKIVTKVPYYDQMVTFKNIATKVFL

SEQ ID NO: 930612 - protein, 151 aa, Homo sapiens [sequence omitted]

SEQ ID NO: 930613 - protein, 155 aa, Homo sapiens
MGQAKSKFANYLSLVRPLLRCGGVIVSTQYLTSLFHLVEKYSPWFPEYGTMNVKDWDKVGSDLKPAQQEGHDIPFSFWSVWSAIKTALEPFHTEEEEEEFQDDIDKFNNQESDDQQSEPSQSSFKKGEKWEGSHSPGTRNRGFGCLAVSSNYFFG

SEQ ID NO: 930614 - protein, 163 aa, Homo sapiens
MFLSGVFSPFIFQLLNYFTEWLGFLGWDLTLFLALDERPCLPDSMFHDFHFSHFRLVENHYWGASGLIWRLPTSEQYSHLSNHASTGDVNLLTSLEVYEFLNSSLPKDPVYDEQFALLEDTIPNHFLIIIYSEQVKLYSLLEKYIIKSSEKNFKSLYTLSLFL

SEQ ID NO: 930615 - protein, 139 aa, Homo sapiens
MDLVLVTIPSNLSPVAGVTTKVAAGEFLQGVLQTLLSGHWLQFQRQKQMENLEVGQCAFFLIEILLSLQDLTLDTTIDVSVFSICHISLRNSPVLLLRSKWICSNEPTIKDNSWVFKCEFNVNVGLRWDVAAKFISAEF

SEQ ID NO: 930616 - protein, 140 aa, Homo sapiens
MLMVVVVMVMVLVVELEPTCELSMEGSRLCNLYENLMLMPEVEQSHPKTIPSPTSTPIRGKIVFHKTSPWCQKAMLAPKPQDALLPTLLSLFSKQRSLSPYSYHHRPLHGISPAQQLLVAESRKSSATLSYQSSSCSPAE

SEQ ID NO: 930617 - protein, 206 aa, Homo sapiens
MFICPQEMMCSLLKTALQAEITQVLVIQEIMHHHHEIILTVITVIPVHVMTIHQEAIAIEMDMIMIMTIQIIQVEVPTEIHMRVMITHIVLHLHKGPHHFMLEAVAIMITAAHVTDMVEVETVTQAAEVISIQVVLIGLADEKEGLPLLQKGGTLLHVIPTAVQAAEHQEVVAVEEADLIEGEAEADTRSKQNFGPKPQFKETNEK

SEQ ID NO: 930618 - protein, 136 aa, Homo sapiens
MKAGRGTWKNYTGYVFWPPSFSRAGCFLPWNIIHSKFFSFWTLGPTPFVCQGLSGLRPQNEGCAAGFPICKALGLRLASLLLSLQPAYCDTSPCDHASTKAVLLQWKPGAKTATNKFDKQRACQSGGGEMQKNLHF

SEQ ID NO: 930619 - protein, 257 aa, Homo sapiens
MCARPHKVDRCVVEPKRAVSREDSVNPGLHLGVKKLFVGGIKEDTEEYNLRDYFEKYGKIETIEIMEDRQSGKKRGFAFVTFDDHDRVDKIDVQKYHTINGHNCEVKNRGGDFLNKRCSLLDHREVMEVDLVILWVMEETLEVVKVILAVMEALVEEEVMVVEVVVAEVVMEEMMVDRMDLEVMVAAMAVVLVLVVDGAMVVVDQDMQTKVVDIVAVVEDKMVTMKEKFLAVITMVVLGTIMILEIIVDNSNQTMEP

SEQ ID NO: 930620 - protein, 671 aa, Homo sapiens
MPISPAAREWGKFAGEFVFGQPHEHMNDKNEKQTYCYGESLKGLDRRSNQPQHSLKPKPNPEQGSTLFNSVKSERCEESAKEKFEASRGWFTRFKERIISIHKNAREMETHGVGCDLLEEKKTLMSAGFMCCHCSDTLVIGPVGPEPRPSHLIWSPFIFPGVCDGVCTDYSQCTQPCPPDTQGNMGFSCRQKTWHKITDTCQTLNALNIFEEDSRLVQPFEDNIKISVYTGKSETITDMLLQKCPTDLSCVIRNIQQSPWIPGNIAVIVQLLHNISTAIWTGVDEAKMQSYSTIANHILNSKSISNWTFIPDRNSSYILLHSVNSFARRLFIDKHPVDISDVFIHTMGTTISGDNIGKNFTFSMRINDTSNEVTGRVLISRDELRKVPSPSQVISIAFPTIGAILEASLLENVTVNGLVLSAILPKELKRISLIFEKISKSEERRTQCVGWHSVENRWDQQACKMIQENSQQAVCKLGYGCPLAIAAITVAATEPGKGYLRPEICWLNWDMTKALLAFVIPALAIVVVNLITVTLVIVKTQRAAIGNSMFQEVRAIVRISKNIAILTPLLGLTWGFGVATVIDDRSLAFHIIFSLLNAFQVLHLSSGLLPNSGRFGIVLSDEYQVVTSLWCQLYTTHAPQQASGVWNHPGSKGTECKFFLLLFLYYQYLAM

SEQ ID NO: 930621 - protein, 180 aa, Homo sapiens
MLNNSCECGHLFLVPDLTGKAIFSSHQFFPIQYDTSCESVIHGFYGVEFNWFCKRYKGNLFDYLPHCQIYFHRIMLGLTETMALSDLTHDQKPESSKGQSCAHCVRYNFCHLPGRTRGTRRRATCLGRVSPGAQMTWAFSKSDRRNATVGLCIEVAGDFPVPVRPNFFERRDILRCSVSL

SEQ ID NO: 930622 - protein, 153 aa, Homo sapiens
MVGEKATFWARNRNVCSHLEPGKSLSQSCELCCLELGELWHKHSLGWPADISLGCVHPKSTGSKPSTASGLVQELQSLWPRLPFQFIYNPRVCQFMVVELARTQVLTTDRDNSPLARAGLIAPSMGASLTLSCVAFHCLVLKDGLPQPFLPGM

SEQ ID NO: 930623 - protein, 147 aa, Homo sapiens
MGLLSQLSSLNPHNNFMRLVLTGIIKNRELHSAFKVLLKNRPQTLIQSWFSIVDWKNIIHVELCNVLELAHTGATCNCVHLFPTSCSGISCGLLEICYGGSIYTMDIGKLLKTCQLSTKCLDKCAGKVYYQKMKQNVTVGQGTWRSH

SEQ ID NO: 930624 - protein, 162 aa, Homo sapiens
MGQVWGLVRFTLELFHTDDEEEREYNEVTEEVTDQVYVPAKAKAAKEGEVQPYLSAPPPYYFEEKTLQIFLFQRTLGKKIHPPDQQGNIIATFEPFPFKFGKAHLVDYIKACDGIGGNLHKATLLAQAMAGLRVDKGNTLFPGPCFNCGKHGHTKKECRKNQ

SEQ ID NO: 930625 - protein, 146 aa, Homo sapiens
MMPELNVNYLVGWCINTNEGTEPEQGEVTCSRSYSVVLKPATSASPRNLLEIQILRPYPDRPQNQKFREEDPALCVLTSPLEGRKALLLLPQIRCQQQHSSCSYVPRCYCTDIRSPTEPCPKGLNLSPWSPAAAFNHLSSITNKGV

SEQ ID NO: 930626 - protein, 165 aa, Homo sapiens
MLRKLMRCTENCNACSRHWSTDRAQFFSISMPNRMLVDSNEYAGKVGLKAKAIYGHTILDAPDLIYRQRQYWPVTAIPHACAMRGMSVGDGCDNSRHGLSQRGLCESVWSQYTRAGRGVGVTLTIASRDYQWSREIQKSAFFKSSLSGRDVAISELVPRSVFRNH

SEQ ID NO: 930627 - protein, 170 aa, Homo sapiens
MLRKLMRCTENCNACSRHWSTDRAQFFSISMPNRMLVDSNEYAGKVGLKAKAIYGHTILDAPDLIYRQRQYWPVTAIPHACAMRGMSVGDGCDNSRHGLSQRGLCESVWSQYTRAGRGVGRFYHLVDRSLQNKQAPHHASKPEPCADPQMLGNRDDPWTPYQVPSNTTCS

SEQ ID NO: 930628 - protein, 144 aa, Homo sapiens
MHHCQRSHIPHSTGTLVTAIAAQDTLLSECPYQGQLHGCVTCHESALFPNQFCASSFRVLVLHGFPENSRVKELQKQSKLGSFNNDKPGEVVSIQVLPTPWHEVQPRQTVKAAYSVCTSHSRKEESGENTSHCSLTCSVFAEYI

SEQ ID NO: 930629 - protein, 177 aa, Homo sapiens
MSPKLQNQQVFIRDFKRGGGIQTRSRSQRSHASKGNKNHKAKAKLELLMRVYVPLCTYYLDKHLNRKQGLRAENQSDQNLSGWNFPILVSLRVLQETRAYFSPYLNCIRQTLPEQPFIDLPPGMHSFPQGIPCWEKNSAISLLFACPFIRSLQELKYGSILPDPTGSQTLWLPSFFP

SEQ ID NO: 930630 - protein, 137 aa, Homo sapiens
MESCGIHESTFNSIMKCDMDIPKDLYANTVLSGVTTMYPGIPNRMQKEITALASSTMKIKISCPQSASTLCGSVAPSWPHCPPSSRCGLASRSTTRYRKERGKKGREGKAQWVMTDNLSPEAEKGMGGFHVLRIPLT

SEQ ID NO: 930631 - protein, 170 aa, Homo sapiens
MSLLLQFFPNRQFKDYWEQNETYFNITVLQNQAITSAVLVYFHAADEDIPKTGQFTKERGLMDLQLHMPRKASQSWQKAKGTSYMTAARERMRVKLKGFPLIKPSDLVRLIHYHENSMRETTPMIQLSPIRSLPQHMGIMGATIQDEIWVGTQRNSIECSHMQKNCIDLP

SEQ ID NO: 930632 - protein, 188 aa, Homo sapiens
MTAMEMLLTPADPGRGGPSVSSERDSALIAFSLHLSCKLRSRSGSDISLRAEGSVTSVLGKPRERESKCPASQQGLAAVGDEMTVPYLQADKSKVSEDCQAPAAAQRSYGCKRRAETRVSWSSSRRPHVLGWHHVLKEPLDPNRLLSVCEGCGQDSRMGSAQLGDGQHGHPTDEDDTPQPTLTATETP

SEQ ID NO: 930633 - protein, 171 aa, Homo sapiens
MVISAHVLSPYVNSPEHILWAKHCFGPACKLDPLHVQFTMGCAFLRESNATTDLTGGGAQAVMLACPLLTCYAAQFLAGHGPLAQFQVHSKIGQQKVQGVPVCSLHQCGPPAAGAFKERPTKPTAFRKFYERGDFPIALEHDSKGNKIAWKKAGKYSPAVYLKGKGKWSEQ

SEQ ID NO: 930634 - protein, 143 aa, Homo sapiens
MHSCGSARAARPLRLPGVLPAGGAGGCVREKAKGAAGWERRESRREGGGEAGGRGAPRSSSQGRGSPARHGYSNPSTSRKRYFLRLGGFCILSSHRWGWRRPTRRPVAARELSFQYRDSELIQSAAEGAHPSYRAAECLWLEQ

SEQ ID NO: 930635 - protein, 148 aa, Homo sapiens
MVLQMEPQMSSTNKLYRGPLDRPTGTFTGLESYPLEDTTTAGPLHRPIQQEVARAVISQIPNSSWGLHVVLMGQLEFWIGVGLVGPSLGVNPFQSTLPFTKKRELSPGLQLASPGSVTLPHCGSFVLSLFAINLAAAHSLGPHCLYEL

SEQ ID NO: 930636 - protein, 159 aa, Homo sapiens
MHMCPPCPLQLTAPSVSLQWDTDVATLAMVYRTVIGGHTSLYCCVPDAPSFSCQPLTEEHKSQSEVESADGKAAASYPKDLVKITDEGVYTKQQIFNLGLSKKLIPTFMDNFEGVKISVEEVTAEIAIATSAFSNQQLDQSTAINIKQGLSTSKKSTTC

SEQ ID NO: 930637 - protein, 216 aa, Homo sapiens
MGGAFRPVLYVELKKNGRNYNIYRITKEKSRKEFEETGVDGRIAGVLSMGGENGRFRSKWRSKEHSEGITGSAHKCTDAEARSENQGEGKDFRGDEKVQSPGKASVRGDNMLAALGCSRRLLGLGLRSGLARGALQPTSALWGLLSGADQGRSRLPLLAGRYGGRGPGRSRGCARRSGATAGFQWVWARWALHRAPGTCWAWSGVGAPSGLPECPG

SEQ ID NO: 930638 - protein, 136 aa, Homo sapiens
MSVGPTEQAWEGIFRSACCEYRGKSAVFEQECTFPLGTVTHGFPWIGKGNPLTPCTSSVRDAPPCFGLPSMGCTHCPTNPNEMNQYAGNSTLMGVLATHFIKVVAAGSMPVHLCQQKQGYSKMHTSVGAGCLKDIS

SEQ ID NO: 930639 - protein, 140 aa, Homo sapiens
MGCYVLPLVCQDNTASNCSCFKNYIKCLICAKYYGLNVSPQNSYIKVLTPSTSECDRIWKQGHCRCKQLRGCLGTGARTQGEHHVEIGAILPPVKECQSFPKKPPKARGGTWNRYFPGAFEVKNTEYRTHQLPQSFKVKH

SEQ ID NO: 930640 - protein, 332 aa, Homo sapiens
MAEGKEEASISSHGGARERAKGEVPHTFKQLELEAPSGIHTRALPWPPEPLILFIREAECKTLKNLHPDHVVEKKNPFSGEKFKPAEEICISSEEPNVKHQDNGENVSRAFQRASWQCLPSPALRPRREKWFHGLGLGHSLHTLDMVPCFTAASAPEVAERGQGTAWAIVSESASPKTWQCPFGVGPVGVQTRVEVWEPPPRFQRIWKHLEYRQQSAAGVEPSWRISTRVMQRGNTGLEPPNRVPTGALPSQAVRRGPPSSRLQNSRSTNSLHCVPRKAASTQSHPVKAAVWGIPCIATGVELLKDLGAHFLYWLALERSMAWWNAGIVTIS

SEQ ID NO: 930641 - protein, 146 aa, Homo sapiens
MRLLGLLTLNMNIAMPSWFDIIGLSPDSQEDESGIKQAAQNIKALIDQEVKNGIPSNRIILGGFSQGGALSLYTALTTHQKLAGVTALNCWLPLWASFPQGPIGGANRDISILQCHGDCDPLVPLMFGSLTVEKLKNIGESSQCDL

SEQ ID NO: 930642 - protein, 196 aa, Homo sapiens
MKTFRMKTFLTTQEQYFASFNPVKLTLDINHHKSTLVNLNPYTSEIICNLQIKTIIRNGAILRAQCWSLLLANWALSSGHSQVSLGEWKSMLLSPCVTSIPATMATVFMGPLGDDRGGWGKRLSVVHTTSDPIHLIIKILFCGGHLLVNTHMGYKYLQFLTTQRVPSTYLFPRFLCHQFSSHASSKSLTIQPNHWP

SEQ ID NO: 930643 - protein, 136 aa, Homo sapiens
MLVHAINLLLSRHAEPHLLVVYIGYWKIMNVIGVVREHYFWLTTLYAKVLPDESIGLKENQTNKESGKQSSQTVFLNIKPLLTPVLVKTHAFRPPIKLNPESPVFISGGNSNRVSGKSYLKPSWVETISVDVWEEI

SEQ ID NO: 930644 - protein, 161 aa, Homo sapiens
MVFHIHCCSHLQTGVSTCFSLGPQSTPYSSSHVSNVDVEKDDQNLESQIPKSSPVADEATVTPCEFAKEGPRHSFPPATRSVGHRWLVIASFSRNGLGQRKLPCPSTQTSMVNVGESDGKGLSVMPNFHSLTPESQDILDHDHSYQYPPTLPGNQQGLEIG

SEQ ID NO: 930645 - protein, 136 aa, Homo sapiens
MLTVRVCSFIFVSQTKNLIVAVGELCVLCSYWCECKFSVEGQQCLLTLRECGVAEPRPAHPELELVCKGCCRPDSCLRLSIRACKLREDHLWKTAVAVCPCLQELAKGDTDATLIIFQAPYSAGEVIRTANTLSVP

SEQ ID NO: 930646 - protein, 137 aa, Homo sapiens
MVYVIHKSRSRQESLKKEETGQQGVQSGLGTASKTGFSSPRLSLGSFVLSFHFIQVLQPSTFWLVPNDSKVIQQPGTIPLSSQCGLEPSQAIPKCQSRHGLLQNQASPDLLNLCLREDSGICALAGSKGWSARRGED

SEQ ID NO: 930647 - protein, 157 aa, Homo sapiens
MFFLPVLLCKVDVLTASWNSWPPVKELQADLGNIIVSGIGSCRWVLGLADFKNEAADPRGVKLQTFTVSVTILKKGASEVVRSSWLVCGLTSFRSEAAKLCVQEFPRCDQVLMSAAEKATDSWGAIFSFSHMMIEIILDGKCGGEKEENVRCSVQNW

SEQ ID NO: 930648 - protein, 152 aa, Homo sapiens
MIVKFPEASPVMPPVQSVELHFIFPKLPDSSSQQDRQALLRLQFAVPRYKSNKTYEEYEENYKILIKDIKEELNKWRDIPCSCIGRLNIVKMSILSNLIYRLKAIAILAKNPANYLVYISPQTDSKITMDRPETQNKQHNIEEEQNWKADIT

SEQ ID NO: 930649 - protein, 128 aa, Homo sapiens
MAILTGIRWYLTVVLIPISLMITDVEHFFRYLLATSVHGPKPKPQPHYHTEPPKRETDFNTVYFANMCLLLTVSATTECPQIAGLQNSSEFGKRRKALTSVPKWVQKLKQREAGRRWRKGEETLDLIS

SEQ ID NO: 930650 - protein, 131 aa, Homo sapiens
MHSTYSLADCAVQNLRRILWTLMPVFQVLTDCVATGKFLNFFVSQFLNLRNGDSNVSISWVTKAPNGPLLDASFMRRKRLLPTKGVYPLPQHTASCPARVRFFTFPRDSQGTGPSLLQLSPVGVVGICSRG

SEQ ID NO: 930651 - protein, 143 aa, Homo sapiens
MRIQAAGFESENGSTYPGAFMWWERRSAGTLFILQTESPYLLNNNSPLPSSPAPGNHRLLSVCVNLTTLGPLHKWIVQYLSLVAYFTQHNVSRFTHVVVSELPSLLRLNNIPLYEWNTFCVSIHLLINTWIVSTSWLLQIMLL

SEQ ID NO: 930652 - protein, 183 aa, Homo sapiens [sequence omitted]

SEQ ID NO: 930653 - protein, 181 aa, Homo sapiens
MKVRMPWLLSSHCLPKGTLTRVSIVEGSQSQVAVDHEKCNPKRKINKISKMIIYPRIPLQGCGWPEPIQWPKREPAVDGTPSHLSTGSHTPTLTETGTTQKRQLACTALGCGRKPENLQKTHADMGRMCELYTDSGLDRESIFLLINVIKKRRGFTTANYPIYNHTGLQKTVSGRKEREVG

SEQ ID NO: 930654 - protein, 150 aa, Homo sapiens
MVDAPAPAKLLPGRLISDCCASSEQGSVGVGPTKPGAGYNLLRKKKKQEEEKEEKEGEGGEEGRRGRGKEGTRGRRRRRKRRRRRGRRRRKEAEGGGGGEGEEEGEEEEEEEEKEEEGGGGIKKEERRRKKMKMKKEQKEEVIPGLEQRP

SEQ ID NO: 930655 - protein, 146 aa, Homo sapiens
MRKNQCKKAENSKNQNTSSPPKDQNSLPAREQNWTENWFDEFSEVGFRRWVITNSSELKEHVLSQCKEAKNLEKRLEELLTGIISVEKNINVLMELKSTAQELRYYPGEIPQPSKTGQNSNSGNTMNTMKILLEKSNPKTHNCQIH

SEQ ID NO: 930656 - protein, 147 aa, Homo sapiens
MEPENYRMRSSSCPGEESGEKPSGLGNGTHRMEPVSLEPCEQEPEQSEWQWERAANVHIPRQNPILRPKSSVVDCICVLQDISPELVQCFCDTIKKWLFVYFCFTVGFLPSCLVLHGSKMAAATMPCSMSYFKGFIPKSLVKFCSFF

SEQ ID NO: 930657 - protein, 185 aa, Homo sapiens
MVEGLGDLPWEIDPLSSCSLFHEKDPPTTSGPQTNQPKEHLTNFKSEHQDLATSARNLATRPRNACSLGFLLSHVPSVRDPTGNRTQLKTDTAVSPQKPTGPSQVLWVTLAVEGKSIPFLVNTEATHSTLPAFQGPVSLASITVVGTDSQASKPLKTAQLWYQLRQYSFKHSFLVIPTYPFALLG

SEQ ID NO: 930658 - protein, 138 aa, Homo sapiens
MGPAGLFPSFLVPGWRVTGKQEMISMKLIIFCCLNHSQKFKFLDSGNIDTTFSLHHLMRGIHSEKYVIRQFHHYANITECTYTNLNGIAYYTTRLYERKGVMQKILGQEGSWAELSQKCRSLKTIWLFEKLNGSVFEL

SEQ ID NO: 930659 - protein, 124 aa, Homo sapiens
MRRRRRRRRRQKEGEEEKEEEEVEEEEEEEEEKEEEEKEEEEEEEEKEEEEEEEEEEEQEEEEEEEEEEEEKKEEEEKEEEEEEEKDGGRMRKKKRKRRRRRRGRRRRKDNMVWLSPPKSYRQL

SEQ ID NO: 930660 - protein, 153 aa, Homo sapiens
MSQWKENRQRSWHKIFQILNLQPPDWKNQFLLCVRYQVCGILLQQPKRTKIDPCTCSFKNGLLKEYGVQGDAISTPFLNDSSPQEDMHMILWEPLAVQNGPQLTSCKETGASAYNLQQQETEFCQQPEGAGNRFSLGVPKREFSPPNTLILAQ

SEQ ID NO: 930661 - protein, 172 aa, Homo sapiens
MIVRPPQPCGTEDNDFMSHSQGSAALHNLGTWLPAFQTFQLQLRFQGAQVQLRSLLQKMQAISLGGSRVVSTDSLYLMPGKASTTQHQLLKAPLGGEPCKTTGQFPKALGAHLLHQCALDKRHGVKRDYFGTLKFNDCPAGFHTCKRFVLINFSFLEWEYLPNAYIPISSWK

SEQ ID NO: 930662 - protein, 134 aa, Homo sapiens
MGPYVVSEVSELASAYLGHKRLRQDLEGGSDVATSSLFIPASSGKNMRHCCLTHSVAHLPAGLDGMEEQLGQPPQHLQSLLGHPSASWTPGGDIDKSFSPSFWVTGHQRLASSISHPFALPKCLPCRLQGTASV

SEQ ID NO: 930663 - protein, 149 aa, Homo sapiens
MGKKQSRKTRNSKNQSASPPAKERSSSAAMEQSWMENDFEELREEGFRRPNYSELKEEVQTNDKEVKNLEKKLDEWLTRITDAEKKYRERHKDNPREEQLQKHIIVRFTKVEMKEKMLRASREKEESEGQYSTFLKKRIFNPEFHIQPN

SEQ ID NO: 930664 - protein, 184 aa, Homo sapiens
MGHCCHHQEFKTSLGNTNFTGACWAHPSRSAWQAALRLHYQPGSCTCRSFELVWCATTGFRLACQCPDKGDVALPKNSEMSATVEPQVVLQVLLRESQGLSPQGALEFRPPGSGNNSSWNLRKKVTTADEEVEERGITSGLLKGDIKLKTVEEEKGEKEKEKDDEEKPKIEDMASDEEDDSGGN

SEQ ID NO: 930665 - protein, 138 aa, Homo sapiens
MDAPAPTKLKCLRSTSDCCAGCENFKPVDLSLLGSVGMGFAEPDHLAPWLQPPFQGISWSVGCEDCVKSIASRPECTVPHSTIPHGTVPHGFPWLGEGVSQPPVLPSLPSVGCTHCLTSPNEMSQVPQLDAEITCLLR

SEQ ID NO: 930666 - protein, 166 aa, Homo sapiens
MLNSIKIPKNVEATLKLGNRQRLEQCGGSGEDQKLWQSLELPRDLLNDFDQNADSDMDNEVQSEVVLDGDEELLGNWSKADSCYALAKRLAAFCPCHRDLWNFGLGRDDFGYVVEEISKWQSIQEEAEHKSLENLQADNAIEKKNPFSEEKFLLAAEICISQRCLN

SEQ ID NO: 930667 - protein, 155 aa, Homo sapiens
MFCINIVYVLKNTVAHEMRLPGAWKQQVPINQLNSFKSRARHCAWSWGLRHRSCLQVYHSKRGEKREKRMRMKPGKAESMGLGVFSVLLVNKCVGCEDSFLPGQRLWEGRAPERRNELTGHKMMQMVCRPEMLCLLLELKLKGGNSYSAKMLQRS

SEQ ID NO: 930668 - protein, 227 aa, Homo sapiens
MRKNQHNKAENSKTQNTSSPPKDHNSSPAMEQNWMENEFDKLTEVGFRRWVITNSCKLKEPVLNQCKEAKKLDKRLEKLLTRITSLEKNINDLMELKNTAREHREAYTNINSRINQAEERISEIEDQLNEIKHEEKIREKRMKRNEKSLQEIWDYVERPNLCLIGVPESDRENGTKLEITLQDIIQENPPQPSKTGQHSNSGNTETTTKILLEKSNPKTHNHQIHQG

SEQ ID NO: 930669 - protein, 135 aa, Homo sapiens
MWWVITEGNTALSLTQVLWVDSPRRTLQGQDLSASREEKENYDCEIERHSGEIKCFNIPPPLRCHPHHSAAVGIRQKREDYKPLATSFHYSFIYNVGGSAKVIGAYMKIKKICSPLSTGGSQSGENRRSVNNSTY

SEQ ID NO: 930670 - protein, 142 aa, Homo sapiens
MSVFLGLFLLDCSYFPEENLLVFYLEDRSITENILRSDWEQGDGSQDSSGPSAAGLLEFAGGPLQTLFAWVSAAKAAEQRILVNSKCCYLVVPLEVLSQRSTRPWHELSRGEDARVEEAAGHAQHRLLRGGALGMLLLMPQR

SEQ ID NO: 930671 - protein, 141 aa, Homo sapiens
MLPFLCPRVLIVQLPLISLLEFAEGPLQTLFAWLFASPVEAAEQQRLLPVPSSGSFVPEGHLPDASGSSSLRKLWSLRSCRPRKSGNVIRSESEGLRTRGANGVTSSPREEDEMRCPNSSNESENRGKFLLSLPLFYSGPE

SEQ ID NO: 930672 - protein, 126 aa, Homo sapiens
MPCNNRGGDWSHATAGQGTPRLAGKLPEARKRQGRILTYRFQREHGTTNTVIWDFCYIQDLFNCHSKSMMRAAQKKEILFLLTTDGQEESVNSTEKFHRNELCSAFAIRGQISFSHLEETSLKSIY

SEQ ID NO: 930673 - protein, 155 aa, Homo sapiens
MQKSPAFCVDFTGSCIPELSSCLISFWCFPLLFLSLLMPCEEAICFSFAFCHDCEFPEVSPAMQNSRECMVVYVEETSPTPPSGYPESRGDKGVRKRQNKHLKGGSRGPEHRRLARGPELSGSPQFIGLQAVCSSGRWELGGRDEEKDESVEENS

SEQ ID NO: 930674 - protein, 144 aa, Homo sapiens
MAVESQWLLVVLSKKAHTVPPHHSSPITQQQAEAANVESKLPPITREITKVTWKANVASSSSIRLPVMTGFTLSYTPPKKIASYLILEDTTCILDNGSPDSHEFRPGGTKHLEESIQLLQDLVPPTWDSPLFLWITAVGLSHLL

SEQ ID NO: 930675 - protein, 161 aa, Homo sapiens
MPFAFHHDCEASPATWHFLHTEWGSGRAGSTALGGGFTSSQRLKTGQSEEAKEEQGGLTFSAPLGTVRAVGLVELLHTLSRFYIGLCSLTNEPADGTYRKTPPYTSLNPVRLIHHHKNSTGKTCPMIQLPSIGSLPQHMGIQDEIWVEAQPNHITLHIAVF

SEQ ID NO: 930676 - protein, 184 aa, Homo sapiens
MFKSAEAAPTVTPSPTDTLPREEESRKAFWLQQLCGAAVDPSQYELPRGFVYTMRGKLPTQASVMAVVPPSTRLEHPRSTSDCCAGSENFKPVDLRLQGSLGVGSTELDHLVPWLQPPFQGSERFCLAGIPGASEEMHFQLTIGGDFEYWVEENDEAKVQANEKEYSVCCGCRKRRDSMTTGPA

SEQ ID NO: 930677 - protein, 145 aa, Homo sapiens
MRIGQRHRSKPYHSAPGPSIKAHTSLSISLSAFWSKPFNKSLGSSKLSHIFLSSSEPSKLFQALPNTQFQSPFHIFSTCINLADLAAADSPVISLEKDNIFKGSNIIPQPIIPTVLPMEQSILNASYECSGNWTPTEYQSFPFLH

SEQ ID NO: 930678 - protein, 146 aa, Homo sapiens
MLQGLCEDDGMGWWLPQAPSVLLLDHPSFQDDGEPLPRWWWAASKMVASLVFSDLGFLASQIPRNGILVHVPCGNNGKPLAQLGVAMGALLDQEHSGHPARSGRMEVSGGSAMVAKQQWCPASKSSARAVTNTDQKLAVARFNRVK

SEQ ID NO: 930679 - protein, 137 aa, Homo sapiens
MQEVGSHGLGQLHTCGFAGYSPSPGCLHRLDLSVCSFSRHSVQAESGSTILTSGGWWPSFHSSTRQCLSGDSSLTSYHQTYNRMTNKKITYKVNLLNNSNIPCFLSHFIHSLNRLLQSANKLCKVGPERSPKPLKAN

SEQ ID NO: 930680 - protein, 165 aa, Homo sapiens
MDGFHLSYNSVEAYLSVDNILQSASFDSRLLLGLGGGPSITVSMPTIPFLGVLVHSAPLGRGHSWQICLMLTWSALICCPRPSQGSIGFCLPAEFRQKWDHWAGSTSNVTHLATGGGMSEVSCPAIWCFQYKRWLCTLTNSGRRKTAQLEALASINFLATRGRGR

SEQ ID NO: 930681 - protein, 150 aa, Homo sapiens
MTTNLNKVSTDFSLNVRHLIVSKNHETWLSLSHHHPENLYYIAYWLRALLQSQTTSVQILVLEEPAVLIRKVLDKKHCSVVSKKMMFQFSTSCCTDSSKFTYSDLACDPGTFSPHKSTQCKALSVNGTIGILEEEGICFPVLVYSFGSLP

SEQ ID NO: 930682 - protein, 134 aa, Homo sapiens
MVRTFSLPVALLLIVSTLILTQGLAIWGLLSGHPSCQSYNNVLAHDAGDGGCWSEVATHSTSSQRTAQCKGPYKRERGEFDISQYKPFSQLAGLSTVPYKGLSRTQSHSSTSGTKCLFDLSATFKKHLHLCKKA

SEQ ID NO: 930683 - protein, 138 aa, Homo sapiens
MVNYSDPTVSFIVQVLQLSLQSILIFVYDERYESSFILLACGYPIFPELFTEKTILSPKLTYLMLTSVMSFFGCRKLYPLLPRVYENAPSEVHTDTLTYTLPDIKRITAFIEKTFLSTLSVLGTFVKNHLIINVQMYF

SEQ ID NO: 930684 - protein, 144 aa, Homo sapiens
MEQSWTQNDFDEHLFMKKITLIIGALQFSVVNCKYLTLRDSYCESILTYKKETAMSVNKTSHPHPPFEEEETKVNCPINSKKLRPSVILQILKFGVKRDFHVFTQLNLTFNTFPICASVASLKLFKIGINKRIFFSNNLSVKID

SEQ ID NO: 930685 - protein, 126 aa, Homo sapiens
MAYSLLLRSTRFYSIGKSLEGLEFSLFSYGIIAINNNVGLGLADARVQTKECASGNGLYTVFLISFPAINPTPQQIEKTGSDPMFTESDHVLKYYSYYKDCVSRGTIQHFNMGGKEKKGRKKKNGD

SEQ ID NO: 930686 - protein, 143 aa, Homo sapiens
MLQEPMFFPLFHTTFIDIPTFCVKSVKELRKHTIKILMLIMRNLESRPGTQRDMDPKSNNNVVLQTHKGTSLVVLDKLQNSLNYKAETLVFFLLSPKGSLYLYAELPGTGSVVMQAPLWPPPLELCWIRPEPSIELCLAQGSL

SEQ ID NO: 930687 - protein, 144 aa, Homo sapiens
MDQGGSGSEMLLLYTVYVPLCVNTDFKISTDVPWVREVFSRSRKCVVLVSHKKNIYEIMIKRKKLIKWKNLQRDIRFRNKLFQHVRFLLGCQRKSMEKGAPCRLNNGKSTLQQRDPNVYPLHIWVILIAVSCIHWLELDLTVLS

SEQ ID NO: 930688 - protein, 134 aa, Homo sapiens
MSACSGCRCFNTFRGLSYKKSDLSSECYKMLASKRFEEIARLKETTVKVPIQLEGKTMKCRGKNIANISKEEHFLPSLVAKANFAPEISETCDLWPVKDLYYLHFCRLFEKVSVQCQSCYVTIGKVVRDDTSFL

SEQ ID NO: 930689 - protein, 154 aa, Homo sapiens
MSQVLVKYYEVFVCNFCFCGLYRKHGRGGLKKLAIMAEGEGKPAHLMWLEQEEERWGEEWLYMVRKSNCQGSLVVTTACLPLCSSLFFHTGHHLVFPIKFVMETFNQYILDTSPYHSDCWVSSSSLDLVAIAASLLATWEKHPAVSNAMTCWVA

SEQ ID NO: 930690 - protein, 153 aa, Homo sapiens [sequence omitted]

SEQ ID NO: 930691 - protein, 264 aa, Homo sapiens
MGKVKVGVNGFGCIGRLVIRAACNSGKVDIIAINDPFIDLSYMVYMFQYDPTHGKFHGTVKAENGKLVINGNPITIFQEPDPSKIKWGDAGTEYVMESTGIFTTMENAGAHLQWGAKRVIISAPSADPPMFTMEHHPCHYWAAKAVRKVIPELNGKLTGMALRVPTANVSVVDLTYHLEKPAKYDDIKKVVKQASEGPLKGILGYTGHQVVSSDFNSDTHSSTFNAGAGTALNDHFVKLISWYDNEFGYNNRVVDLMAHMASKE

SEQ ID NO: 930692 - protein, 149 aa, Homo sapiens
MGKKQSRKTGNSKRLENYVKNAEASGADEIKWKKGPNLRLIGVPESDGMNGTKLENTLQDIMQENFPNLARQANIQIQEIQRTPQRYSSRRATPRHIIVRFTKVEMKEKMLREAREKVQKLYKPEESWGQYSACFKKRIFNPELHIQPN

SEQ ID NO: 930693 - protein, 315 aa, Homo sapiens
MSFNTCSTFSTCSTFSTNYQSLGRLDSQRVASIYAGAGGSGSQISLSHSTSLQGGMGSRGLSTGMAGGLAGMGGIQNEKETMQSLNDLLASYLDRIDNARLAADDLRVKYETELAMCQSVESDIRLKEELLFMKKNHEEEVKGVQAQIASSGLTVEVDAPKSQDLTKIMAENWAQYGKLARKNREELDKYWSQQIQKSTTVVTTQLAEAILENSLREMEAHYTLQMEQLNRIRPHLESELAQTQAEGQGQAQEYEALQNIKVKLEAEITTYHRLLEDGEDFNLGDALDSSNSMQTIQKTTTCQIVDGKVVSENEQ

SEQ ID NO: 930694 - protein, 192 aa, Homo sapiens
MLTVHQTVSDVRGNFYQEKTVFLRCTVNSNPPARFIWKRGSDTLSHSQDNGVDIYEPLYTQTGETKAWYLPVCTRATSDPENPMMRHCQGYGECSIHPRLRTPGAKWLWCWVNEYAGSLETQAGTSPQWSTAAQGETKVLKLKNLRPQDYASYTCQVSVRNVCGIPDKGRTFRLTNTTGTGIFLPILLPYLS

SEQ ID NO: 930695 - protein, 152 aa, Homo sapiens
MRTDFTLDFYFSLQGKGTGNPASCPGVPLGLLRLAKQSALEKPGVERPGWRDPGVVCGTFSSSVAYASVSQEQSCKVASRARWCRPVFVMQVAELTVFQRSVPGQRMNEEMDGQENTLCPIGEYVSILAQLCCQKDTFSAAKKLLSGAKHNQ

SEQ ID NO: 930696 - protein, 217 aa, Homo sapiens
MAMLLLMDIIRRSKPIPVTEDKPFLNHPSVFLLDLERWVTFDSVKGLAEDISDKGEIGTKAQREGQSGMWGAGSDASPVEEERPRVQAERTASIEALWGFLRPGRLEWGEAGGGAGEETGQTVSDSAVSGLAGNDNHCRFHSEANGQLLEHFEAGEGYLETDSELAMHRQKPCSPTSRRTREKQGWEEGERGVSQHRPPTDPAKAVGLGGPFRVSSS

SEQ ID NO: 930697 - protein, 146 aa, Homo sapiens
MIFMWKGWSLGCICRALHSLGLQWSPEIFLLSQVILPKNDSRKGEVWAGNQLGTFKVYILNATITTMFQNRNCILECTSWEVGWGYIDEQGTIVAFQQLPGLWERPTGTQGNTGRETGVILNTKEAIREGKKYYVVGITQLVAFSD

SEQ ID NO: 930698 - protein, 162 aa, Homo sapiens
MPLRAQTATAAPGHILGTLQSRCSLLLQLLGPAAVLQEGTVVVPAEGSCPKRENCERRRGSHKGESEEQQNRQKNQGFQGWKFKVRVISGAKHFHPQANILATRSHGRLSGDTNHCQPQHVHQRSRTTVSDVHLGSSLMAIGLYAIMEADEDILEGCSLCVR

SEQ ID NO: 930699 - protein, 243 aa, Homo sapiens
MASLKENIESTGKAQLLGTRTRPKCSDSSPPPRHLRGDGCSGRGGAHREIPVLLGFRAFPWTLLHLPGYRLGPSRRELLSDNHATCRHADTHYRMACLVHVPAPIPSQHLNLEVVASALPLALNQPFSSSAGASERTWPCTVLGASKMTALCFSVLSPASAGLSPADTTRVPTRLPRITCSPLTKSSPLSLGWVWIFGRRFDSSNSFLVLVHLWTLGPVCQVLIRPSRDLVSCSEPSPVSTCR

SEQ ID NO: 930700 - protein, 142 aa, Homo sapiens
MGAVSPMLSDKTLFPSGLEEESGYEFYSCEEINPGELESEFSPRSSERSAWHIVNNNKCLSNISKFRASLSWYHLTLIGTNASIHSCAWDASECKMDLSVPGNGSFTSEKVCLYALVPLLSLSQEFYTLTCYSMLVSLVVVG

SEQ ID NO: 930701 - protein, 145 aa, Homo sapiens
MIKGTVVAADEARRDSRHQAMQGSSVVVWVSPDVQWSPQSVNKQCGDVNPCGEGPIGMLVEGGPGQQDRHESQSGGYTITGWRWLISVEVEWVPVWKECGSQRQDDQLIRSAQECSGFKPKSLCPGKPFSLSQIGTVGDSRLGTN

SEQ ID NO: 930702 - protein, 143 aa, Homo sapiens
MMCGYFKRSKTKQNKIAAFYSDSVPVRDGRAVYEGEVRGEVCTCDVVQDSLGPSSCSHEADGRWRTGTMRPSASAKAHYWAVLCMVTVDLLHRGYFYGKSPLAHISLFKFTTLPVSAISFFLNSSELAASSFPSASGPGRSIH

SEQ ID NO: 930703 - protein, 136 aa, Homo sapiens
MVTRPPRLLSLEEHAFDQLHERLLTVTQILGYRGISQINAYENSEHLVKGGDTALPAVSHGEMVEGGVEGGGCCQLLSTCGWWRPGTASAGKRGYSEQVTFPVVRELHSLRHKDGYKGTEMSSLADCSPAKVAVWQ

SEQ ID NO: 930704 - protein, 197 aa, Homo sapiens
MPSWGGGGSKSLGSGIGSPVTILALEVWCWHLLLVRPQETYNHGGSKCNIYSKGQTNISRGVTAQVYQRRVPDSRDFSPQNSSSVGLGWEPGICIFSRYSDASDRVSMCSEPPSEPLAWKTPFLGSEWAHLSPCWIKLAREGTLSPIFHPPERWQKKLEASLTCNSFLENLQNGIGKYQVTATFVRGLDAEFGLKEK

SEQ ID NO: 930705 - protein, 166 aa, Homo sapiens
MIYTVLLAICQLQFKFSYLVPAGFLLGGFCSEWLLLTPGMLFGKDYGESDSSSVIKHLFMREFGSPPHLLLGRRGSAQTSISRFHSARALTQALPQCHTLCLPVSEQAYVGRCKDKLTKDGSPGQRPSVKPSSCRSLHRVRSNLTGPHIQKRGREGGKGSHVGRRL

SEQ ID NO: 930706 - protein, 139 aa, Homo sapiens
MPSKAMGVEPSPRPQNCKATSVQCQPERDAGMRLRSVTAAEWAEQNHKEHICGISTQNWQEHWFRCRNYTQEELFLCAFMHQSRASSSSFTLKRQRSISTGGEFSPINRKTGLTHPGEQLFLFPSLVSHYSLQERRPKM

SEQ ID NO: 930707 - protein, 138 aa, Homo sapiens
MNCWHESETLLGLQFWVGGFHKFFTSFTRWTGGRQDKLSLLMARERAKLLALEAGESWPCSFRYGNGRSQDNSRDKEAQGKSTTHCVGQGRPLEPNVSWELESVHQISGASNSTGRIIIPWAMPLKTNPSEKTNKDMY

SEQ ID NO: 930708 - protein, 134 aa, Homo sapiens
MSQTKVIKSERKVIQTEYVKLIDEDDFPVKWKSLIKIQKWNTRNKVTLRAARTEQRALEGFCTSGTAAASAEGEGVPRACALATCRERICQVPEGERRREESEEEQGGPAFCLLWPVRARTGATAASGTEMVKQ

SEQ ID NO: 930709 - protein, 144 aa, Homo sapiens
MLSSTVIKLDFFPSISFIPPYHLELMDERGSERPIQYAKLLQINIKDLPDQMAIWEHLATNEDYDIISRIEPNFVNPQMQIEPRKPSGTNEVQNSHSKIVLPSAHKEAKIRCMSLGTEGDGWNATGKVKVKDRKYVFERRKEQL

SEQ ID NO: 930710 - protein, 139 aa, Homo sapiens
METGEIKESRSIKHKMGEKDNPGKPTCATNWILKKRKQKTWRQYCQRNNRKKCPRIGKGFKSSDSKGSLSAEQDECKKDPFLDTFTCSFRATESLAFQETQPKADQDGRSSSFQVIPLYTTCEGKLTMGRKEGMFKGHR

SEQ ID NO: 930711 - protein, 137 aa, Homo sapiens
MTFYQTLLLLIGFCEWEATRLAFGYIASGLIRKAEEDLAQTQRREGDVKMGQKEISRNTDLEYWSEAATSQGMPDPVRTWKMQGMDALVQNLKPLSTPTGVSLSGSYKIKQLLLTVFNKCLGGKRELSTYKKEEIQH

SEQ ID NO: 930712 - protein, 145 aa, Homo sapiens
MRIATCSWSASVCTAMRPQVASMCPTLSSWIWSPAPGTLVCSGSFVQILRLDNFIFHQSGAGNNWANGHYAEGAELVDSVLDIVRREAESCDCLQDFQLTHSLGAGTGPKRGTPLISKIPEKYPDRILNKFSVPLRKVSDMGVEP

SEQ ID NO: 930713 - protein, 171 aa, Homo sapiens
MCRCGETLDGLTRKPGETLARSHCIFSDDSWRASPAQLLPLSQPIQLAGDSTALSSIKCSTGAVFPVASHKRQSPTTRGPPVLRSCGMDSRALSLRASPKRTAGACPVHIKGKCEDFLRIEECKTNNDNEVIIERIKKVQESFKEKSVQQTFDKIDQNNKKTVRNTLLRND

SEQ ID NO: 930714 - protein, 174 aa, Homo sapiens
MCRIHVRYWGYEEKSNRIPSPERRQTKKLMVETANVESCSGCHRSTYRTEARAVKTILGGSNYSHNSQEAKQGKQRKKGPYRACSWWSRHYERVSRYHHGHLSRCLNPETLSRRHKLTVKSNIGDPKTQIRGASESKRELAVIPSRYEREMATMVSLGIALEYGHTTMNVADLV

SEQ ID NO: 930715 - protein, 124 aa, Homo sapiens
MLLTFHKSPIGVWYPHQLTLWLKPIGQFVEVFEHLLQRIPDLSKFGCETSQPTKNELLGPTYLGINHPRRKRSGGNLRPECQASEPKLSHHIPCDLHIHIQMAHGKQRENNSMWKLSKRSGPND

SEQ ID NO: 930716 - protein, 158 aa, Homo sapiens
MESSGLKIEENNIGLCLISTTFQKTNAAFVAHWILSPQNAGVNHEKEAQVAPGKDVITPYLQSLVHSAKDGVLCPTAMKIKAHRQFEWIDNPEGGAPWELEELGTWLQLSSKDVWMNYGNMHEPHQGLATHTNFPRVKPLLLYLYPPNLMQNFSLVGL

SEQ ID NO: 930717 - protein, 139 aa, Homo sapiens
MSCFQGRNLYSSASANANENRLMFISLNQLKLGVYIVRKAGKQELRRGKEEIMMDEESGVSLPVYSYLITFSSLPERGIQVNPDILQTLKLSYIQNSRLLLSPFITKCPKLKAFSCFLIATTTTITISITVRNVISTYY

SEQ ID NO: 930718 - protein, 155 aa, Homo sapiens
MSNKRLAIRKQAYYESIYLIYWFDGLGFRPVGEVSLGRNQFWLKQAHQGCLTVGLELKTFPTVPSIATVPVLKETSHKQTGQAADPLGVEEWEQFSGHWVDVPEGTVAASVPLCFMQEVNPTQAAVSPTQIPHTCLRCTKCWDTGVVHLTPTLRL

SEQ ID NO: 930719 - protein, 153 aa, Homo sapiens
MIQLAFVISVTTVIVSVSLKILVLRMVVLSTRGYSRVLLQFKLVLSYGYFGLLMSRGRQSSEGVTISVGGQLRSAGGGRAAAVQWGWGGKCLSSGDLLKHLLVLCCPVLMLNGKKMSKYMAPVLKTHHLTHERKTPSLKHTYLGVVTTIGNQA

SEQ ID NO: 930720 - protein, 140 aa, Homo sapiens
MQVALPLGPYDSADSMVLEVSVADRDTVWSLWQAPIGESQQRPLGVLSKALPSSAGNYSPFERQLLACYQALVETEHLTMGHQVTMEPELPIITNLAIKWVMHSSILSSNGSGVYMIRLEQVLKAQGVKQAVPDVPYPIS

SEQ ID NO: 930721 - protein, 184 aa, Homo sapiens
MRILIFFLSFPKMPLFYAVLTTVEKPVSVLGNIVIQPLSYIVSHYTRVSVPLLETCISPAANQGPAPPHSLTADDQHAPPGPIQPFSCGIYYLKGPFHLLIYSIKTSIFWKKKKEKEKEEEEEEEEEEEEEEEEEEEEEEEEEEEEEEEEEEEEEEEKEEEEEEEEEEEEEEEEDHLHLAVFSY

SEQ ID NO: 930722 - protein, 143 aa, Homo sapiens
MLAHSAQQVALSSQYWPGSHACQEMEEVHADWSMDGRGQALKKHHPAGQKTSRKFSLLVADSTWNSHPGPQALDHPWLEGEVSLGTHPFPTSNLSASYCHQHAICTTQTVHSEGHLQAHAEPHRQPPAKFVPELVGPQSFRVG

SEQ ID NO: 930723 - protein, 135 aa, Homo sapiens
MLSKSHVLESKTLELYLVFYCTVAEVVLKPQNAVLPTFPFSFQRQRSFTLWPEPLLAHGEYCQTTTAVPLSPKGSSYLSIAAGYSGPKGSSLASGKFFQDWVLPLKTAGSLLAQVHCLLATFSTRTCLKVAVLVA

SEQ ID NO: 930724 - protein, 144 aa, Homo sapiens
MASEVRKCTQIGPWVAMGGPRKAPQVPTPVGGTGSLVPSLQALPGLKVGSHQGPAPFRPGICLPPAASSLSTPIAIILVQAISTSLLDHCKNILTDVPVSLWPSDFFQCTSDYSPLSLYPYNGHWSLNKDQNCENFLQVRLCTI

SEQ ID NO: 930725 - protein, 192 aa, Homo sapiens
MNKILTLTSSSLQSDRQPADLSLYSGTIGDPGGLQGGGTKRKATFSCCSCLHSKLITQILCVIINSLGSATYFPRAAFGLLPIFAQLGWRYMVVEVEVEIKGVVLEVVVVGEVMVEVTVEMVEVVVEAMVEVVMEMVEMVIGVVEVMVEVTVEMVEVVVEEMVEVVVEEMVEVVVEVVVEMVVGGDGGGDRW

SEQ ID NO: 930726 - protein, 225 aa, Homo sapiens
MIFGEELYSGSLPLDLWAVHCHFDPRDGQMKGSGENVCSVLGKRDTGGRNRNTETQEIVDLCIYVAVIPQNWNTGKMKGLRPESEASADSQCMLIGFGENLELFSEQTRLERTNIPAPRKGWRYMVVEVEVEIKGVVLEVVVVGEVMVEVTVEMVEVVVEAMVEVVMEMVEMVIGVVEVMVEVTVEMVEVVVEEMVEVVVEEMVEVVVEVVVEMVVGGDGGGDRW

SEQ ID NO: 930727 - protein, 134 aa, Homo sapiens
MSEIPTKKHPAQSSHRIKFYYVPSIEDSRVTQTRIPVLMEPTFTMVCGEKLAIKGNAHTSLTFDGEADILSLGKRNPWFIALANNKNVEKSSGKAVAIGIFNINYVKRSRVLLSVDDHTNSSQVSTSSHQCRTR

SEQ ID NO: 930728 - protein, 242 aa, Homo sapiens
MVVDAVMTCDDLLQLKMIGIKKIKVHTVEDYQAIVDAEWNILYDKLERIYHFGAKVVLSELPTGDVAAQYFADRNMFCAGQVPEENLKRTMMACGGSIQTSTNAFLADVLGRRQVFEETLIKGERYNFFTGCLKAKTGTFILHGGSEQFIEETERSLCDAIMIIRRAIGNESVVAGGRAIEREFSKYLQDSSKTIPGKQQLLIGAYAKALEIVSFQLYNNAGFGATEILNKLQAWHSQGHVI

SEQ ID NO: 930729 - protein, 251 aa, Homo sapiens
MVQDSAVARADCQELGGKFEAKIQENAQRVGQLDMRATLTRHVDEMKELCSELDETFHQISKMEPEMEICLALKEQVLGWDSLATRVAALEQATSGPWLGAPMAGRALGAGDHLGPEEAVLNLGKLETVPSRKRKQKQKGPEVPRKRDRKEAEPLPDTHIKGPVPDALNTELWQAGSPVAFYASFSERTAALQTWKFNTSYIDTDSSNFPEHGYYQAGVWALAKDGLQIILLVYLFPGQLLRESVVYVVSV

SEQ ID NO: 930730 - protein, 117 aa, Homo sapiens
MSWGGENLGMVGNEGREGEPEKGRGRKQGGPENKEKPPPGKWEEDDTGTALHSTNSQSPALCLVRNAGPTPSSLTVFGVTHSSGGWNIHENSWKKDRDSQNSGASNFYTKYGHSQNC

SEQ ID NO: 930731 - protein, 247 aa, Homo sapiens
MQITATRRCHLTPSRMAVIIITVDKRPFLHYDCVSHKAKAFASLGKKVNVTKAWEEQTETLRDMVDFLKEQLPDSPMRPLIHSDKMKETITNQEKLAKLQAQVCIGGKGPACRKKKVVHRTATAEDKNFQFSLKKLGVNNISGIEEVNMFTNQGTVIHFNNPEVQTSLAGNTFTITGHAKTKQLTEMLPSILIQLGVDSLASLRRLAEALPKQSVDGTAPFATGEDDDDEVPDLVENFYEAFKDEAN

SEQ ID NO: 930732 - protein, 152 aa, Homo sapiens
MTSPSSLSSDLNHVKSFSSLRKKINVTRAWKAQNPVLKKVVDMLTEQLLDIQLENDTPRDKFKMVQDRREQTVVGWRQLLISCSNINPRGPEARTGYGSESKSRRLEVGQGGGTGFVKTRADLFPRGQNPSPCRPGCLVSGKVMDIVVDLGI

SEQ ID NO: 930733 - protein, 199 aa, Homo sapiens
MNSRTIITGSKYLQNVNITLCILFRPVSSQLPRIFAITGEDYDERVLTSIMTEILKSVVARFDAGELITQRELVSRQVSDDLTEQAAIFGLILDNVSWTHLAFKKLFTEAVEAKQVAQQEAERARIVEKAEQQKKVAIISTEGDSKEAELIANELATSGDSLMELSKLEAAEDIAHQLSGSRNITYLPAGRSVLLQLPQ

SEQ ID NO: 930734 - protein, 201 aa, Homo sapiens
MTFFRFALFRPHLVLTGAPRLVPGKHWEVAVPMQCLFCLYWHSCQPARFVKFFGPGSDTSSLCPQELQLPEGLLDLQINDTGNIRPFMDTQPPFPGTEAIVAPLYSATTPTVLRGPHSAFQRVRPELLPVGEWFTIGPWSLQNHSNFCRSENDCSQPEGACFPFCHDCKFPEASPVMRNCESVKPISFTNYPVSGSIFTAV

SEQ ID NO: 930735 - protein, 134 aa, Homo sapiens
MHKVKHAQDAMCTGWGMNSMPHAQDATYTGCRMHRMPHAQDTARTGYRTHRMPHAQDAARTGCRTHRMPHAQVACSAAGKEQPRTHILCSHSSGHSSTTGLRSSHADSGHSPPKDIAGQMENTSFPSVSMPAVS

SEQ ID NO: 930736 - protein, 172 aa, Homo sapiens [sequence omitted]

SEQ ID NO: 930737 - protein, 160 aa, Homo sapiens
MSFPPGFQSTHWVGAWALEPDNLALLLNGDLGQVFQHLHRRSTSTSRQGKVITIVPTSWNQCKDYEVNTFRDLRTALGKQYEDCDFEKIPKWSCVLSRLPARLLRIENLLWHASMGQYLDLGIKYHQFLAFNQTHTISSSKSQVLAWHPAKCHLARTQLN

SEQ ID NO: 930738 - protein, 165 aa, Homo sapiens
MSPQFMSCSLEKGTFVSLSVTNYAGFSRTVLVLAQKVSLPRKPFSPGKPGWWVALEHMDLKQPHLCTSAAVSHRRLFRCELNSISYAHQTPATYGKPSKWPVKPLLKACVEKRLERGPNGGDREDHSGISGCMQQCRVKSEAFLESGHVARLVIPVVDLSQNAKR

SEQ ID NO: 930739 - protein, 159 aa, Homo sapiens
MGYFSTGILHLHVLRCALCTETLHPCVGSYLGVTLVLTFIGTKPDQQRNFIQEALDPKQLTKMFGRHRNNSFLLPFPFLLLSPSLLHMCEQVSASMFSGHISFMVIVGNKAWIVTIGTVKAPAPGPLLTLTPHGLCDLGQFIHATENGDNNGTYSYDCF

SEQ ID NO: 930740 - protein, 157 aa, Homo sapiens
MCSLLVSVSHFGESLIQSKAGTLFNYMKAERGEEAVEENFEASRGGFMRFKETSRLHNIKLQGEVTSADTEAASYPEDLAQITDEDEKLLLMDKQRKWFLEMAPTPAEDAVNTIETTTKDIEYYINLVDTAAADFDKINSNFKRNYSVGKRLSNSIT

SEQ ID NO: 930741 - protein, 139 aa, Homo sapiens
MAPPTCLSNTYRPSSAICGDSIREHPALHGSAFSSFEVTPPLPPISPTQMSSTLCCLLGWPGKALLLYLSREAHTRQKPDSGVSMKATTQDFAMKVLISSEIAPSPPAWGPALLLLADIAGHCSLSWGLVSLGVFDLGQ

SEQ ID NO: 930742 - protein, 137 aa, Homo sapiens
MNASKETGTSVLQPKKLHSANHLNELGSDSFPELQIVNSLSMRLLAENPAGPHRTSDLWQSKFSGKGIVITGDDSSMHVIAPEDPPVGQDVEVEDSDIDDPDPGHVTGLSIHSSLTQSLTHPEQLPVLQAPFMVSAL

SEQ ID NO: 930743 - protein, 135 aa, Homo sapiens
MIVSTVISLPMSAGAAAANYAYWAYVPFLPLIRAVTWVDNSIEVYVNNSAWVPGPTDDRCPAQPKEEGMMMIISTGYCYPPICLGRAPGCLMPTTQNWLVEVPTVSATSGFTYHRVSGMSLRPQVNYLQDPSYQR

SEQ ID NO: 930744 - protein, 146 aa, Homo sapiens
MRAVFSTSCKAVLTSITPPAAMPSLAMARVKNFCLDLRDLLLPLPSQPIVSFTNIDFYNIDFSYCIDFSYCTDFSYCFDIPSKDSHEIAFKLSARGCHLKDHLTLDFTSKFTVVVVHRENKEVIIKREAVSKVKVKSCQSQRRLCN

SEQ ID NO: 930745 - protein, 141 aa, Homo sapiens
MLWHAPGPHYPWGLSSRLAQYSFHMAQGSKKAARPLIAQSQKLHYVPVTSTTFCWLKQVTGPAQIQEEWKQREKWQRPICKRASPVKYKPWLHTCHGYIPQQKPWVAQRPIFTFFRALSWGDIPRHRLSSSAERPRQQPIH

SEQ ID NO: 930746 - protein, 175 aa, Homo sapiens
MIRAALLEPQPPKLKQSSHLSPQGAGTTGAGPHTPLTFLYFFRLELLQAALPPQPPKVLVRQPGGKDSLAESPFDLSTGRNAPCGGALGNLRHLQWGGAWPLLFLGGTWDSVYQAGSTLALGRVSVSLFFFLPNKFHSHPSRHLTSKGEGVYEQGVGHKDHMLQRAKRRTKIICF

SEQ ID NO: 930747 - protein, 126 aa, Homo sapiens
MPFLCWLYFFLIPTDVGVPSPLFTSYLLLTAFTIAVVWTDLKSCQQSDCLSSSSKFSPRQFHLMLLKASPVHHALKPFIPPSPTSALPSYSPVYVKSTTSSLPGLKLWKDFIVNDVEGTERFCIAG

SEQ ID NO: 930748 - protein, 149 aa, Homo sapiens
MRILIPASESTQTEYKGWSHLMARDDSVIWFGSVSPPKSHGSEEDKKMKESLELPRDLLNYDHNAYSEMNSEVQAEEISDGEEELIENWSKSHSCYALAKRLAALCPCSMDLWNFELERDDLGYLVEEISKQQSIQDVARQAACSGTCL

SEQ ID NO: 930749 - protein, 142 aa, Homo sapiens
MVSGYKPRKSHLQEHRTQGTIRPSAQGLRALKNLPSSPEQALQYVGKWVKILMLEILWTTSCHLYIKNEEGKNRIQGQWLEHLCSQGFSLICGPKSISVIKAERRFTSGVVQCGLPCASLGFRVPRYEPVEELVGVRWVFTQ

SEQ ID NO: 930750 - protein, 233 aa, Homo sapiens
MTIGEALRVWSCVCASECPIPTGAERSRGRGVRCKERNGCDEDKEQWVAKSSVCEACSCWSLNRNQTRADSPGSGPPVSTHPTPIQETLNLVMWTGTIAHSSAGCTGSIVPASASGKAIGSKPIMAEGKGGAGASHGESSSWRENGGGGGGCQASFTLEFCMPAGLTPREATKSYGLHPLELEQQPELYLNPLEPRMGLEHPECGNSVQRLHRAARPWASPTQPFFPPTPMGL

SEQ ID NO: 930751 - protein, 311 aa, Homo sapiens
MDDAITALVVVDNCSSMRKAPQAVFPSIVGHPRHQGVMVGMGQKDSYVGKEAQSKRGILTLKYPIKHGNVTNWDNMEKIWHHTYNEVRVTAEEHPVLLTEAPLNPKLNHEKTTQFIMFETFNTPAMDVAIQAVLSLYASGEDPHPAQLQLHHHAEQEIMCDIKEKLCYVALEFEQEMASAASSSSLEKSYELPDDQVITIDNERFRCPEALFQPSFLGMESCGIHDTTFNSIMKCDVDNHKDLYANTVLSGGTNMYPGITDRMQKEITTLAPSTMKIKIIAPPQCKHSVWIGYSILASTSTFQQMWISKQE

SEQ ID NO: 930752 - protein, 161 aa, Homo sapiens
MMPHGHEKGLRGKVGFPKAFAFSHLITNPTNFMRSNSKCSTYPHLSIVRHSPQDCLGDGGPVLALLILRTSLKPPTPYPQRFSTPFQEPPFHWKYTSLKPLQSFPGPAAPSLSSATTRHYSGTSEAVTQETSRWHMGTRLHTPVAQDKEMGEEGFRARPAG

SEQ ID NO: 930753 - protein, 141 aa, Homo sapiens
MVNIECQLDWIEGYKVLILGVSVRVLPKEINIGVSGLGKAHPPLIWWAPSNQLPANIKQAEKREKNGLFVHVDESFFRIQMAVHCTVPRFVQCSDPTDIFTDMHAVVAKKGGGENIGFEAGQTPLDSQITYWLCDCLFCHL

SEQ ID NO: 930754 - protein, 144 aa, Homo sapiens
MHAVFQSSVYPAMCSSAGAQKLLPDPYSRFQGNGGKAAAAALVDTFPGPRGDLLNPGSLENGQHHVSPLAASASALVSLIDRNDSQGRVSALQEGRSPWPACPGSQETPRPPSGAGVPASEERQTALCVVTTGWDWQLSAPHRL

SEQ ID NO: 930755 - protein, 145 aa, Homo sapiens
MPEPPTHSMGSCAARASPTSTTPCSTAPSPIDHPRAEECELTAQDWQAAPPAAPVRDPLGEASWAPESGGDLKVCECTNRHSVSSCSGGALENLCVHTLYLANLMGTWRTFVSSSGIVNAPISALSKQATWLYQSAGCGWGQIRE

SEQ ID NO: 930756 - protein, 144 aa, Homo sapiens
MAAQVGAGFLQGLAPTWLSPSWVGSGGCHRSRANPVGAKAASGALTITEASESFVSWQGASNHESIWTCWSISTWSFHGKHPLTRGLVRLIHYHENSTGKTGLHDSITAPPDPSHNTWEFWQIHFKLRFGWGHSQTISLENFDL

SEQ ID NO: 930757 - protein, 467 aa, Homo sapiens
MVWKLKECSCIVVVIPITSSSSSSPPPHHHPHRYLHPHLLLLIIILIISIFITILFLLPIILNIILITILLLILIIIFITILFLLPIILNIILITILLLLILINPSSFFFSPSLSSSIIFITILFLLPIILITIFIPISSSSPSSSSSSSPLSSSSLSSSPLSFSSSSPSSLPLIIFITILLLLTIILTVIFTTILLHPPIILVIIFITMILLLLIIFSITIILLPIMLIIIFITMVLLLLTIIFTIISFSIPLLFTIILTIISITIILLLLPIIFIISITVFLLLPIILTIIFIPVFIFLLPIILLISITIPLLLIIILTSSSSLSSSSSSSSSSLSPSPSSSPSFSPSSSSLLSSSSPSSSSMIFITILLLPTILIIIFITIILLLPIILIISNTIILLLPIIFIIFITITLFLLTIILIVFITFLLMIFITIIILILPLLTIILIINHLHHHHYPPHHKHLLST

SEQ ID NO: 930758 - protein, 134 aa, Homo sapiens
MPDIATPPRSCQARSQEAASLLLSRTPPACGSHLARLRRGSVLVLAPSKNPLLENSGEQGEVVSSESLKAKKWLKKMHSSRLGAWQGAEGGSSSCHPEPPASAREPWHPASPGSEKYTWSESQVYLNSWEMSKC

SEQ ID NO: 930759 - protein, 178 aa, Homo sapiens
MPQQELFEVFCFYIKIRRDERSTPKVYPEPDTPRTGCSVAGTAHLSHVDPSRHLTTLLLQPFPSVVYTNMETSSPLKHSTQAFQWPHSEKQPEASGLCWRRGGLCPIHPCGITSLRMPVPLQCPTSPHPWGLLGMAFLLSSAGCSPPDGPWFSSAPPVSTHSHLAGPPPCPHLTFQPS

SEQ ID NO: 930760 - protein, 145 aa, Homo sapiens
MRGARSLSSVIWYNRINPCMVGPSEQPAGCTEPPRNTQNGNTESYRDVIQVGAGKGLPAEVYTQARGENALRGTKPRTQANAGNETAFPGQNAGALQQNQGLGSSVTSGRKAMEREQGLSVSRDGTGTGSFHVGNAEPALPTASG

SEQ ID NO: 930761 - protein, 135 aa, Homo sapiens
MESMCCCEGQMENECINSTVKPRPIRTWNHSHHWNLQSQRKPHHGGSEVKREEARLKGKLGGGEPLTFHTEKYGRWAVPLTLYTEKYGRWAVLRRVQASPSTVKLRSSTATPGCLPGLLDSEHSTTSLEFLRVLP

SEQ ID NO: 930762 - protein, 143 aa, Homo sapiens
MTQRSVPCREPGSGLLLLLAVQDQGVSRALSEDHEGICPRPLLESQGNDSVNVRIIEVKSVPSAMMGPTVPARLCSNVLKYTSSLALFLNSFYDGSSCPATSWSGLVWYVGHDSIASIPFFPEQSPLSQVQLVSSMNLTFTVF

SEQ ID NO: 930763 - protein, 205 aa, Homo sapiens
MFTAEDPIVFTAVDPNLTTKGPHIFAFTDPRCLSHHSPSPTAGAALASVTVGAALASVTVGAALASVTVGAALASVTVGAALASVTVGAALASVTVGAALASVTVGAALASVTVGAVASNPGQPLSMPTNVPPTSSPCTTITCMLTLIQLPPPALGLAFLEAITTRQLDLDVMLKPPQPPWISPTAFGTEGHAMASVIDPSCLSR

SEQ ID NO: 930764 - protein, 360 aa, Homo sapiens
MPSSCSRSGSRPASGCAWAWSPQVALGAGSRCRRFSVPPVLGAAGSRCRRFSVPTVLGAGSQCRFSVLPVLGAGSRCCRFSVLPILGADGSRCCRFSVPVLGAAGSRCCRFLVPVLGAAGSRCRFSVLPVLGAADSRCRRFSVPPVLGAGSRCRFSVLPVLGAGSRCCRFSVLPVLGAAGSRCCRFSVLTVLGAGSRCRFSVLPVLGAGSRCCRFSVPPVLGAAGSRCCRFSVLTVLGAASSRCCPRPPGRTHHPLCSARSDPVPAGPAPQRPGTSPIQVPKYEGNGGQGQERVGFRYLSEMNGGSVDDSGFENSRCPHLLALTPQPPAGSCAEPGDSLGWVENVSCHPEPPTNATFYVC

SEQ ID NO: 930765 - protein, 125 aa, Homo sapiens
MRSTGHGLDELGGDECGGCDSGDDQARGGKVFLDPPRGIRRVGTPQPRAAEGLEPRSFHSTVTTTGTSLNEINVFVCVAHCTLRTQNSGWHIINTQQTLINWKPGSDYSNGSCTGPTGFGGWKNL

SEQ ID NO: 930766 - protein, 133 aa, Homo sapiens
MEHWHCQPGTVALDDRDYTRIMRAAILGPREKAQHLIGESVSCLRAALCFSLQHCGPSIPKFIAFCEPRVREYFHHWPWCMKATLPTCHYHQSGFLSDGVRETPGPDWKKLISAGEMSAGDSTGPLSKKRLHS

SEQ ID NO: 930767 - protein, 140 aa, Homo sapiens
MLTTDATSTTLTTDLASTTLTTDATSTTLTTDLASTTLTTDATSTTLTTDLASTTLTTDATSTTLTTDLASTTLTTDATSTTLTTDLASTTLTTDAASTMLITNTASMTEADAPHQEKRSRHQKVVWGLWDSSTAFSVFL

SEQ ID NO: 930768 - protein, 136 aa, Homo sapiens
MLEALWPLGRTRGKTGTSFFWSSYCDWTLLAGASTCSWNELISKIIAAPTLFSTNIKVFSNLSPILVIHSVSPLSEITLTICLGELSVSPRGCTLYTYKVLFISLVPGSSCLKQYYACSRSSAAIQVNERYEGVTE

SEQ ID NO: 930769 - protein, 121 aa, Homo sapiens
MVLCLFSKIRSSLLSQIREKYTEKKCFAVLCPLRVCIQNYKKSLCSFSCVLTELDSCPEKKAGTGHLHHPLFLHFPTFLLNVFVSMVTPNFTLRCSSDEKDCRLPTGVSLPHMACWSLALG

SEQ ID NO: 930770 - protein, 153 aa, Homo sapiens
MGQKLSGRPCSGHCECGVWLCCDHTTRLRAAWSLHPRLTLARLITICTQSWVDRPSGPPCVPWTDLQPGVWTAACSLQQAALPSSAGLWLLRPQLWAMSRAGSFGRPPLVHPPRDPRCQEGGRTEVKSQLWRFRCYVPDFLTMLLPDVLNSCL

SEQ ID NO: 930771 - protein, 356 aa, Homo sapiens
MRCGEEAFLPSLGSAGVGRGGTGLVGRGGTGLVGRGGMDLVGRGGMGLVGRGGMGLVGRGGTGLVGRGGTGLVGRGGMDLVGRGGTGLVGRGGTGLVRRGGTDLVGRGGTGLVRRGGMGLVGRGGMGLVGRGGTGLVGRGGTDLVGRGGTGLVGRGGTDLVGRGGTGLVGRGGTDLVGRGGTDLVGRGGMDLVGRGGTGLVGRGGTDLVGRGGTGLVGRGGTDLVGRGGMGLVGRGGTDFVGRGGTGLVGRGGTGLVGRGGMGLPSGPGKPHLKCSRLSRADMASPPLCTLALGPADAARGAADTLGQRAFPRRMETAWTETAQGQQSQQGSCSPCSVTLNGTQAFLLRSGVANSC

SEQ ID NO: 930772 - protein, 152 aa, Homo sapiens
MILTGRFSFRWQEEKEIGPNTLKSKGNSLSPVAQTAASFQVLRFAYAEDVTTREGGWGQGPRSRAPSLSRFSCPNTRARVVTTDIYVLVFLGVGRRRPLAGVTDQQIRQPSAGSGGGRLEAHGSHMYPNRRTGEKNEDYSMKSKKNRKSGDN

SEQ ID NO: 930773 - protein, 146 aa, Homo sapiens
MEFSDAQKSQLQAFPPSMEFSDARKSQLQAFPPSMEFSDARKSQLQAFPRSAEFSDARKSQLQAFPPSVEFSDARKSQLQAFPPSVEFSDARKSQLQAFPPSVEFSDARKSQLQAFPLSVEFSDAQKSQLQAFPPSMEFGDITLRA

SEQ ID NO: 930774 - protein, 145 aa, Homo sapiens
MPEPPTHSMGSCAARASPTSTTPCSTAPSPIDHPRAEECERTAQDWQAAPPAAPVWDPLGEASWAPESGGDLKVCECTNRHSVSSCSGGALENLCVHTLYLANLMGTWRTFVSSSGIVNAPISALSKQATWLYQSAGCGWGQIRE

SEQ ID NO: 930775 - protein, 200 aa, Homo sapiens
MLRRPLLPLPPLSANSSILWLHSGEPVPGTLARLEARAPGNSQSLSAGREHPITRASGPVGPSPLGHSMGSTHSLEVLFRFHAADKNMPETGRKKKFNWTYSSSWLGSLRIMAGGERHFLHGGSKRKMRKKQKQKPLINPLGLVRLIHYHENSTGKTGLHDSITAPPDPSHNTWEFWQIHFKLRFGWGHSQTISLENFDL

SEQ ID NO: 930776 - protein, 486 aa, Homo sapiens
MPALRLQTAAQLDGTWKSMVWKLKECSCIVVVIPITSSFSSSPPPHHHPHRYLHPHLLLLIIILIIIIFITILFLLPIILNIILITILLLILIIIFITILFLLPIILNIILITILLLLILINPSSFFFSPSLSSSIIFITILFLLPIILITIFIPISSSSPSSSSSSSPLSSSSLSSSPLSFSSSSPSSLPLIIFITILLLLTIILTVIFTTILLHPPIILVIIFITMILLLLIIFSITIILLPIMLIIIFITMVLLLLTIIFTIISFSIPLLFTIILTIISITIILLLLPIIFIISITVFLLLPIILTIIFIPVFIFLLPIILLLISITIPLLLIIILTSSSSLSSSSSSSSSSLSPSPSSSPSFSPSSSSLLSSSSPSSSSMIFITILLLPTILIIIFITIILLLPIILIISNTIILLLPIIFIIFITITLFLLTIILIVFITFLLMIFITIIILILPLLTIILIINHLHHHHYPPHHKHLLST

SEQ ID NO: 930777 - protein, 151 aa, Homo sapiens
MHLCSPAQPLTHLYARHCHTAQVASSYGNTKAVSVSCTNQQPWKAAAMEDAGISSHIQSKEKTKPTAEASLTCALGQSRPQALQLQGDRPARSGIWKELRKRSPAGSRKQERHQGPGDGIGICSILQGRKPQAVHVRLLAKGLRGGHEVTH

SEQ ID NO: 930778 - protein, 148 aa, Homo sapiens
MGVLLPFSNTFIKFNPDSGQEKHMWAELRNQGKERNGIFASLSDEMQTDVNSAVAGISEACRPVPGSASSHPGSADVLVFRCRGLRLVQGPWHTPQNHMVPMARECDWAVLSLGKGPTVTVTVRHLQGPFNTPRGNRVQCLLTQRPAF

SEQ ID NO: 930779 - protein, 143 aa, Homo sapiens
MGLRLFGTQAVCTWALWDSGCVDLGYMGLGLCGTRAVWTWAVWTRAVWDLGCEVLRFCGTQAVWTQAPWIRAAWTQAVWTRAVWDLDCVRLRLCLLPVTQLCSFRSLSLPQLACGHSQARCKNTPLHLSRRNPVERGKSQSLL

SEQ ID NO: 930780 - protein, 134 aa, Homo sapiens
MGVTQFSRCCLSQLRLARKGNSLTPCTSQVVWRTVQRLTFHSSDITIIHMFDWAKSSSSPNELFHSFSHLCLASDWDGTCVRCFLLPGRLRHFKFNILAHKLAPNKQINMYSNICNTNIMHIFFKSNFLKYFPN

SEQ ID NO: 930781 - protein, 146 aa, Homo sapiens
MATKAKIHKSDLIKLKSFLTKIFSFYFLESFKLKHCEDQKLKRHVDCRTYISLLKYAMCLFQNHMYKLTTISEWDKKLHGNSLYREEGPSLNHKWLQSVEGECRKQNEQTENCQKWRLEETARHLRGLAGKNIEELLIFIAFIHVY

SEQ ID NO: 930782 - protein, 140 aa, Homo sapiens
MKAWTAAVSVTAQFEKHADLKRVLGQDLLKPKIQAQLTSINIKKDTFRLTKGIFVIMRHQHDRQQALIEIQVFYPKIYFFDIVLNGPAKLSLLGKNLHSVENLCTFLSQTRNICNLFSLMPATWRLHLHNKNLGLYTLLS

SEQ ID NO: 930783 - protein, 146 aa, Homo sapiens
MGSPAAPLLTYKCTSVYGLNFRLFSGGSQLFIFSLYLPSEHQTYLFIQLPNLGFYCISILREMQIKLFKTESYVSPTSWFSAPFHCRQQSSQATLGSPSADHNLECQNPKGAKSLIFKIPNVKYPKNHNPKQTVTILYFKILEVEF

SEQ ID NO: 930784 - protein, 147 aa, Homo sapiens
MYYTTLITTVLKSVFPFCGLNPPTLFSSSRLAYLYILESTCQFLPKMGDFDLDWIKSVDKFGEISLITTLRFQMTNTIYTPIYLDFLSFCLFPTQRYYPFIILSSSLPPLETDNILTIVAEKHDSLTSPGHQWELNCLNMNDGTEGA

SEQ ID NO: 930785 - protein, 158 aa, Homo sapiens
MKAGIGSICLEVSLGHPGDSSEHATTKHTELLLGYFKRPASSLGLGELEQGCITRLTDKYKVKPQMLFCGDLALQNQKTIKKSPNFAIPQWDPLSKPNFHCQLSLYQTTMVCRGILSGIMDIGVSEVGRMERGVRDEKLPIKYNVHYLGDGYSKSFCF

SEQ ID NO: 930786 - protein, 143 aa, Homo sapiens
MKAAKRGAVPNKATGEELPKSMGAHLLHQCDLDVRHGVKRDHFGTLRFNDCSIGFQTCMVPVTPWFWPFSPIWNGCTYLMPIPPLYLERDCGLDRKSEGNILQSQQVEDEVLPKGVLPQAQGTIFSSGNLPGFEIRSVCRIKN

SEQ ID NO: 930787 - protein, 183 aa, Homo sapiens
MNVVSLYVQEKLKNLSLFAKTYQKLGSQRSSIALRSLLGGALLKRQLKMGKHLWNWVTGRGWNSLEGSVEDRKMWENLELLRDLLNGSDKNADNDMNNEMQVEVVSNGDEELVENWSKGDSCYVLAKRLVAFCPCPRDLWNFKLERDDLGYLVEEMSKQQSIQDVTWVLLKTFSFTRGAEYKS

SEQ ID NO: 930788 - protein, 174 aa, Homo sapiens
MITLEYLKNFLFQSGADISSAFPIYCMNMYPLGPLQKHGTRSRNCQNQLCPNSGKSQRFTETKHNLNQEKVNLKIVKKHCDILTFSFSKLSQLCGTPEDNSLHSKCETMILDPKGSRAYLIHKELSGSFLTHQEILEKLMKGVHLCFTELGALPVWKGSRLCSKHIVKWGETHS

SEQ ID NO: 930789 - protein, 134 aa, Homo sapiens
MLHTGLPSILLNIQALSLLSSPMHFHWPSSTSPPEELHPTLQEPDIFSGLCCLQGWEWATGGKGGGRDNSEAATAVTQMRGEGGVDKSSGTDDHLLPQRIFTCPAVLVSLEVSYNFQAGQISIHTPAPLHWKSS

SEQ ID NO: 930790 - protein, 136 aa, Homo sapiens
MVSCPNNVSFTEEDASRGPNHIKEWRIATNTNSHDLDPCCIQTIGSSRLWKKEHRSLTQREKRFGDFSQQQTLKVGKVNIYKVMTKAFKQGDSYHLLSRKLSLEVNEMEATSCKRDLPELWIPFPEKRFLIAQKVW

SEQ ID NO: 930791 - protein, 134 aa, Homo sapiens
MPREHAVGDWPTEVALLQSTDRWGLWLYHHLGLPLPLDFLLVAGQSPGTVEPPLASGKLEQKAGKQGTLPIPSSPISHSISVVWGGRKEVLKERTRCRKEEERSRWAVQRDGSEAPVAPRPFKVNVINHVPCTR

SEQ ID NO: 930792 - protein, 147 aa, Homo sapiens
MVSSQQVCLYFQPAQQQTTNNLRAQIQEAAREEDPALKLKPHWAGSSDAWYMTGTTTQIQKTVWLQMHLQIWIKNKVPGWTHQAYILEGFLSLSLWKCSGLLKIEVYYGNADRPLNRALYLQHCNYASIEKLQRKHDFLVQINHAWL

SEQ ID NO: 930793 - protein, 134 aa, Homo sapiens
MAVSTLEEGFQGGRKHIGSLVAPTAQPCPEQRGCWLGWLISMELMGLLWPSTPPSSGPNLLLPLCIWAVATAKEARVRLLSPSFHQIPQAQNHMGHMEEPPLTTLRTSDVDFTGKGAKTIPRGKDHSSLFKPVF

SEQ ID NO: 930794 - protein, 163 aa, Homo sapiens
MPLAGLCVLPAFSCLTDGHVALQKVFIDTQEVCSILQLERDREYADQATHFIGKVGLGAVTSEVSIAAQQITPRLSGLKRHHSFVISHSFCVPGILEQLSWSAPLYSLQLDMPVARVILKAVFGSREGKLEWLGPLGTGTGDSRLIVFFMASIKILRESDKGV

SEQ ID NO: 930795 - protein, 125 aa, Homo sapiens
MDNLASWNPSLANYLVISLFIPLCSFYHCLVQVPITPPGIPAFIANQPHCQRIGFISLSCLRTLMATYIGLEVKHLAIILTLLASVGALGPCVCSSQFEFVLSDLPDYNLLVCGFPLSNMVSDTK

SEQ ID NO: 930796 - protein, 133 aa, Homo sapiens
MSVDHCPEQERECHQCPRNAPVSLLDTSPTVLKGPPDSYEDDEDDDGGRGGEGEERKGEGREGEERGVGEEEGGGEGGGGDKEDDVGDDKDVGGDDNVDDDDERGRGEGKKEQEKRGKMMSVAVMMLLTMMIK

SEQ ID NO: 930797 - protein, 671 aa, Homo sapiens
MSPGCRAPPYLGRVGVADEGRTDTAYRVVADHIRTLSVCISDGIFPGMSGPPLVLRRILRRAVRFSMEILKAPPGFLGSLVPVVVETLGDAYPELQRNSAQIANLVSEDEAAFLASLERAEVAWSLSLCGDLGLPLDMVELMLEEKGVQLDSAGLERLAQEEAQHRARQAEPVQKQGLWLDVHALGELQRQGVPPTDDSPKYNYSLRPSGSYEFGTCEAQVLQLYTEDGTAVASVGKGQRCGLLLDRTNFYAEQGGQASDRGYLVRAGQEDVLFPVARAQVCGGFILHEAVAPECLRLGDQVQLHVDEAWRLGCMAKHTATHLLNWALRQTLGPGTEQQGSHLNPEQLRLDVTTQTPLTPEQLRAVENTVQEAVGQDEAVYMEEVPLALTAQVPGLRSLDEVYPDPVRVVSVGVPVAHALDPASQAALQTSVELCCGTHLLRTGAVGDLVIIGDRQLSKGTTRLLAVTGEQAQQARELGQSLAQEVKAATERLSLGSRDVAEALRLSKDIGRLIEAVETAVMPQWQRRELLATVKMLQRRANTAIRKLQMGQAAKKTQELLERHSKGPLIVDTVSAESLSVLVKVVRQLCEQAPSTSVLLLSPQPMGKVLCACQVAQGAMPTFTAEAWALAVCSHMGGKAWGSRVVAQGTGSTTDLEAALSIAQTYALSQL

SEQ ID NO: 930798 - protein, 394 aa, Homo sapiens
MRRIIAEDPEWSLAIVPLLTELCIQHIIRNFQKNPILKQMLPEHQQKVLNHLSPDLPLAVTANLIDSENYWLRCCMHRWPVCHVAHHGGSWKRMFFERHLENLLKHFIPGTTDPAVILDLLPLCRNYVRRVHVDQFLPPVQLPAQLRPGDQSDSGSEGEMEEPTVDHYQLGDLVAGLSHLEELDLVYDVKDCGMNFEWNLFLFTYRDCLSLAAAIKACHTLKIFKLTRSKVDDDKARIIIRSLLDHPVLEELDLSQNLIGDRGARGAAKLLSHSRLRVLNLANNQVRAPGAQSLAHALAHNTNLISLNLRLNCIEDEGGQALAHALQTNKCLTTLHLGGNELSEPTATLLSQVLAINTTLTSINLSCNHIGLVSHLFWACEGGCGIQLPGVLVG

SEQ ID NO: 930799 - protein, 136 aa, Homo sapiens
MCVPNAPVTHNPTIAHGHHTFSGSNWKERKTLPTGKWGPAQLPAPLNIPGTDSLALPCPRHCSRCCFDCCCPACCCLLPAWPANTSCPCCADWPAAWAPRTCERLCWAVCCSFSASDTRQTLGRPQEWTAWRGGRG

SEQ ID NO: 930800 - protein, 316 aa, Homo sapiens [sequence omitted]

SEQ ID NO: 930801 - protein, 262 aa, Homo sapiens [sequence omitted]

SEQ ID NO: 930802 - protein, 170 aa, Homo sapiens
MGHKAVETTLNVSNAFGAETAEEYTVHWWFKKLCKGYESLEDEEIVASHGKPNLHQKEFMVTVSWSAAGLIHCSFPNPGKIISSEKYTQQIDEMHRKLQCLQPALVNRKSTILLCNTQLHITQPTLQELNELGHQLLPHPLYSPNFLPTDYHFFKHLDDFLQFAGKTLPQ

SEQ ID NO: 930803 - protein, 275 aa, Homo sapiens
MLLGFLDSATFLEECTDGSLTLLGFPAPESVKLQDLYAKKPETAASGAVGLKLPVSKAQVWPIGQENLQGLGHCCPALPAASYLLAASLPPPAMAQRDTGTAWVITLEGASHEHLWHPCGVKSADAQNARIMEAWKLLPRFQRMYWKAWVCRPATGVEPLQRVFTRAVHIGAIATGALLLRPKNYRATSPKPCWRAGLPEALGANSLHQCAQGVEHGVKDYLGALTLNVCPAGFQTCMRKPLNSQQASLVMWFQSPGPLELVWYWGIREDWAVCG

SEQ ID NO: 930804 - protein, 225 aa, Homo sapiens
MVWEHIPSVIWFVISWGGEDDITRNITGGTYTPPSNIVCNSEDVHQPIILFVISRNREDDITPSITGGVQLNVILFVISRKRKNGLTANIARGVHPLVILFVILSVGEDDIIFNITGAVQPPVILLIIFSEGKDDITLNITGAVHLPVILFVISKGEKDDITPNIAKGVHQPMVLFIIFRRRKDNITPNIAGSVHIPPVILFVIPRKGEDDIHPNTLNTLFVHPL

SEQ ID NO: 930805 - protein, 145 aa, Homo sapiens
MIRQQHLLFTNIHCSAASAADTQANRMENDFDELREEGFRRSNFSELKEEVQTHCKEAKNLEKRLDEWLIRITSVEKSLNDLMELKNMAQELRDEYTSFRTFAIGKCNNGICNGVAVICDEFPPPEKLVTKENDLMLWSCASVHM

SEQ ID NO: 930806 - protein, 485 aa, Homo sapiens
MNSNNTLSPSGYYERYHKGLYAPRNMDSNITISRPAYYVQYQKRVYFHCDMGSNFTLCFPEVVYTMGDMGTNITLSLQDITNHITGSPPGYNETYHKGLYNPRDTGSNRSNITLCPQDIRRHITPSMIWGVISPSFFLDITNHITGEIPAIWGVISPYAPQNLRTISHGSVRPPRYVMSPSPLLDITNHITRMYTPRDMGCNITHFSLPGYYEPYHREVYTLQDIESNITLLSHPGKNITGGVYSPDDIGSHVIFSLMDIWNNTTGVVYTPCDIVININLSFLDIKNNITGVVYISCDIGSNIILSFFGYFEQYHGEGPFDIWSNIILFFPGYYEQYHSGMHTPCDIANNIVFSHPGYYKQYHGGCTAPVILGGVITSSFPVNITNNITEGCTPSAILRETSSTPLDIIKNITVGLYTPCVIGCNTILSPPLNIRNNITGGCTPPAILGVISSSPPINIRNNITAGVCTPYDIGSNIILSLPGYY

SEQ ID NO: 930807 - protein, 150 aa, Homo sapiens
MLTSLRPLLKLHLLNEAFSGSACRGHRNIRLLRQCQVRAAELPLFELLRVDISALHVEGGDWGTPLAAAATAGEPLLVQYWQLHAKPGRVWPGCSGFPAVPDGLSAHVAISSSLPGPPWSLSFSRVDACQFPKLYIPSCSLSIQVGCSYG

SEQ ID NO: 930808 - protein, 233 aa, Homo sapiens
MGIGDPSPHPSPRLRPDPSPTLHQTCGQTPAPPCTPPAAKPQPPPCTPPAARHQPHPAPHLRSNPSPHHAPHLRPNPTPHPAPHLWPDTSPTLLPTCGQTPAPTLHPTCGQTPAPTLHPTCGQTPAPPCSPPAAKPQPPPCTPPAAKPQPPPCTPPAARHQPHPAPHLRPNPSPHPAPHLRPNPSPHPAPHLRPDTSPHPAPHLRPDPSPTLLPTCGRTPAPTLHPNFSHASQ

SEQ ID NO: 930809 - protein, 241 aa, Homo sapiens
MTSSPDQAKPLKYTLYSTVYLTSQLGCLINPQGHEQNQPVETRELIPIPGPRSCRDRAKAIPTHSDFLGDIMIKAKGTLKALDLYWGRKMSPIDSSCLGIHLPDRSINAVKSSTISIPNQLFCKAPVFPTHQEEDKISKCILVDVYSLNVNKNFTLKDSRFPLSSDRQQTAGSGAVLTSEPKVRELSDPHSISPTGSIAFLATERLIIHCTRERRSLVIDKDVPASHLAGSGAEKPCTELV

SEQ ID NO: 930810 - protein, 216 aa, Homo sapiens
MPFSHIGAAQALSQGLCHFALSSPNSWTYSGKPNLTSYDLALPLNCQPWGIAPPNSPLNCQPWGIAPPSLPLNCQPWGIAPPSLPLNCQPWGIAPPNSPLNCQPWGIAPPSLPLNCQPWGIAPPNSPLNCQPWGIAPPSLPLNCQPWGIAPPSLPLNCQPWGIAPPSLPLNCQPWGIAPPNSPLNCQPWGIAPPSLPLNCQPWGIVPWNPPLNCQS

SEQ ID NO: 930811 - protein, 134 aa, Homo sapiens
MSSWAYCDVLVGPYYVFFQGLNNGPKANRKTSRERETKGTSYIKSQEPDEQLALHLPTICLLKEHLCWGDLTPPLISTGHRHPCTRTVNACHVGKTEGLPCTSEKQRAYHAHPNPNSLPSSPLANGWLPLSPSM

SEQ ID NO: 930812 - protein, 151 aa, Homo sapiens
MSLTVLLPDRPHAQGQMGGLVLLEHSQGLAFLRFEAGICKCTKQAHIDSWYRFPNMKAVLGIFEASKQIWEPGEGSSSGSVSRHRSHRQQASTCSAGAFFKRVQLTSASLGFPLLNCSQLLLLVVCGQSHGIYRKVVLTLFSVLTPLLGLR

SEQ ID NO: 930813 - protein, 139 aa, Homo sapiens
MWIMPLTLTHSSFLIALPLMSGAVLTAATGPIWPGPDLEGMFLPRFSHEERCSWEVFHTHSARLKTCPSIPSLDDAAGPKLTYDGVIGLHPEHLPAPHAAPQTSPPNHRMTEPHVSSHGHQRRGAANLKNVFTSRWDTA

SEQ ID NO: 930814 - protein, 155 aa, Homo sapiens
MRRWEVSLKRQLSHTVVVLFPIASRVEWKVESLTYGSCSCPWHRHSYGIPWEDITAQWEGVCYRLDLSQNPASPALGEKGACEGPGEPRIVREASVSGGRGSPEALKVQCIAKLSQGTKNTKVPNIQRASWSLIFPYFYYIFKDVIVKYTYGKVH

SEQ ID NO: 930815 - protein, 179 aa, Homo sapiens
MNLSHSRLFWMAEKTTMKEKLSSRCRPPGTAPHEVITHAHSGFRYLTPELNARRAVACRAQRRLPSEGGLWADPMSELPGRATADFVTYRSSERSSKGHPVVDDVECDAHGATGPEGLQAAVGAQALSAKRFLSTAGVAALTLPDEGNLQFLQSQCSELKHIYYDTQRPVWWLDRSTNG

SEQ ID NO: 930816 - protein, 235 aa, Homo sapiens
MKDYLLNGMAMMAMVRMMTVVMKDYLLNGMAMMVMDDDGDDEGLFIKWHGNDGDGKDDDGGDEGLFTKWHGNDGDGKDDDGDDEGLFTKWHGNDGDGKDDDGGDEGLFTKWHGNDGDGKDDDGDDEGLFTKWHGNDGDGKDDDGDDEGLFTKWHGNDGDGKDDDGGDEGLFTKWHGNDGDGKDDDGGDEGLFTKWHGNDGDGKDDDGDDEGLFTKWHGNDGDGKDDDGDDEVITY

SEQ ID NO: 930817 - protein, 477 aa, Homo sapiens
MVAIDKEEMKRKCSNIHESREDNGTDAIGHGHPSLCREDNGTDAIGHGHPSLCREDNGTDAIGHGHPSLCREDNGTDAIGHGHPSLCREDNGTDAIGHGHPSLCREDNGTDAIGHGHPSLCREDNGTDAIGHGHPSLCREDNGTDAIGHGHPSLCREDNGTDAIGHGHPSLCREDNGTDAIGHGHPSLCREDNGMDAIGHGHPSLCREDNGMDAIGHGHPLLCREHNGTDAIGHGHPLLCREHNSTDAIGHGHPLLCREHNSMDAIGHGHPSLYKEDNGMDAIGHGHPLLCREHNSMDAISHSPPSLCREDNDMDAIGHGPPSICGEDNSHPSLFREDNGMDAISHSPPSLCREHNGTDAIGNGPPSLCREHENPEPPLPGMNGLQNPEPPLPGMNGLQNPEHPPGTNRLQNPEAPLGTNGLQNPEPSPGTNGIQNPEPLPGTNGLQGPAKGRRLCTTPTYYSILSRKPMHASVQMS

SEQ ID NO: 930818 - protein, 219 aa, Homo sapiens
MLSSQLEVHHRTAVEAGGLGNTCTAANSYTHISTAANVFNCQTYCACPRMPPIQHHKPFRQTDTARASARKPNPQVLLDDGFVPSPSVFPAALGALINEAHHLCPQHCLSLAKPLPVLGAGQCYACCLAASAPHPRPREATALPCILLAWPGQDSRETRTQKKQTLQAPCSRASRILGQQMFTTDGSVIIVDRLQKRAREHLTEGTDLTQRSENEQRPT

SEQ ID NO: 930819 - protein, 818 aa, Homo sapiens
MQGQSEEVRGAAGLVLALTDSRRETAEWPREILHDFSRAVKFVKIIVLVKKLGSWCSSDLYAESVYLLETVLFLLYAESVYLVQTVLFLLYAESVYLVETVLFLLYAESVYLVDTVLFLLYAKSVNLVETVLFLLCAESVYLLETVLFLLYAESVYTVETVLFLLCAESVYLVETVLFLLYAEPVYTVETVLFLLYAESVYTVETVLFLLYAEPVYLVETVLFLLYAEPVYTVETVLFLLYAESVYTVETVLFLLYAESVYTVETVLFLLYAESVYLVETVLFLLYAESVYMVETTLFLLCAESVYLVETVLFLLYAEPVYTVETVLFLLYAESVYTVETVLFLLCTESVYLVETVLFLLYAEPVYTVETVLFLLYAESVYTVETVLFLLYAEPVYLVETVLFLLYAEPVYTVETVLFLLYAEPVYLVETVLFLLYAESVYLVETVLFLLYAESVYTVETVLFLLYAEPVYMVETVLFLLYAEPVYTVETVLFLLYAESVYLVETVLFLLCAEPVYMVETVLFLLYAEPVYTVETVLFLLCAESVYMVETVVFLLYAEPVYTVETVLFLLYAEPVCMVETVLFLLYAESVYLVETVLFLLYAEPVYMVETVLFLLCAESVYLVDTVLFLLYAQSVNLVETVLFLLYAESVYTVETVLFLLYAEPVYTVETVLFLLCAESVYTVETVLFLLYAEPVYMVEIVLFLLCAESVYTVETVLFLLYAEPVYLVETVLFLLYAEPVYMVETVLFLLCAESVYTVETILFLLYAESVYMMETVLFLLYAESVYTVETVLFLLYAEPVCMVETVLFLLYAESVYMV

SEQ ID NO: 930820 - protein, 232 aa, Homo sapiens
MPVRARRLRDPGPTPDPGPRPPATESPRAGVAAQRPALEEAARGPILVDTGGPWAREALLGALAGQGVAPGDVTLVVGTHGHSDHIGNLGLFPGAALLVSHDFCLPGGRYLPHGLGEGQPLRLGPGLEVWATPGHGGQRDVSVVVAGTALGTVVVAGDVFERDGDEDSWQALSEDPAAQERSRKRVLVVADVVVPGHGPPFRVLREASQPETEGGGNSQQEPVVGDEEPALH

SEQ ID NO: 930821 - protein, 137 aa, Homo sapiens
MQIKSWQPPGWVLRYPQIDVDTQASVEDQKSRAGIGFMHFPNSYKMLRLGLMLVTSSAVTQSADNNKLSPTDTQKRGRRVSGKEDVAKRADWGWRLPSIAHQLWASVYITSWLKLWITTNRNTSKKGKEEENESKLL

SEQ ID NO: 930822 - protein, 169 aa, Homo sapiens
MSKWSGALPREHSQPGGPWPGKGAQARCPGRGLSISKREKREGAGMLGAPGVCVIGEEGGLGQWRRTELEERAGSSLKGFLGSPGLGLCTEESGLHGVSVEENEKGLTPATGNGEKEGSSDAWLRTVMQHLQRIGGRWKTKAHSTLVASGVGKGWEAQGGFHRSPCDNE

SEQ ID NO: 930823 - protein, 153 aa, Homo sapiens
MFRRKPSPITTQSCCCTTLTLGLCGELGDCSPKVSASPLGLLSTRVDQWWHRGRDGSGGAVTETATILKVLNGQVPTWAARRSLWRCKADIGRGRNGVLLTRWLESASARTEALRAQVIEQVLSANYNAEKLISFNRHKKGAQQQAQTRIFIL

SEQ ID NO: 930824 - protein, 196 aa, Homo sapiens
MYRFSPFAWTDCRYLCEGDKDGAGDEDRHVDKGGGGDGDGIKMRMEIGMKIKMEIEMSMGIERDGDEGGDGNGDGDEGGDGDEDGDGDGDGHEDGDGNGNGVGMGMEMETEMQMGMEMKMKKGMETRDVDGDGNEDKNGDEVGDGVGDGNGDGDRGADGNGDRDGDDKNGDEIGDGDGAGEGDGDGDRCRWGWRQG

SEQ ID NO: 930825 - protein, 149 aa, Homo sapiens
MLSSASEPLCRPLCLPDIAAPPVELPWAQLLDFQMPNPTLKFPNSYFSPMLPLLADLSPLLLVSGMEEMFLQQRKDVPYQTRLGSPPPLSSSLAAPNTRAAREQHQKKGELYYVSRKWDQGLQVLFVFMSCPSMDYEREMFCLLCEGTI

SEQ ID NO: 930826 - protein, 152 aa, Homo sapiens
MMNNTPKSNSQVSERGLRPQVIDDGGNGDDGGDGDDGVDGVVDDGDVMVVMVMVVMVMMVMVLMVMVMMVVVMVMMVMVIMVVVMVVLVMVMMVMVMMVMVMMVMVMMVVKKVVVMVNGSDGGIGDGDDGDGDGGDCDSVNGGDDGDSYVFI

SEQ ID NO: 930827 - protein, 140 aa, Homo sapiens
MFLSMTHGNLCPDTEISRKPKPSSSEAGLEHQQIPPELLPLCEPDHLAVGIVQGPQPTTPTVFAGPEPENLSQFPNVYRVSLLGYNILLYVARLQLSLLPPWDRQNLKLRLQGLRWSFSRREQDHCPGHHSRCSTGDCKV

SEQ ID NO: 930828 - protein, 135 aa, Homo sapiens
MRGVGEAGGAAGFPTSSASHIGPSSLCPTIVIIWSLPGLACSGSAGLSASGTLAQEACLSTLGPFYSHSHRIPGPLSPAGLRACPVAKAYWLNISREEFLLKPSVRKHFLGRNTLGKVLSNTNRRSGILHFISKF

SEQ ID NO: 930829 - protein, 160 aa, Homo sapiens
MGHYPIKSLSHYFPFGGYLAEEISKQQRIQEVTWVLLKAFSFIREAEHKSLENVQPDNVIEKKIPFSKKKFKPAEEICINNKELNFNPQDNGENVSRACYSSSFHHRPRGLGGNNGFMGWAQGPSPVCSLATWYPAFQPPQPWLKEAKTARYNRPTLRFC

SEQ ID NO: 930830 - protein, 172 aa, Homo sapiens
MLRCAACEHQAQVPYRHLASQKTSELGKDMSDSYILDVKSGEWLPYCFPDPQINMLTRELVLCRALTILAQLSGEQPLNLDFMQIHEARLMRSEFSKKTKVVDSRSKSPVSFTLGKQCSCHPSPHPFSLSQDLLHKQLRNRTQCNIYSLEVDTREFRPKNPEASFVSCWTCS

SEQ ID NO: 930831 - protein, 230 aa, Homo sapiens
MPWPLASSALGSPPFSSPLLMEKMRRLWDSDWLPCSSACGWPIVRPYDRPRQMSAVKMRALIGKEWDPATWNGDLWKDHDEAGDTEFVNSDESFLPEGTASPSPVVATSPLRPMLPSAFPPLSGKINPALPEATVMSFPETVARQNNVDSPEEPPPTPLFASRPNTRLKSWQAPRYLTVRTAVTQLQNLNTMEILDPEVAGSKWQHSTVKGKVGITTVMDSRGKSAIRIV

SEQ ID NO: 930832 - protein, 317 aa, Homo sapiens
MPDTQSCKTAIKVLLLLFSVPLSPFFGFGRMRKYSRLDPEDPVGQGLLKVNFVTKSRPDITKQLQKIEGWNEKSIEELLREAQKLFVRREEERQKQKAKIVVSINLKVEISLPSNRKIPQPGGNSSIAGLCCHIVSLKPQTYLVRSSKGRNSGIRGTKASSCNSSGPGPPTSRETVPFVGDSGSGCCPWGAYSNLGIFVSKLLDPVSRRWPECVQVIAATALHAEESQKLTFDGALISATFWWSTIKKKVNWINYIYYNQKRFISYTQDALKGVASQLNATSQMSWENKIALNIILAKDGANQSGEAYWSKLDSKIV

SEQ ID NO: 930833 - protein, 144 aa, Homo sapiens
MTGSFLRPHQKQMPIPCFLYSLQTCGKCDRHTKQGPHTLGIVSSTSIPRFGTSDAEAVQHRVLLLPTRICSCFLTTFADEQISLCLHHSGAECSRMNAAKSFPINNLNQHMAGMGEPRSKNLCPQVGHLRGTCSTLVSRVLQWD

SEQ ID NO: 930834 - protein, 151 aa, Homo sapiens
MLNIVMTIGLWVSIPGKDKALGPLICLTAIPGLLHKLCFPHCNVYNNDTFFSLNISDSFLHLLSQLLTLPVMQLQCLEISMNTQSPFRVLIQLIRESYLSNLCNVPLLHPLLCRSLLLHCSDPHNLLHIKWSFSFSNSTLPPYSWKLLRQC

SEQ ID NO: 930835 - protein, 206 aa, Homo sapiens
MSPAYPALPSQGIGSQNRLPGLSLARLLLEMNQNTGRGLIDRSMDAEDTALPQKTSSPRYQKHHWACPRGTLGLKKQVNTHRHRLQDSQGPGRSPQPTLQVGPCSPTIQQTQVPGLLQQTRVKSCLELESPPRTQVPGPPLCSQVPGWPLKTQDPGQPSLQCQHQWTRSPDSRPALMAPGTGLMPVVLGTRPALMGPDSMPALAGG

SEQ ID NO: 930836 - protein, 142 aa, Homo sapiens
MVYYGERPSTEIHLFHSSHYRWMGKFPGRQRYLEGVVIIGDDSSMPVIAPEDLLLGQDVEVEDSDIDDPHLVANGEEISVGGKLIERNGMVTSSCSTKEFAANSSVPKEILKVFLQEKGYHGNAGIINNQGKVTHGVNLNEY

SEQ ID NO: 930837 - protein, 249 aa, Homo sapiens
MPLTDLKINHKTTKRRCLLFGALWLKMCSVSDGIAQFSANYSQPCNQTLQHSLQAACECGVFPVCLWKETLFSALLLLILLGGSSVAPIVGRNMDGNGHSSMVSGGNEEQVIGNWSKGDPCYKVASTLAKLCPGILWKVDFDSDEIGHLAEEISKKNIEEAYSVFLTLGVRYERRETIHIAKKEKTCSKENTTGVDEQLLDKIHVSVNRKWNQPLQRKPEVEMGLYLQRHCQFEMRVWTLDFRVDAGMS

SEQ ID NO: 930838 - protein, 155 aa, Homo sapiens
MNRISLTCLLSRQYPQRNKLNNHNLKFWGNFCENMQTPNCYPVLPKKVRGAESAEEAAGTFWCGGKCKEKSAASGTGNCGAQLEAAAPERVAPSWRQPHAQGGVSEGDRKDGGGSSPQGAKGSPSQEAPSSKKHARTCSDSSLLSLSLVPLRNVT

SEQ ID NO: 930839 - protein, 178 aa, Homo sapiens
MSVKLEIRWLSQQIQVDSLCDLNNYTTKYDGCDREPRRTWLSAEVKKTQGMKRIWDERDLLIFVSLKGTKQVESKDSVGERMWILTAKCNCEKDGRFNSGYFKAQQSRQKLMIENYKNSKGINNFNNTINHIDLIVIYRTLYTTTAKYTLFSSAHDMFTEINYTLVHKVCLRYTHYSY

SEQ ID NO: 930840 - protein, 163 aa, Homo sapiens
MPIVISSFLWSQFLEICIPLVVSYFLEFCVCCCAVLVSALLKESSPLTVFTYWVQWKNTFIYWWIQGHQLSWKGRGSRKNGRETGAKLSGTCDSLHPPVFVFNISVGVSLCDLTYPHLTDLRRVEKVFDHFNHKNFMRVCVKRPPNRLCVSNKAVYFTWGQVG

SEQ ID NO: 930841 - protein, 141 aa, Homo sapiens
MLFCVHAVIDSVEGSLPPVHIEPIPTVAVRRNYTIKTDMAVKLGTFYECLLIYLHQCIHIPLINGFGLAIVIDRKPVISWSSLSLEYSYWGADLCNWLRKQNSSFNKATISLWKLCELESIREMLKKVMIMEIMTTHERGS

SEQ ID NO: 930842 - protein, 214 aa, Homo sapiens
MISLRSYDFNEISLYINEAFLRPYLQLQPRLWESLELPRDSLSGFDQNADSDMDNEVQVEVVSDEDEELIGKWSQDGASPKPWQLPGGAGPVGAQKSIIHIWEPLSRFQRMHGNAWIFRQKFAAEVEPSWRASARAVQKGNVGLEPPHRVPTEALPSGAVRRGPLSSRPQNDRFTDSLYQNIDPYASESEDFFFINVSDHIFKSLSHEAVYNFS

SEQ ID NO: 930843 - protein, 216 aa, Homo sapiens
MKMADFLFGQELFPGVTRIAKVEREDGKLIPLENIDGSQMVYQALFHRVEISGEKVFRKGEHQVKGKGVNGCFFKLCHDELRAGIAVECGSYSGIMASVESWLNPSGVDEGNNTLDTPLKSLIPLQSLNVPVPETDSPDSPEARTFTYYQILTIGTCKGILWRPLEGFPDKKYMPLDVYLAVIDAWNSKNKQQDQSIKLRSSQQKRAKSLSSQYHN

SEQ ID NO: 930844 - protein, 155 aa, Homo sapiens
MPACESSCRNCTLKYRRDRAAQGLGSPPIVSVLKEGCCVQGFLCTHFPFGFSHNSRWFLEHLLVELLAMGRSLSSQQWAKGSTRKKQNDLTLSYDALKIELSHVVTTDECREKNSERISIKTNKLHAITASILPSAALVRKPLVRITCGMINNVS

SEQ ID NO: 930845 - protein, 150 aa, Homo sapiens
MMSCVFLRQDADRSLSRSCSFQVHVRSRAPHSKATGISSTMFGAHRRLQHTCIQHFLWDMSKHHKEVAEKPGVRHQQDRMDDITVTITLTLQELIAPKYVKGNKNTGLEVHLPYALIVYKHQAPNKFNILKLSQPKGTNPDFAEQKDSPP

SEQ ID NO: 930846 - protein, 142 aa, Homo sapiens
MKRFAFASTVCLRCQEYVITLNDFIEFLYKFEPYDPMMSGLGLQFLKKTSYFFSSHLTVMPVALSAEVSFVSEQGCVHECVFPTPLLLADQHYIVNNRWRRAGFPPSPEAPGLGLRLDGSSISWLSPSSTWHLLPMREEFQN

SEQ ID NO: 930847 - protein, 134 aa, Homo sapiens
MEGEEKGNILMNLFFCPGKLDYGSTFEQDGGEPCLEVYGHPARHNAQTQQRVGLMRTYCQYWQAAFTTHIFRCSWMLHVAPSTLPSKTNNIDSSSTPFRESWNGWSPEKADSSHSCTCLLLPSMKSTSCLRLTC

SEQ ID NO: 930848 - protein, 136 aa, Homo sapiens
MAPSLSCQRELSRYAEIPMGVYGLSLFPGHIEQISITTSLMSGVAQRPTSSSRICGQAVSPASDRSLDLRFYSPGFICSVAGTVQAENSASTKLLHLTRWTISQFQNYFYCFINGNNKMNTTVWEGGGSGKKRDRD

SEQ ID NO: 930849 - protein, 221 aa, Homo sapiens
MRVQHWWRLRLAPSLASANSAVMNSLVHVAFFTCGDVSFLTAVDVSTRIVISSSHTGQFFERSKLAPTSATQESHRKLEIQRHILELILSLKKAFSHHKCPGLPSSCPEPALVLQASDWTNLSPEALPKTVDGGLQPGSSSIRGSNVVFQLTVYGRVVKVQTGGSSDWTESQMQAVPRQGWQESQKFSSLAPGLPALALFGEQAPEACMAGCPLFRSSLLS

SEQ ID NO: 930850 - protein, 145 aa, Homo sapiens
MRLLRISPAPFLPANCTCGVSNSRGKVHPCVSIPTVCPVVSWRWSFLTEGGDVGWRMRRGFRLPPKAALLSGLGEEGCVLGGKTVPQSTPKGIYGSAPDNRPQPSAPSPAAGGMPPDPSYRWTVCLSFSTIVNFPRVFMDIFTGG

SEQ ID NO: 930851 - protein, 158 aa, Homo sapiens
MSTSAMGVERSKTAPGKIHVGVFTTWEKYVISAFSDKAGIGPNRSEGQDRQRETCARCWVPGLSDSGKLLRLISSDPWDFRLQEMWFDGSETTAQWAFPQGGGSKDPWINPRLCLPQKLPRPVPTFLVDTCSLRAGLEPKMHPHRPLKSHPKLTWVRI

SEQ ID NO: 930852 - protein, 362 aa, Homo sapiens
MKTVHQVRRINYRGLDETGPVHLILKAVDMENHSWGTLFTFSSAECDVKDLAEGRTDTETPGQDVQQVLEEPKETKVVTWGAGEPACGGEEPAGGGGEPAGGGGEPAGGGEEPAGGGGEPAGGEEEPAGGGEEPAGGGEEPAGGGEEPAGGGEEPAGGGEEPAGGGGEPAGGEEGPAGGGGEPAGGGGEPAGGGGEPAGGGGEPAGGGGGPAGGGGGPAGGGGEPAGGGGEPACGGGGPACGGGGPPGGGGDPACGGGGPAGGGGGLQVEEGGCRWRRVACRWRRGSCRWRRGAADGGGGLQMEEGGLQVEEGGLQVEKGGLQVEKGGLQVEERDLQVEEGSLQVEERSLQVEERVQSAGLG

SEQ ID NO: 930853 - protein, 135 aa, Homo sapiens
MLNSLLLKLGTRQGYLLSLPLFDIFKGGGLEHRYMEKEGHEKMKMEAEVGVTDLQRPPRVAGQCQNLKERHGNKLSSELPEGTNLTKTLIPDLWPSSLWALGEMVTLHFLPFGAPLFPLNPGLPHETQCSLLLAC

SEQ ID NO: 930854 - protein, 160 aa, Homo sapiens
MAQQVTSQKCHLATRTPHYESVIMVQERCHEENLCTELLLLGFANFHGVNAPTWPTASHQCEVTGCRAGNKYVPMTLGSRSMHSTGHKQRLQRPREEPFYSKGQGGTVLRTRWGGGGQKNSRSLQKLSLTPGLCSQNRCLGLSHLHLFPWASILLSLSAM

SEQ ID NO: 930855 - protein, 125 aa, Homo sapiens
MGENAPMIQLSPTGTLPQPVGIMGATIQDEIWVGTQPNQISCPDSFATLGGHLMKLSPVNLGLPGRLMAAASAGKEAFFPQHIKCGTGGWLAGPGAGSGSVAHNDSVWQAFLKSLGSAICTSYVH

SEQ ID NO: 930856 - protein, 147 aa, Homo sapiens
MLVSGCTAPSKDSLIGALAQGLGADTQDKRQMIPQNPGESTVSACGFCQGGSLTPVIHFDPTFTHQGHGFSKLPENSPARWRKWPLCSPRINIHRCKAGTGLLDSGFNGGNVRESDLNSHLLSFLICKMGAFKTYARLLSESSKMLI

SEQ ID NO: 930857 - protein, 148 aa, Homo sapiens
MGPILLPSDQENKNPNAINETVAKRSHGISTGHASGQGLRQRWRWFPTSCADISHLRLELGRCGEITRFKSLPFAEATSPQTRHRQGHAPSKACARGRFLPLPPSTGGWQSLACSCFTEISALVITWCPCVYKCCTRAELSSSVNKSH

SEQ ID NO: 930858 - protein, 222 aa, Homo sapiens
MGVSRIGEGGTGSMMTLEGVMTPSSVMTLAGIMTPAGMVTLAGVMTPAGEMTLAGVRSPAGVMTLADVMTPAITLAGVMTPDAGMMILAGMMTLAGVMTLEGVMTPAGVMTLAGVIIPAVVMTLAGVTTLAGVMTLTGVMTLAGVMTLAGVMTLASVIYDSGKCDDSGLFDDSGWCNYPNWCENPGWCDDPGWSDDPGRCDDSGRFDDSGWCDEPGRCDDPG

SEQ ID NO: 930859 - protein, 320 aa, Homo sapiens
MASPAAWNSTEAQPSSSSWAGPHVRGIPGLIGGSAAPDDETSAYTCRDIKQAKDKCGRGWGETGSLAALLVEMSAIMENSVENAESLSALSNHALIPDQTCVCNPHYQENVSVKLRNVRKPAPAKSMVVACCFNLNVLANQQQTRSSLVHLVGGLRVCMSNKLSSNAMTHGYWSTTLVVAGTCDDSSTCDDPGGCDDPSWYDDSGRHDDSSRCDDPGGCDDPSWCDDSGWCNYPSCCDDSGRCDDPGWCDDSNSVIYDSGKCDDSGLFDDSGWCNYPNWCENPGWCDDPGWSDDPGRCDDSGRFDDSGWCDEPGRCDDPG

SEQ ID NO: 930860 - protein, 140 aa, Homo sapiens
MNPDAKWRIDWRTEVQGRTNLEKEKQGTQEQEPSPFWVHSHQGWTYSDNQNVPTASCRATCHFMSTCVANAYSVQGPADTKIRETEGVFQKEIIGSGVHRSGVLTLRLQRVRHKDTGHHYGMFFKYDRGFFKSGNGQEIL

SEQ ID NO: 930861 - protein, 163 aa, Homo sapiens
MSVGCSEDRVSVPNSISVVTQPEYTYLLSLQLGIVMLPSSGRLNTRRCNVPLPGLPHKMSPQVILDHPPSSAGWTRGLWKACVEDGRREGGGPAGEELPVHSACLMSVSPGKPTASESERVLEKKTDPPWSESWLYHISLEVFRKLLTNYIGNRWLDISQQQP

SEQ ID NO: 930862 - protein, 136 aa, Homo sapiens
MTDMACRGEGLDRVAKVVSPVEKAESNQIISKSQQVESLVLVSPQRVSRLHCLFSISGAEKSLPEARLDKWDRVPPQTHPNPGQGCAQISTWWIRQQPPALHTEFQEQLGRLQLLFQEQCVQPPRGSADSSTLIIF

SEQ ID NO: 930863 - protein, 137 aa, Homo sapiens
MGQCTDISSLYLLHQELELVLQWAEQIVTEHPSDSSRKMLTWKLATRIQCGSLQVKDLGYQQEWAGPFSLWEHPYWRGNTDFLGLQMNKYSRARGHKVQIFCMVSERDPSWCWLCPWPFSMGQPCFAPCGAILSDIR

SEQ ID NO: 930864 - protein, 164 aa, Homo sapiens
MSWDIQVPRPRGSTELHLTGAAQEECGCGLELRAEQVVECQAVQRLQGFGLDITGAPPTPQASTLSLSSRLFSQMPRKRAQKQPPEAWSPAKRTGPPGQRDRGGLCPGGPEAAQDSLAPAAPSTQQTEKLPVGKGLGTLQRRRSEYLDFLNVNTLEAPKAAKRL

SEQ ID NO: 930865 - protein, 158 aa, Homo sapiens
MTFLWLKAQVSGVHLKIKSASSHEFSRATSTASSREFSRATSTASHEFSRATSTASHEFSRATSTASREFSRATSAASREFSRATSAASREFSRATSAAAREFSRATSAASREFSRATSAASREFSRATSAASCWLIRAACLTVSQQSREWASHELCS

SEQ ID NO: 930866 - protein, 142 aa, Homo sapiens
MTPLPARAGLRVTLQDDPLPARAGLRVTLQDVPSARQSWPAELACGSPCKMTLCPPELACGSPCKMTPLPARAGLRVTLQDDPLPARAGLRVTLQDDPSARPSWPAGHLQPTGPETRMQLWARPQQVKFLENPMNHLVLWRA

SEQ ID NO: 930867 - protein, 143 aa, Homo sapiens
MGRLCASGDGGMLQVQKPVQAQVGKHKALDSGLERWRGGASSRATTGDLWWCELGGAEQDVQRRQGSRNGSKATGKNTLRSEEEQIIAIEEALGSYIKNNGKQQFLSANTWPQIAQSSSPSTRKAFAPIATMTCHWGKFCVNM

SEQ ID NO: 930868 - protein, 150 aa, Homo sapiens
MQTVGASRSRSRATERSQITSRLRTEELLPTFKHLKLIREKLPLPKPIWQLCTEKQVKKRVFRKKLPLSRSWCGWLHHLCAGPFWSASFSLDEEGLQADSDRCSSSARQECPGSLLLQGRGWGALFGPVGICFNGRNVGKYSLQAQNENR

SEQ ID NO: 930869 - protein, 170 aa, Homo sapiens
MVQLLFPAMDNVMIRKMCLSPYDHLEECHQLFTRVAVLEDHSREFAMDIPCVNFCCQETTETSLVAKSSWPGIRHNLHSTRRPLGPMESNNLLQTRNKEAHVIAYSRLSENLIVVRCEIEFWIRFGLLLEIGNSVASWESNCHAAHHPEKPSDNLDPEKYSASRNSVFAL

SEQ ID NO: 930870 - protein, 149 aa, Homo sapiens [sequence omitted]

SEQ ID NO: 930871 - protein, 140 aa, Homo sapiens [sequence omitted]

SEQ ID NO: 930872 - protein, 163 aa, Homo sapiens
MLGIYKRQPACRAMHLTHCLWACRSESHLATCRKASFTVAKMCKQPNCPLMNEMWYMHIVEYYPGFKKKEILPFVTTRTDLEDIMLGEIVREEEILSDSSYMEHLKIVRCTEVDNRTLVTSGWRGGICRVAVQWIIKLQLHKISSRDLLYNTVPRVNDKVLCT

SEQ ID NO: 930873 - protein, 162 aa, Homo sapiens
MAQVVVSGDIFLVNMEGTMLRRSPNPKERDYGTDWRPSGKWGAYSQGFDWNSLHSFKESNLTCRANKSCLENWPHTLPIIQSLYKVSDLWHSKSQDEIGGQHKIQVIKTLLIKQVAVKKLAKTYQNQDGDESDLWSSSLLHSHQCHDSLQMPWQHQELPYMV

SEQ ID NO: 930874 - protein, 154 aa, Homo sapiens
MDLGCSSLVALLLVIPRETGSGVDLQQTPADVQQRGLTIRRKTNKQKEIAHPLRDPNQKSPTSKTKAREQNWTENEFDALTEVGFRKWVITNSSELKEHVLTQCKEAKNLEKRLDDLLTRITSLERNINDLMELKNQHENFVKHTQVSIAGLIK

SEQ ID NO: 930875 - protein, 293 aa, Homo sapiens
MAGPGVLQVASTAGTRQFNGTQNLRDTRDCRAPKRVLQHVTLQTWGAPRSRPQRAEALLSLLPQNDEWGGRKCVFRPVSVTLFQSCCLTLAHGSWAGLALTTLIPVTWGGCQAPAEDQHVVCWAPVVHVKGNSLQPPGLSLMLISTQSPEGSEGMTCQNCPQHAHWLGCHSAWAWSQCCSAWSGHWEQREDREWQQALLSLRKQGASRPPPPPLRAPGCLVWVQNQAEAAAPRSAGFHPNNGAPSGITCSWLPVALQRVQAPAMSLPLQLATLQWPLQAGCCCHQQQFSHQKQ

SEQ ID NO: 930876 - protein, 221 aa, Homo sapiens
MWAGPNKGIKAGHRASSSNLLGSPSKLWKLCSLAVSNESCCCSLFGSAASLLKSAGPRTHQKKEIPDTSEHLKEQTLDTPSLRTVTLTARVRNFVLEVRETKNPREGTNSGHILATQRGHNTLDGSRGLSILANSSKWATYWENIPTAQGCKGDKFCLVPGRSGDTIEESEPRVGNLRNLPSAVAELVPKPQDKFLLTLSSTNRGVSPHGHHYLRPVAGYC

SEQ ID NO: 930877 - protein, 151 aa, Homo sapiens
MCLSSDSPWVRHSVAAVMDGHFSLAKNHYWGSTMGIWSVMQNQVNTCMHWEAVEFYGRDEYTCLTNWLYLATTGNQKPIYGLVKERLCHLQNNFEGDLIAIIHLYNAGYSKHENATVHAFFIFIFMRYMKYITLLDICYHTQKFCIFYILY

SEQ ID NO: 930878 - protein, 137 aa, Homo sapiens
MCYKFPSKHCISCVPEILVYCVFVLLSFKELIYLSFNFIIYPVVIQEKVVQFPWSCKVLRGTGVRGPLEEAVCLLADPERYSGRSTALFRADRQERLSLLKLCPQLSFPPGALSQRDGSFVYKLLTGAAALLSEMPC

SEQ ID NO: 930879 - protein, 150 aa, Homo sapiens
MTWIMNQCLPGPNLGPILFYGSVVTPPQRDKRGEKERRWHPCLIPLNLCLWQTRESKVPPSINSWSSEMNCCLPGLWPVFFLTAGQETGNGLEIIYHPDWRAEIECKSLGTPINVPVCWLPSRHNKSLSVQTANGECMFQAGKEFVWHTK

SEQ ID NO: 930880 - protein, 174 aa, Homo sapiens
MWTHAECAKSYWSSRPGKAVLRVQTHAQVADSVMMVLVSDSEMAQSPVDSATAPFGLGHATRTICQGPRPQAPEADQEMTRGAEEWQNGAAEKERRGMSELREFSWGNWRGDQTLDGQIPGEDRLPTPSHFQLSIHSVESHLHHLIKTLLSSLKSMCNPILPGCKTRIWVPRGH

SEQ ID NO: 930881 - protein, 142 aa, Homo sapiens
MPASSCYFQLDIMPCLAIMHSLGYGGRDYITDCVLKPGDVSNLGFLNSFTGFKLKAVSGSALTTCSWPKPRNPKYSAVTEKRSLHGCICLFTYFLVLYVDGKEKHQTFLYNIPEVFLCKQLSYIKEVVIENLYLSWKPLRAS

SEQ ID NO: 930882 - protein, 139 aa, Homo sapiens
MKLCSQPDYGCLCCIILSLGKCGKAGSDKPHPAPMQPAKPVSLPPCLPSSTKFTSRQLVSRAEIMPQATSLPAEKASRALRPYPFLPACTSYLHAAPLPITSNRPARKPPCQFCPGKFVLGRNYYKAQMEAFFYLWSFH

SEQ ID NO: 930883 - protein, 172 aa, Homo sapiens
MGSNITLSPLKYYESYTRGLRPSLYGEQYHPLPPGILQTISQGMYTPCDMRTFWILQTVSQGVYTPLDVGGNITHFSLPSYYEPYPREVYTPQDIENNITLFSPLGELRTISQGFLFLLDIKSNITFLSHPGYYKSYHKGLYNSRDIESNITLLLPPGYYNPYHRRCTPPMI

SEQ ID NO: 930884 - protein, 162 aa, Homo sapiens
MCSHRSTPTYNKWSLSLSLCQAAWNWGCGDAGTPATTTTKTVLDLFRSQHSTGSCSKSAVTATCPSPMFTHGPRVLQLAGGKTSQVCLLPFRAASSPRPWAEEPLLVGTTTTSPQGVSARQWSPLWPGAGPEMLSKSLGLNVGTSRAYFLLYSTVAELVPKV

SEQ ID NO: 930885 - protein, 141 aa, Homo sapiens
MKIMSFFELHYEAIIIHTVSELKDKVLPTLLFFLHKQGSLSSWPPPPQAHGEYFEDTVDVHSRPKGSSARLWCTLPFPGLMLHGNGFPSDPGLIQKCCSRAKAWNRPLGALLHCGQADIYGARQSTILFPLLFSSRRSLFP

SEQ ID NO: 930886 - protein, 138 aa, Homo sapiens
MTHRDYYNLRPTACYVGIAVGYSGPKALQSAGEQFCQDWVLLFNAAGSILVQDVSRNAIWEIGPAMWALTLPGALFSATQSPHLKSTETLRAKSALNIRYTSLLPNLNLLILHCLIDFPCLQYMKTKFPPWVGCDLAI

SEQ ID NO: 930887 - protein, 173 aa, Homo sapiens
MKPLCPELVPSGGFMVSLTSRMELQTFMVSVTALKDGMDLKMWKGTQPGCRCWLGWPAFIPLFVPAHVLLIGPFYRALIGPFYSVLIRPFYQPLASHRALIGAFLQSADWCILQSSCKTEKFSKSPPDPEVQLASPLNPPSKQTGHPNCCWELGNDHSSYILLDRGEEGALQW

SEQ ID NO: 930888 - protein, 124 aa, Homo sapiens
MAEGEGEARKIVNQKQYHIPGGIGAITATIKDLKDAGVVILTTSPFNSPICSVQKTDRSRRITVDYCQLNRVVTPIAVAVPDVVLLLEQINTSPSTWYAAIDLANAFFSVPVHKAHQKQFAFSW

SEQ ID NO: 930889 - protein, 157 aa, Homo sapiens
MHSLLKYSKREGGVGMVEAKPLPIPTSVLGRAFNLTQGHLSTWRIIQSSTVPQICYGFAAQQQECKRTYQEKGEEETEVSEAKLSDRTHSVGADVWLRFGKVRQSPGEMVSTCTPMAAADAERAGSATGGVDRQRPGGGRVYSVEMVDNGIIHVSVR

SEQ ID NO: 930890 - protein, 154 aa, Homo sapiens
MKSSLGWGLLVFLSEKLHVFCRTPLARYVIALNVHLNLTSAVLSCLLTPAGGTRRKLSAAHPQQVPQHLPWRITTRRQPMTHPTFQLLGVPVGKFLASSAAPSSVAFYFPSNSQDPQLQVCWSFLEVHSRPCFPGYHQWRLQNSKYCRTADVAA

SEQ ID NO: 930891 - protein, 137 aa, Homo sapiens
MDKDKCRHMAVGGKQNTRCEHWIIGCAYNVKRENFSGGSNCRCGEKARELELELEPEDVTELLQSHDRTLMNVKLLLMNEQRCWSLEMESTPGEVDDVSTTALSVTHSLTHFSASSIVATYSFFLKVLPFVSNIVLF

SEQ ID NO: 930892 - protein, 160 aa, Homo sapiens
MICVFGKKGVTSHMDIRWPERSGEGELAKALRRGGSSRICAQLHMPAPWQSTGETGDASSRQGNIQPAITRYWRFSKNCDFLSDYAIQFTCNGTRSIFSRFHGLLVAPLNVAVRVDLFGNICDLQLWDSLHAGGGRSVGTEDVQEAALLQYEISFVSMVW

SEQ ID NO: 930893 - protein, 318 aa, Homo sapiens
MSSPSLSPGPEAHKGLQNIVKHLKAQGLVRKCSSPCNTPILGVQKPNGHWRVVQDLRLINEAVIPLYPVVPNPYILLSQIPEEAEWFIVLDLKDAFFYIPLHSESQFLFAFEDPTDHMSQLTWMVLPQGFRDSPHLFGQALAQDLGHFSIPGTLVLQYVDDLLLATSSEASCQQATLDLLNFLANQGYKVSRSKAQLCLQHVKYLGLILARGTRALSKERIQPILAYPHPKTLKQLRGFLGITGFCGLWIPRYSEIARPLYTLIKETQRANTHLVEWEPEAETAFKTLRQALVQAPGLSLPTGHNFSLYVTERAGIAL

SEQ ID NO: 930894 - protein, 133 aa, Homo sapiens
MDTTASTAHSICPLWTYFYSNSQHVVVQHFIWFFNRSFVLKKSDAEIQYREHVQVKLFLSNMGAEALFTVVLLLLNEVLSENMPVPVKNFTGCIEVIEINNWRSFIPSKAVKNYHINNCRVHVHNVQVTTTVE

SEQ ID NO: 930895 - protein, 145 aa, Homo sapiens
MRFGWGLTDKPYQPVLSAVTLLEIWFSRKKKIMAYQINLFCFSVTLLAQTRKSCSRPYVNSALLTNLSSCSSLLIVKPTLLALMPSFGLLDLPPVVCQGLSGLQPQTEGCTVGFPTFEVLGLGLASLLLTLQTAYCRTSPCDSMK

SEQ ID NO: 930896 - protein, 139 aa, Homo sapiens
MLKRLKQDTDSKDFHTLKSMQYAPYLGFGHLHWIPSSIRRKNIKEQMLTQQDGRIGIAQVCSSQRDERRRQVISAFPTEVPSSSPWYCVNKAARKFRLVEGGATTVPQSCRRQTASLDTSSLGRASLKERQQPHSGAYR

SEQ ID NO: 930897 - protein, 211 aa, Homo sapiens
MLPGGPCSQRSQDGGDPLPRWWQALCSLTWGSWPHGFRGMESWAMRKIFCITKCECTSGWTGQNCSEEINECDSDPCMNGGLCHESTIPGQFVCLCPPLYTGQFCHQRYNLCDLLHNPCRNNSTCLALVDANQHCICREEFEGKNCEIDVKDCLFLSCQDYGDCEDMVNNFRCICRPGFSGSLCEIEINECSSEPCKNNGTCVDLTNSRDL

SEQ ID NO: 930898 - protein, 137 aa, Homo sapiens
MAVQQYVPEIFQPYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICQINNLVHVKISPGWSLQFHIVL

SEQ ID NO: 930899 - protein, 144 aa, Homo sapiens
MILCYVQHIIPQFGLPTSIQSSNRPAFINQITQAVSQALGIQWNFHAPYCPQSSGNVEWTNGLLKTRLIKLSLQLKKENSDKDRAQKLTLNPLGHSLSPPSRGTELWAGTGESSDVIHLQVFQLWIPVTCSGGDSRGNQYGWTN

SEQ ID NO: 930900 - protein, 136 aa, Homo sapiens
MAAVLAGTTEAIFTPPEIVQTLIQDHKHHDRFTNTYQAFKALKCHGIGEYYRGLVPILFQNGLKWLKSKTLTTPNASEDVEQQELSYIVGGNAECIGSETVLHDTNVEHICHYTFVKTQRMYNTKKDPSGKLWTFG

SEQ ID NO: 930901 - protein, 317 aa, Homo sapiens
MKCKAAVAWEAGKPLSIEEIEVAPPKAHEVRIKIIATAVCHTDAYTLRGADPEGCFPVILGHEGAGIEESVGEGVTKLKAGDTVIPLYIPQCGECKFCLYPKTNLCQKIRVTQGKGLMPDGTSRFTCKGKTILRYMGTSTFSEYTVVADISVAKIDPLAPLDKLCLLGCGISAGDGAAVNTAKVEPGSVCAVFGLGGVGLAVIKGCKVAGASRIIGVDINKDKFARAKEFGATECINPQGFSKPIQEGLIETTDGGVDYSFECIGNVKVMRAALEAYHKGWGVSVVVGVAASGEEIATRPFQLVTVLCSSIQLRELS

SEQ ID NO: 930902 - protein, 150 aa, Homo sapiens
MEVHMIKKYGLTNVDYAVDILNSLNGHISLVSLGLAPGILFSSIAAWNQGWGDTSVLVAATTGTALSQTQSQHSTVCASPKACCNHYLATAEGPIAIQSACGKASQPISFLSDEVTSQLSDHASCLPGEQYTWAESNTKILDFEHDAMLT

SEQ ID NO: 930903 - protein, 135 aa, Homo sapiens
MTQCSGRRKHLCDLNYCHCLHYPSQQGGVEAGAGTCHWETRVQVTSPDPLQTFPRTIISMAAPLGEQTQRSSRITELGVDKPVDSPPRTLQGDSLPTGGMPSRFRLAEEVASQPLTTWNTSIPAAEKRCLSDLNS

SEQ ID NO: 930904 - protein, 250 aa, Homo sapiens
MAVFDFATPIGWPASPGLTPTLGPLTDTAPPRDSWMFWAILPPPPPPLTSSLPAAGSKPSSEQRAVTGSGNHLCDLKPEGPPEANADPLGVLINSDSESDKEAQHSVIPKEVTPALCSLMSSYGSLSGSESEPEETPIKTEADVLAENQVLDSSASKSPSQDVKATVRNFSEAKSENRKKSFEKTNPKRKKDYHNYQTLFEPRTHHLYLLEMLLAPDIRHERNVILQCVRYIIKEDFFGLDTNSAKTKRD

SEQ ID NO: 930905 - protein, 136 aa, Homo sapiens
MLMFHVESEFDATSYLSLSMEGTPLEVMQHKYRLQRRSEGSSLAFGEMFQGGAQLPLLHKIIHTETGDGSRQQPHPSTPAHEAEVSNSCTHVYNTLLTCPLILLIKVPSHSIFDCRSSLGAYLNLCPSPELAGRVL

SEQ ID NO: 930906 - protein, 136 aa, Homo sapiens
MGRKQSRKAENSKHQSTHSPPKDCSSLPEMEQSRKENNFEVLREEAFRKSVTTNFSELKEDVQTHRKEAKNLEKRLDKWLTRINSVEKTLNDLMELKTMARELHDACTSFRNRESTTNILFEKSSPKTHNYQIQQS

SEQ ID NO: 930907 - protein, 179 aa, Homo sapiens
MIVGFLRPCKPCLTASQLNLFPFINYLVLVFLHSSDLLNNFDQNADSDKDIEVQAEVVLDGDEELGNWSKGDDCCVLAKRLTPEGRSTNSLHSVPGKATDTECQLVQGAVPCKATEVKLPKAVGAHLLHQCYLDCPYSTAEDKELREFFQCLPLAKFIRKPVIWSSEEDSFLQTQVEQR

SEQ ID NO: 930908 - protein, 169 aa, Homo sapiens
MPLRGFPPWAGQVFLALIPINPQSSSLGSKNIMPSDIAVVYISMFFLCDGTLFLGKTFLPSSQAIAIIHFHIKDKANRKVKLNDICNSDEINEILLSFIMLLVKVQPKPFLTHRWELNNENTWTQEGEHHTPRPVVGGWEGIAFGDIPNVKWVDELMGAAHQHGTCIHM

SEQ ID NO: 930909 - protein, 169 aa, Homo sapiens
MGKMSPGHVRNFCSSLSHHRPGGLRGKKWPCGHSPGSLCCAQSRDLVPCITDAPAWLKGDNVELRLWLQKVQAPCLGSFHVVLSLRVHRSKELAFWNLHLDFRCIEIPGCPGRSLAVQKGNMGLQPPHRVSTGAPPSRTDGRTEQWVKICMSLLVIDYFSTGFSRCWYQ

SEQ ID NO: 930910 - protein, 156 aa, Homo sapiens
MQAWVRCLCWRPPLGLRLRRPLAGTRGLCHKKGEDAPDTSVAETAFLEAKWAIQQAQALQVVDQGHPFELDLHVTTDGFSWGLWQHTEGLRTPVAFWSQLWNGAKLRITSSGIEKQDWEGKDIEGWCTKQSLLEAMTNSVLVNLKICLNIVCERRL

SEQ ID NO: 930911 - protein, 145 aa, Homo sapiens
MKKSPVFCIDHTGRLLPRIPHKPLHCHALMNCSTLMISPGLGVNPDVTDLIAFLFSGKDIKWYKHSLPQEVSHLALQHKKLNEVTTSMKAQTSYMEFLHTIAHALTCSLRIDNRNRLHSTSDAQFFLERRRTLSLASVSCSYLMQ

SEQ ID NO: 930912 - protein, 157 aa, Homo sapiens
MGKKQSRKTGNSTKQSASPLPKERSSSPAMEQSWTENDFDELREEGFRQSNYYKLQEEIQTKGKEVKNFEKNLGKCIIRITNTEKCLKELMELKTKARELQIWDYVKRPNLRLIGVPENDGENGTKLENTLQYIIQENFPNLARKYRECHKDTPREE

SEQ ID NO: 930913 - protein, 173 aa, Homo sapiens
MSVAGRGPVLVLGMLGTWMHSSSTGEQLQIQINICREAWLHRDHNKSIACRLISKLYQRVAGDKLHLVTGFRVASELIYFNYAAASGWQALSQKLTVILVHTRPAHYFLHCFHGHPFFTLHTCLSHSFALLLNHRRLLNWEERDRDPFVNKPGQKDIKFVPFDGYISRSNGEH

SEQ ID NO: 930914 - protein, 200 aa, Homo sapiens
METSIITSCFSTAPVLLSWATPETARPTLPLPPPPQPPQSEDEEDEDIREKTHGKIKEGYVSKSTTDFHDRKCIHFVQELFLKGQESLDQSEINIFLQIGPFQKCSARHLKISIILKDNESVENGKLLAVRYKLRNYNVTKDEFSEVEFPKIMKFIPHQSSLFFLPCPIAPSHQNLECGKRRLSLGQSRSCSPFSYMEQW

SEQ ID NO: 930915 - protein, 136 aa, Homo sapiens
MPTQQDLTVKPVPMADSHCRAQVAFTGSHSWWPVFVRPLDSIDQLTVTYRKHRKPASRSSNFTDMRNPLRVKGFWYHFIMFLSCLVTDGRATMLLSEALSNVSKRSGHRASGSQCWLPIPTCWVWFAKFQDFGPYQ

SEQ ID NO: 930916 - protein, 355 aa, Homo sapiens
MAHVYICESLEDNRYLVGGRLSILPFCRMPHLLSGAFRQFTFNVHMEMTRKMSDGPFKILPGENVSDVHYIFTGFHTSGWCEEQRSIGSETQSMEEQLHAVIMKHAILTTESMPADISLCVLPAIPCWKSRLYTGSLSCQATSQVITFILLSLEGAKRFSGTVLQGPGWSAVLSPPLQGCAASCALQAPTPRANEASDFKLNPMPIYHSKNPRALKHYAKSTLLLFRKWNNKAWLTAHLLAPWFTGYFKPTVKTYCSEKKITFHRLLLIDSVSSHLRALMEMYKDINVFFITAFILQCMNPGEISTSKSCSLRNTFPKAIAAIDSDSSDASGESKLKPFWKEFTILDVIKNIRDS

SEQ ID NO: 930917 - protein, 137 aa, Homo sapiens
MQLLDFKVSDHLHAGTQTRHRHSKHSQLAELQAAIGKWEYFYMTKLQVCGCEIRDQDDWKHNLLNILQFKVTFWSAIDNPLNESGKSLVLIKLGESMITGPFVPVLHDSGTSRWSAGKTTNPLVISEITSLLSLPGE

SEQ ID NO: 930918 - protein, 127 aa, Homo sapiens
MSKFTSYILNFLLYFCVTNFFYSKYVGGLGQSQQEYKEKDSSLGFSLRLLEEDFRVCRKALVLKGKLCGERISLASIESCPGGLDYNKQQGQREVANDRGGGTCERGWKIDGGEAGSKTCPDHSFTG

SEQ ID NO: 930919 - protein, 154 aa, Homo sapiens
MVGVRPALWFAWELTRLALPSPDGPSLPTLIVEDNGHIVFGVLEPHPALIPLHTTSADAFWKTFPLTEPTQMRRNQKTNPGNMTEQGSSTPSKNHTSLPAMDPNQEEIPDLPEKVFKRTAEWIRTHQPTICYLLETHLTHKGLHKLKGVEKDIS

SEQ ID NO: 930920 - protein, 170 aa, Homo sapiens
MPKGQGCGDGPGAGHCILSRPAGAVLVDRHGYSPPEDKADRTWLFVGAELVVSERSIIENLLMELPFLQRKGRTLCTATKALPIPSHPHPAKTVTSPSPELITREPTSAQNARTSPSSGTPRVNSHTSVDLLFPPLLPSVAKNLCTQYGWLYGSQGRDVCLGLNVSSDHR

SEQ ID NO: 930921 - protein, 139 aa, Homo sapiens
MRKLVLGQKRGIGHGLKMLTVHCDGSVSDEVTCGSRLREDPRRLSARSVTSCQWEESPVSARLGETRSSDLEGKRQEHTAGWSSQGEHPFREASETSGNIRSCQTYDDAKRRYCCMYAKCQALSCQVCILFANDIEPKC

SEQ ID NO: 930922 - protein, 148 aa, Homo sapiens
MRKTCHHDSITSHWVPPTTHGNYGSYSSRRDLSGDTTKPYYGAQPSELKCQAHSHVPDLPQGILAPGPPLQIQAPGPPPWTHVSGNPKGTNARHSHSWTPAAGLPFQSVKNGKGDYFFKYTHIKATKIMKNQKHDTTQGIKETSSNEP

SEQ ID NO: 930923 - protein, 185 aa, Homo sapiens
MPQGALIRKLSIAYPPTPLRPQLGLKPDPGYDIWCSGEPDNSHGVKFIDLREDAIRNIFVTWKEVKTATLTGIWKKLILTLMDDFKASVEEVTVIMIEVARELELEKKPEDVTELMKFHDKSLMNEDLLFMDEKANFIVALFPEIATAIPAFSNHHPDQSAATSIKASSSTSKNTLQLNEVSDDC

SEQ ID NO: 930924 - protein, 142 aa, Homo sapiens
MSLIGHRSSFLWLLCVKQPKGTQNAAVVIEVGGVGDGENSGGQKAASDKDKKLLDVGDTYLWEKTVPHLFHCCLHTCVVQTFSLDVNWIPSLQGDCPAPGRAHGLVASDAPILVPSFICHTNISFFSLCQYINGVGVIYFSD

SEQ ID NO: 930925 - protein, 248 aa, Homo sapiens
MRPEFLPSGGFVASLTSGVKLQTFKVSVTALKGGVCGVVHSFMVSLASGVKLQTFVLDRKVLQVPTQPRSPAGFTSQWHSPWDFAAPSLSTPAAQRELIPRSSPAGTSQLHRVWGPPSVGSTEPTPTRILHQPMSATHSPSSCPHLSLHISLQAEGAGSSLSQLQRGAPTVQQRAEGLLERGQSGCQGQGGSESKQGLLARCHPSIPPLYRTPQLLFGIWLMTTLATSCWIEAKKGPCSCSVLQSGTL

SEQ ID NO: 930926 - protein, 246 aa, Homo sapiens
MLWRHFPHCPGPGQLCPCGSAGYSHRAGFHWLVLNACSFSRCTVQAVDVLPFWSPEDGGPFSTAPLSSALNDWVGQQQLCYSPATGEGRVAFNASSSRQVAKESTLLHQMAAVGRIACPEGTHKWVATHFGPGGSCQSWQWLWVEDVNGLQECGDTRVVGLQGWMESVYCYERASGHAAECGKIGKAHGNPEQRRSSGVNAKRCLELTRKVLEIRKLNRGNSGHEKVKDRPYRNQSYWHQASHPQY

SEQ ID NO: 930927 - protein, 288 aa, Homo sapiens
MRNVQVCYIEEEEEEEEGEGEGEGEGEEEEEEEEEEEEEEEEEEEEEEEEEEEEEEEEEEEEEEEEEEEEEEEEEEEEEEEEEEGEKEKEKKEKKEKEEKEEKEKKEKKEKEKRKKRKKEEEERRRRRRRRRRRRRRRRRRRRRRGRGRGRRGRRGRRRKKKKKEEQGGEGGEGGEREEGEEGEGEEEEEEEEEEEEEEERRRRRTRRRRRRRKKKRKKRKKKEEEEVERSRRRRSRRRRRRRRQKKKKKKKKKKTKKKKKKKKKKKKKKKRKKKSSWVTELAYDWLQ

SEQ ID NO: 930928 - protein, 154 aa, Homo sapiens
MRTVCGGVHSQVGAQKAFIAGEHGALTMGLHRVPAVGAGSRSLHGPAVEVHSLAAWLMVLGQPGWLTGLADRLLKARHQVLLAPTNSLHPGDLAMPVSSVFLSYNSPCMAQDSISWNPWAKNPRSENTSLATILEAAHHHLGSSEIKDPLVTLV

SEQ ID NO: 930929 - protein, 199 aa, Homo sapiens
MVPDNVEFSPWGQRRVQPLGGPTPGEDHLLSPSRYWPAHPSHRQLLPPLHETLHPSSKSMCRAWNSLESSEEDRKICESVELPRDLLNGFDENADSHMDNEVQAEVVSDGDEELLGNWSKGDCCCALAKRLVAFYSCSRDLWNFQLVRNDLGYLEKEISKQQSIQEVIDYKSLENLQPDHGIENKNSFSVEKFKPVAEI

SEQ ID NO: 930930 - protein, 277 aa, Homo sapiens
MVKGSLPMMKTVKMFVSHVSAYQRVTSAEEFNNQVDRMTCSVDNTQPLFPVIPVITQWTQQHGLPLTKSDLAPATAKKVRQWAHDHEIHWSYDVSHHPKAAGLTEWWNGFLKPQLQCQLGDNTLQDSGKVLQKAVYALNQHPIYGIVSPIARIHRSRNQGVEGEVSLLTNIPSDPLAKSLLPVPVTLHSAGLEVLVSEGRMLPAGDTTITPLNWKLRLTPGHFGFLLPRSQQANKGVTELAGVTDLEHQGEISLVLHNRVTGAQCEGNIICKSEQIC

SEQ ID NO: 930931 - protein, 345 aa, Homo sapiens
MSSTQFNKDPSYGLSAEIKNRLLCKYDPQKEVELRSWIEGLTSLSIGPDFQKGLKDGISLWTLMNKLQPGSVLKINRSMQNWHQLENLSNFIKAMVSYGMNTVDLFDANDLFESGNMTQLQVSLLALVSKARTKGLQSGVDIGLKYSEKQEPNFDDATMKAGQCTIGLQMGTNKCTSQSGMTAYSTRRHLYDPKNHILPPMDNLTISLQMGTNKCASQMGYTQGAKQSGQVFGLGRQIHDPKFCPEGTVADRAPSGAQARGRSLNIPLTTRRRLATEAPSTLSPHIISPSEFLGFSVFSSFFFLTCSVLPINPGSDNAGKSGIIDDFEFKQLLYNEVICCVKGGP

SEQ ID NO: 930932 - protein, 146 aa, Homo sapiens
MPRYFLATSLFSPNPCKESSKEGTCGPHNCILEQRFPRADSCEDSFMGHNDGCCGEPHPDGPESVHSPLTSSWSDPIQWPSGLPLPEQLVLRKELQLPGLRFLLNKMPSLPSSEALTTASTADTSPKFLKEKLFLCRCFRFSLSLW

SEQ ID NO: 930933 - protein, 143 aa, Homo sapiens [sequence omitted]

SEQ ID NO: 930934 - protein, 141 aa, Homo sapiens
MVQEAVQAKESEPAAISGDHTVLEGNIALPDICHYPVTDKWQNKENEGDAQLEEVKRYICPLDPGDCNAKRFLKCLTVTSKSQFKDRSLGHPLVAEKSHEISAHVYQKARPSPTFPYNIENVARSGMWEGLKRIWNHKNWT

SEQ ID NO: 930935 - protein, 572 aa, Homo sapiens
MNRLAQILFPSRHVLFICLCYRLQNQSVHQSQPRVLEVETTPGSLRNGPGEESNFRTSSQQEINYSTHIFSPGGSPEGSPVLDPPPHLEPNRSTSRKHSAQHKNNRDDSLDWFDFMATHQSEPKNTVVVSPHPKTSGENMASKISNSTSQGKEKSEPGQRSKVDIGLLPSPGETGVPWRADNVESNKKKRLALDSEAAVSADKPDSVLTHHVPRNLQKLCKERAQKLCRNSTRVPAQCTVPSHPQSTPVHSPDRRLDSPKRKRPKSLAQVEEPAIENVKPPGSPVAKLAKFTFKQKSKLIHSFEDHSHVSPGATKIAVHSPKISQRRTRRDAALPVKRPGKLTSTPGNQISSQPQGETKEVSQQPPEKHGPREKVMCAPEKRIIQPELELGNETGCAHLTCEGDKKEEVSGSNKSGKVHACTLARLANFCFTPPSESKSKSPPPERKNRAVGCPGEGGMALGWDCLQLKAVSGGGFSCELSAANTLSSWKKWAHQSSTGNVGSAPQHLLPSVSGQDWVDRASSGVAGSILAHDAGRGCGRSCQALNPGSPFLMCTKLQHLCRDESEPKGTGW

SEQ ID NO: 930936 - protein, 201 aa, Homo sapiens
MTELLWVKGGCHHCSSSPLFSPVGDWTDLTQEEFPTVQHSGCGRSYSSQEFRDRPLISLGLSPWRQRWPQSPQISRLSLPLLALRNPGRPEEWDFPPVQRTASAKVQPQCFIKQVLDPVPPDWVRPLPTGVARHLTQESSRWHQVGASPGQRSQRKEQAAMFAVLQPPLVTSPGAGGSQVTKFCSESPANFSSPMEEGPEF

SEQ ID NO: 930937 - protein, 149 aa, Homo sapiens
MANLGLFRKKLVFWWVQTCPAKELRIYADDGAVGLRPAADTTAYLKYTWDLQQRLELVYVCAVRSGGFVVSLASGVKLQTFPVDVTAHKRSAGPKSEQQQDLLQRAKEQSFHSVEDLTRLPLLARAACFYSLIWPHPHPAHWSILQRAD

SEQ ID NO: 930938 - protein, 142 aa, Homo sapiens
MHDSLLEFAEGPLQTSFAWVSPQKLQNSKDCCLFLPLEALSQRGTHQIPAEALLYEVRARVLCLESRCSLQSLQAGTFKSAEAVPTEIPCPERRNLERQSGYSGSVELWWAPPSLNFLEALFILLIVLTRIPNFRSEKMVEQ

SEQ ID NO: 930939 - protein, 144 aa, Homo sapiens
MNILYVSSSCVRQDVSDRHSLEIWYMVLQPFEIENTEKGAGWGGKFIILVLYLLDLMCLTCVLRLRCVVGSCRYWLGTQKWLVRSRCRSGSEGLTYSSKSPYGKIAASELLKCHSSLTPCFIAVQLFPKWLSLVVGFRLNIQAQ

SEQ ID NO: 930940 - protein, 142 aa, Homo sapiens
MRRRERGTPVLPLIAICDPGKEGNADGRGRLGKDMGLPLKRVVDFPAQCSSSGKSQTASSSGSLTLVYPDWEISPSRGQQTPHTGELWLASSGCPSGTKLPEERTGSNLCCSAASTRDTKANSIWSGPPANSSRPAAEGTNS

SEQ ID NO: 930941 - protein, 145 aa, Homo sapiens
MKPTESWWIIFRICCWIRHWTAGSRGQQFLRDEKQTRYPTIIQLNAWRVFRPPCGGTQASSDSFPESNRYSWELKDTKKKCIIRQFHHFANIIECTNANLDTIAYYTPRLHSMLLLGYKSVQHVTVPNTVDKCNTMGSICVPKHN

SEQ ID NO: 930942 - protein, 284 aa, Homo sapiens
MLVVALDNPFKEDHLVQLNEIYIFCILTETLAAHIEAMFLDHNNASLSRCDKSENSDQIFTDGSSRAAGDPPCFQGLGSPRSRCLLILGLVRGHFLVYRGPVFLYPHKAESRDRSSYQPYHPKCSRFLLISEAKQGLWEVGVAWTMAGQPSGSHVVHGGVGSGCDGLSICTLLSCVGISVIVALCAALSGPRVLSTIISRKAEFWYPAYCAKTVTAKGKLPLRPLKEIRAAPADSQQANENLSLTTTNTVHPRITQLELANEEEDIEAVVPESKLTLENPSEGF

SEQ ID NO: 930943 - protein, 142 aa, Homo sapiens
MTQNRIKSLTNYWQGRNVERMDILLQMGLLAAFPRCSLEDGQFQGEAFHPTQPLSSGYQGIKPGSMWMSLRGASVSSASPGGVGEHQKERVVGRGAVIEICMNGKDPEQGILMSRGHSETCNLSSATQLVEICYSSLRKQIS

SEQ ID NO: 930944 - protein, 145 aa, Homo sapiens
MGSPVAPGRSKNAIHEPRSGAPEACLQKGSLHIVVTAGNDVLGHTWRQHSSEPHPQPVDWVLPFKAADSSLAQSVFRDVIWEIGPGMGASGLCLLPSSTVSELVSKFQDKVLFTLLSPLLKQREAVSPRVVMVVEGELSQGRKFE

SEQ ID NO: 930945 - protein, 261 aa, Homo sapiens
MLTVTWIIKSRLRWSQMEMRSLLGAGHVAFCPCPRDLWNYELGKHDLGYLVEEISKWQSVQEEAEPESSKRLQPDNAVEKKNPFSGEKFKLAAEICISNEKPNANDPDKSWSRSRAPLLCATSGLGAPCPSHSSPWLKGAKGSVKGKCGVGAPIQSSHWALPGGYVRRGPLSSRPQNGRSTDSLHQASGKAADTQHQSMKAARSRPVPCKATEAELPKAMGANLLHQYGLDMKHGESAMPGLLLGTYPNKLKTYIYTKPAH

SEQ ID NO: 930946 - protein, 173 aa, Homo sapiens
MGRLLGRGAPHIPDGAAGQRRSPHLRRWAAGQRPSSLPRQDGGRKEALLALVFPYLRGLIYLWSLMLVTFGWGFCVHILFVGIDATPSYLLLFLQKVRLLCCRSFLEVHSRPCLPGYHQQRLQNSKDCCLYLPLEALSLRGTCQMPARALLYEVSLDPCWEVFPSQEAWQREF

SEQ ID NO: 930947 - protein, 147 aa, Homo sapiens [sequence omitted]

SEQ ID NO: 930948 - protein, 142 aa, Homo sapiens
MFPSLCPCVFIVQLPLMRSSFCQDLGCAHDTDSGGPEDMCPSWLGHSLVLHILGRHETSINTCRCTLVQSGKEIKKKIKRMIRGKHMATGHLQQHKQFQIVVQQFGEDHQLPLVHDCEAFFSITCTGAVYAKQISQCLVTLT

SEQ ID NO: 930949 - protein, 144 aa, Homo sapiens
MLKHDLRVGDIAQGESEGKEKRLQNIPQESPIHKVWIKEEPQNRSEEHITRKEINFQDSFHGCKSVYFTLTMDDFGSTLYYMGLLYYSSTPRWCQGAERSLGTLSALVQLGGETSDVPLFLVLAFESLLASMEMSLSLPEHRAS

SEQ ID NO: 930950 - protein, 138 aa, Homo sapiens
MGVRDPLEEAVCPLAELKHCAGRSSAVFRAGRQERCSLLKLHSQLPLPPGALSQGDGSFIYKPLTGAAAFLSEMPCPEMRNLESFVLETQGPGGVATGGNLLVCSCGDHGKSVVSGPECTIPHGTVPHSFPWLREGVS

SEQ ID NO: 930951 - protein, 147 aa, Homo sapiens
MMPRYFLATSLFSPNPCKESSKEGTCGPHNCILEQRFPRADSCEDSFMGHNDGCCGEPHPDGPESVHSPLTSSWSDPIQWPSGLPLPEQLVLRKELQLPGLRFLLNKMPSLPSSEALTTASTADTSPKFLKEKLFLCRCFRFSLSLW

SEQ ID NO: 930952 - protein, 137 aa, Homo sapiens
MLQCTPNLLVLEDNDSLLAASSTGLQNLQQRLSLSPICVSDVRPVPAMCVQQVAEGNCCDDCRRNREGTAASRLWFGQFKPKARCRTWLGLRGVHSSSKSRGPVYKGGPREQVSNHQPQASVADTGRVPPGSHYTDF

SEQ ID NO: 930953 - protein, 136 aa, Homo sapiens
MVQEAVQAKESEPFCSSHLEKSFQANALKFHLHCKVRQGSAQSNGAEMPKRKNAQMNLDYLICVKYHSRDLQGGVKNMCKDLSDLGAFLGVKAWQGVSDGPSLDHLPFGMEAHNKNAAFQRLQGPYPCDQNAVLPH

SEQ ID NO: 930954 - protein, 169 aa, Homo sapiens
MLSLPLYPTPQKAPAPLPQVCCSLLEVHSRPCLPGVSPVEGAEQQRLLPAPSSGSFVPEGHQPDASRALLHEVSAEPCWVVSLSQEAQGDALPSEEESREGIWPQPIRHTVVDSTQSKPPGLLSTVRGKPPTQASVTGDTPPPTSSIIPSRLQNGVLAARISSQWFLAC

SEQ ID NO: 930955 - protein, 171 aa, Homo sapiens
MVPLCSRQVLQSHSTKIIRFNGLTVPRGWEGLTIMVEGERHVLPGGSQERMRAKQKGFPLIKPSDLMRLTHYHEYSMGETTPMIQLSLTGSLPQHMGIMGATIQDETGVWTQPNHITLPPPDAKPRCGSPRQKGEERLEYIFSFYGLPRGEKGAGERKAGQEGGRGKEVEN

SEQ ID NO: 930956 - protein, 150 aa, Homo sapiens
MSGLLTCGNFLILISLGALWETGAYFIPTVSTIEDSRTQGGRFRGLPLGMHSLSQGCSLLRKRIQRYFSHLLLKEEKYGSVLPSSLAVTETLESKTTDKGGLRTIVVWYELQRSMIRGVSGCSHTGAVWTQRTARGLAANYTPLCQRDRK

SEQ ID NO: 930957 - protein, 140 aa, Homo sapiens
MSYTLRIQIIVILSTRCSNTDFLMTKICFLGAYILFFSVILLLSSKQLEHTYYMDSPNMFTYHGSLSIYSNWKEREIHAFAFFATLFIYFLNFNLILDARCIYAGLLDGCIATRCTDESNIVACLMQLTSASHCVTLQKE

SEQ ID NO: 930958 - protein, 195 aa, Homo sapiens
MYTSCFCAYYQAVRKMGLYCGRRRTNLETMRATLEPTSANWKQHCLSLPPSIKCDEIDKSVEYAATTQEEFISLPIQSGLCGVRPESNMQLIKWFLDIFESHMDPAPYHEFPNLCQIYLPPNRQASHLNSSFISQTRFTLPGSQPNGLHLPSNLQNYSNKPVTFSHGNQKLCWLIWAMAATLYNTFLGVREGPGP

SEQ ID NO: 930959 - protein, 140 aa, Homo sapiens
MSFLFVSFPSNRQDPQLQVCWSLLEVHSRPCLPGYQQRWLQKSGGCRTADIGELQMLLPDRSSGSFVSEEYLAVSPAACWENHYSLQSCQTGTFKSAEVTAVFFCLSVPCPKRWSLQRQEGLLELWWAPPSLSFPAALFT

SEQ ID NO: 930960 - protein, 149 aa, Homo sapiens
MAYGPNIPGNLFQGFGFPDENVPALHYILKQLTLHKNCSRIAANSQAGLFGYVQAIIDVSKLLKSQQIELKVGYFLKTCSQLAKLRGGEYSPPDCQVCPGLPILTTKSWDPATKLEERVYKRQFSLLAENPSLAVYQNYSNPKKTCRTP

SEQ ID NO: 930961 - protein, 144 aa, Homo sapiens
MPIVHGDFVAGIGSFQWVLGLADFKNEAADPRSECSDVSRVSSFWWVRGLADFRSEATDLRKVKVQTFAVSVTAHKGSVGLKSEQQQDLLQRVKEQSFHSVEVDPSGLPLLAWVASFYLLIWPHPHPADWSILQSTDRSIFTEC

SEQ ID NO: 930962 - protein, 171 aa, Homo sapiens
MPLPLQLGSSQRLLQTHHRCHHFLMFICPFICQLTLRLFSILAIVNSAATNMGECRYLFDTLISFILDIYPVVGLQVHILDYLVALVSTWAELAPGSTRVVWELEFIKASLGLGSTGVGLDPRFMRTDLVLGSTGGGLSTGFLVLRLEPVSMGMGLEPVSTGKFKEGPLFN

SEQ ID NO: 930963 - protein, 147 aa, Homo sapiens
MTEVVACSIPQALCPREKLELCQPPGTQAVKLGEISSSKENKRGYISLAKILRNSCEIQDTRDLNEGRTHSKLSSCERVSLLEKWKQVTILTKDKHCGSKEDLFGKLCLSEINGKKEEKGETHRKFLFGVFKNSQSSIASEKLGQQL

SEQ ID NO: 930964 - protein, 149 aa, Homo sapiens
MGLLVCGGSTAVCCLQSILLPLPLFQTLISILIFYKPSSELWKINLNTINTQCGTLKKGDSMIYCAEALLDLHTGGSEVGSMTDFSRLLMSMADKWVLAVSYGPGAFVLLHVCLFTGCLGFLKSRYLKFKSEGLDRQELEAPSSLNFGP

SEQ ID NO: 930965 - protein, 143 aa, Homo sapiens
MLDVISFVYVCIVAFAFEGLPKKSFPGSVSCSVSPAFSPSSFIVSGFTFRSLSLYFSYGERSSFILLHMNIQFSQHHLLESVSSPLYVLGNFVKKELAPTDSNVNLIWQHPHRPTQKQYFASFNTIKLTLNINHHKSTLRQLH

SEQ ID NO: 930966 - protein, 132 aa, Homo sapiens
MVLPILSFRVFIVLGFTFKSLIHLELIFVYDIRKRGPVSIFCLWLASYLSTFIKQGVLSSLLVFVNFVDDQIVDIIDRLIILNSEAKIRSLFNYEQSHIFGLSKVTFLDLREINDNSPPKKGSNYFSKVRIL

SEQ ID NO: 930967 - protein, 136 aa, Homo sapiens
MRTHTRGAPSVFFIYLLCFVSAYITDENPEVMIPFTNANYDSHPMLYFSRAEVAELQLRAASSHEHIAARLTEAVHTMLSSPRNPSPMRIQSSPGPRGMLLAQPTLECSGVIIAHCSLDLPGSGDPPSSASRHHHA

SEQ ID NO: 930968 - protein, 149 aa, Homo sapiens
MRSRNQGGESASDGHISCPKPSIIGNAGEKSLSEDAKKKKKSNRKEDDVMASGTVKRHLKTSGECERKTKKSLELSKEDLIQLLSIMEGELQALGKSVALANSNFCVMLLHHGELWKVFKIHVVFMFIVVLDKVSDPRYAKYKLTLLKY

SEQ ID NO: 930969 - protein, 139 aa, Homo sapiens
MVELVYSPTNSSGPSAAGLLEFTGGPLQILFAWVSAAVAAEQRILVNHKCCCLILWKFCLRGVPSCEREFPDPLHFLGQVTFLPPQLETMEPKSLNIILHQFHFFIASMTYSRLIPNDVHYIVGKNSSKYLISAVIAFR

SEQ ID NO: 930970 - protein, 271 aa, Homo sapiens
MLWSFSSFFFLLYLSSRVHVHDVQVCYIAGAGHWQEWGNGISTHACTDIGEGGVLVGTGIPVSVHAFALVVVVQQDVCESVSSSPCPLKCPWQLWNLLLLQFCRSVARAGQSLPVQLTPSPLVSGSQESSPGSQQNQGSMLPSTSPQCLHPPPFTLNAFPLKICRKCGSLPKIPVSQWEMFLLVCCEPLNGTETVHSGSLDFKAVACRCYQLNKALPSTTRCLRSFVCSSSCYISWFPDREVREQQHKWLAEARKDQQREKEAIYTNSKLV

SEQ ID NO: 930971 - protein, 156 aa, Homo sapiens [sequence omitted]

SEQ ID NO: 930972 - protein, 144 aa, Homo sapiens [sequence omitted]

SEQ ID NO: 930973 - protein, 138 aa, Homo sapiens
MTPHQLCHILFNLKMDRKYRKEGKGRMKNFKAGKLQGRACAGVSAIRSRSSCPERATASILAMWIRGDCSVHFHIGLANAYGHNTLIKAVVKTGQNRLEIMDFLTELDGFIQIFHHQNGEISCACRNCHVYSPLDEKQ

SEQ ID NO: 930974 - protein, 126 aa, Homo sapiens
MPGAFPSRETGSPHSLCWTHHLVWKYLSLLFLDVCFVWLECVHLMAPGQPLEGCMQTIYLHWLSGETSWLWGTSAHLLKLILLCVFSGLRISNANSLTNLLFEKSTKSQQSLIVLVPHPTTLKPLS

SEQ ID NO: 930975 - protein, 136 aa, Homo sapiens
MEATRSWLVRGWLRTRSSILRPAEEVPRAGEVEPITGALGRPGLHQGHRREDVTPARPSNLNKGVAVHLNAVKVCVTMPCEHKRREEGLSSTSPWGVGRRGASPSNWLVKDLKKVRKDLGSVLKISTQNNPPLEPP

SEQ ID NO: 930976 - protein, 156 aa, Homo sapiens
MINTILQSFANQLLGLGPILYQVGAEHGHGNECSQQEAVVDPASKLSCTNGVSHGRGPGGAHLRLPDGVQACQWAPVMGPGSLALGTYFAGLEMLERVRSQPLTNDDLVTSISVPPYTGDLSLAPRISGTVCLSVPQPSPYQVIGCSGFHLSSLYP

SEQ ID NO: 930977 - protein, 125 aa, Homo sapiens
MVDDAGAAESQRGKQTPAHSLEQLRRLPLPPPQIRIRPWWFPVQELRDPLVFYLEAWLADELFGPDRAIIPEMEWTSQALLTVDIVDSGNLVEITVFGRPRVQNRVKSMLLCLAWFHREHRARVF

SEQ ID NO: 930978 - protein, 141 aa, Homo sapiens
MKAILDFPLNFQEKYEVGNVNCQTQREGVLPGIYVTEVLGVSKKRCLTHLNFHEEGYFSVSAFIFAQYTGGSIPKKIGPCSMDYDPNLLEEDDELHSQGDSLTDHSVKGKSTVWRIGEAEDYSQDISYLEELEEHRFSVWL

SEQ ID NO: 930979 - protein, 167 aa, Homo sapiens
MIRQQHLLFSNVRCSAASAADTQANRVWSGPLANSNRPAAEDPDYKTTKMGKNQSRKAENSKNQSASPSPKECSSLAATEQSWTENDFDELREEGFRLLNFSELKEEVRTHGKGAKNHEKRLDKWLTGITSVEKSLNDLMELKTMAQELRDEYTSFSSQFDQLEERV

SEQ ID NO: 930980 - protein, 149 aa, Homo sapiens
MGHLLFITRVLLVVPHLSNRREPPCLASNSHFCKVQMENNRTELNSQSFLLTVAVSPPGLLCLCSPTSDESPRGSASDFCFSSHWPFVCKQTISKNVKHPMLYIPRGICIYVIFFKYECKDLLEGFLKVIQLFNTYFRFVGTCEGLLHS

SEQ ID NO: 930981 - protein, 166 aa, Homo sapiens
MLNAMAGYHEGVAKEHTNDKQRSLNAHVEKVLVVWIEDEASHNIPLSQSLIQSKALSLQLHIQAQRGEEAAEENWKLAEFGPEVLRKEAVSITEKCKKEVLLWVKCYQTALHATEKPLVKESINEAMRLPQPFQPSATTILINQQPSTSRMVLRSLVKLVKPLKWF

SEQ ID NO: 930982 - protein, 146 aa, Homo sapiens
MLSPLKRIQPINMRAFEGHNLQSPECTERASRCLGYALRQLFNSCVSQLNFQYEDSSSGSGSHYIKAATERSPFQLSEPQDSPGHHLKSFWRQPHSHGPCTLQTSEDVKMAPCKCHQDLLPVLSGGVATTVPRLARTKPRAAEDYC

SEQ ID NO: 930983 - protein, 184 aa, Homo sapiens
MQFQKGKIPSLGNTALSLETCWDTKISGASKMQDTERNLKCIQKEAIYIFLQHFYNRKAKMRRNLFAVIISVIKNLLSKEAGTYSRNLQQCNNCGNLLGHKNLDEELGFSAMTPVDVSTAVELWSWSVERGPVLLVQIIAAFLIGMMLLSQDPKGEEKTCTFLVRVTEKLHEEEHGYKGAELGH

SEQ ID NO: 930984 - protein, 131 aa, Homo sapiens
MFTTFVFSQSTFIYSTSFYNSFVSILKDLEASQPLQILDLMTSLHLPVSHGAPVHNFPANLGCRSPWALVPMDFQYSLGKIYERNYPPLQFTFYLWNALTIDQVLKIIVEVFIQHDVLSPGKVFAQMSPSS

SEQ ID NO: 930985 - protein, 316 aa, Homo sapiens
MLSANYSAEERFLLLGFSDWPSLQPVLFALVLLCYLLTLTGNSALVLLAVRDPRLHTPMYYFLCHLALVDAGFTTSVVPPLLANLRGPALWLPRSHCTAQLCASLALGSAECVLLAVMALDRAAAVCRPLRYAGLVSPRLCRTLASASWLSGLTNSVAQTALLAERPLCAPRLLDHFICELPALLKLACGGDGDTTENQMFAARVVILLLPFAVILASYGAVARAVCCMRFSGGRRRAVGTCGSHLTAVCLFYGSAIYTYLQPAQRYNQARGKFVSLFYTVVTPALNPLIYTLRNKKVKGAARRLLRSLGRGQAGQ

SEQ ID NO: 930986 - protein, 229 aa, Homo sapiens
MRFGALWMKEVHGRQTCLGKQQPQRFSPHGGQEWIKLERDTTEEKMFEQLKPIEPVQKTLPWVGEVAATLQEAMKRDCWREARVKKKPVTFEDVAVNFTQEEWDCLDASQRVLYQDVMSETFKNLTSVARIFLHKPELITKLEQEEEQWREFVHLPNTEGLSAWVRKKEEEEEEEEEEEEEEEEEEEEEEEEEEEEEEEEEEEGEEEEEEEEEGENKSRIQLTLEQCMG

SEQ ID NO: 930987 - protein, 147 aa, Homo sapiens
MRGSIRVCERGCEDDVEEATPNLICSQGAQKKLLFGESSLGNTGGLYLDITERGTFQKDSPPHPPGRPVRAIFMVRSRWRRRHLETVIIQAMFKDSCQRTQKPPANTPIPHSETTTHNLECSQPTRSTFYSLKSLAAKRSVERGSPP

SEQ ID NO: 930988 - protein, 262 aa, Homo sapiens
MGKKQSRKTGNSKKQSTTPTPKECSSSPAMEQSWTQNDFDESREEGFRRSNYSELQEEIQTEGKKVKNFEKHLDECVTRITNTETCLKELMELKAKTRELCEECRTQELIKAGQHSDSGNTENATKNATKNASRRVTPRHIIDRITKVEMQEKMFRADREKCRVTLKGKPIRLTADLSAETLQARKEWGPIFNVLKEKNFQLRISFPAKLSFIREGEIKYLTDKKMLRDFITTRPALKELLKEALNMERNNRYQPLQNYAKM

SEQ ID NO: 930989 - protein, 139 aa, Homo sapiens
MATRDWERRGSRKGRNRELLIQEYKVSVVPPFWTEPIYLLYILVDVSHIPETYTIKLYPNHLGPKSSGPPEAVSQDACEAPVSIHSLIPRDLEVFSMHRLCSAQEAQWRTEQADWSVFLVCWDPETKKRTMTTSVKRYD

SEQ ID NO: 930990 - protein, 144 aa, Homo sapiens
MRCKHYSTVCFLLDSAPKWYTNGQRAHEKMLNIISHLTNADQNYTELKKEELYLAGSFGKTHVSNNRAPRVSNSCPFQGLTTLRGSLDKADSVPGFKACAGPQRGQSGHSTPLAAVAGSGLNMRPNSGNEAHSWAFPGKAIPFR

SEQ ID NO: 930991 - protein, 124 aa, Homo sapiens
MLISSRNTFSGSQTQNHITMQPVLKGYIFTQITHNLIDYHFENQCQWRENSFFTLCLLFSGYLTFLFTEIFKSDMGRRLLTVYNNFQIPIFNGLSKIRKPIKDAMKSSSDALNRALALALEERV

SEQ ID NO: 930992 - protein, 151 aa, Homo sapiens
MRGREVLQCGKYNALGRLKTTLNKNLLEKDLPYKLNVTFPLNRKLGEPAETILFMDAEELTVTRRANWEICPFDPVISHEAPPPTLGISAQHEIWAGMKIQTLTMGKTNLDCYKSGWWLFLGWVPGIAGTGCEGLVMFLDLGSGYICVFSL

SEQ ID NO: 930993 - protein, 187 aa, Homo sapiens
MIDVTVSFAKDFLGDGVATAIFKIAVAPTVQVKLLMQVQHASKHITADKQYKGIIDCVALNFAFKDKYKQIFLGGVDKRTQFWLYFAGNLTSGCAAGATSLCFVYPLDFAHTRLAADVGKAEAKGNSEASVTAWLRYVNLMGLRARTKASTCLCRLLSSTELPTSVSMTLEMECFRIPRTLTLSSAG

SEQ ID NO: 930994 - protein, 132 aa, Homo sapiens
MTVGSMRARMLEAHCLLPPLPPAHHVEDSRHRGSKEPLPGHGLSPLPERWKQSRTVHASGDSLGHVSGPGRPELLPLRTVSESVQRNKRDCLQGVILPEKCSTQIQDNITNVKFLISSELNFPVILHLTSFL

SEQ ID NO: 930995 - protein, 151 aa, Homo sapiens
MQVCCTDYFITQVLSLVSIKLESNFSATSADDLPWLGKQQALIVAGQARGPVTNGAAQTDIEDKEEREKGRGEKKSGEKLGNGRRCWDGSRQLRRFVLWCAAPQARLGPRDSGGDLQNTCPTKHTRVLGQRCHGSIVYNSEMWGTYLVRRQ

SEQ ID NO: 930996 - protein, 154 aa, Homo sapiens
MTTQNLTGFVFCREEKKKVNELQRDENQKYSISLNLSTQERCKPTAFLSRKLSCFPAKVRTEAAMGTMHPQPRDAGSPHQRLEEAPPEPVLDFRPRPPNTSAVARMGLWLWLQPPGTPAGEKEATHGERPGSKYLKENGTRSQSSVLNVVISKI

SEQ ID NO: 930997 - protein, 226 aa, Homo sapiens
MSSQSVLVSWVDPVLEKQKKVVASRQYTVRYREKGELARWDYKQIANRRVLIENLIPDTVYEFAVRISQGERDGKWTPTTAPENLNVWPVNGKPTVVAASWDALPETEGKVKVSSFQPSAKSFQNTFFHTPRLSNHLEQSPSPILETLLLPWWMVCSLGNAIFSKSGPQTGEAWDLTPKPSLSLCQQVSIMCLWLSSLSLHSCCLFCVPLNHALGFGTAQQMIFPG

SEQ ID NO: 930998 - protein, 177 aa, Homo sapiens
MTGIEMLSIERHKHMDPSRRAGGVFLSLASRLMEPPSSRKRPNAPYVTYLNKDPSAPCSLTDALDHFQVDSLDEIIPNDLKKSDLPPQHAPRNITVVAVEGCHSFVIVDWDKATPGDVVTGSDPAVSVTISSRWATHLSLFGVSPGLVPLPLSLLSRLLGASRQIWVLLSSLCGNRR

SEQ ID NO: 930999 - protein, 142 aa, Homo sapiens
MKPMSLGARRHCVGTVCWSLLFAWVSPEKATERQRLLPIPSSGSFIPEGHLPDASQSSSMPCLEKRNLERQSGLSDLAELWWALPSSNFLATLFTLCNSNMMVNSKQLCTLEAGVEVGRRSLTALVAAFGLLCERGEKSCLG

SEQ ID NO: 931000 - protein, 140 aa, Homo sapiens
MRCVPGLSPRFSTHLNTHALCQRIYSAHSVAEIPVLPVEVMCTSSWKDRLTAGGRHSSAPFSCFGGCEGTGPFQGHGAFPPLRYIQLKAALKCAFRKSNLGPTLDLLNWNTGGSQDRQEVEWLRRPRPGLLAEAEASSRD

SEQ ID NO: 931001 - protein, 170 aa, Homo sapiens
MHGRSLAAQRCVSVPVTSPNINPPHFQFPGLLWMFDLPNGRPFTPIGSTFLASPMRCAEHLLPETSLACLRDKGAMPPSTTAKLIAGSFKIHEEKQIELQEEIDKSKIMLRDFSIPPNSTEQVERKIRKTTKDLNNIVSQINLLDSYRMYQPQTAKYTFFSRTHRTYRPR

SEQ ID NO: 931002 - protein, 239 aa, Homo sapiens
MSPFKMGQNINNAFGPETANKCTVQQRFKKFCKGDESLEDEECSGWLTEVDNDPLRAVIEADPRTTTREVAEELNINHSTVIRHLKQIGKVKKLLDFIQQPAMTSSIVEPRRSSKALLKVKLALKKVMVIVWWPAASLIHYSFLNPITSEKYPLQIDETHGKLQCLQRALVFSMTMPNHTWHNQRFKKFSKVNNILICPGLDPGLKGFWEQETFAAKTGKVLDKLGSPLSPLIGFSFYE

SEQ ID NO: 931003 - protein, 157 aa, Homo sapiens
MCGERAWFGFKSEKLARKVSRACVLQQVVTVGNRTMVLLETLCGLGALHYSKLMRGGLCSKHGGLILSLSPGPICSIVLGRCHCWEAGGSSSCLAQTVEAFLAGSCSLCAPHLVQGLEVKCSTLLLRVQGSSSPPRATALPTLNPYDILGSRATFLP

SEQ ID NO: 931004 - protein, 150 aa, Homo sapiens
MIAAAGKSETLGPASSWKLRRRHLQKAPVSNNTVERTLPLRQGSRAAGELEVLRESGPDPDPKRGFLDLAQEGILGKSIEQSESKFIRKPCWAARSMGLDHIRCDQWIPNLCGSTCVPLTAGLPVIKVVREGQGGCAGVPDLVALSSEEK

SEQ ID NO: 931005 - protein, 128 aa, Homo sapiens
MKKVPPVHDTFAFTVRFQRRCILLIKKSYFGLLAGTAIFRVTMAKLGVYDVPQHAVGIVVNKQVKGKILAKRINVRIEHITHSKSRDSFLKRVKENDQKKKEAKEKEPMGRSLSCWNLFPINSWHNRC

SEQ ID NO: 931006 - protein, 135 aa, Homo sapiens
MLMRPEMYEQACTAAVCVRPEDHLEHAYQREDNTDIQEKTQRSPREGGSKDWSWRGWSCSKSRNARSHQKLEEEGFSLQLQRESGPADTLIWAHWCNAVLTLTTLCPVLRAQSSMDCPHFRHQLLVQRSQGYPHS

SEQ ID NO: 931007 - protein, 150 aa, Homo sapiens
MRSPYTVHISCTAYSDPLKIHNSYREQLCGTAGFNLDLYDSKVHTCEYNTLDCPRQCGLCPEVNLEVADPSSSSRELWFRAGAQGAGAMQGVTELRPPEFVKSRKPQVGSGHMGNCLSKGKRFLGHCQYKQGLPQRHQLQAEERESGMRQ

SEQ ID NO: 931008 - protein, 153 aa, Homo sapiens
MALWLQGSPWLAGHLTGEALPGLKLHLFHVILISFQTILHPPCLLPTGISGLTSRLCFNKPSCSGLHVLVSHKQMAFQPLLKRPGSSAEVFVGCLKEEKPRMRAQPPTQASTKAALSSSDLILAFRVMFRLKKKIHERNIQKPLLSPKLEPLV

SEQ ID NO: 931009 - protein, 141 aa, Homo sapiens
MLCKTASEQEAHCIPKEMQQATLTLHHQQRPCGSGSPSAQFYLLPFMTGFLKVERTDNNFIQNILANIYVQIPMKLSVLANFHVTVTTRNTHNHMSEDSGVLPLVRGYTFMEKHTEEQQKGIVSISWEKPDTELHDLSEAI

SEQ ID NO: 931010 - protein, 151 aa, Homo sapiens [sequence omitted]

SEQ ID NO: 931011 - protein, 159 aa, Homo sapiens
MALMGSRLDHRRYTNAPSNSRHKIRGRTCPHLPPCAIITKTTCPVTESKDLNLLGTNGSDTEPLKVVFCREQEVFIEGTDDGKVVKGLDYRINVLGLQRSFYRNDCRGTALDIGKDVFNLYCFGANRMVSELQRYLNSPIKCYPVMSLDIVRGFNVKLN

SEQ ID NO: 931012 - protein, 153 aa, Homo sapiens
MYIRQFQNPKWCKKISLILPLHYLQISITFDKKATFNYIAALLYTVSPFSFAAFKIFSSPLTFNSLTIMWVLHNEKKGYRPYFLHAASTLAEKGSEVLRVNWVHTGKKGFLPAGPRGRMFYFLETISIGSFSSFFKMEHDFRPFFLANKFLKL

SEQ ID NO: 931013 - protein, 135 aa, Homo sapiens
MGRDALDASDSKKCLRPRGLRKKTADAGVKNLPRVSVTETTSSRTEHQGVSEKEIGTSKALLPLLALPFLSRVPQLQVCWSLPEVHSRPYLPGYHQQRLQNSKYCCLILLLESSSQRGTRLYEVSFGPYLEVSPS

SEQ ID NO: 931014 - protein, 134 aa, Homo sapiens [sequence omitted]

SEQ ID NO: 931015 - protein, 169 aa, Homo sapiens
MARNGLRRNIFIANKNNSPEIPTCLTAVLTHKYLYTKLKFVTILILLIVGIQVYQILQVAKAEQKILEKNTLITGDAKETEIILQPHVVVIEFLRLFSTPLQGIPSNHVTEVVFVRFLHCKVTTCPSSLSLPLSLEDITIDSPHLREEKFMLHFLEGYSKILIAFRPFG

SEQ ID NO: 931016 - protein, 125 aa, Homo sapiens
MNTRFRRSEYSLEPSVLAFFITFGNAFWRKPSQNFTELYLLPMVAALHIPEIYVFLGSDIAHSACLLFRTREGRRWYYWSSCSSSAFARWYHKKIGNSGNVCKTYVTIIPPEGCRDLQQLLPVIS

SEQ ID NO: 931017 - protein, 263 aa, Homo sapiens
MSQPSEGKIEKERARPESSCLISSDARKVCAYSFSWAHRRGLCVSPFVHPVLQGCIASSSTIIITIIIIITIIITTTIITTTIASTTTIITTTITSATAIITTTITSATAIITTTITSATAIITTTITSATAIITTTITSATAIITTTITSATAIITTTITSATAIITTTITSATAIITTTITSATAIITTTITSATAIITTTITSATAIITTTITTITSATTIITTTITSATAIIITTTTIPSIILTTHITTSITSIISNLL

SEQ ID NO: 931018 - protein, 141 aa, Homo sapiens
MDWYLSAAVLDSHRSGNPIVNCICEGSRLQAPYDNLPPNDLSLTAIILRWDHLVAGKQVVGGKAALKAQGQGSKETQVLGVRSKSMSGALRKQVTPGNPGGADDCPLQSLLLSKFPPAWTFHLNFRPMHPTAYLTSLLGYL

SEQ ID NO: 931019 - protein, 197 aa, Homo sapiens
MSGYWYTLGFTENTHSANPLLRCFTSDLDINNRKVKLHFEDKFTFTAHLALKEDGITILCSDNNRGKRPYPPYPISEEGEEHDFTKLHNKDGRQHSFRCAHSRHHQHSCHRETHQHSSLPQSGLQASKAKMANANSQEARYSIICANSPLGARWLQQVQVRELSCVTPKEQKPGTGEWRTKDQRTNAQDAQNEKVSC

SEQ ID NO: 931020 - protein, 156 aa, Homo sapiens
MWPTAGGGEWCPKYACASEGDMQLDTTLASLPGDSNSGSLRGDGKVNFKQANLTTANLGTTDLQSGTQNPENEACILTNPPLENLSLLSFDYDQRGVMKSKIYIHGICVKNLDLDSSEGWYSTFSESVKVPFLIIRYSCPSGKEEKKSCFKNIAQY

SEQ ID NO: 931021 - protein, 147 aa, Homo sapiens
MGISSEAGSESSPAAKKTLRKTETEKSIQDIGIPQKSYLPNFGWQHPKMKGAWIPKSLFGGEPLQRTACCALDCEPPCLQCLQLTEARITHLPFSKPFLLKEYSDHLVTLDWWSLCVLLEFMNITIAEKQHKLALYILPDNEEFLRG

SEQ ID NO: 931022 - protein, 162 aa, Homo sapiens
MSSTLCFTKDTATERNRKRKRKAEGKENPWGSYIITLDSHSNQCYADLSDELEKQEEAETSVSRQERSAPGQIFRDQFLSVWGAPWKPVASNGPLTGKGSRSLDPKKGLLDLVQERIQGLRCQWEIETSIDSLPPSVVRVMMDRKAAHITVLAAICFFSCSW

SEQ ID NO: 931023 - protein, 164 aa, Homo sapiens [sequence omitted]

SEQ ID NO: 931024 - protein, 362 aa, Homo sapiens
MIGQVTALRLSSNPLEPGCPDDLVWLERILPCMDVTLWDDVKGSGKRGASIRFYRGLRKLKIMVEGKGEQGLHVAKARARRREPVVGGATLYNNQISPFLAKVWAARPKLDFHKHICISQVSGCMDSPEKPPWSQWTVPYETLLTILRERCVSLKLMVNNENPWQDPSAKKENNMEEKHPLLKNCGPEWLIPLPLTLRGLELSCMATPNCKGDWERRRRRRRRRKKKKKKKKKKKKKKKKKKKKKKRRRRKKKKKRRRRRRRRKKKKKKKKKRKKRKKKRRGRRGRRGGRRRRRRRRKEEEEEEEEEEEEEEEEEEEEEEEEEEEEEEEEEEEEEEEEEEEEEEEEEEDSSLLWRCGVGIPS

SEQ ID NO: 931025 - protein, 185 aa, Homo sapiens
MEQQDCALPLLTDVIQTNKEVAFKDLDVAILLGSVPREERFTENVKIIKWQGAALEKYDKKFVKVIVMGNPANINCLTASKLVPSIFNENFSCLTCLDHNQTQVQITLKLGVTADNYPDVNQAKTKLQAKEVVYEALKHDSWPQGEFMAVQQHGAAVIEAQKPSRTMSTTRAISNHLRDIWLGTP

SEQ ID NO: 931026 - protein, 157 aa, Homo sapiens
MGVFTQAQQHTPPVPPLSLDGLSFSHTGLLQSFECSQSFLSSIFCLPAYKNTAPHPCKDTAYYSSSDGPLGSSRWLPPFPWLEIQNEGVDGTMLPLKPPGKNLCSSLPPSGSCWQPCHSVAGAAALQFLPLLSHGLLPSLCVVYVSPNLSSPTETSH

SEQ ID NO: 931027 - protein, 137 aa, Homo sapiens
MTLVGKNHFVPGISGSKKGIPVILPHLEAIKGPFSLELKGTSRNRLIQRFALQQIRWFNPHFTEEDVVSESNTHQKHLEGSSRTDGWASPEFLIQQAWVRPENLQVQQVPGDADADAVCAGTALKPPQRRLHKGYAG

SEQ ID NO: 931028 - protein, 142 aa, Homo sapiens
MPFTVKRNVNKCKGGSIKSQLHKIYCEKAKSLYDNRKQKDVEGSNAGEFNASKGWFDNFREKFVFENVKITGEAFSANPETAKLSEPNKKYKTTPGHIINKLFKTSYEKKIIKATRGIKTHYVQKQQDKDDISLLVENNARF

SEQ ID NO: 931029 - protein, 145 aa, Homo sapiens
MEEVETVGFNEIQCWACRLPALMGYISSLSLSFFICETAEKQSKKLTLVEALVRLPYQRAQSYSPSQVNGYVMYPEHLLAEIISVGHLALDPYLLMTLRWFHCFQSFSHILKHKLDHDSALHRSRPIASHQDKIYTPYPSEQGPT

SEQ ID NO: 931030 - protein, 151 aa, Homo sapiens
MRKGVQRFFPERNPCTAGAHSRLSLHLLCPPTQLMSGRFIEGNQLFKGSAPQMALLSPAVGTHLRLCIQATLSLPPPPLLFLQTGPHTHPLYTMVSLLCGLHVWVNPVWAENRGSFQLQKEIPAPLLLLSDPGHERRGLPLRIPSPPLKHL

SEQ ID NO: 931031 - protein, 170 aa, Homo sapiens
MGLQRDMSWNQSPTDPEVWLLPGSSTWKQQCEVWSEAVGGSSRESEPWLLLWDLLLHTCTCAGFRLLNAGLWTYLPHGAVVWVTVRSSASQPLKPQTKSRDMEVRLRGVDKKTASTHKGNLQSLIIGGACFSFVFCHDSTCSLRKEQLPSCLIEGWGWRAGNCYYAKSQL

SEQ ID NO: 931032 - protein, 355 aa, Homo sapiens
MAVPALTPAALDVGALYPFSRSGSRGRLPRFRNYAFASSWSTSYSGYRYHRHCYAEERQSAEDYEKEESHRQRRLKERERIGELGAPEVWGPSPKFPQLDSDEHTPVEDEEEVTHQKSSSSDSNSEEHRKKKTSRSRNKKKRKNKSSKRKHRKYSDSDSNSESDTNSDSDDDKKRVKAKKKKKKKKHKTKKKKNKKTKKESSDSSCKDSEEDLSEATWMEQPNVADTMDLIGPEAPIIHTSQDEKPLKYGHALLPGEGAAMAEYVKAGKRIPRRGEIGLTSEEIGSFECSGYVMSGSRHRRMEAVRLRKENQIYSADEKRALASFNQEERRKRESKILASFREMVHKKTKEKDDK

SEQ ID NO: 931033 - protein, 148 aa, Homo sapiens
MGSEGTEGDNRAEESQQRPHGPHGLEDLLVGPLERKSVALPWKLNGASTELHPLASFYLPPLTSCVSAPFSYCVGKRVAASHMSFWPTQQGKGEGEILFPTQRKEPRLSPIGLAWMWCLSPWQSALMVQEWVTHHSWSWEPTCHSPVS

SEQ ID NO: 931034 - protein, 227 aa, Homo sapiens
MILNRFQYLEAQDFLGLRLALLAPQLAACRQPTVGPCEHVSTVKVRALIGKEWDPATWNGDVWEDPDEAGDTELVNSDELFCQKEQLPHPQVTVHWGKGNDQTFQGLLDTGSELTLIPGDPKRHCGPPVKVGAYGGQKTDGSWRMAVDYHKLHQVVTPTVAAVPDVVSLLEQINTSLGTWYAAIDLANAFFSILVYKAHQKQFAFSWQGQQYAFTILPQGYISYLAL

SEQ ID NO: 931035 - protein, 163 aa, Homo sapiens
MGSKPNNVVVLVGSESSLKDLGIYDQHVAKLAITLSPSEQQVPPGPRWAEEPLSVATTTTDPCGVLPGHHHCSLKAQGRFSQLVVNAARPGTHPSGPLAPVWTKAGPEMLINSLGLDSGTPRACLVLYPIVVELMEKPMLLATHTQCSLCRGADKVIFCGSEV

SEQ ID NO: 931036 - protein, 188 aa, Homo sapiens
MFMTVTLEKYYYLRINYPSSGIALSLRKPKVPHKRRQVEKTRGCCLNPVPCLRSRGATQRSKPLSWSLPPEQRHNGFAQLDTLVLRGESSKAPLKELTLFGTESKGNSSLRAFWETVESNQLIINMNLCLMVLEAKKSKIKGLASCEGLLAVSSHSGKARAYARMRVKALNLPLYNEPAPAMRALIHS

SEQ ID NO: 931037 - protein, 168 aa, Homo sapiens
MQQFSNSASYLSRKLACIWLCFPGSTHALCPQLDPTASMKLSLGETWFHSFYLSNVSRIQPLLTTFLLTTCEIKPLALNLNPAPSQIIMPPLDFGINSLNCLLNCHLCPQYSQQGSQVILTKSLVSSPQNFWSQDSFILLKITGDPKECFLMWVVGLSWIYRLFFGSI

SEQ ID NO: 931038 - protein, 141 aa, Homo sapiens
MAEWYCENATGYTHNCPQGWKKLREEPGKEGAVASLVAGSCQQGTNISQSPTGSSFQNSILTATKTGKKLGQVKMLIAEENLEFSSPIHHSFGWCKPFAIFQSSKRVGYDHFGLLFNVSAGRWEIGAAYSPILLMSLLGYS

SEQ ID NO: 931039 - protein, 136 aa, Homo sapiens
MACLLQAPLMCLHCKELGGHFRDLCSTLSHNRPGGLGGNNGFAGRAQVPASLCSLGTWHTVSQLLQLHPWLKGAKVHQQLAPCTWKSCKHSTPTHETAVGAVPCTATEAELPKALGAYLLHQRALDVRHGIRGDYF

SEQ ID NO: 931040 - protein, 306 aa, Homo sapiens
MRSFYGCFDLHFSSLNVIHPFHPSTHENKSQSLPFIISPLYAGLKLSPNNTLKGVETNNNLENKTGGMERSKQMKVRITEAFKPLIEVTITLVFKKQGYNKRLAVSNSEEGPHLIPTMLTPRSWTSSLQLKDSEVHLPLPQPTQGQRPGCEHQGPYEGISRVPGASSLRESKRAQKPTTEDPCLPFSSNVKKVHENQERTIQKDESSRTCAHASPRIVPFSSDQIGKCQGSWLQPPVTFSPHLESVVSFNISSCAAIPFMMDFQLPFISKTKHQVICRSCSLLFPSDTVFWFPSVSSQGWSPRDGN

SEQ ID NO: 931041 - protein, 154 aa, Homo sapiens
MDLPIRDVTPAAELNTPVFSHSTDFHKERSDNDFLLVTLRKDKSECYSTFLVLNLTVLLQVAFYFTIFIPEIKDTFNSSSLKNVHWFTEFIVSTRISGFFNGFWHHSNSQLAIFVGTRVPCEEENEFNCYGLNVCAALKIHMLKPNPQCNGIKR

SEQ ID NO: 931042 - protein, 151 aa, Homo sapiens [sequence omitted]

SEQ ID NO: 931043 - protein, 170 aa, Homo sapiens
MQNARTQWLAVASFGALQKLTLRLPDHIKELKLSRSSHPDQKTDPTSLMILLPLPNSSLPACSYISSLLYKPPILVGQGGGFETDLPSTWMQHQIKAFFSSNTCCLSDWLSVSFDPGQQLQARAEKVATACSLLLRCTLQKQKGHLLKQARSTSSELPTDSVLSDCVLLP

SEQ ID NO: 931044 - protein, 158 aa, Homo sapiens
MPYITVVRSGRLQICAYVKRSQLPQRHFRDLYGSPSHHRLGRLGGKNGFMGGAQSPTGLHSLGELCLTSRLLQLQSWLKEAQRICGKDSMSQKKPAAGMEPSWKTYPRAVLKENMGWSLHTEFLLGYHLVEPREESHHSPNPGMVEPLAARILHLEKP

SEQ ID NO: 931045 - protein, 169 aa, Homo sapiens
MLSVCSMIRDIELNLSRGPPHSSPSYTHLGEGTLYFSEVNCWSAKRDSDISLHQPNNYFSTNDSAHPPPLTPLFTVYWSLYNVLFMVILTVFSRTDIMENNPPLHGRILSSFLVICVFSVCSRAKKVIRDKQQLKNTAGVTFALWMRWGFPLATWCTPHANEVVVSQLG

SEQ ID NO: 931046 - protein, 149 aa, Homo sapiens
MIGKLVTRKSGEEAVYALNEHLIYRTVSPITRIQGSRNQGVEVEVAPLTIIPSDPLAKLLLPVPVTLHSAAPEVLVSEGGVLPPGDTTTIKLNWKLSLPPGHFGLLLPLSQQVKKGVTVFAGVTDLNYEDKISLLLHSGDEITLDFHPT

SEQ ID NO: 931047 - protein, 162 aa, Homo sapiens
MDPKSEQRQDLPQRAKEQSSHSMEEDPSTLLLLAQGSLASTLSCEDCLKFERASQGSRGEHMYVPLPTRSLTGHVGPGPTSPPTLCSLANQRGSMEHPVLSLFPLIGASLISQRGSTPLNKLEAGASQVCFMLEVKPQYALSQTTTESFQGDQGRHMFKNTE

SEQ ID NO: 931048 - protein, 152 aa, Homo sapiens
MFRERGRACTSPQLAFLGHCLPLPYRHTETHRTDSQRGCTMHCPVERTTGHRTARRLRHLAPAKQLGDVLWHARGERHSSVTCDISLSSDVPRKWITTAAMPQKEITILGYKDLNFPILRVTSDMSSRRWYKALKCDPCSFANVLIKMKGDL

SEQ ID NO: 931049 - protein, 183 aa, Homo sapiens
MPQGESPAWSENTISNNFTTSGRPSSRGLGSGAVPTASFRTARRSRPAAERLPCPQFSPRKRSDRGDGPRGSPSPVWDLAEGGSSGPFTEAPTFFQQGPLLHQGSSRVTQPRRCSLSLTLRLCRPSVKGSLPGEAGQVLADRRRTASPVVLSSQRTADAGYCSTGRLALFASAPHGCVPVPRT

SEQ ID NO: 931050 - protein, 140 aa, Homo sapiens
MITRRIGAELRSRESLLQGSVTIVGKRRGGEMKKKPHLQGAVTQKVTKPAGYQAVIEGSSRCIISSLTCKEFGDCHSHPHKKSIKLNKQKIIISYTCQRTEVTGQTSALNIGDTGEHREPFLPGTETHEQKQIDGTCQNT

SEQ ID NO: 931051 - protein, 236 aa, Homo sapiens
MPSTVGVLLSVWKPAVLCGRHRKTGGAGDQVFGFKCSKGESCQRNMKTGASDHLFNCYSEMDLSNGYSGLQHSGWLNRKIHPADDSKLLSLFGLALSLDLGPVLQKAKSHLSMAVPLPKGDAAAMPRRHAVPTILGHTMGIQDTEVSSSGAVQCGTGESKVKKYGMGWVCPLGLSSKLTDTEEEVMGQATVILKCTIFLTKTGFPGFLHLCTCSSSALALYLHVAFDSNLLGLLLR

SEQ ID NO: 931052 - protein, 157 aa, Homo sapiens
MTSPNKLNKAPESNPEETEICDLSDREIAILKKLKEIQDNTKKEFRIMSDNFPSNSQDPPLQVCWSLLEVHSRPCLPGYHQRRLQNSKCGCLILPLEASSQRGSWPYEVSVAPLLRGASQLGYSGVRDPLEEAVCPFSDLKLRAGRTTTLFLSDRDV

SEQ ID NO: 931053 - protein, 151 aa, Homo sapiens
MLLFLYPKSDSGCACASACVYWVDAAFVILSSESTPVNPWQTVTPGTMLDPGAGPGYPQSTFLHGEPSHGTLSFSALGTSSPTHWKGCALQGKDPFLPGASRSLCTLTHLLLGVQLCQGTLRKATQGQSLLLLVFTKPGGHSQSVIQMAFE

SEQ ID NO: 931054 - protein, 134 aa, Homo sapiens
MWQAAQPALATRWGPLPHCGRFVISLFAINPAAAHSLGPHCLYELFTPEASETKNPPGGTNNSRRATLRALTLTAKVCSFTPEPGDHEPTRRKKLRTHPKIRRNKLQRRHLKCCNTHRKANWMAPRCHALQALN

SEQ ID NO: 931055 - protein, 169 aa, Homo sapiens
MLAEDANSEEFQRCHSLFQRVLFLVQISPDSNMKMEQQEELVKGLELLKIKAADGRIIRSPCDSGESGYRGQLRSAGGSAVEQEEAHELCSPLAWRTGLTCTQRPQPSITASSGPRYCSHSFRYETEFIHFTLHATKVFNNASVVASQINAVRKLSKGISGSGARYNFV

SEQ ID NO: 931056 - protein, 144 aa, Homo sapiens
MLVLRPQLKTNRIQRPEWSPASCFNQPSRRCPCRQKFEPCCIRRCQYTSMAKDVDIYHGDAIKQETLPLIPHPFPDIRISPGAGPESPGVKSGNLHSCQVPRLFFFHVKNVTVPHCTVLSPRLRWARGLQCPAPTSPRPGLLPA

SEQ ID NO: 931057 - protein, 142 aa, Homo sapiens
MVHKHMKRCPTSLVIREVQTKLRGHLTPMRMTSIKNQEFTSVDVNRQVTRAAVRATDFMGSGRGDGKRTPPRAFEVAIPASLPCPVNVAYSPSSFQGPVSHSVIGDFLTPPVSSGDVLGSVGHGCRHSMDTTHQGAVVCFRK

SEQ ID NO: 931058 - protein, 175 aa, Homo sapiens
MKQTAWAGKKAEPAPGLTETRTTRNNPQSLDPEEKEEQKQQVENKQKMEPGTVLLPGAGFRREALKGPLVTCIPNSLTSHAALVSSPFHTTTPKGHEAGRMGSDVHLAFLEVQWSHAKSCGRQGEAVYSFGGCAVLPPHLWTPPPPNLAPVSCALGTLCACTSLRSAGSLMPLSL

SEQ ID NO: 931059 - protein, 226 aa, Homo sapiens
MLQLYLNIFLPFKRVICFSISAPSPHPVLLVWNSLSSLSTQPGPLPQIDLQSFHWTCSQGKVQLQGPKSNSKVKVQAQFLCLRSDLMSRWEQGPRSSFKIQVLIHFADPGSDARYRSKYKVYVKGPGLMFAPMVLVPRSKSSTFEGQGFLLLKTVATVSPTCDSPANCKNTALPTCCVSVHEIPTKEKKRKRAVLECETLNSPGCQASMLHSQAVSNNYLQLVAIE

SEQ ID NO: 931060 - protein, 175 aa, Homo sapiens
MEAQGRDTVRWLVSQLRELAGSPGARLAPSVYLSVGNSTSDAFHFEEITGKVHTSEWRIICWHVHILDTRLNASVHSFQPYFLYSWSTYKHTCTFTLTAEICMASQLQHPKMLMDLNLGTEDDCRFFLHLFQRNFIIQVERIMNPNPMSPSPSCNCQCFANLLSCIPIIFLFRIL

SEQ ID NO: 931061 - protein, 142 aa, Homo sapiens
MGKKQSRKTGNSKKQSTSPPPKECSSSPAMEQSWTENDFDELREEGFRRSNYSELQEEIQTNGKERKKNKKKRQSLQEIWDYVKRPNLRLIGVPESDGENGTKLENTLQDIIQENFPNPARQANIQLQEIQRTPGEEQLQDT

SEQ ID NO: 931062 - protein, 175 aa, Homo sapiens
MVSAVVCLAPSLPHADKCKVSLALIDGLMPLPRRPQPSDEILTQYQALIAVIYPFPVCNQFISMLFSYKIGIFIVLFFLETFCFSNWQRSVSSPEWWLHIFVPFADKKKKAQEEVIMRYWKIFLRRECLPVHQVLVHQLAMGEIPERILEYANTVDPKYKAQGRALGYAVSEKGS

SEQ ID NO: 931063 - protein, 174 aa, Homo sapiens
MRLPTDRQQTCDYVTLYDTDDFVDVIKDPEMRKLSWAQCPHKGLLIDLFNSSARETRWPTNNGGPQLGPDTQKIPKWIKPPPLSARRLLISHTRKGSDSLCGHPADDDVSVLGIRKHSLCGVIDTEVGSSDNTLHRHVKALVQALNPIRFVDLNQAVTEASEFPFSFSFTHISC

SEQ ID NO: 931064 - protein, 142 aa, Homo sapiens
MSLKMFQSLSELVPRAMTFTSASLVLLSLGALGFLAGPLRVLSVLLLYGYRLAVPPFGPWWFGLAQGLLQSLAQVKVDHTDPEHVAGTLPCAQGLELLSGFASAPTSRNISATTAHLLLCGPVTNRPQTSPSQQPQGQGPLL

SEQ ID NO: 931065 - protein, 152 aa, Homo sapiens
MVDKHFDVLLDSVCQYFIEDFSAGLLDFAGGPLQTLSAWVSAAEAAEQWILVNSRCCCQIVPLEVLSQRSTQPQLCCFGYYHFVAEVEDSDFTQKECPRTIPIIHPHSLISNKLSMRYSCVQKLDVPYEEKNDQMFLAEGWGCNNRPLGQWD

SEQ ID NO: 931066 - protein, 179 aa, Homo sapiens
MIIWYSLEDYCSQEIINDSEEDAPVVSNHHSSTCFCSQDPVEDSVAIEGSMHGFPVMVLTLAIYQGANNPSGGSAVRCLLLPGAQAAVMYPLLQHIHIMYYLKEWTQRSQTKPLGKEDLRSPLGHSEFDIPVERQSLPNRIPGGRAEKRVVFSFQESHKNIKRLRQRQTMRQIIKTHHS

SEQ ID NO: 931067 - protein, 353 aa, Homo sapiens
MCAPQGSLLGPALNSYTSSLAAIISFLCMVESPPAQFHLCEHTAGIESPGTYTPVSFSGCQALAVCPFILTLTPTQSITRTSGYSGTSSKPAEHQSLLHARLEQGTLRTNERLLPNKKAAAAHYSYGQKRPNRGVTLSQCEHVQTSQCRDQDMRLIVESECMAPGNASLLITALQPSLCGSRCPEGLLLTATTASLEASPVAPCDMGLCTVCMPTPSVDDPLCMRHLHSAGLLLGCSVNFRPVPATSLNPDLMGAHPHRFCVVCEAALYLYLASCCWAVKIKGVAMPPAEEKQGRNTTYMCGHQEPWEMGGSLSWRRLLHKKCGLCQKCEDESLEYNVMLFPKVKREMGTKND

SEQ ID NO: 931068 - protein, 146 aa, Homo sapiens
MLSQGKFHSHEEDGKYEDLKKQIGLSKYNPFLIKDDKFQNKGKGCSGFYHLQAVGRMKECFSQPQQQPERQHMHQLPEARSLSAKEGSEIRCLPALVKEELERTHQKRSFSYATCCDRGHGMGGADDYPSSSQHGSEKTFKRCSSC

SEQ ID NO: 931069 - protein, 134 aa, Homo sapiens
MVVKPFLTFSDHAKLLDRTLICVLILTATPVAAKVLAITNKAVMTTYIQIFESSWRKAIEMEENRTKEPIQMDAEHREVLPESLPVLHNQREFSMADFLLETTLSDFGQSHSTEEKVISDCECVPQKRADQSHR

SEQ ID NO: 931070 - protein, 144 aa, Homo sapiens
MGTGCSGLLSGPQSSVTSAALHPEPSSCLGDAAGSIHVGLNCAGPGCILGIYYKLSYIKAEQMLKQTVQKEGQQDGNHSDVYKQWVLCSWGKAKRSLRVCIGLGNQNVFLSFYAQEEMRIIKFGIQSRKLESRRAFSDISRKVV

SEQ ID NO: 931071 - protein, 161 aa, Homo sapiens
MAAGIGQHPAIVTGTYTTKQILKQNSPPSLDSRKIQEADTIALGRNYYIISICKVLNSRHVTKLSMHSQGILNVVCKEGDQCVLVAFIYEFSSLNRCFTMTKLSILLWQRFLDIYQIPIPFLLLAQLEYIYQTYYSMAAAMFPLRETYNSSIKFLYDSPKQ

SEQ ID NO: 931072 - protein, 143 aa, Homo sapiens
MSFFAMQILNFISVISDISVWLRAISGEVVCLFVVKGSGANLLLLGTASVASIVARALAPGCSGSETCGGLHGYCMLSPQQLWALYQFRGPGERSREWNGGCQGMRGGDNGELRYNGCKVSFMKDESLLEICCTTLHLQLTLL

SEQ ID NO: 931073 - protein, 137 aa, Homo sapiens
MCKFRQPSPYAVLVPPQCFLRAQLEDPSNSSTSGHSGQKDKTCVLLENSPLLPKADRTIARSNTQHQPTQRMTDLKLTNIFYKSHFRKINTSEATGYILEILNGFTLFGPSSYLNLADLFPFDTLLCILWILLAQCY

SEQ ID NO: 931074 - protein, 149 aa, Homo sapiens
MLLLESGDRGRAHPRGRHGGYKEKKRKPRGLGGPSRSLPTVSLRSRWSFHCQRLLLSRPEPFHLKGPYNLRETEFLTVHRSYHSTPVKVNPSVPDEPIMAFAGGFSMQDSAILLRTHPYHAALLLDLQLDSVPREGKLKTVHDRKAIFP

SEQ ID NO: 931075 - protein, 143 aa, Homo sapiens
MLVKYDGWEAEKKRRSPLAVEVLLTAVTAVDSSEPALVPEITVKSITGVIFLLAFLRLKHPEIMHPSRRGKWTCMESLILLEENTPDARSMKTGKTKQNKTTLEGEGGISLSSPTQPGKGTEVLPGFLNAYNYFKGSRVSRKN

SEQ ID NO: 931076 - protein, 128 aa, Homo sapiens
MYLLFFLMLFLPLPPDRTQCVLFTPLCFCVLTVQLPLISENMWCLVFYSCISLVKIMASSSIHLTAKDMISFLVLAAWYSMEYMYHNFFIQFTIDGHLGSFRVVAIVYSAAMNMFVKDQMVVDAWSYF

SEQ ID NO: 931077 - protein, 189 aa, Homo sapiens
MNSAKRQTDSGEKKGRSLEEPHLQAKEGLKPGGQAACPADLNGNLWGSLQAHPWLPIDQSAHAFSPMKARNTPGLARLKERLQDVKAERSEKVAEEKLETSRCRFTRFKERSHLHNIKVQGEAASADVEAAASFPEDLAKINDEGEDIIGRKWDNEFGDFNLKPMFIYHSENASALKNYGKSSLPVLYQ

SEQ ID NO: 931078 - protein, 155 aa, Homo sapiens
MLQAITISPSTSWLVRFKHKITKHNILGLLFFWSLNLSFNSDMISYIVGFSNVTQIILNVNKYCSLSPINVIIRRLFVTLSLSRDVFLVGIMLLSSAYMVILLSRHQRRSQHLHSTSFLLRTSPEKRATKTILLLLEFLKISHKCEIMQYLSFCI

SEQ ID NO: 931079 - protein, 138 aa, Homo sapiens
MGSQGKFQTALSQRASADRKEREHVKEKALSDVTAHFWAKGEEISTLRPFRLINPLHLFSEAPAKNRDIIPPPPPQILSQKYVTLSCRSVEVCWRSTPDPVCLGISSRGFRTANIAEQQMLLPDCSSGSFISEGYPAI

SEQ ID NO: 931080 - protein, 166 aa, Homo sapiens
MPGGRGRVGYRPTVPASAGLRGGEQSRREAQAVWTSLLPNLCWPLILCHPWLRGVSPERDLRGKSGLGSEKSVTLRSAPHLCLNRAGLSLTPPLAAQLGFPPEHHASSSTGAACFPRLLWNWPEVPDAVHCAAALRALQPERQFTGFWENSAASPARGQGHSFAGG

SEQ ID NO: 931081 - protein, 177 aa, Homo sapiens
MCTTCRSKLLLFIYDRTHMQDLKDVTNNVHCENYGSRKLAAVTYNGVDNNKNKGQLTNALLTCPDDDCSCRGLQNPQLPGPEIMECSMNEDHPGYGRRGHVSAPGGGSPAWAGRGRKQAGLGRCPWHWVSGPGPSHVQVEHGRHHVHAAGWLPTLLAPEADADAEDDHEQHLPVWVA

SEQ ID NO: 931082 - protein, 148 aa, Homo sapiens
MNKGSLEVRSKMESESQSSGARRESFLKKPEKSRLAPPGWNFQRQILNHSLKMQLHVSARSYPLEAEKGKEIDDHLGQGSSTPRLWPVRNWTEQQEVSGGQASEASSEFTHAPHHSHSCLSSTSCYTSCGIKFSQECEPYCELGMRGI

SEQ ID NO: 931083 - protein, 137 aa, Homo sapiens [sequence omitted]

SEQ ID NO: 931084 - protein, 129 aa, Homo sapiens
MFCPNTALYQANFMGDAQDKDVLLLYPEFLRLSSVEGLKTSCKSVEMSDKFNHSISLDKGQEHHPTNYSQPWSGVIVETEGSPQTEIQNVQGRPRISTQIWRLHCPCPRAFTLKSFVTFNTLKDFGKGS

SEQ ID NO: 931085 - protein, 139 aa, Homo sapiens
MQPQLLYTEPGAPCSLVYSAEICGSDPPLLTPFLVVSAQLPGLVQCFLGACCVTAFQRVFRDSTLTTPCPKGVHIPSGLRFLLNDRKLAERGLRKPFQNPTLPMDPEKHKMRTNKESLGFRWRKRKGRNRQDQKTGQTR

SEQ ID NO: 931086 - protein, 140 aa, Homo sapiens
MYQEQLLVLPARDPNITSRDGKTLVVISMSEVTTREDGINSFDILEENITLLEEIAGCRIGFYNCDPKWTGVTQAMRREDRSVHVAWHLKPLPLGITLKLPNNCTCMASDIQGAPVVMNTILTGYIVFANTSTALCMTKL

SEQ ID NO: 931087 - protein, 164 aa, Homo sapiens
MRSQPKMFNKNHRKDTRSWSCCPPGLLCDSPHAASKVPDVLLRAGESVDHHAGESAAQCKSVGAQEVDMDVSLGQEKGSCSQIATGQVWGSTKRAFSSTEGPELLKGRDLGQRRTGRGLAAQEKAGFMLSGGIQHGIVEGEVLHLPVPGTTGILLHEPSSTAGD

SEQ ID NO: 931088 - protein, 162 aa, Homo sapiens
MGTERGTRGDRRGVLWARSGVGTGVRVVVYGPGVGVAAGGLGCTPGPARARSEGGEHGGRGRPVDPTPPPRALPNLAFYGEELGPSGPGRPRGGVGAGEGRAGGRPGPRWTRTGPGLSPGAPRGPGTREAPRAAAHVSRAGLGAPDNNYPPSPGRVGPRTPS

SEQ ID NO: 931089 - protein, 644 aa, Homo sapiens
MEVGPATETFVLELQCLEDGGPGPDTLSGGSGGSESQEEEEPQERNSSPQRPAVSAPVGASEIAEETRPGQRELQLQQLEQQPEPQQQPQHEQLQQPQPHLELQQQPQQDGQQQLSQLQQEKHQSVHHQELKPELQLMHQQQQLQPQQVQEQQRLQQQQEQLQTQQAQEQQVLQQQEQLQQQVQEQQLLQQQQEQLQQQQLLQQQEQLQQQQFQQQQEQLQQQQQLLLLQQQGQLQQQLLQQQQAQLQQQLLEQQQAQLQQQLLLQQQEQLQQQQQQQLLQQQQEQLQQQQLQPPPLEPEEEEEVELELMPVDLGSEQELEQQRQELERQQELERQQEQRQLQLKLQEELQQLEQQLEQQQQQLEQQEVQLELTPVELGAQQQEVQLELTPVQPELQLELVPAAGGGGAAVPGAPAAVVVAPPGYVVVQELMVLPAVAAPAVVAIPGPAGSAALTPARQRRRRRARDRPTICGECGKGFSRSTDLVRHQATHTGERPHRCGECGKGFSQHSNLVTHQRIHTGEKPYACSYCAKRFSESSALVQHQRTHTGERPYACGDCGKRFSVSSNLLRHRRTHSGERPYVCEDCGERFRHKVQIRRHERQLHGAGRSRGLGLLRASRPAALGGPARAEQAATATAPADKAL

SEQ ID NO: 931090 - protein, 213 aa, Homo sapiens
MIHHNFLVKSNSVLAQLFHKNWYFCWKRKREWLDKCEEEPEKKLTPEPEETWVVEMLCGLKMKLKQQRVSPPDLDTPPPKIPSEPTILGASPTSLPPSDLHPTIEYPSTLLFPNEYSHPNTEEADVSQKSLLVVPLSSNLIAVPSYLANDMEEDSETPKQNIFFFLYGKNCSQIALFHTLHFRVFRSVCCRACISLEEFEEIQAYDPGHWVWA

SEQ ID NO: 931091 - protein, 4219 aa, Homo sapiens
MIPKDWPLIIIDLKDCFFTIPLAEQDCEKFAFTIPAINNKEPATRFQWKVLPQGMLNSPTICQTFVGRALQPVREKFSDCYIIHCIDDILCAAETKDKLIDCYTFLQAEVANAGLAIASDKIQTSTPFHYLGMQIENRKIKPQKIEIRKDTLKTLNDFQKLLGDINWIRPTLGIPTYAMSNLFSILRGDSDLNSKRMLTPEATKEIKLVEEKIQSAQINRIDPLAPLQLLIFATAHSPTGIIIQNTDLVEWSFLPHSTVKTFTLYLDQIATLIGQTRLRIIKLCGNDPDKIVVPLTKEQVRQAFINSGAWKIGLANFVGIIDNHYPKTKIFQFLKLTTWILPKITRREPLENALTVFTDGSSNGKAAYTGPKERVIKTPYQSAQRAELVAVITVLQDFDQPINIISDSAYVVQATRDVETALIKYSMDDQLNQLFNLLQQTVRKRNFPFYITHIRAHTNLPGPLTKANEQADLLVSSALIKAQELHALTHVNAAGLKNKFDVTWKQAKDIVQHCTQCQVLHLPTQEAGVNPRGLCPNALWQMDVTHVPSFGRLSYVHVTVDTYSHFIWATCQTGESTSHVKKHLLSCFAVMGVPEKIKTDNGPGYCSKAFQKFLSQWKISHTTGIPYNSQGQAIVERTNRTLKTQLVKQKEGGDSKECTTPQMQLNLALYTLNFLNIYRNQTTTSAEQHLTGKKNSPHEGKLIWWKDNKNKTWEIGKVITWGRGFACVSPGENQLPVWIPTRHLKFYNEPIRDAKKSTSAETETSQSSTVDSQDEQNGDVRRTDEVAIHQEGRAANLGTTKEADAVSYKISREHKGDTNPREYAACSLDDCINGVCRCTQQLRRDSDHRERAMMTMAVLVKVRSSVVIEDKSTRDPEYIYSQPYDLKDWKRIGKELKQAGRKGNIIPLTVWNDWAIIKAALEPFQTEEDSVSVSDAPGSCIIDCNENTRKKSQKETEGLHCEYVAEPVMAQSTQNVDYNQLQEVIYPETLKLEGKGPELVKENKTQPPVAYQYWPPAELQYRPSPESQYGYPGMPPAPQGRAPYPQPPTRRLNPTAPPSRQGSKLHEIIDKSRKEGDTEAWQFPVTLEPMPPGEGAQEGEPPTVEARYKSFSIKKLKDMKEGVKQYGPNSPYMRTLLDSIAHGHRLIPYDWEILAKSSLSPSQFLQFKTWWIDGVQEQVRRNRAANPPVNIDADQLLGIGQNWSTISQQALMQNEAIEQIRAICLRAWEKIQDPGSTCPSFNTVRQGSKEPYPDFVARLQDVAQKSIADEKARKVIVELMAYENANPECQSAIKPLKGKVPAGSDVISEYVKACDGIGGAMHKAMLMAQAITGVVLGGQVRTFGRKCYNCGQIGHLKKNCPVLNKQNITIQATTTGREPPDLCPRCKKGKHWASQCRSKFDKNGQPLSGNEQRGQPQAPQQTGAFPIQPFVPQGFQGQQPPLSQVFQGISQLPQYNNCPPPQAAGTVGLILGRSSLNLKGVQIHTSVVDSDYKGEIQLVISSSIPWSASPRDRIAQLLLLPYIKGGNSEIKRIGGLGSTDPTGKAAYWASQVSENRPVCKAIIQGKQFEGLVDTGADVSIIALNQWPKNWPKQKAVTGLVGIGTASEVYQSTEILHCLGPDNQESTVQPMITSIPLNLWGRDLLQQWGAATVEPPKPIPLTWKTEKPVWVNQWPLPKQKLEALHLLANEQLEKGHIEPSFSPWNSPVFVIQKKSGKWRMLTDLRAVNAVIQPMGPLQPGLPSPAMIPKDWPLIIIDLKDCFFTIPLAEQDCEKFAFTIPAINNKEPATRFQWKVLPQGMLNSPTICQTFEQVRQAFINSGAWKIGLANFVGIIDNHYPKTKIFQFLKLTTWILPKITRREPLENALTVFTDGSSNGKAAYTGPKERVIKTPYQSAQRAELVAVITVLQDFDQPINIISDSAYVVQATRDVETALIKYSMDDQLNQLFNLLQQTVRKRNFPFYITHIRAHTNLPGPLTKANEQADLLVSSALIKAQELHALTHVNAAGLKNKFDVTWKQAKDIVQHCTQCQVLHLPTQEAGVNPRGLCPNALWQMDVTHVPSFGRLSYVHVTVDTYSHFIWATCQTGESTSHVKKHLLSCFAVMGVPEKIKTDNGPGYCSKAFQKFLSQWKISHTTGIPYNSQGQAIVERTNRTLKTQLVKQKEGGDSKECTTPQMQLNLALYTLNFLNIYRNQTTTSAEQHLTGKKNSPHEGKLIWWKDNKNKTWEIGKVITWGRGFACVSPGENQLPVWIPTRHLKFYNEPIRDAKKSTSAETETSQSSTVDSQDEQNGDVRRTDEVAIHQEGRAANLGTTKEADAVSYKISREHKGDTNPREYAACSLDDCINGVCRCTQQLRRDSDHRERAMMTMAVLVKVRSSVVIEDKSTRDPEYIYSQPYEQGTLDLKDWKRIGKELKQAGRKGNIIPLTVWNDWAIIKAALEPFQTEEDSVSVSDAPGSCIIDCNENTRKKSQKETEGLHCEYVAEPVMAQSTQNVDYNQLQEVIYPETLKLEGKGPELVGPSESKPRGTSPLPAGQVPVTLQPQKQVKENKTQPPVAYQYWPPAELQYRPSPESQYGYPGMPPAPQGRAPYPQPPTRRLNPTAPPSRQGSKLHEIIDKSRKEGDTEAWQFPVTLEPMPPGEGAQEGEPPTVEARYKSFSIKKLKDMKEGTWWIDGVQEQVRRNRAANPPVNIDADQLLGIGQNWSTISQQALMQNEAIEQVRAICLRAWEKIQDPGSTCPSFNTVRQGSKEPYPDFVARLQDVAQKSIADEKARKVIVELMAYENANPECQSAIKPLKGKVPAGSDVISEYVKACDGIGGAMHKAMLMAQAITGVVLGGQVRTFGRKCYNCGQIGHLKKNCPVLNKQNITIQATTTGREPPDLCPRCKKGKHWASQCRSKFDKNGQPLSGNEQRGQPQAPQQTGAFPIQPFVPQGFQGQQPPLSQVFQGISQLPQYNNWEPPQKTPTGVYGPLPKGTVGLILGRSSLNLKGVQIHTSVVDSDYKGEIQLVISSSIPWSASPRDRIAQLLLLPYIKGGNSEIKRIGGLGSTDPTGKAAYWASQVSENRPVCKAIIQGKQFEGLVDTGADVSIIALNQWPKNWPKQKAVTGLVGIGTASEVYQSTEILHCLGPDNQESTVQPMITSIPLNLWGRDLLQQWGAATVEPPKPIPLTWKTEKPVWVNQWPLPKQKLEALHLLANEQLEKGHIEPSFSPWNSPVFVIQKKSGKWRMLTDLRAVNAVIQPMGPLQPGLPSPAMIPKDWPLIIIDLKDCFFTIPLAEQDCEKFAFTIPAINNKEPATRFQWKVLPQGMLNSPTICQTFVGRALQPVREKFSDCYIIHCIDDILCAAETKDKLIDCYTFLQAEVANAGLAIASDKIQTSTPFHYLGMQIENRKIKPQKIEIRKDTLKTLNDFQKLLGDINWIRPTLGIPTYAMSNLFSILRGDSDLNSKRMLTPEATKEIKLVEEKIQSAQINRIDPLAPLQLLIFATAHSPTGIIIQNTDLVEWSFLPHSTVKTFTLYLDQIATLIGQTRLRIIKLCGNDPDKIVVPLTKEQVRQAFINSGAWKIGLANFVGIIDNHYPKTKIFQFLKLTTWILPKITRREPLENALTVFTDGSSNGKAAYTGPKERVIKTPYQSAQRAELVAVITVLQDFDQPINIISDSAYVVQATRDVETALIKYSMDDQLNQLFNLLQQTVRKRNFPFYITHIRAHTNLPGPLTKANEQADLLVSSALIKAQELHALTHVNAAGLKNKFDVTWKQAKDIVQHCTQCQVLHLPTQEAGVNPRGLCPNALWQMDVTHVPSFGRLSYVHVTVDTYSHFIWATCQTGESTSHVKKHLLSCFAVMGVPEKIKTDNGPGYCSKAFQKFLSQWKISHTTGIPYNSQGQAIVERTNRTLKTQLVKQKEGGDSKECTTPQMQLNLALYTLNFLNIYRNQTTTSAEQHLTGKKNSPHEGKLIWWKDNKNKTWEIGKVITWGRGFACVSPGENQLPVWIPTRHLKFYNEPIRDAKKSTSAETETSQSSTVDSQDEQNGDVRRTDEVAIHQEGRAANLGTTKEADAVSYKISREHKGDTNPREYAACSLDDCINGEEISVGLSELVGEDVPSVLVGTIQSAASPDRANTEVKLVSLGAGTDFAAAALDIRSAPASQVCGLQDLHQWPPLGPEAFSVGLKSYTINSPGSEAFRLELNHKAAITPGSPACRWSIIRLLSPYNHVSQPLQ

SEQ ID NO: 931092 - protein, 136 aa, Homo sapiens
MAYVTLLNEFYANGLHGGWARFDACGIDKSVKVISGSSTTRPYFLRKSCQLCLVLPAGVLTPAAAIPLTAETPLSLAFCNCKAKSSITERGSNAGNAIIALVIYDGGDLAVNQRFLERGGTGQLAIVDVVSQLLTL

SEQ ID NO: 931093 - protein, 130 aa, Homo sapiens
MVICFLLAAFHTADRFRLIESFSSFGFQDTKASLFSCRLPSCAFSIPFASSSSPSPHFLTPEAIISSLPTPRPLATSSRLVASSPIYVLMVLQVCLQPSPLPAISDTESSFLHFTDVLTVLPAGTCPLGL

SEQ ID NO: 931094 - protein, 135 aa, Homo sapiens
MMTMAVLYSCWTQILQPLSTLVGLRHYNQWVLLLDSDTTTTEVLWLDSDTTPSGYSCWTWTLQPVDTTTTEVLWLDSDTTTNGYACWTQILHLLSTLTGLRYYNQWVLLLDSNTTTAEYSGWIQILQPLSIPVGL

SEQ ID NO: 931095 - protein, 413 aa, Homo sapiens
MRNGNGSDLSSPQPSLAESSRRSPGLRSPRLGEAHLAVGWSLHLLRVRAYSAHFVPTSCSALVTCGCVQGKMLNCYPCAPAVSLLKLQGDLLVQNIGKNVRSKWDHRGGPRTDEDVAAFGGVETALPSPHAFPSLHLRKRLHPGGHLGHRLLHARLLTCPACRCSSCLHQHPQIQPSMLLAMLLCQASHRRADPLSVLEIQVSAGLRPSEGAGKESGPGPSPASGGPPPLVVRRFAGKTRNSLEAVIVPAMVYHREKTPIKISMQGQSPRGFHTLSVCCPLLWSCGQRYPSDNVRSYAQNTVSQEGFLPRPQQCRDMQCENPINPSASPGFTPLLVDLVVGAFCRLSGRVSSFWWVRGLAGSGVKLQTFAVSVTALKAARLELFVFPGGLVVSLASGMKLQTFVGTDWCVYNP

SEQ ID NO: 931096 - protein, 135 aa, Homo sapiens
MSRPSVSRSIDPSRIIRHPWLPPACHELHLPWTLNNSSSGSRRKERTSSELDADSFGRQQNIQMPDLVVIVLGTPWGSLDPPALQAKHIGGGWRIPQKRTHFRDASEIRLFIVIKIFEIFFEIYLKFSPIIEWFA

SEQ ID NO: 931097 - protein, 139 aa, Homo sapiens
MGEKTGREEDGEGASSLITPGRSLWISGLGGPTEPSAHLPPASVPSKNLLTNLGEPPQARALAAKLLGRPSSSQSGSRVPAVWAQAGNATYITVHTLCSHNTHMSPMQDPYFPALRPCGKEKPDFTRCGGLTTGSTSMH

SEQ ID NO: 931098 - protein, 547 aa, Homo sapiens
MRAPPPSTDMKWQVQPRDEGLWDMFVKDIPRSATSYTLSLDKLRQGVTYEFRVVAVNEAGYGEPSNPSTAVSEPPRQLWGSPRVPDKRSRLPGTSQKASGGAGDSSCSGLKVSSIAVPEDGVQVKVLPIPGWAFLHVHTFAVRYRRLQRPPWVQVQVCSQGNRLQARALGGSERDGLCLRRGDLSSMKGREASALGQQSLSQKPQTQSWPCHELDRTELISPSGKPATITCWRQDRARPAARVSCPKLRVAVFGRVLAAVSQCLGFACERLSVLGGFQCHRTYSPSRPMEGPEWDAGTTQHPSRYNFPLFSQVEAPFYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEVSVGAYFRAVTISPYFCKARCMYESSRLCGAGSLRAGQSGQQRGSSHSAGLGPVPAAAAGPLLFRVSRHRGGVIAVGGSCVLSARCCVFPALTVGLAQVKFPDANQG

SEQ ID NO: 931099 - protein, 163 aa, Homo sapiens
MPSQPLFGGAPTFHRTPSCLPCTGGGHVAGTSPRPPRPCLDHCSPLDFLLTSRTIIPTCCIGHPAIVLEDSFSPKEESQPKIGSRGHRLCDFPLDLPDTPSSALAVPASVTPPPSPFCFRDGSPSNPLNLLWFQLNGGPSSQLPDSPGDTAVPLQGVLNVLEL

SEQ ID NO: 931100 - protein, 417 aa, Homo sapiens
MALWEAKLCTAEKLFALPHSQQHTHKSKRGKAPECPSLEEQTHQMRHEKEGNSDICYNPVEPQKPHAEGKDLDTGRQALHDSICTKYREADPPPAMGANWGPVTRIQLESTESAMAAVRSGTHPLLTAPWHPSLTAPLVAPPWPSMGSSTARSIPEGKLSRTSVALSDPFEHIFVQREAEIPDTLIIPGLKQHPSKSAPAEKSRNIRLYVKSGNSLKSPASEEAEPIFPCQWRGDLSPDSNVFKEKERCWTPEGLGRSVPGCPHHCGPLWQWGWGCTELTSLADKDLHGRAGWALADDVIGAPTTIKQKTYPSYPVFREPRLEEPSKPPQGELRDQGDANCLVVSKGHLWGVPTVQTPVLQFPVFNIHQHHAWRCTGVKLCEHRSIGAAAVRALGQALALGKLNICLPRIRATQALG

SEQ ID NO: 931101 - protein, 136 aa, Homo sapiens
MKNGVCCCAGPVIAEGLYPRRISPGSWRETISNSPREPQHVTCDITTCAGKSLRRNLNCVSGNSGGWVGGWSLLKIKVMTLGKRWIWVMTHCLHKRTELLGPRRQRGTNGQKLLKERFQFSIREILLMMYTLHELT

SEQ ID NO: 931102 - protein, 166 aa, Homo sapiens
MDLGAGSRIQSGCAGAHLPQLVRADPGHLLPAPSSLTSYWELEIGCAGFTYSKKTTLSVLKRFSQWSPGLAVWASPEYLPEMPGPEAPAQKLWYGAWECVSSQVLQGKSDGVSTLIRRDCLYESLVAKLSSFNPDTEWRQMNACRMLLQRRRVLAVVSHPDRLKKC

SEQ ID NO: 931103 - protein, 241 aa, Homo sapiens
MPYTVNCCCHHHYHNYIITTTITSTATIIFTTTTTTTIITTMIIIIITIIITIIIIFIIITIITTTTITSTTTMIFTITIIFIITPTIIITTTTTIIFITTTTFIIFIIITTYDHHEHHHPHHHHHYLHIIITIIIFIIITNIIAIIIFTIIIITTNTNIIIMNIIILTTTILITTIIITIIIFIIIITTNIIAIIILTIIIFTIIITTTTTISPSPPPSLPLHPQKFLIYNDKCGTYRNI

SEQ ID NO: 931104 - protein, 405 aa, Homo sapiens
MSTVSLETLSYPQGTSQGLRPCNYPGAGFHGNKNQKGTRGQANPNMACLFQASPCLISVDIPLAKALYLSHGSLQKSSWTSYMTHRAPETQKQSYQAFLRLRLGTGRILRLPHSICQNKFQPNPDLSGGVTQGNGYLEKWNHGDSDGGDDEDGDSDADSDGGDMMMVMVVMIVMVVIVMVVMLMVVVMVIVMVMMVMVIMMVMVMVMVIMMVVIGDDDSDGGDGGGDDGDGDDADSDGRDDGVGIGDSDGGDDGDSDGGDDDDGVGVGDSDGGDDDYDDLMVMVTVMVTMMVMVIVMVAMMVMVMMLIVMVVIMVVAIVMVVMMVVVVMMVIVIVMVVIIVMVIAKVVMMMVVVVMMVMVMMLIVMVVMMVTVMVVVMMMMVLVLVIVMVVMMIMMITMVMVTVM

SEQ ID NO: 931105 - protein, 142 aa, Homo sapiens
MNSSMQLLGGFAKRIQNSENQSMVSCPKARHLRGQMGEHECPELCGLGQPDLGYLVTGPVWRPLLLRAAEPPWGGDADVLFSSLWTKKGKGRRKEKRLSLPMVLIAAGLELGCSGRGDVLPPVPVRTSLLQEQLGFQCEAWL

SEQ ID NO: 931106 - protein, 140 aa, Homo sapiens
MEISSESSDTPGPGLDQQGRQGGPASIRVVPWEGAPSERMGCAGQACEAREGPQLCGQHEEAEPTAQRLQSRVPVNGGSRSSPLASGPTAASSQNPPGTHFGDSYKYLFSVSLRPGVQAGDEGSGHLCRPSNEQQYHQAL

SEQ ID NO: 931107 - protein, 152 aa, Homo sapiens
MIFLAILRNKSILYTTQFKWTASFLNHHVTREILAAYSEHFLHDLENDYPNFVVKAAVDLAKTMQTPLTVPVPVLQLPWGPDGLSLGFAPMDAGAVEARAALWERYLHSMLAMEYQQVSFTLYNYVHMAAHFRTTNLDMASFYVSQLNCRFP

SEQ ID NO: 931108 - protein, 237 aa, Homo sapiens
MENVDMRNYNLKNAVKVWVNTHKYVKVFGKFSNSNRDKTRYTGKKHFKCNKYGKSFCMLSHLNQHQVIHTREKSYKCKECGKSFNCSSNHTTHKIIHTGEKPYRCEECGKAFSWSANLTRHKRIHTGEKPYTCEECGQAFRRSSALTNHKRIHTGGRPYKCEECGKAFSVSSTLTDHKRIHTGEKPCRDLLNAFDPNANSDVDDKVQAEVVSDGDVKLIFKMEAEHKSLETLHLTMR

SEQ ID NO: 931109 - protein, 163 aa, Homo sapiens
MCFVKQMLERQHAPEHKTFPKVILRRYESYGIQNLNLRKDWECVGDCKGQKKSYNGLNQCLSTTLSKIFQCDECGNAFNQCSILTQHKRIHTREKPYKCEECGKAFNWFSNLIQNKRICTVGKPYKCEEFGKAFNQCSHLIGHKRIHTGEKPYKCEECGKAFN

SEQ ID NO: 931110 - protein, 145 aa, Homo sapiens
MGPGAHTDWIQLWAGHCALGRDFHDEIAEHWPPDQTSAESGEGDLLLRRLQDEGQVPQPGGPIFCDPDVPALRLPSCSPPPHPCHPAPASPAMDTSPSLVHMPCPPIPVPLHMLFPMLQCPFPPCLSKSHPLFKACLTCYLHSPR

SEQ ID NO: 931111 - protein, 149 aa, Homo sapiens
MPGSSCSPLTEPEMGQWWEKVCAVISAGFPKLAPVLAHGQQRCVVLEIPLPFEDFLDAAANFHSCHEASPQTLPGTSLFHLFRAQEKQQEEEPCRRLRGRNLEQRTVRVQCSVPPYLRSTCQQQVHLAGAQVSEKLKDIFGSHQELNIL

SEQ ID NO: 931112 - protein, 143 aa, Homo sapiens
MKTEGRNTSAQGHFAWITRETANSFKKMFINKFLYADLLSPLTVKRVVVLLSERIRVRMGSLSIRFVFLVFYVVDVFGAACDWSLRKVPCFYKEIRSELGSTARTLQPLEKSERGEAIDPGELRTQSFTVGRGKKEKKTFFLM

SEQ ID NO: 931113 - protein, 146 aa, Homo sapiens
MIAIPYRSSSKELNARDWVLTKCQKGWRKGLSWASNDNSWSTRKGATRKTEFRTHCCSNNPRIRSCCHYCCYNCLPTKGAGGKRKTKKHWNVIGEKTQKFIFPYPVTINKSKKVCENGLSLLFSTWDTKPFTLHCKILVAKKSWCT

SEQ ID NO: 931114 - protein, 177 aa, Homo sapiens
MGHLEKGRVRDINEEQPSYSSLVFKINTYIVKIFLHIKAKSWQNPCNAFLTGRVRANMVGKAKWKPLELPLPRKIVNQKQYCIPAGIAEISATIKDLKDAGVVISTTSPFNSPIWPVQKTDGSWRMTVGYRKLNQVVTPIAAAVPDVASLLEQINTSPDTWYAATDLANAFFSILVH

SEQ ID NO: 931115 - protein, 136 aa, Homo sapiens
MTLPCEIPSPGSSWLKSSPTEHLLLDDIVVLYEDFAHCQSTKLELSSQKSLICMFSGNSWKQDIFASFGRHECGNNEAIIYCLKVGVGQVLLQLTLMIPESLAALVVWQQPPHLQRTLGWLLQRLQILARLKRLNG

SEQ ID NO: 931116 - protein, 162 aa, Homo sapiens
MRTHGHRDGNITHWGLSEEDVEDVPASKKAKGPISFFQCVYLDGYNGYGFQFPFTPADRPGESSGQANSPGQKQQGQQLRICNPENFCENILLFGLNNRAVVESPPDEESTNPRSDFNSRSNSGHLSSLSFNTSSPNENKSATAAKGLSSLARNIMEMYLVK

SEQ ID NO: 931117 - protein, 156 aa, Homo sapiens
MGGRGKNYSVKMHGNALMPRQKFAAGAEPSWRTSARAVQKGNVGSEPPQRIPTGALPTGAVRRGPQSSRSHNGRSTGSLHCMPGKATDTQQQPMKAARIEAIPCKATGTELPKTMGTHLLHQCELDVRPRVKGDHFGVLKFDIPAGFCTCMGPRLA

SEQ ID NO: 931118 - protein, 481 aa, Homo sapiens
MCKLSCKAGNADTCESPHLPCKYLFVQGHSIANIEHYDRPRKTIKESNFSQPVVQLCYEDVNGSCIETPYSPGSRVILYTAFSFGSLLAVFGNLLVMTSVLHFKQLHSPTNFLIASLACADFLVGVTVMLFSMVRTVESCWYFGAKFCTLHSCCDVAFCYSSVLHLCFICIDRYIVVTDPLVYATKFTVSVSGICISVSWILPLTYSGAVFYTGVNDDGLEELVSALNCVGGCQIIVSASIYCQNHPTFLICVVPPDGSHYVPLLFGPETDSSGAQRPVTRNCKQMRSQRERAHCPFVMWMQTHCRCVPRALKIRNNPVFFVIINKDKTSPYVNNSVMSSNSSLLVAVQLCYANVNGSCVKIPFSPGSRVILYIVFGFGAVLAVFGNLLVMISILHFKQLHSPTNFLVASLACADFLVGVTVMPFSMVRTVESCWYFGRSFCTFHTCCDVAFCYSSLFHLCFISIDSKEFARLEAMWNIHQ

SEQ ID NO: 931119 - protein, 139 aa, Homo sapiens
MYVGYLLQASCHPHVGCMPQNIFGKNKSAWTGQRWGLCELGFLKCEMEGVLLQRRKKLHQTKLKTRKTLLQTIATGEKGQNSTHLSSTSLKQRAEKFLKVKGEEVVDHLCLLMGPTKRESELSYIFMTGGNRGKNEKWC

SEQ ID NO: 931120 - protein, 144 aa, Homo sapiens
MGVGANGLSKLASNVRRVTIQYRGIHSQRDSPWRMQDNHRSSEACCFHSDVATTNSFARHILDIKAHIVSRRSPLKASWCILTDITSVVMLTGAECLRYWFENTSVHLAHRDSANIPNFVDILEGQTQGLVNWMSWCFNDGSIL

SEQ ID NO: 931121 - protein, 179 aa, Homo sapiens
MSFVFGYQGRQRKTISCLQGPAAALRFLQRICEFSQLSWYVLVVVLGAKVHDVSLHTLLCQSKWELQVKKWGIAIKIPENVEVTLELGNGQRFKSLEGSEEDRKMRESLELPRDLLNGFDQNTDSDVNSEVLAEVISDEDGELIGNWRKGHSCYALAKRWWHFAPALEICGTLNLREMI

SEQ ID NO: 931122 - protein, 240 aa, Homo sapiens
MLATMCNCPVWEMERPASLLKPARPRTHHKEETPKTSEHQKEQTLDTPYLRIVTLTARVRGFLLEVSETKNPPIPDTAGQAGRNRKSHPLGLYVKMQFEQRHVRSFLGLGKLQCGEGVDGLVCGLGAALLELSTSQILSASTEAMAWPPGHPRLPCKQVWPGWDPRKASRPRGAQVESALSDGQDHPAEIRMDSSPRAKVSYGSKSGLGRWLSLAVLHCRCSHIKSSWLHISLLALPRLL

SEQ ID NO: 931123 - protein, 137 aa, Homo sapiens
MFLPDTVKEETNNSDTIWKMVTYPSQMDVWYDCTFGFHSSGHFLLSNSDVPDIMLEITDGFGDMTDMVWMVFSPPNLMLKCDIRCQSWACITAVVNCQQPSDSVSCLQRSTIAHDPTHPPHTKPQRKAARVLYVCFI

SEQ ID NO: 931124 - protein, 181 aa, Homo sapiens
MSLGLGLGLGLRKLEKQGMDQTYCNKMEYMTDYFPRINFFYMYEGPAPRIRAHNIPHDFFSYTIKNICDLWEVKISSLIGVWKKLIPTLLDNFEGFMTSAEEVTTVVVKIERELESEMEPEAVTELLQSHEKTGTDEELLLTDDNHHFDQSAAINIEARPSTIKKDDNSLNAQRIIGILSN

SEQ ID NO: 931125 - protein, 130 aa, Homo sapiens
MLRTLTLSQTLYALLRVQPPRNYLCEFLNVGRGSAALIQGSEGEALSTVPSWEATEGCVVCESLGFLGPWFDSTIINFALLRCYELNCVLQNLYKGSIRFGLDYVTDDVFYFILHLINRPTISGCPPVGC

SEQ ID NO: 931126 - protein, 198 aa, Homo sapiens
MFQWSQEIYYILGIQFLSKNNTDSDSWNLQPSDKIDINQTTAPERRDNLDSQSRKVDAPNAWRYVQGEPNTWKYVPQRGKEYLLQSGVTAATTGSWRGSGEWVWGWEEAAQAPISGKQNWWVLGLADFKNAVADPRVMKLQTFAVSVTVHKGGASGVVRSSWLVRGLADFRSEAADLRAIAIILKFTVLCKPDITSIL

SEQ ID NO: 931127 - protein, 139 aa, Homo sapiens
MGLNRTIQQGHSALTVRSPVDPQLPMDKVRAGCGEDGSKENKNKRMQEEKKGEFQKGRRKKSVKESDEGEEGRKGRRRTSWIRLAAYFLDAFELICISFLWLLLQITTNMVAIIYPEMMNTPVTSSCSTLSLRPVSPDL

SEQ ID NO: 931128 - protein, 156 aa, Homo sapiens
MVSSCIHVAAKDWVVYTLAQTWHLRLRSIDVKLTCPRIWANRAHQRLVSKCSRKEHLWEKENEGGWLKREHQFVNSCLIAASACEKESERALWGPFIRALIPLIRAPPSDLITSQSLHLLIPSHWGVGYQHINFGGTQTLSPKHSPSIFPSLFFFS

SEQ ID NO: 931129 - protein, 143 aa, Homo sapiens
MSASGPSAAGLLEFAEGPLQTLFAWVSAVEAAEQQILQNDKCCCLIVHLEASSQRGTRLYEVSVGPYQEVPTSEAMPHPALAHTPWAASTVRHPQSGKPHASEPLVTTLQWVVSAKLFQCGDSGIHPCLHVPAAVVAAAAAGC

SEQ ID NO: 931130 - protein, 144 aa, Homo sapiens
MRETLLLGLLFVPCKTSNFGSATPDRPPQTNPPPYPTGAGKHSKDGSEERKAINLDLSLLVSAQQERDAISNIQCPRDQMSQLFRSSTTIPGMVPEYALGYWSPPPPHPCHAQDRKELSLSDDGHSHPQALLELPLSFSQKLTG

SEQ ID NO: 931131 - protein, 175 aa, Homo sapiens
MAAVGNGSVVLRPVELCSQWVMAAFAASKRKPADCRFLHSCIYYQRIMEPFLQSVHQEFCLLKNEKRDKKSQFLVTIAIATHTNVNYLDAFCSEDHFIGQVGGKPRWLVILITTSQSRAPQKPGLDCLSSGSWSHTGDSAAASEAVLDKRGDIFPLPALSFPICASCWPNQLPVS

SEQ ID NO: 931132 - protein, 148 aa, Homo sapiens
MFLLSNCGKGISQLSHGSTSRVSHEICNIDQQVNFKPQLQWETQKVDRRQAATGAGTPPSPALGHQTSRFSSLQTLEFAAGTAHEGAWFLQGLGKRSVRKAIDKSSKKDRMRKTGTEHERCKPDSFCNLIVEVASYHFIAFYLLQVSH

SEQ ID NO: 931133 - protein, 155 aa, Homo sapiens
MFLLSNCGKGISQLSHGSTSRVSHEICNIDQQVNFKPQLQWETQKVDRRQAATGQSCQLEDRLKVYVKLSYTPDPLSRNLALFYLYGTDLPLERFTAENGQWGGIGERQHRKKLQPKRKAPQMLRAGDPQEKTPPLAEEDSKGKGQEGPEEERAP

SEQ ID NO: 931134 - protein, 134 aa, Homo sapiens
MRILRALPGRHLPTLVPPLEFPVNQSQPEDHVLVKRWKEEKLEPASEGPYLVLLTTKNAVHTAKKDRLIMPDSRKRHPLQSLGPTSKPSLNSSRLRAVRGWEQLHQPLQSGSEEDNKPCFSHTWKLTGPCTAEA

SEQ ID NO: 931135 - protein, 136 aa, Homo sapiens
MGWSHGSSHGLQRGGTGPSYSEEEVSGAALLALNDRMVQQLVKKIGHQAVLMDLIKKYKQNTQGLKSPENPKKAALVMQTEAAREATALDSGLQGPSSPMSAEKSSPFDEELLQMGFGSGLSSPLFFPLFNLGPHL

SEQ ID NO: 931136 - protein, 154 aa, Homo sapiens
MILSMDATRTRENLDAGCGPLPVSGFLLETCEEDELLHRETKTAYSLRPITPSSINLGVNRNHGEDLRVSPIRELGMELNITDLLSQARLSTSLYHTHPSSEDLCFTEMLQDLGPTCLKFSLKALLLSVTGLGTLVLAPTEWKVFSNSIFQSEL

SEQ ID NO: 931137 - protein, 202 aa, Homo sapiens
MSSAGQSKTQSKVHPPAIEVSGWQSDTAKIPELCIISILLFSFSLLIPPLGILLCDLTSFPYGISALLICFSTVNVALGFPRSHGYPRQGSESINLTTQLPYHNSKIDILEVVTLWVIGPYVDTDVTKNEDQGSGRKEEGEFFLGMAMARMDKDLQGMVVILLHPKTKCSVGCRRITIITCKDHRGSKALKGESGYSERKKV

SEQ ID NO: 931138 - protein, 161 aa, Homo sapiens
MLKPFYSLPVIVHQTPQLQICWGLLEVHSRPCLPRYHQWRLQNSKYCCLILPLEASSQRGTCLFEVSVGPYWEVFPSQATRGSGTHLRRQSVCSRSSNAMLREQLLSSELSDGTFKSAEADCCLLFYYALPQEVESIEAVGLAELWCAPPSSCFQASLFTL

SEQ ID NO: 931139 - protein, 146 aa, Homo sapiens
MGCCCYHVPPPHGKEEVRIASYLVEVFVSLRIGYPTVASVPHSIINGYKRVLALSVETDYTFPLAEKVKAFLADPSAFVAAAPVAAATTAAPAAAAAPAKVEAKEESEESHIYNSPSSITISSLSKVRIFGHLNRFLSRVLLSLKC

SEQ ID NO: 931140 - protein, 171 aa, Homo sapiens
MASEDTSHKPWWLSHDVGPGDAQKMRIKECLPQCFIGAIEVGSLPASTYQQEPWHGEVHVHWQGWAMGEGGRPASMHMLTLATAVQQGAHILVGWHAHGGLAELSIQAHLCQWQWSNVVCACMLVEKTRQSPPACSSKTVYGAGVGERASAKCTLRCICTSVHLPSAQRRW

SEQ ID NO: 931141 - protein, 135 aa, Homo sapiens
MPLHCSPGNSARLRLKKKKKKKFIVSLTGVGCYLIDQCGMWIKKSQNDLGRSVSRLLGIAVKLFSSTARHGSTLRRILRCRCYSIWFCKLRAHIYECVECVEKCLPCPLHLYHPGWSIEAVPKEVTIKQKPERND

SEQ ID NO: 931142 - protein, 160 aa, Homo sapiens
MEQEARVYSHGLGSVITPTRKEQGSHLSAAPFGFTDNAALAIGAVRRGLPSSRPQNGRSTDILHCVHEKTTGIKCQLVKAATGAVPCTTIVAELPKAVGAYPLHQHSLGVTHGVKGDFEVKIDSAPTLLEDNAQTSNGLLKENFCPSQVQGKAIPSSTDN

SEQ ID NO: 931143 - protein, 167 aa, Homo sapiens
MVMDLEDSHPGQEINTEKAARRKSISWPSMIKRTRGSLHSPAQQQKQPLPKSPQWSLNPADQNSCAHQRSSRNTSFPPRPQGGPRKMCPEFRPSGGFVVLLTSGVKLQTFTVSVTALKGGASGVVHSFCGFMVSLASGVKPQTFAWVPGLAGFRSEAADLRGECYSL

SEQ ID NO: 931144 - protein, 142 aa, Homo sapiens
MRWGKGNDQTCQGLLDTGSEHMMIPGDLKHHCGPLVKVGAYGFQIGLCEDTASVLYGQMLSPSPPFVKFGYDFMWDLMLLKNTLKSLDSDAGESPAGNRNKNKSELSVILENMICILHMALYGSRKLCACHGFTIGIYINSM

SEQ ID NO: 931145 - protein, 165 aa, Homo sapiens
MGLDKFITTCIYYYKTDKSIILVGDAIILVSITERTSRQKVSKHIDDLNNAIVSHLGRQNVSKIGSFRWVLGLADFKNEAADPCKLFVPPGGFVVSLTSGVKPQTFTVSVTVHKGLYVELCSAKFWTVENIYPATSHCSTNFSSLAATAYNFLCQRVSELLSLYG

SEQ ID NO: 931146 - protein, 157 aa, Homo sapiens
MKLKPAHLIDHLHVYVCACVLFVTTIPGVWSRSCCLLHRKPITEKTNIAKGEGFNRVPQQGDGKMGLQVLEGFSRVFIYTWNLKTEDICDIISTDEVWRIDNVPEHLYALYVGSRINFNVQYVGKWAKGTSSEFQYASDEDYTQLGHRLHQGRLKDL

SEQ ID NO: 931147 - protein, 144 aa, Homo sapiens
MVILHSPFYFIAFKMRNFGCVYVFQFMGHTLFLWLSHKFCWKVDILDDIATFLGALKDKCYIFFNMYLEIGSMINSQHHEKIVSNTYTTEKFIFYKLKMETFPWQKNLELKVSNLEFAYRIWLSQEYKRLAPTSHKFLVMIATN

SEQ ID NO: 931148 - protein, 135 aa, Homo sapiens
MNKLHRSAVQCCVYSQQDTDIAVIDSDYIDESGQSKLKTFWKGFTILNAVKNTHGSGEDVKISTSTGIWKKWIPYLKDDFEGLNTSVEEVIADVVEIAKEPELETEPEDSSSQSLTFYAANGRTYTKPQDPEVQK

SEQ ID NO: 931149 - protein, 137 aa, Homo sapiens
MTVDYHKLNQVVTPIAAAVPDVVSLLEQINTSPGTWYAAIDLANAFFSIPVHKAQQKPFAFCCQGQQYTFTVLPQGYINSPGESEQRPLGFWSKDLPSSADNYSPFERQLLACYWTLVKTESLTMGHQMTEEEKNRA

SEQ ID NO: 931150 - protein, 127 aa, Homo sapiens
MWNCLNKEDFQEGGDKCFHSVGSAMWCSSNDSKQASISCQIGMTLRVGQTRIAVHRYKNVACFGAKTAFRIKGPQRAESCVIPQRLKKRVRQPSFLRGFCCRQLELPEGYILTMGRVRKKYILRKGQ

SEQ ID NO: 931151 - protein, 139 aa, Homo sapiens [sequence omitted]

SEQ ID NO: 931152 - protein, 168 aa, Homo sapiens
MISFDSLSHIQVTLKQEVGSHDLGKLHPCGFAVYCPHGLVMSVCSFSSVLPPRTGDECARSKLSVNLSFWSLEDSDPLFTASLGSAPVGTLYGCSDPTFSFHTTLAEVLHDGFTPVENFFLDIQAFPYIPGNLDRGSQTTIVDFCAPTGSTPHGCHQVLASVPSEAMD

SEQ ID NO: 931153 - protein, 134 aa, Homo sapiens
MLFKGLISGPYTGGLGPLMYKALKVGTENLCLPSLLSCNSVKAADDRLEIKWSKVMAEVFKSLTDGNICGYPMGIPGLDEGLGVWKVGRSAKAMNLSRASAHEVILGVFNECLAKTKMGFQNVQKEDCSYGYIL

SEQ ID NO: 931154 - protein, 178 aa, Homo sapiens
MIISSLRSSLEANAGITLLVLSAELEEAERETAVIAIALLGLATQWGYQALVLRSICKESCDVIRLQVFQPWIPAPTLVEVAGECNTMYTKATLGVIDQTEIVSLVNADDIHKSSRENDEGETLSKLVRTGGLMKSKHTGQCIQHLVLWSCHPFQMLLGTRSHGCARHGNSQTLTQNG

SEQ ID NO: 931155 - protein, 204 aa, Homo sapiens
MCWISPEASTSESSTQDQRHSSWVLLLVIQSPRALQLADDECFQDWVLLFKATGFLLAQADAESVTKPCTTKEIFSLSLTMSCFSGENLEIRHLCNIKVQDETVSADIEAKVQDETVSADIEAKIQDETVSADIEAKANYPENLAKISDEVCYTKQHIFNVDEIDSHWKKMPSGTFIAREEKIMPDFKDRLTLLLRLIQLVILN

SEQ ID NO: 931156 - protein, 163 aa, Homo sapiens
MPAAGIAVLVHLIDLLIVFLRCDGFTRIQKAVVDQTGSRPSKSDHGLFVMQVWLWEVLWSFFSVEPLSWEVGSPVAQGRSRNAIQDSCPGIANPKSPLGALFTCHQHSTWVLLLVIQGLRALQLASDESYQDWVLFFHKADSLLVQVMSKNVVWKQRLGKKTS

SEQ ID NO: 931157 - protein, 187 aa, Homo sapiens
MAHVYVCNKPTCSASMPAAGIAVLVHLIDLLIVFLRCDGFTRIQKAVVDQTGSRPSKSDHGLFVMQVWLWEVLWSFFSGSGLPCGPGQVQKCHPRFMSWNCKPQEPTWCSIHLWLCWYLRRALAEFGLVLFSAITGEFNALKLLCSPSPQCTKTLCTKPLMLRGMEKKWWRRLKTVFPTSSVPLSAI

SEQ ID NO: 931158 - protein, 157 aa, Homo sapiens
MNSLDGLIVVSLGGDKFQGKETSGFKAMQMFQLCAVIIPIMPPTFSKVPMPGRIRPERKQQLCQEEMRSSEQAIELRAEILMGKGTGIYAAPGMGLGSLFLDIEPLHQKAGELEATLVVIGLGLFLGVESARGLIYGTAVCVKPDTQGHFKALYVII

SEQ ID NO: 931159 - protein, 285 aa, Homo sapiens
MRCPPGSSYSPCSSPCPDTCSSINNPRDCPKALPCAESCECQKGHILSGTSCVPLGQCGCTDPEGSYHSVGERWYTENTCTRLCTCSVHNNITCFQSTCKPNQICWALDGLLCVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVRKTSGSSRWGGSPREIAPKNHSPPPGLRHVWELQ

SEQ ID NO: 931160 - protein, 616 aa, Homo sapiens
MFQPLSGDRHAAAAGSSGRGSRGLLLCGSGLPYWTLGLVSRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGKTCPCWPFFLPEGQEAGEGV

SEQ ID NO: 931161 - protein, 262 aa, Homo sapiens
MLNCAGTAVVDEFVANNHYQPQLISELAQIWKAAAGLQFPIVTAGQYTTGRGSSGVGLTAAVLRDSVSGELTLEGGALVLADQGVCCIDEFDKMAEADRTAIHEVMEQQTISIAKAGILTTLNARCSILAAANPAYGRYNPRRSLEQNIQLPAALLSRFDLLWLIQDRPDRDNDLRLAQHITYVHQHSRQPPSQFEPLDMKLMRRYIAMCREKQPMVPESLADYITAAYVEMRREAWASKDATYTSARTLLAILRLSTALDS

SEQ ID NO: 931162 - protein, 265 aa, Homo sapiens
MIPAQASPPWPVCQYTTGRGSSGVGLTAAVLRDSVSGELTLEGGALVLADQGVCCIDEFDKMAEADRTAIHEVMEQQTISIAKAGILTTLNARCSILAAANPAYGRYNPRRSLEQNIQLPAALLSRFDLLWLIQDRPDRDNDLRLAQHITYVHQHSRQPPSQFEPLDMKLMRRYIAMCREKQPMVPESLADYITAAYVEMRREAWASKDATYTSARTLLAILRLSTALARLRMVDVVEKEDVNEAIRLMEMSKDSLLGDKGQTAR

SEQ ID NO: 931163 - protein, 253 aa, Homo sapiens
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRALALALRRLLLGAL

SEQ ID NO: 931164 - protein, 149 aa, Homo sapiens
MVGSSQAASGWGLAIKNTKAKLEEHVKGNEVCAEKEDIGMAKVKKMPGGENGMLKGRVEEVKNKCSYLCVMLLKHHLRGGENIGQFLELKTSLRDGSSVRATVEKNPENLRGQVRSGKRPPYSSSAIVFNIPCKSAIFFLKSNWAITFF

SEQ ID NO: 931165 - protein, 168 aa, Homo sapiens
MLMLGSHPQVIVSSSTPQYPSVEQPTPQALYVTAHQAYPNYATQLHAHQLQPAITPTGNQPAAPSPVQHQAGVAPHLGSGQPQQNLYHPGALTGMLPSLPPGPSAQSPQSGFPQPATVYAIHHKQLPHGFTNMAHVPQAHVQTGITAAPLAPGDAAAPTPDVIHIVKK

SEQ ID NO: 931166 - protein, 144 aa, Homo sapiens
MADTPPPASLPPCSSISDCCASSERGSVGVGPSKSGKFLVGAFNKALVRQKRSPSPHWTQEFQLASPLMSTDLFVSFFTESWVLQRIAALPGTHQPQHTQRSSAHPLCKVTPGTPKSQRDQGTQCKWQQSFRLDRTLSMTLGGL

SEQ ID NO: 931167 - protein, 262 aa, Homo sapiens
MSVTVVKNAKFYIVQVNHAPYYGHKKGKRVLAPPGKTGKTVNEHDLWTIILSQAPFPRLKKAFPSTRLASMGPGFRLAPVDTGSRPVPVDPMSRPMQVDPSARLVSWTQGPPTPADPSCRPVQVNQGSGSYPANPSAKPAYLLTQTPNLPRPGHIPCQMACPESLQAPLPQGSCGLLGDHSRPNLLEFLPYLERGTKLMPAGTLLYEVSSDPHWEVSPSQEAQDQGPSGCPLAEQAVSSLLLLAATRADCTALCLGPKALVA

SEQ ID NO: 931168 - protein, 157 aa, Homo sapiens
MEWKDNLPPEFHHPRPNSSLKSRHQVIYLTSSCCFSSFLLCRSSLLSCQWCLGFLWVQGRKWGRPGWFWKRQHSEIDLEKMQRVMNFNPICQYKSGTFHFYKKRSSEMKIILKTSLKGPVIITCSLEIKGKLKEVSRKPQTWLYLSQTLWSFPEANR

SEQ ID NO: 931169 - protein, 144 aa, Homo sapiens
MGRNQCKKAENSKNQNTSSTPKDHNSSPEREQNWMENEFDELTEVSFRRWVITNSSELKEHVLTQCKEAKNLEKREKRMKRNQQSLQEIWDYMKRPNLHLIGVPESDMENGTKLETTLQYIIQENFPKLARQANIQIQEIQRTP

SEQ ID NO: 931170 - protein, 168 aa, Homo sapiens
MYSCFWVASNQVMHLLVLILYPDDWMPPPRLLLLPANWEKTEEDSRILGDTGGGHRWKKNQVLDSLYGKNMTTGTSSHAQGCLSQETRQCYDSRANSKSAGIGVFNESFCNGTLKLNFAEAYPKCSPLVVTECNTGFNRHHHSRRRWVIYKPHFQFPVDWAWKFNCIH

SEQ ID NO: 931171 - protein, 127 aa, Homo sapiens
MLTLDPPPGSLLPSPPSSIQYLATFPAPHGRFGSLNSVELFPITEAALKTTSLQTPCTCLWPSCRLTPGMALFTLPSWPSNQSPMGEIRDSKQLLPGMIRWHPDQCPSQLVQVHNCLLLAHKEKSRN

SEQ ID NO: 931172 - protein, 243 aa, Homo sapiens
MHGLFKLTGWECFCFSLQLCCQEPGVMNKPGLSAMQEEKAFSYWGNRITLCTDQGKKGHGSRQSISLVVRTKARKASGAVKYSLVGIYQGKKSHRGASTGDTWENRVWSGPPANSSRPAEEGPVRRKTNKTEKNSSNINKKDVYSETPSEGHQHQRPKVDKSTKMGRNQRKKAENSKNQNASSPPKDHNSLSAREQNWMENEFDELTEVGFRRWVITNSSELKEHVLTQSKEAKNLEKSTRTS

SEQ ID NO: 931173 - protein, 171 aa, Homo sapiens
MCAEGGQDRDPASRSSEIPTLAGASVSWEIRSTPTQISSALYPPPAFAHTWPLRQRHPWVYVNSLFSFQNRFLGGRAEHGFPNPTDLIWNSASPPTACVTLRKLCNLSGAQLTHPKMREVAVTLKESLVLEGDSRESQPLSSSSPSASLTSFHLAPRGASCAHLRVPTWSV

SEQ ID NO: 931174 - protein, 139 aa, Homo sapiens
MGAVALPSFWGMDGRPVLPSTESLVLGAGCRPGLGFASSAQGHQSLDEALRRLASFREETFLEALYMSDTILDSGSTMMDQSQIGLMDRTGNWQQSKNCASKCKERKDKNTRGSTYEETSIENEFQKRREQMEMQSKGK

SEQ ID NO: 931175 - protein, 141 aa, Homo sapiens
MRGPLSEGPRLMAPERKNEMPRPRHLAGLITLNETQLAVGAGGAGAGPDPCTQLPGATKACPNPASYPHPGISQPETIEGRGEVLLVLLITLSEHWYRGGLAAGSSWQADACGLQYLGAGLVLRGTNRSDKFLSSRDRARV

SEQ ID NO: 931176 - protein, 221 aa, Homo sapiens
MNAPEHLGEASQQHIQAASLPPWVSLPPTRLHRESLRRTPCTNVALAFSRQPCLSPAEVHPCLHWLVPNGAAAATNPQTPGLLLASPRHPLQTQLQPPQASGQGSLQDGHHPSGHQPPSSSELPQVSRDWIQGSCVLERTGDALSFIPTSCLSAALDPQILPQDKRWCHHPLGAPLTHELSVAPGGAITLILGEGASRGRESMEQETKPQNVHQNIVEFSI

SEQ ID NO: 931177 - protein, 186 aa, Homo sapiens
MVVVAVVVGCGGGGGGGGDGGGGDGGGAGGGGGGGGDGGGDDGGGGDGGDGGGGDDDGSDGGGGGGSDGGGGDGGGGGGGDGGDGGGGDDDGSDGGGGGGGSDGGGGDGGGDGGGGGGGDDGGGGSGDGGGGDDDGSDGNGYDGGDGGGGADPRNDGGGCGGDGDDCSVGGGNGGMLEVMVSARGK

SEQ ID NO: 931178 - protein, 505 aa, Homo sapiens
MVPPYLHLLLDGEIQHRKKQGDAMARKLSVLEVLLIIFCLIVVTIDILLLLLVLEETSDTSFTPECPEIPQSERIDCTPDQEVTEDICRWQYKCCWSPVADANVPRCFFPWNWGYEASNGHTNTSTGFTAQLKRLPSPSLFGNDVATTLFTAEYQTSNRFHFKITDFNNIRYEVSHENINLVDGIADASNLSYYVEVTDKPFSIKIMRTSNRRVLLDTSIGPLQFAQQYLQLSFRLPSANVYGLGEHVHQQYRHNMTWKTWPIFTRDATPTEGMINLYGAHTFFLCLEDARGSSFGVFLMNSNAMEVTLQPAPAITYRTIGGILDFYVFLGNTPEQVVQEYLELVGRPFFPPYWSLGFQLSRRDYGGINKLKEVVSRNRLAEIPYDVQYSDIDYMDGKKDFTVDEVAYSGLPDFVKELHDNGQKYLIIMNPGISKNSNYEPYNNGSLKRVWILGSNGFAVGEGYPGPTVFPDYTNPVCTEWWTDQVAKFHDHLEFDGVWIVSYYS

SEQ ID NO: 931179 - protein, 135 aa, Homo sapiens
MCAWTLATHTSPSLCHGHQCDHAHRGQQALPQVQMQAQTSATLSPPMTHCWHEHVQECHSPASASIPLPQPTCMHPAVLCHGCQHNPSDIVPSKIEETSAHTVRKNQCKTSGNSKSQSVFLPANNCTSSSVMVFR

SEQ ID NO: 931180 - protein, 139 aa, Homo sapiens
MHFHMACPADLELEVNSSDPWLLALHLTMERTWTLRASPTQTGPHLSTEEFSSGLIKAGEDPAKVVCCCCELLSSNWGVVREKTNASRGQPQPLTLGLTEKAGSSAAIWKQEAYLGPGPELSQEKRRGRSLGGTDLEEQ

SEQ ID NO: 931181 - protein, 165 aa, Homo sapiens
MPVEEQPSSWALPEFCPFPPTVPIDTEVTQTPKHLVMGMTNKKSLKCEQHMGHRAMYWYKQKAKKPPELMFVYSYEKLSINESVPSRFSPECPNSSLLNLHLHALQPEDSALYLCASSQDTALQSHRFPVQKPSGPARKPWGPRRARVNISSKSPEEASEHHSTC

SEQ ID NO: 931182 - protein, 331 aa, Homo sapiens
MHRPRRPLHPVAPAMSIGLLCCVAFSLLWASPVNAGVTQTPKFQVLKTGQSMTLQCAQDMNHNSMYWYRQDPGMGLRLIYYSASEGTTDKGEVPNGYNVSRLNKRDDERVDEPITGTLQEPNPGVCLATQSAADNSLPRAFGIRLETAGKAMDWTFCTLNAGLSEIPQINVRKDNELTFWCFVLAELLTHPREHAQQTEERLWDEEINSEMQHHTGAGVSQSLRHKVAKKGKDVALRYDPISGHNALYWYRQSLGQGLEFPIYFQGKDAADKSGLPRDRFSAQRSEGSISTLKFQRTQQGDLAVYLCASSSATALLLQCQLGSLGNGVSRT

SEQ ID NO: 931183 - protein, 255 aa, Homo sapiens
MLSDPDPGHALVLKGNQHMGRWVLGGAPCVDFKAHPLSTGAVASALSFSAGPVNAGVTQTPKFRVLKTGQSMTLLCAQDMNHEYMYWYRQDPGMGLRLIHYSVGEGTTAKGEVPDGYNVSRLKKQNFLLGLESAAPSQTSVYFCASSYSTVLHGCLLSAQKGKGRCCPPPQHRFSDALGPSTENFGAPMGPGGASLHLCQVPLQSVSARPGSVPGPQMSSLLPSGLSSEVSFWASARGFPALTFLVIHLSLRPPR

SEQ ID NO: 931184 - protein, 239 aa, Homo sapiens
MSIGLLCCVAFSLLWASPVNAGVTQTPKFQVLKTGQSMTLQCAQDMNHNSMYWYRQDPGMGLRLIYYSASEGTTDKGEVPNGYNVSRLNKREFSLRLESAAPSQTSVYFCASSEATALHGHHTGAGVSQSLRHKVAKKGKDVALRYDPISGHNALYWYRQSLGQGLEFPIYFQGKDAADKSGLPRDRFSAQRSEGSISTLKFQRTQQGDLAVYLCASSSATALLLQCQLGSLGNGVSRT

SEQ ID NO: 931185 - protein, 134 aa, Homo sapiens [sequence omitted]

SEQ ID NO: 931186 - protein, 175 aa, Homo sapiens
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSYSTALQGRLLSAHKGREVLPSSPTQDSGMPWAEISAPGTLEPTVAPSGLDRLSQLLLFYSLS

SEQ ID NO: 931187 - protein, 251 aa, Homo sapiens
MSLGLLCCAAFSLLWAGPVNAGVTQTPKFHILKTGQSMTLQCAQDMNHGYMSWYRQDPGMGLRLIYYSAAAGTTDKEVPNGYNVSRLNTEDFPLRLVSAAPSQTSVYKVTKRGQDVTLRCDPISSHATLYWYQQALGQGPEFLTYFNYEAQPDKSGLPSDRFSAERPEGSISTLTIQRTEQRDSAMYRCASSLATAWHSRLLPVHKPHPSLSLQLPEIINRGLSLLLTFPGKEVDLDLGCPLGGKRPQIHS

SEQ ID NO: 931188 - protein, 180 aa, Homo sapiens
MSIGLLCCVAFSLLWAGPVNAGVTQTPKFHILKTGQSMTLQCAQDMNHGYLSWYRQDPGMGLRRIHYSVAAGITDKGEVPDGYNVSRSNTEDFPLRLESAAPSQTSVYFCASSYSTALQACLLSAHKGTEALPSSHPRLKDALGRVLCTRNLGTQSGPKWPGQFASIKQGHYKFESVTDL

SEQ ID NO: 931189 - protein, 196 aa, Homo sapiens
MLGHLEGLRLHPREDLSSEASSIPVTLEVFCHKISNLSSCLKLRDQKDHILSILLSWTECGHSPSQSLEVVQSSLRIPALGQNHQGSSSPAPHRLQQGFPARCAGANPWRGKWSSSAVTGDRRKQSHLIHSPLADLLPYDTILHQRVLISRCSSASSSVISSLFAAQISGCALYKVIISYSSPFATLSYIHPYFLH

SEQ ID NO: 931190 - protein, 173 aa, Homo sapiens
MGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSLATAWHSCLLPVHKPHPSLSLQLLETLNRGLSLLLTFHGKELHLDFSCSLGRKRPQIHS

SEQ ID NO: 931191 - protein, 293 aa, Homo sapiens
MVCVPYSTVDTSIMVLAMGSSHGNEESQKESNPAAWFSRQKDLVEGCWLGLREDDELRKQTKRNPRRKLLKPWRNHKSNFSQKMVAVTHLQRRPVNWEMSSNSTTTDTHSPGTGRGQILASCSTRALNALYLLSLPWDLGSSPGRWTCLGFSKPDHADTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSLATAWHSRLLPAHKPSGTYFSFQLSEALNKGAALLFPQQGE

SEQ ID NO: 931192 - protein, 194 aa, Homo sapiens
MRSMEVQMLPGGIWGKALTKQHIILILCVWDIRMAELIDARVTQTPRHKVTEMGQEVTMRCQPILGHNTVFWYRQTMMQGLELLAYFRNRAPLDDSGMPKDRFSAEMPDATLATLKIQPSEPRDSAVYFCASGLVTALQNHLLPVQKPWCFLFSSSTQQLSAAFLAPPLAQEVHRFRVPHVLGKARTGHKDTSR

SEQ ID NO: 931193 - protein, 136 aa, Homo sapiens
MYWYRQDPGQGLRLIYYSQIVNDFQKGDIAEGYSVSREKKESFPLTVTSAQKNPTAFYLCASSIDTVKHGCRLSVHKCAQDKKFLEKYESLSRIHKPWLHEFSSNYFLDSVFSFGFLLLHSLWEFDSHRVPQKPKY

SEQ ID NO: 931194 - protein, 199 aa, Homo sapiens
MGANSAVNTLLLFLLSPSSTGSTDTKVTQRPRLLVKASEQKAKMDCVPIKAHSYVYWYRKKLEEELKFLVYFQNEELIQKAEIINERFLAQCSKNSSCTLEIQSTESGDTALYFCASSKATATFIRSIVLQHRVSVVGNVVHVSAGNTWDSVVSAQLCCGLKIAPKIQFTNLKMDPSIQMENYHIGGTKWEHTVESVAI

SEQ ID NO: 931195 - protein, 148 aa, Homo sapiens
MHWLCTKSGVGRTASPHPVNQPGRDWNSLEDSEEDRKMWESLELPRDLLNAFDKNADSDMNNKVQAEVVSDGDEEIVGNWSKGDSCYVLEKRQMAFSPHPRDLWNFELERDDLAYLAEEISKQQSVQKVTRVLLKAFHFKKETEHKSL

SEQ ID NO: 931196 - protein, 176 aa, Homo sapiens
MPALPISRIQVRLGEHNIEVLEGNEQFINAAKIIRHPKYNSWTLDNDILLIKLSMPAIIVSFSGLIYTSTFFVLLLILTANYPDELQCLDTHVLTQADCEASYPGEITNNMFCVGFLEGGKDSCQVGDSGGPVVCNGQLQGVVSWGYGCAQKNRPGVYTKVYNYVDWIKDTIAANS

SEQ ID NO: 931197 - protein, 188 aa, Homo sapiens
MNPLPILASVGAAVGVSFDDDDKIVGGYNCEENSVPYQVSLNSGYHFCVGSLNREYCIQVRLGEHNIEVLEGNEQFIYAVKIIRHPKYNSWTLDNDILLIKLSTPAIINAHVSTISLPTTPPAAGTECLISGWGNTLSSGADYPDELQCLDAPVLSQAEYEASYPGKITNNVFCVGFLEGGKDSCQVI

SEQ ID NO: 931198 - protein, 146 aa, Homo sapiens
MECRPPLLSRNNVRAQPPPGACPLRWVSPERCVSDISQRENKARLHEGLYESQSKLVRACLLVTGPAGAMCRARQPRLAAAAERHEQLAVRVGAGSLAAVPHVGNDLSRSQGWAGVFWREKDTFQDSPSAGVPNPQATDWYWSVAC

SEQ ID NO: 931199 - protein, 116 aa, Homo sapiens
MAQCRVPAGWHNGLKLGYERRREMYALLSQLWNAAEVCIESLTLIKGPSALVIHQIGTKDQTSRGRSHKAIPAGRPSHLTAGTYAKRQMWWGLLFRGKGASAVKPLPCTSLPSDYP

SEQ ID NO: 931200 - protein, 135 aa, Homo sapiens
MVIPPGQVLKGHSILLIDDWIQGSLTAPGCKDRPNVACLCAQEEEAGLVGFAKAEMRRDWDTGEQRSSNSGESGGWCQQEAVIPGEGLDRVKCGSKGCTSWVKLGASPYGGRQGAFCKDWLVCVALGGPCNVGNA

SEQ ID NO: 931201 - protein, 244 aa, Homo sapiens
MLTPPEALLDADIRGLGRAPTESFYEGSVEEKCGVGAPTQNPHQGIVFGAVGRGPLPSRPQNVLEASMSGELHVALLISVEGACPGVCILQNSWSAAFQPEFADQELFSGAQALGLSAVQDPQGHGPPKPMQAGLVSKDSFSHKSHEKPLPVELDPCRLLPASGSLQFVEPDFICSSNLQLPTPLLATKLPSHPLIISPDFPSSQPLRLTKLSGLMPDFLLHSLHSCAPGGKDSPPHTTDKGQG

SEQ ID NO: 931202 - protein, 333 aa, Homo sapiens
MKELPMPAASSAHLPFSLGPSAGRLPATITRVLQVGKANAGLSDRHVYQLFLIYGNCSINVINTSTTITINTTIITITTTTITTTTTTTTTITTNTVITIITITTTTTISITINTTITTTIIATTTTATIIITTITTITTTTITTITITITISNTITTTTITTTTATTTTIITTTITTITTITTTTTIIITIITSITITTTTITTTITTTITPTITTTTTTSTTTITTIITTIITTIIIITTITITTITVIITTTIITITTTTTIITTINITTMTIFTITTTTITITTTIIIPIDLNHRTMLFFGMWHVAPCTYLALAGSRSRETIPPGLSKL

SEQ ID NO: 931203 - protein, 140 aa, Homo sapiens
MSVQAPDNCMPLGRGTWKVLLKTDLSMCKNELFRGRRKMKARAPPPPGKAATLHVHSDQKPPHDGALGSQQNLVRMKEALRASTMDVTVVLPSGLEKRSVLNGRAASYEEAGSETRAGTAVTYTPGWDSSHSVPQMPFKK

SEQ ID NO: 931204 - protein, 174 aa, Homo sapiens
MDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRGEAPLRLTHLPIITRMRGVYMSPVGSPQHSQ

SEQ ID NO: 931205 - protein, 140 aa, Homo sapiens
MNTAICFSISWRGRHGRTHLHTSHLLISYGETLEGQEHMALEESVTGEEAWSLDRPVFDHSDMDSIHGPRPWKPLCQREDGGQQDPDKEGLSGWPWAGSQCAGSQLFSREGRPHPATCKSRADTAWRSQLPQGCGVLTGF

SEQ ID NO: 931206 - protein, 146 aa, Homo sapiens
MGSNTCYHNLLCTRGPDPDSQQLLSGMSLCCLYICKEESDRKETHLQLYGIPEMLMQLAGPPVSARSPCCTPMPVIKISVRTHQINIMEMLTEIRDRLGIHIWSEPCRKPRQHRGGKGRAGRELPRQQNSGVARWSRPVRWSRSLQ

SEQ ID NO: 931207 - protein, 803 aa, Homo sapiens; identical to SEQ ID NO: 900657

SEQ ID NO: 931208 - protein, 171 aa, Homo sapiens
MQLYLFTSEIPLLLHCLLERSSWTRGPYHKSINIENTLRTIKAKLTVGSLPSDAYALCHPFIRQTHSEHPLSFTGTKKRNTVPASWNLGTRHSSVLCKNPHSVLPGKSRRRKEAWERQRKAWSLLAAGLRRARIKGSTHSTLRSEGLRQRRKVLGMWATSKSEFHILHFDL

SEQ ID NO: 931209 - protein, 138 aa, Homo sapiens
MNSNSTAVRTFAVVPQATEAFLLLLPLLLLCLPCFFLFTLCLSFNPFYCYDFRLIDLYFLFFLFHLCNISCKIVVNYTKGYSPLLSVVFSLFSKTAHVGLRTVPASCVLSAGVVHCSHGPTSAAPLPNRGWQGTVPGM

SEQ ID NO: 931210 - protein, 136 aa, Homo sapiens
MDKVTCLSLTKGPGVASKGPTWVNFHRAARYPGHFIDPIDHGKWPLDTNSVPAPAQGLPHVVHVTQSYPVPWLPHVTAEATEARCGPQSQKDFTAPLRPGVSWGMKLQEATYGLGPQSQKPGLGRTSLVFRKRGLE

SEQ ID NO: 931211 - protein, 312 aa, Homo sapiens
MPAFLDPNASCWPESNGTALQEFVILGFSVWPPGLRVLLFVLFLPLYLVTLAGNLLILGLALVDPALHSPMYFFLGALSAAQAAYTLVLTPRMLAGFLLPSRGQAVDPSTCAAQMGLFVALGGSECLLLAAMALDRYLAICHPLCYPRLMTMDLPFCRGGLVNHVFCDLPAVLVLACGCRALQERVLLVACLLLLVLPLLLILLSYTRVLVVILGVGGVAGRRKALLHGGVPPHRGPLNSRSLEEDKLVSLIYINVTPLLYPAIYTLRNRDMQEALQCMVGQRTLGMATRGSVIRDDKQKKWYVVLQWASLV

SEQ ID NO: 931212 - protein, 157 aa, Homo sapiens
MLLTLCPKHLFPLQTASFFRAEAFPSAIPTWGTLIYFGHWQQKVHLAVAFILVIFELHQQVGPEASLAAISLVSGGPGIQEWLSLSAPTFLSPPNVDFNLPGVWVHPDPEGSGCSPVPKPACSVASLKLWLAHLSTYAINPAFSGGRAGLEEDVIFG

SEQ ID NO: 931213 - protein, 177 aa, Homo sapiens
MRRPRVGGVYSVAVRHQQETAALCQVAGAEFSLASDGMVQGWEKALSSSAANVASLRPCACSGEDAVPVAVSGFDLDSFRDTEKPMWAFSSINGSVDPRPAVPEVSGISFEGGCRVLSCKAQAHRDSLHALWFGEVFLQALSHRSKAGSACCPRKDSTHLASDESALPPDPNYSGVP

SEQ ID NO: 931214 - protein, 150 aa, Homo sapiens
MWHGQGPLCRGFFSNCAVLPPWPPPSEPLRPGLAGQMPPKQHVCTPPLAANRALLELCVCAVQRPRSVAFLLVAAARESAAPLVTRPWVTGVFSLEEYLSFISSIKFSALPSASGLYPISMSSPSTCERDAGGLTGLQALSFPGLPCCWP

SEQ ID NO: 931215 - protein, 147 aa, Homo sapiens
MCFFLFQAQLATASIHYSPASLTLRGFLAHAVVLWYFLSIQCLMDTGLRGPSMLTVTFPAHNAIDIPALTKEQGTYPKVIINSGPFYLAGIAIFSARFLPHGLRWLLELHLLCQHPSQFPLNGEKKKKKGSETHCPHALKTIFGTYT

SEQ ID NO: 931216 - protein, 140 aa, Homo sapiens
MTGATETQTLAIHHNLAPGVRALIPLLIHLLKKEEEEDDNDNDDNDGNDDEEEEEEEQEEEEEEEGGGGEGEIIVEEGEEGRERGKEEGKGEEGEEEREEEKEEGEEEKEEEEEKGGRGGGEKEGEEEREEEEEEEEEEE

SEQ ID NO: 931217 - protein, 146 aa, Homo sapiens
MYTVLNKFGLLRRGSLSCALPSSAASVFACETAQGPPFNSALWIPVLFQFQFPLRKKPHSVSYYIRGKNCFGGVRGQGGGPHLRRRPVRREMALSIPRQGLRLLPAWWTAPSSSPPSQSRSLHFPLFPEGSLPAPDRVINGPLGQL

SEQ ID NO: 931218 - protein, 159 aa, Homo sapiens
MCLLDIPKYYCCTMMVLSLENGVDYAMEERIGSSSIVGFLVFGWSGKRKSQMEVEGRYWEANAPSRPAFRAQSKFCSTVGPTDRIPHRDSVTSVGKDIFKHFHMKNLDLKEKLKFHKLAFRSSIIWLRCTSSLRNHFFEMREYLQRTEIVGPGIKQAGV

SEQ ID NO: 931219 - protein, 200 aa, Homo sapiens
MGKMLSTKWAGAFFAQCIALHIKLSPLHFISLKGGVFGEKGPCEESLTFLAVSPLPGPTSPHSQLFHSCLISDRAEELPDLPKRWCMCGMTRTRDEGREDKMMAEPTVDASLSSRGGQGVAISRGMWPESGLAGLGVYMCPWGGPQVPGEHVLYQEAQEEGPKEDAGRQCQGREYMCQGYRGPLHHRSSQLPIIVEDFNL

SEQ ID NO: 931220 - protein, 277 aa, Homo sapiens
MARVHAARQDLLENAGEIPTGARPGLCEPGKGCTEQAATPQLHARYMSSSQPPRTFAVSVTVIKDGVSGDNPSAVHMCPEFPPSGGFVVSLTSGVKLQTFTVSVTALKAGACGVVSSFWWVRGLADFRSEAADLHRVKLQTFAVSVTVHKRGVSGVVHPSLWVCGLAGFRSEDADLRESEFFYQIMSIIKTNVWCILCSNRAERARSKEGCPGPEGAWALPALLLAGPFGVYRVVSLVGATNETAGKHTFYFICDVRAAVLSPSPVSRMTLRGLLRE

SEQ ID NO: 931221 - protein, 154 aa, Homo sapiens
MIMWKSYGVETPTLVLLIHMIWDSPCIFSKGKTKGEITRLLLLARNKTCSHQLGCSSISNHSKKKKKKLKVTPRTDFPFIREVAGDDRRDGQYSHTNECFASGLTQLDRELMQRQKFISHEKGEKCTGNRVTPEQVIMKLELMKAGRNLEWMGW

SEQ ID NO: 931222 - protein, 153 aa, Homo sapiens
MENLPSHKRHCSLLLALYLGLVTLGEASCHVVRTIEQAYEEVHMKKRDRLPYGIYKPEWKTDMEQETASVSCTTLWVALEEKAQDCVVRREGRTSVEVGPAKEPPDKRNPTCELKHRSLSPGGHGHSYHVRLHVAVWFVHCTEAMADRTINSS

SEQ ID NO: 931223 - protein, 145 aa, Homo sapiens
MHGTAFRNEALSSPKCKIYEEFILLECLATRVYLIDLASANYNTHERLDSEVTIMKKWLGRRMDLLSSTRAKNVVLSGTIVFSANSHGCPSAVLMFLKGYLSVIGHYNCAASKSGFLILMNFKSRPHQENSGQAANIENATCLWK

SEQ ID NO: 931224 - protein, 146 aa, Homo sapiens
MAIFSWTGLQISSWKIRNWCRRVGETHRVWHNNNSLHLHTILELTILFLNGSWETCLIHQVKAQMQTSVSYPTPDESESQWSLATAKSGNEGPRSRQGVTHCAKKERVKEDAILNVDGLALTHRHTHSYLTTITQLTAKPYEGSSI

SEQ ID NO: 931225 - protein, 145 aa, Homo sapiens
MHTLLLNTLCTGDESGAALDLADCSSDTSAPLRPFVAISKQPTGNLEAAINIESSSSCQKSGSQGHFSSSGRGLLRVLENRETGMCGYHTREGTAAQAVHNHRCSHRAPPSCKEQERRAWEAKNFVSLAGAHGSQDQHPYMVMPN

SEQ ID NO: 931226 - protein, 159 aa, Homo sapiens
MNPSGPGLFLVALSRPEGNSRSVVIHGGNIRSHPLTAVEWQLYIFLVLCLSPLYTERQAQVHAYLWNITSGPTHPVWAKQQAQRCYPASVPCTQHFSTSDSRQYCPAMETIFIPAQSEIFTGPSQQLCDGIVQPVVSPEHGAQPTIPHDLRAQEVTQPN

SEQ ID NO: 931227 - protein, 151 aa, Homo sapiens
MAITQAAADTALLHGSLNYTKCFEQSQFQNILLSSQTLEFLFIPKFQEPMLVGRESPNMGHFGSRHQLLHLWIVKLFERDCSNSQLLLRAEFCPPNSYVKALTSNVTIFGYGTFKEGEPIGCQPPKSACSWDGKLALLQSAIKASARKRLF

SEQ ID NO: 931228 - protein, 162 aa, Homo sapiens
MGVQFQECGGTLFSCEIMNPKFKVPKFCCSVDGKSSLSLMFSEDPIHARLLDSLSLSSPTEPVHHTIAVEVKLQDKRKSLLFVCFMEPQATVSQFCKMLSKGLHGMGPVIFNPFKVDKGVSTCGLWARWLPWVTEKIRKGKERKGKRHCLWQGGEDVTKLKG

SEQ ID NO: 931229 - protein, 160 aa, Homo sapiens
MELVAAEEDVGIIVLCWGFKGGCCQLPAKVETAATKKGASPSCLISRGCTSSSLQVCLRALWLEGDGRLPDRPLSSSVYGRLEGEFNSMVRGSGIFPSVKAKSMSMAMEHILVSAINQDRNKMGSSGSRSKGTLLSVGECGKKLVVLSQGYFMHNLSILG

SEQ ID NO: 931230 - protein, 124 aa, Homo sapiens
MRASACVCIRSYKRKTDTGQGSPHPDRMVWEPCTKVSLICFDLFSPLHREGCPVTCAVGRCIETTANPLETYSQGIGMEGIEGGRCETLNNAERIRSTPLDAIEKCKLNCSCLEMRNDQTVRTP

SEQ ID NO: 931231 - protein, 354 aa, Homo sapiens
MQTFGVLTELKTCQVHTYGLIMGGSNRSAEAQKLANGINIIVATPRCLLDHMQNTPGFMYKNLQCLVIDEADHILDVGFEEELKQVIKLLPTCRQTMLFSATQTQKVEGLARISLKKEPLYFGVDDDKANATVNGLEQGYVVCPSKKRFLLLFTFLKKKQKKKLMAFFSSCMSVKYPYELLNYIDLPYVAIHGKQKQNKCTTTFFQFCNPDSGTLLCTDVATRGLDIPEVDWIVQYDPPDDPKEYIHCLEKLIEKNYFLRKSAQKPYKPYIQAYDYHSLKQIFNVNNLNLPQVALSFGFKVTPFVDLNINCNEAKQKKQGGGGGFGYQKIKKIEKSKIFKYISKISSDSRQFSH

SEQ ID NO: 931232 - protein, 236 aa, Homo sapiens
MQGHEWQGGNVNSSHSAIPLCGMQEPPEWLKFNTVTSKYGKKCGASVRLINADHPGQQTEIPSLQKEEEEGEGEGEGGGGGEEEEEEEEEEEEEEEEEEEEEEEKKKKKKKKKKEEEEEEERRRRRRKEEERRRRRKEEEEGRRRRRKEEEKNKKKRRRRKEEEERRRRRRKKKKKRRRRRKKKKKKEEEEEERRRRGGGEEEEEEEEEEEEEEEEEEEEEKEEKKNKTARHGGTI

SEQ ID NO: 931233 - protein, 170 aa, Homo sapiens
MGDGADSLHASPETGFPLIDFPTSCELRQLQFIWSVFLDVVPSELHTSGEQLLVWAVKDVPNPLSVHSSRLSLPKAAAFSTGSSCVTFDKDVTRNGSLGSHQDRVCAGRTQGKQIQKDQLLVLLNSQDGFHSIQAFTPLILGHYLHILEEGAATVPIMQLQEMLGQSPVV

SEQ ID NO: 931234 - protein, 149 aa, Homo sapiens
MQLIYEARLDHNNPDARWLPFTFHHEWKQPEALTRSQADADAMLLVQKVKVKEALPEWLHNEDLIHSLGVKVLLGYSHQSEAQLARINWLSLWQNVTCCFYAKVDALLHCLNSLLEHSFPQSLKNGTDDSQPRNCPKKSSFASYYTLMM

SEQ ID NO: 931235 - protein, 125 aa, Homo sapiens
MPLTIEVNISLFVYLHTITKKLTGSNKKTYAYYSHSIPYKVDLNSILIEEINDCEMHEIRNLIGLPRFLACQHCDAVALWVDMEGCQQSSRHVEMQMTKQKIEDKKVKKNYSDLKDIKEQSTADF

SEQ ID NO: 931236 - protein, 144 aa, Homo sapiens
MSRPKCAAGSEPSWRTFARAVQKGNVGLEPPHRVPTGALPSGAVRRGPLFSRPQNDRSTENLHCTPGKATDTQCQPMKEARRRAVPCKTTGTEMPKSMGTHLLHRCDLDVRHGVKGDHFVALRFDCHAGSWTCMEYFISGRSCH

SEQ ID NO: 931237 - protein, 139 aa, Homo sapiens
MDTFLLNELIHTYIHTYVSPVVLKVGFLAQQQHPARNFLEMQRESVLIFVTQLEIRGNSQKSFGQSVNPRVFTPSQDPTAGCLQAEDQGEPVQVPKLRNLESDVPGQEASSREKGIGWEGRPVSLFHVFLPALYSLEAD

SEQ ID NO: 931238 - protein, 173 aa, Homo sapiens
MFYHYVGYLLYSFDRYHLPELPIGVSAGLFDICNDIFTPQAEKKPKQKPQCRNKLTHGSGTWKVKGGDRTASGITVGLAVALFQHDTVTISNQHSSGACQKPIKLMDLQENYITFKSMLVTQVAFIKSKEIDINTACLCCLPMNTPALLKKDLLSSKKRIIFKCLNLNLSKIA

SEQ ID NO: 931239 - protein, 146 aa, Homo sapiens
MTMAVLWNRKGGKVGKRLRNRMGKAELYVFNVLKCVLFGEVAAEVEHGFPFLLASFLQLIIFPWNASPLFSIGDSFSLFKKSTKVQLSVGNPNPMSQSKERLWVTVEGRNGEAALYICVWEEALSINKQAFNLLSPFPQQSIHLEK

SEQ ID NO: 931240 - protein, 178 aa, Homo sapiens
MNSVNQRLWCSYCVPSASSVPSSCWAGKLHHLFIGLRNEIESNTRILGNFSTPLTALDRSSRQKVNKETLDLNYTLKQTDLTDIYRTFYPTTAEYSFYSSVHGTFSKIDHMIGHKTSLNKFKKIEIISSTLSDHSGIKLEINSERNLQSHANTWKLSNLLLNDHWVKNKIKMEIKKFF

SEQ ID NO: 931241 - protein, 148 aa, Homo sapiens
MEKTKKVVKRVDSCDDYELLRSIVVSIVVRLKPKNMYGHLIHGQENVKPFSASAGWFACFKKQCYMENVKLAGKAIKKHLPTVIQKKGYVQQQVFKGAGVGWWCIMNALPYLLNISASRNLLRDKEKTKSIVKRLPRKSEDGKTKHLS

SEQ ID NO: 931242 - protein, 180 aa, Homo sapiens
MLNRSGERGHPCLCRFSKGMLPAFAIHYDIGYGQVPLLQVCWSLLEVHSRPCLPGYHQRRLQNRKDCCMVLPLEALSQRGTGLMLARVLLYEVAQSSSAVLEESSLSGPAAVFRAGRQEGLIPLKLSPQPPLPPGALSQRDGSFISKPLTGAAVFLSDMPCLERRNLERQSGRSHFAALC

SEQ ID NO: 931243 - protein, 134 aa, Homo sapiens
MIVRPLQPCETLYRQDTFAYATSSNYRKFIFSHFQQVWEPLSLWPCRRLQCLRHGAPSPKWRRPGVLAQLHLNQYLSYILYVNMLILKIELNYLLKEDKFLDNGYNLYPHQEKPDSWNYNQNINTGSAKKLNGS

SEQ ID NO: 931244 - protein, 189 aa, Homo sapiens
MCLGVISVGVFILLIILRASCICYNSYPCSSRHKGVFLVLCSEDLVGFLEILSYNLRILLGPKRVFDFQLLAFSNGADIHKFEDTFASSKRSTNTYHSLIQLAWGSPTGTAKPNADMEISVKMRHLLLGTKQGEPGSSCFRPVFPGSLQKVLNCPYSMPENNCLICFVQFYRFSHWENKSFTSCYILER

SEQ ID NO: 931245 - protein, 145 aa, Homo sapiens
MNACTHTETRGPSPPCTTIAASADMQMDSNSPAPQLCTTTTTIGVNACMEATNDPCFALTLLLVQMHTWMPAALPSYAATNASQVSEQPTPLLLLLLLARVKEHGSCCYHTMKHFSWHYTSEGCGQWSRNTLAPLAQQVPKLKGT

SEQ ID NO: 931246 - protein, 137 aa, Homo sapiens
MQKSETTGLYRNPSRHRMYNCAFSPSSRLEVTPCCIFHLHLDVIQGKTPDNLWKVWSIPTLKPLCFTALPSHYLDLHSGQHQSSGHADPITRRGTYLALWGWSVEASAGLEDGTGTPHSSSLEVVWATVFQRRALQT

SEQ ID NO: 931247 - protein, 405 aa, Homo sapiens
MKTDSYSKLVQESGALLKRYPKMWEPFWNWVAGRVWNRLEGSEEDRKMCESLELPRELLNGFDQNADNDMDNEIQAEVVSDGDMELAGNWSKENLQPDNAIEKKIPFSEKKFKPAAEICISNESNVNPQDNGENVSRVCQRSSQQPLPSQAWRPRRKKWFCGLDPVSPCCVQPKDLVPCVPAVPAVAERDKCIAWAVSSEGASPKPWQPPHGVEPASAQKSRTRVWELPPRFQKMYGNAWMPWLKYAAGVQLSWTTSARAVWKENVGWEPPHRVPTGALPKGAVKRGTPSSRPQDGRSNYSLHCVPGKATDTQCQHVKAARREVVFCKATGVELSKTMGTNLLHQRDLDVRNGVKGDHSAALRFDCPARFRTCMGPIGPLFWPTSPIWNDCIYPMPVLPLYLGSN

SEQ ID NO: 931248 - protein, 128 aa, Homo sapiens [sequence omitted]

SEQ ID NO: 931249 - protein, 218 aa, Homo sapiens
MHTETKDESLKVEDNESRVGQSDAMCEGFKPLLFEDGNLVEGCGQSLEVALKRIWWKSVEEDPGCGSRKNLVEGCGESLEVASHENLVEGCGESLEVSWELGTYGTHQLDSFAGFRSCSCSSHDAQRDVGSKASLLGLKRPSNSPAPAVTMTTASCFPEHPPTPAFVWLLTSLLPPEAVVAVLTSCWNCTQPSGGDAQNITIPWILSKHKAAWSRSGV

SEQ ID NO: 931250 - protein, 155 aa, Homo sapiens
MCFHNGVPGSQEKDFLLLHLSPLWGGNISGQPQQTSYWMTGSLLAFSPGKGSVWVPLFGPFLRATVLFPEHNQAAPQDGGGNGCNVCFESCELKPVDFPQPSRTHLPKQQTLEPRADTSVLVLRAHLEGTSDKLHSLQTLSPWSLELTCQSLCFV

SEQ ID NO: 931251 - protein, 136 aa, Homo sapiens
MCKLIHFLPKEPSPGKMKLLGRDHLQEPTGGQPLCMCDQTSNYKHGAWCKLLVDLAFWGLEDGGPLLTAPLGSAPGEMQPPLDRKTPDSFKKEKPRSPKSLTPAAWEQHEPSAVTLSPPAAASIQKSISGSVLTGT

SEQ ID NO: 931252 - protein, 232 aa, Homo sapiens
MIYDLFRKRKVISFGGCIAQIFFIHVIGGVEMVLLIAMAFDRYVALCKPLHYLTIMSPRMCLSFLAVAWTLGVSHSLFQLAFLVNLAFCGPNVLDSFYCDLPRLLRLACTDTYRLQFMVTVNSGFICVGTFFILLISYIFILFTVWKHSSGGSSKALSTLSAHSTVVLLFFGPPMFVYTWPHPNSQMDKFLAIFDAVLTPFLNPVVYTFRNKEMKAAIKRVCKQLVIYKKIS

SEQ ID NO: 931253 - protein, 177 aa, Homo sapiens
MGLPGPAPPSVFSGDTSPLPPTVPDCLRADVRVPPSESQKCSFYLADKNITHGFLYPPEMWDYFHSVLLIKHATERNGVNVVSGPIFDYNYDGHFDAPDEITKHLANTDVPIPTHYFVVLTSCKNKSHTPENCPGWLDVLPFIIPHRPTNVESCPINENVAISPSDFHYSTSFYMHS

SEQ ID NO: 931254 - protein, 777 aa, Homo sapiens
MEEPGATPQPYLGLVLEELGRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLSRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGQVSELNKQKITFEDSKVHAEQVLNDKENHIKTLTGHLPMMKDQAAVLEEDTTDDDNLELKVNSQWENGANLDDPPKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKISHATEELETYRKLAKDLEEELERTVHFYQKQVISYEKRGHDNWLAARTAERNLSDLRKENAHNKQKLTERELKFELLEKDPNALDVSNTAFGREHSPCSPSPLGRPSSETRAFPSPQTLLEDPLRLSPVLPGGGGRGPSSPGNPLDHQITNERGEPSYDRLIDPHRAPSDTGSLSSPVEQDRRMMFPPPGQSYPDSTLPPQREDRFYSNSERLSGPAEPRSFKMTSLDKMDRSMPSEMESSRNDAKDDLGNLNVPDSSLPAENEATGPGLIPPPLAPISGPLFPVDTRGPFMRRGPPFPPPPPGTMFGASRGYFPPRDFPGPPHAPFAMRNIYPPRGLPPYLHPRPGFYPNPTF

SEQ ID NO: 931255 - protein, 224 aa, Homo sapiens
MESTEWNGMEWKGMNGMEWNGMEWNGMESTRVEWNGLEWNRMEWNGMEWNATESTRVEWNGKEWNEMEWKGMEWNQPEWNGMEWKGTNGMECNGMEWNGMEWNGMEWKGMEWNGMVWNQPEWNGMDWNGIVWMEWNGKESTRSVWNGMEWNGMEWNGIKPSGMQWNEMEWNGMEWNGMEWNGTERNRIEWNGINPSGKEWNGMEWNGMEWNGMEWNGMDWYGME

SEQ ID NO: 931256 - protein, 162 aa, Homo sapiens
MALITLQRVIATINYMVDLLGVMGGIYPGQTNPHQVLHAERCRPPLAFGLRGQVKPHANATAPMFCPLRGTGSSDTPAAMSTPNAQIWLLNIILHNNELRLFGEMADTRTGEEKVKELRIREVPVKTTLEVFLYLGKSMLFILFGSENNDYSELFILLLNAG

SEQ ID NO: 931257 - protein, 147 aa, Homo sapiens
MPFRDSNYKSTSSSPRTDFPNGPLNPINHNQSYRAQISETLILGVAELQYKLNSQPHGTSSVQVRALIGKNLDPEYWNGTNGQILMKAYPTIFLASISITRLKSQPQKVRYKVTHETGYCAPKELNDFSNLYKQKSQECVWGWILRA

SEQ ID NO: 931258 - protein, 138 aa, Homo sapiens
MLEQTPWCWTGIEGIGKDLELLGEVAKSRTGTGKPKMRLEHSIVLACEKVPSSQNGGDMPDGHRSQSGGTLTGRTWDNMIKKKKEEDKKWDMEIRIKAKQCSKASQAFRNSDFVKIYLNLLVGSDPLGHLFRLYYVAM

SEQ ID NO: 931259 - protein, 161 aa, Homo sapiens
MLTGVGARQKAPRKSAASAALPPPPPPPPPPPPTPSSPSPPPPQDCGLPPGLPLEDTSPFAGNSLTKQKCRNVARRIPDPASGKRLTKGGRRNCPQWQVLNHPVSSSYCLASGVCNTEIRGVEDQPGGSEVKLPTKVALTVPQLVTTSEDFFLTLAPTFLY

SEQ ID NO: 931260 - protein, 143 aa, Homo sapiens
MVFSLACFLSTLLICLDLCVLTGFKESFENIKTELCLKMFLQHCLQNIHALSDEYLNISQSEWLSFLSSLICITMTKCGLLISFSHNGSPCSDPHTSTNLGHSWNVVSVACLSQQHDLRLGEPSWQVTCCVIPSLVIKQCPVK

SEQ ID NO: 931261 - protein, 140 aa, Homo sapiens
MYNYIVMQTTGRFAEIFIIISYSNEAHPPLDTQFPVLLIGSFWWVLGLADFKNEAVDPRGELLQFLKMVCPEFVPSDVQMCPEFLPSSGFVVSFTSGVKPQTFAVSVTALKGSASGVVCSSPWVGGFVVSLTSGMKPQTL

SEQ ID NO: 931262 - protein, 157 aa, Homo sapiens
MSVSRFCFCESQALAFCCRFIFKSPQLKTTKCSLMDVWLNKLAQPYHEILFSNKWEKGRGKEDLPCYCVFTDQGCGRGHKVCSIMCGPLFPVFFVESTGLGMLDYYNPSPLLIDVFFHMHLSLAKITRKPVGMGAWKMECPEHTANRGSGELKLCTR

SEQ ID NO: 931263 - protein, 156 aa, Homo sapiens
MEPPAVGEEGDFLGAQVFVASGAILLWGSQCFQARSLDIVEYSLPCLLGACCETLLEMSSLFQRSGSGQMFNQLQEALRNKFVRNFVENQLHIDVDKLTEKLQTYEKSIASTGDDSSACVSALKTSFQWDKRWRWKKVILMIMTLCRPRLMCGFVS

SEQ ID NO: 931264 - protein, 229 aa, Homo sapiens
MSVFYSSMNSEDLGAGKPVEEGSKHERQRQLSVGTDAAMSGDKCPQDGSGRIHIHFQIHLHNLHYMSGGLLDEMFNHAGAGRFRFLGSILVNLSSCVALNRFQALQSVDILETKAHELLQQNSFLASIIFSNSLFDKNFRSESVKLPPHVSYTIRTNVLYSVRTDVVKNPSWKFHPQNLPADGFKYNYVFAPLQDMIERAIILVQTGQEALEPAAQTQAAPYPCHTSDL

SEQ ID NO: 931265 - protein, 549 aa, Homo sapiens
MFQNNTLQPPIWRGLAEQGQDSIIKVGIFEKLFMTYQIKSQNANLLNGHSLLKLLIWQEPAGSTGWVAACPHVHLMIFRVLALTVSDTCQNSKSRLADICCRMRHDGAEGMAQQMTCAEEFHRVGLLKDHLCLESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWIFVQLASQGTVLLLLRVLLHWDLLRWPRGHSTLQGTVKSSKDTDVEKEEKRVFEGRTNGDILVLYNLSKHYRRFFQNIIAVQDISLGIPKGECFGLLGVNGAGKSTTFKMLNGEVSLTSGHAIIRTPMGHPAELPGSRMVLGSVCKESCDVIHLQVFQPWIPAPAQVEALGLYNQQVEKPAMFVSFPSGEEPLSVATITTGSQGVLQGQR

SEQ ID NO: 931266 - protein, 116 aa, Homo sapiens
MMREREGARNGTWIGSRNWPSPESESERGLRDPQPEDLRRFHSLAPRPTCCLCYAYPGSFSCYGDSVGNSSARRGMLLLETAGVLEERCETSGKIWLQNILELCPHKPRVIAPTKR

SEQ ID NO: 931267 - protein, 134 aa, Homo sapiens
MSTLPKISTWLLLARLAISPYCHCVTVIYLPLQKPFFGYLRRVICVGCTSGLSALWLKTVGPKSNDCVIRRGYLKTQGHMTMEAEVGVMQLQAKEGQGLLAATRCKERGVGWFQKEPTLLTPWLWIAGFLKICL

SEQ ID NO: 931268 - protein, 195 aa, Homo sapiens
MQYFLPGRRFPNVKDSIRRGWYNFRSNLFQRQRLKIDNSPGFFSSYWGMGAGLPLRLASCQQMTSPFMFGAEHSFESAYTSRRRPGVNGMTSLRQSARWASDAFSNLVIILPTPPAPKGGSQRVPGEKEAGPGILDRVPLGSGEGAGAGANKIDAINGSVYTGEQGERENDKAEDEGMRRKRGRGKREWKEGKAT

SEQ ID NO: 931269 - protein, 181 aa, Homo sapiens
MTTPSQPAEKAAARGPPAGLRGGARGKGARDSPPRRAPARPARAVGLRAAGLREEPAIPPAAESDRGAAKSRRAAALPSALTPGAPGPPSGGRTRGWGAPPGGSPAGGRPAKAALGRALLALTEPRARGPISARREGRGIWNCAALTAKADCLVCAAGRAARAVAPHLEPRPDGPAGGWPG

SEQ ID NO: 931270 - protein, 130 aa, Homo sapiens [sequence omitted]

SEQ ID NO: 931271 - protein, 203 aa, Homo sapiens
MIHFKLIFAYVPGQGPNLHWLPQNSPWNRDDPSPAPCCGCPSFLGQFLLAEYSLIPGAGNALSVMSASRSYPYLLEAEHKPHSTQAPGGNVPRTQKEADPEMAGIVNWTVATAWGKAVKPGPAPRTTKLFSSSVNKWSPAAPCSALGLCAAVGLKTPETSPSPHNRTITLGSRDQGHLGKDREMWCECVCGAGDGMHEPAECM

SEQ ID NO: 931272 - protein, 136 aa, Homo sapiens
MNYPSPGDQAWIPGKGPGQITVTAALVEHLLGKEGTALSTFHAFAHPIPTTSLWRGSQFPTLWDPGNSAGGCRARGEQLGFGEGLLGPGSTPHSQCEPPGYISQFCGAGLLNVEDAWRKKLSALEHLLYSSSGPGV

SEQ ID NO: 931273 - protein, 160 aa, Homo sapiens
MPDPSFHARTSQAALSQPQRGSCAYFSLMKPLEMSELQPTKLGTIQLNPFIQPGRKWGFREGVRDALQVTQLIGCAARNELQASGAQIQLSLTLGGNVLQTLKATNLEQAAKGGMESLAANSSFNYSTDVYYLPGRCWGLGKALGLQKGETQFCPSGHKV

SEQ ID NO: 931274 - protein, 145 aa, Homo sapiens
MLRARWLGRRTQTLAPVFPDSTFSNPAISEEGELAVWLRTSCSAWKLSLSIPRPASSPLHLPFISQTSLSPGLRPGGEGLWAALGRVLPCKTWRRQAQAVLLDFPSLVVPRRGVVVLGEGRGPWDPPPSPLPLKVMVINLLAEGN

SEQ ID NO: 931275 - protein, 135 aa, Homo sapiens
MAGGPGEDVQARACLCGGNRTELLPRARCRLLLSLCSPEGWGRQADNGPHGPASWPWPLELGRQPLAKAAASIGPSRSPRPACWVALITGQQVLRLASHCVGKHAASLLLEAKTCSNWARQERVLKKPNPQIHTL

SEQ ID NO: 931276 - protein, 148 aa, Homo sapiens
MGIMNSFVNDIFERIAGEASRLAHYNKRSTITSREIQTAVRLLLPGELAKHAVSEGTKAVTKYTSSKQQDSLKLEQRNENSRCYIQTLLSVIGPSWVKEYEKHRGQEGLSDFSQLFSPETGHRTLMSPRESERNLNKKTLLGFCFTLS

SEQ ID NO: 931277 - protein, 137 aa, Homo sapiens
MRRPLVFGSPTKCIKYRMHVKNPLLGSSTALESFPLLLFLTSCLSSPSLCPSHPSHPPLPLVPATLSPLNCGTNTVPHFLPMSVLPTVLSSSANVTQVVSFLHLQWLGFGLPFCCMFSICLVSFCFYSSFPTFLCVK

SEQ ID NO: 931278 - protein, 141 aa, Homo sapiens
MGHGLGGKHGPIEERARRKKRGRWAPVLEKRDQIQSKKQRNVFFLKFFCCHFHCRSQLCSSRVPPLALHCSPLADRGRLLFSLQTAHPCPRSALPICCRSFQVHEYLELNPRKPSLRDSAPSRETHSSFPSGPLTDLQQRA

SEQ ID NO: 931279 - protein, 140 aa, Homo sapiens
MKCGASVRRQCSLSLIAQLRIPTWEDQHSHIKTEIPFREKHFLVTLISQERTMPLSKIYLFHISNLDLLVQVFYYFLWKMLIATHELHVGFVSPTPVDLRRNPDFCVLNKRHSCFSERLCQEPFEITVLRIGLRENSEKF

SEQ ID NO: 931280 - protein, 166 aa, Homo sapiens
MVHTRGAVISLMEQFCLHNGHLTMFTAYLLRADGRGPGFFASAWSLESLEGEEIAPPTSTCRGGRGAAAPDNAGRTPSGGCLGPSGVLGVLNKELDKTHKQSKERMKGFIENESILHSVGVGLSTGAQRPRYRVFVSLNIIYLGEIYKKKEEEEERKGWMAEDRQW

SEQ ID NO: 931281 - protein, 150 aa, Homo sapiens
MWQGDTSVLEVWIRHQDLSTDLGPFTVKEVAVGKQMSLENSTDHKQFRDETLNVASSVKLEKAFLNTHCYGGLTFSFRGSAGLTAGLEEIPVSSNDNHYFAKLVQSYNLDIDNDTAKLQNISITPWIHHVSLDNYTYLTPQPLYMTTTKL

SEQ ID NO: 931282 - protein, 141 aa, Homo sapiens
MAQGKAQWLLILCKEGGEREQGESHKGKTRAAKMSSLGYSGTEKGTSQQRRTCLPTFIMSAPEVDSRSLSAELVPTTLHAAEHILRKHCSMNDDRGERKGRKDSGDVVQEGSTLFAGESAMAVAGRLLLTIGYLSDLMGEG

SEQ ID NO: 931283 - protein, 148 aa, Homo sapiens
MRKLSQFFQIHKCHVPFVLRPRRSSKDPNNYQTSQRTLWARVRRQSIALFPLQFAVINFMEESTSHRGQDTVGTARLSSTDIPECKKHRRCQQEKEAGIQTKRHKPDKELENAGEPAGTLGRQIPGRTRLRAELLRYCLGQSSTSLRV

SEQ ID NO: 931284 - protein, 173 aa, Homo sapiens
MPRQLPQEFPNFFPQVRTHTCRCLCLYVYIHVCIHICILVYIHARMLACMFRWVNTHVHTCMQTCEHMSICTYIYTNTCMHTVYTIHGYTYIHAHTPTCICTCMCTYLYTLTHARTCIYMYTYTYECAATCVHACTCMYAYAYVSANTHIHTHIHTVYMHVYINMHACIHMYV

SEQ ID NO: 931285 - protein, 141 aa, Homo sapiens
MERYSLPTLNYSNYSKTSNLSPTGLKRRMRDKEKSCLAASAVYRLKKIHPAEPSLDQLTSPISLYEINAYCYVTLSFEDSLLCNNLNYHSPTTEDGNLDLPQPSSFIFNCSLNSPEDKSHITGMTEWEARKNLVFTISWNP

SEQ ID NO: 931286 - protein, 184 aa, Homo sapiens
MKEQTPDLSPLRTAHCEDSSRQTHTRLDVKTNTLAEEHTSTWMWRGCREHADRYRQACRPSTDRPNDLEFGQGGLTTLKLSHERVVTDLSNQAVRDRGCMHRWEVEWLKLLSRCFCALLTEKAEVKPASLGIPCYTGNSTMAASSMKPSLMLSLFAERLGPPREVFTGFIMWVLHLNYQHSDNQ

SEQ ID NO: 931287 - protein, 137 aa, Homo sapiens
MNIGLVWKGGTTPSGGRGLPGHRREKLYYPSNEITLLKCEKQIGLGKPEHSLMCQFPLPRKPNHAEHENIHFLTTPFKKRDLRKAIHNQASPGLQFPHKFQTWKARTECYRILFQDLPMLSMHVSLSAKPAPIVISW

SEQ ID NO: 931288 - protein, 261 aa, Homo sapiens
METSSSSHDNYDSFASDNFANTRLQSVQEGCWTSSQCRHSGLLRQAMKFPGRNTRGAANKKAEYPKPSRNSMTGSNSDSEDEILEASLVCSPEDIPRQAPTHNQGDPKVRILGSLGALPTEEKEEKTEAKYMLVRKRKIVDGYMNEVEMLRNRPARSPMILPHIIRPPEEITEEGLENICSNSQEKIYNRSLGSICHQCRQKTIVIKQTAETQTVGAFKACSAAPTLETLVVKRSGILCWMRTGIVRLVEAVQLQFPLAAR

SEQ ID NO: 931289 - protein, 194 aa, Homo sapiens
MDMMVFYLEPNGFLHCPMFCGASSLVAENRRVSLELPRKSTEENMWPIWGSNPRPWRFWHQRGPCYYISAAACLPGLSGDLGASGFLGQADVELCLQAPTGTTCLKSSGYKPQATSRYPSPEEIGTPSPRGSMGIFWVIAIWHSLGDCEWMNGTRPEPEFPTASPLSPCLKPSLSFPTTEDKKAFVHHFKQLTF

SEQ ID NO: 931290 - protein, 178 aa, Homo sapiens
MEETCSKWIIKQRRQLAISTMHFGPGTANERTVQWWFQKFCKVSSSFILRNKEPFLHRIVTCDEKWILYDNWRRLVQWLDREEAPKHFPKPNLYQKKVIFAVWWSAACLIHCSFPNTRETITSEKYAQQLNEIHRKLQCLQPALVNRKGPILHNNVDSTARRTNNASEVERIGLRRFS

SEQ ID NO: 931291 - protein, 156 aa, Homo sapiens
MQTMNQIRILSRTPVYVHAGKHPSFTPYPPGASLSGTLPCFGGSQVHSSEPLNKAPATLIPDVFVAIGTIKGNDRGETGDAWSGTLGLEAETLLTEIPKSLSLNKASRRQFALGREQRPLHPNLAPFKGRDLLLFRTLPTTCREKHLIEQYSAFES

SEQ ID NO: 931292 - protein, 145 aa, Homo sapiens
MTLERSPTLQPNMIPSVSQLLRVSPASPSPEGAGSLISGNASCLVSFCQNVRIRGPPRELKFSTVTYANGQSILCVVVAEWLRRWTRNPLGFPRAGIYFSKVNILIHTEKEIPGNPGSNTSESKDSDMVAKMGITWALLSKQLSN

SEQ ID NO: 931293 - protein, 134 aa, Homo sapiens
MSSFALGGNEHTTKAIKCLWKTGGEGPKLDLRNPAIAKIAVQHLLKSLLPVAPICPYLGMLLAGASRTDHGPSLLASPKGIPAEDYGKSFFVIFFVWNDGKHEKRAILALLMIALSSEAQIFLGCLHPLFTALQ

SEQ ID NO: 931294 - protein, 152 aa, Homo sapiens
MISNSAAGLRPNGTENIPGFCKCGVFLCRLTIRTVISPPEVILTCFISLHSSNEPSYCLKPEAASHSSPGQMPPHPFLTEVIVGLKKPHYNYRFYDAYLMDCKLPDSRHHILFNIVSQSLAEYEPWSLLSNSFLNEAQLKKYNQAGHGGSSL

SEQ ID NO: 931295 - protein, 171 aa, Homo sapiens
MAVIPDTGWQTGRAQTKIEQSSNKVGLKIEAPEMRLLSGYMSQSQTFCNELEKNIKTEGGALGVNTALTFVTCCTNKEWLLCQFSLKRCLTSWLCEFEYSFQAGSGRVLGNPERQPRDAGLRMQARCRRGWEGRQERCGYRETRRGRGRRRAPLLRVLALKATTGQRGGAR

SEQ ID NO: 931296 - protein, 193 aa, Homo sapiens
MFFILLVLKRATVHWGKENDQTFWGLLDIGSELMLIPGDPNRHCGPPVKVGAYGGQVINGVLAQIRLTVGPWTHLMVISPVPECIIGIDTLSSWQNPHIGSMTGRVRAAMVGKTKWKPLELPLSRKIVNLKHSVIKGKLATPDLSQFIDSEPFEWSGSRVFLRKDLETPDHCGTPVRVGAYRSQVTSEVLAQV

SEQ ID NO: 931297 - protein, 180 aa, Homo sapiens
MAVSRASRLGLSPSWILSLEFWYFWFCYVECIRKGKKRRKYDNGCYSSFSRVVVLTFTSPWKDPPSETGRKYLPDSSHSPLYFSLGNLFHRTPPQLKEPMLSQEKDRYGALTNLSLYADVTQVLHLANSAFLICDSSSSSNNNNNKNNKPNQTTTTKNQYDTDTKTNIETNGTEERAGEV

SEQ ID NO: 931298 - protein, 144 aa, Homo sapiens
MQTRGTLPPVNTSGAGGTQPTMQEGGAGNALNDAPGSIISKLPFLPRNSHSGGTRTCKTELLGLLAFVTEQKQAAFFQIPPYNFTLHINTTHSLCLEVVVGLPDQSGESLCLLFPLLSILSSMGARNREPLLTLRSCELVVAGS

SEQ ID NO: 931299 - protein, 141 aa, Homo sapiens
MGLWGCSQFDACSWTACLVQIECNSLQVGVGFRDFRFLNGHTDTLEVVFEDRMLPLVDDNSSQRQTNKKTTTQDPENSKSESLTTILQDRLSDERAHPAHFEQPIYPVVRRSLPGFLTGGTNPIHEDAILMTYSPPKGPTS

SEQ ID NO: 931300 - protein, 134 aa, Homo sapiens
MKHASLDWTNLNYNTPDPTKSATAPKKGKKRKRSRKESCSVYLYKVLKQVHQHRHLVQSNGDLEHLRYAIFERIAGEASRLARYNKRSTITSREIQTAVRLSRMLCPRAPKPVEIRRPTPKTNDHFRRSRFWFL

SEQ ID NO: 931301 - protein, 213 aa, Homo sapiens
MACLDVRAVEMLAFAFAVLIVLLPLTLILVSYGYIAAAVLSIKSAARQWKAFHTCSSHLTVVSLFYGSIIYMYMQPGNSSSQDQGKFLTLFYNLVTPMLNLLIYTLRNKEVKGALKKSPDCLNQGSPTPGPWTSTSPWPVRNWAAQQEEHIVKFQVNSNPLVLGTYYDFKEIRDLQTTVFLLYPHMVENRKDEQHVISVLIKAQIPFMTAPQS

SEQ ID NO: 931302 - protein, 213 aa, Homo sapiens
MPHRTNRKRAIHTELVAQQQVIREMKPTGADPRILSLAAEVAKSPEWNVPVILLKLKAIAVQAWSQEKMQRNFPMNYFHQLQKIFYPVIRSTAAKLLLLMAESYQEILILLRQSACYKGLRSLLSKQETGTEFSQELRQLIGLLSPTVYQEVEKQKLHQAACLIQAYWKGFQTRKRLKKLPSAVIALQRSFRSKRAKMLLEINRKKEEEDLRL

SEQ ID NO: 931303 - protein, 431 aa, Homo sapiens
MLGMKQEFCEVTEPHREEFDGCNETVSQHAKHRRDSEPNGNLEMHDGDATGEKIYKCDECGKTFTWIRGLQMHRRIHNGEEPYPCTECGKAFITHAELTQHQGLHSKKKTHKCKECGKSFSQKAGLFQHLKIHTGEKPHQCSKCGRCFSWRSVLRKHQSLHTGEKPFECMDCGKAFCHSSHLIEHQQFHNKEKPYACNECGKAFRQCSPLTEYQRIHSEEKPYECKVCGKAFTQYAGLNQHQRIHTGEKPFQCPSMFRLNKHKLGGKHGNPPEPRKYKCDECVKTFTLSTGLRKHKRIHTGDKTYQCPECGKALTRRQDLIEHQGIQNKVKLYQCQVCGKALSQKTGLSCHLRIPPGEKPFECSECGPAFCWKSDLNKHKRVHSEGKLYKCEECGKAHRQRATLDQHQRSHIVPRPGSGVSGAKPAVEAQP

SEQ ID NO: 931304 - protein, 149 aa, Homo sapiens
MVPSLSNCCLFTRVGVDQSMINQQQDSERKKVFLCLAQDWLSPVATDTGKGLWGPSFPNINPKAVKRSLLSEQLRSSLDISGGFRMTLLRAAARSEAGSWVYNQFYALPRGPSPGHNLCIHPNQLPLFAATRESGTNLSTHLLKDSFVS

SEQ ID NO: 931305 - protein, 171 aa, Homo sapiens
MLGASYAAVPLYRLYCQTTGLGGSAVSGHASDQIENMVPVKDRIIKINFDADVHASLQWNFRLQQTEIYVVPGDTALGFYRAKNPADKPLIGISTYNVVPFEAGQYFNKIQCFCFEEQRLNPQEEVDMPVFFYIDPEFAKDPRMINVDLITLSYTFFEAKEGHNLPVPGYN

SEQ ID NO: 931306 - protein, 138 aa, Homo sapiens
MAIRVILRSLLIKDKGKQKIDLLVPYKKGIEILVSTHTLLVFFATELGVWCSDSHLHSGGSYLEDRSVNPFPISGGQKSKLSITGLKSRCWQGYAPSGGSREEYVLTFSQPLVAARIPWLVVALLLSVSVWSHCLLLF

SEQ ID NO: 931307 - protein, 142 aa, Homo sapiens
MKCFVLKKSTNVGNYFLSYIVMVIFVKFQVDCNKGVTGTIYEYGALTLNGEEYIQFKQFAGKHVLFVNVTGIEERVQNTVEDSLGISLSLPLPGWSTKEYSWEWDWNWSVWLCHHGTLYEWGRGDAGIGGPRFIHVINGYIQ

SEQ ID NO: 931308 - protein, 135 aa, Homo sapiens
MSLLNGGGRPYPSLPILSLAGLSKKSLQPRVYISVTGRPELFPPAASWISFFFLRRKGWAGASSWLGLQRKPAASPALELAPLGLNPLTRSLPLACLALSHLTRHASPTRALSSTLPPPLRGPARPAARPLPCPL

SEQ ID NO: 931309 - protein, 186 aa, Homo sapiens
MWRTFVSSSGIVNAPISALSKQTTRLYQSAGRGWGPDKRIKAGCPSQQRQPTGVSSHSVEALFLLLFAINFVMADSLVYTAFIHSSEATSPPRGTNNSRSVALAVVTLVWRVCSFISEASEMMSPLEGGNNSRRPALRAVKLTAKVYGFTPQPGRPRIHQKEETPNTPKHQQEQTLDMLPLRTVIS

SEQ ID NO: 931310 - protein, 224 aa, Homo sapiens
MGQTEKLFQTGEDSVSVSDAPESCVIDCEEEAGIESQKGTESSHCKYVAELVMTRSMQNVDYNQLQEVIYPETLKLEEKGPKLAGPSESKPQWPTPLPAVQMPVTLQPQMQVRQVQTPEEYQIEKDKVSAMAMPIQIQYPQYQQVENKTQLPVAYQYWPPAELQYRPPPENQYGHPGMFPAPQGRALDPQPSTVRLNPTALPSGQHSALHKIIDKARKQGDTEA

SEQ ID NO: 931311 - protein, 162 aa, Homo sapiens
MARSSWPVLDGRCLFGAAWGDTTVDTIIKAASSILSGVCVSFVFSRHFVANCVSFFNCAQVSSFVFLVDGNFIYSSDITILFILERKVGPGDRRSAYGGPVPPVLVSEFPQYLLFTISTISEKGMWRDYRVMVGRGSAGKNVNKDLCVINKFKEKCCALMCT

SEQ ID NO: 931312 - protein, 254 aa, Homo sapiens
MFGALDVLQMNEEDVLKFLAARTHSGGTNLYFQMEQYIYKTRAIAAIENLADVSVISSRNTGQRAVLKFAAATGATPIAGCFTPGTFTSQIQAAFREPRLPVVTDPRVDHQPLMEASYVNLPTIALCNTDSPLCYVDIAIPCNNKGAHSVGVMWWMLVPEVRRISCTISREHPWEVMTDPCFYRDPEEIEKEKQAAAEKAVTNEEFQGEWTAPAPQFTATQPEVADRSEGLQVPSVPIQQLPTEDWSAQPDTED

SEQ ID NO: 931313 - protein, 154 aa, Homo sapiens
MFAIQKKILVSWSPPKPIRPLTDLGDPMFQKHPDKSGVIKDTLQKVRENLDRCQQERENNIPWYQSMFNWNPWLTTLVTRRESEDIPEDSILELRSRWTETDKESWLTAVLEIDDGCERIQGSFGPECLSPLDTASRQDSIQKFQKQELKHSGL

SEQ ID NO: 931314 - protein, 178 aa, Homo sapiens
MKSMLGFSHGAGPGAGEGKDRQRPTSWVFISKSWEFHLLTSSPGPKSPRRLGDRACEETIEKPKKKKKQKPQEIHQENGMEDPSISFSKPKKKKSFSKEELMSSDLEETAGSTSLPKRKKSSPKEETVNDTEESGHRSGSKKTRKFSKEELVSSGPEEAAGKSSSKKKKKFHKASQED

SEQ ID NO: 931315 - protein, 136 aa, Homo sapiens
MSVNSFKFVEAQGMRLGDRACEETIEKPKKKKKQKPQEIHQENGMEDPSISFSKPKKKKSFSKEELMSSDLEETAGSTSLPKRKKSSPKEETVNDTEESGHRSGSKKTRKFSKEELVSRTSGTMPLFLPQDIFLLV

SEQ ID NO: 931316 - protein, 174 aa, Homo sapiens
MPKSRALPPSIGTGHAETSESFAIPLLLSDDSGFLLTFLMGMTGPVSWTLHIGLQGIGGLVLPPRIHRDASGPGHLLVNARHPELQAEASAGAHLDVITHSRAQHNGPDGSRLSGRGAMQRPLACRALILRIFWLNHSYTTIIINIEDYCGQMCEGFSPHIKQQTPARCPPIQF

SEQ ID NO: 931317 - protein, 134 aa, Homo sapiens
MEQFHPTCMLPTTPGFPLQMPFPDSLFGLSDPVCDANCYEQNLGLDSENEKRRIKGNKMEERKLSTYFWVYFAEDTGCKVQVEEKVGMEPKRLIPDQKIEGSSPFVVVVLRSLVRKIFVDSEHFPFSCSGLAAN

SEQ ID NO: 931318 - protein, 149 aa, Homo sapiens
MEQGGPTGPHLQYWGLHLNEFPFPFLSLNRERSNDLTLVTHSLQSKIILICDETIKNKSDETEIESSKVHAQGYRKQGKRREMKGTLESFAGIHPFKQGACYKISAQLVCIGYIFWKSPSLKRWSKLPQIQAPSSAFLASQHSPRTPDP

SEQ ID NO: 931319 - protein, 136 aa, Homo sapiens
MLPFSAEPFSPPTALWEPLSGLAKAGVHFLSLQGGVDGEARAGTGAVCGACRPAGVPGGRGLGGPRTRSSQPALLAPGNRELSTWASGCGGCTGSPAVPAHQCSSHPLHGLLCGPSLPDEHHPLLHGAQSHGPPKG

SEQ ID NO: 931320 - protein, 164 aa, Homo sapiens
MAHSFTQQPLPASKPQDTDLHQHMGQHYLPNSVEKRTFHHWVMRVDSDSWLLNARHDWRPFIVLLEKSMKKLSHCGPRTWARNESGYSATPCKVPRFLTLQPRFYVLPLSTLNAFPPKIGSEYASLPDILAEPIIHDDYIVEGSANSHISVKGHNSQKETLCST

SEQ ID NO: 931321 - protein, 311 aa, Homo sapiens
MNDDGKVNASSEGYFILVGFSNWPHLEVVIFVVVLIFYLMTLIGNLFIIILSYLDSHLHTPMYFFLSNLSFLDLCYTTSSIPQLLVNLWGPEKTISYAGCMIQLYFVLALGTTECVLLVVMSYDRYAAVCRPLHYTVLMHPRFCHLLAVASWVSGFTNSALHSSFTFWVPLCGHRQVDHFFCEVPALLRLSCVDTHVNELTLMITSSIFVLIPLILILTSYGAIVRAVLRMQSTTGLQKVFGTCGAHLMAVSLFFIPAMCIYLQPPSGNSQDQGKFIALFYTVVTPSLNPLIYTLRNKVVRGAVKRLMGWE

SEQ ID NO: 931322 - protein, 272 aa, Homo sapiens [sequence omitted]

SEQ ID NO: 931323 - protein, 146 aa, Homo sapiens
MREKALLEGCRPAVFVSVELLWNLKGPDKTITFLGCVIQLYISLALGSTECVLLAVMAFDRYAAVCKPLHYTAVMNPQLCQALAGVAWLSGVGNTLIQGTVTLWLPRCGHRLLQHFFVSFWIWVWAWDSQMGMAPVGGTWVREGER

SEQ ID NO: 931324 - protein, 136 aa, Homo sapiens
MLNPSISSNHQASLLQVSWSLLEVHSRPCSPGYHQQRLPDSTDCCLFLPLEALFRRGTCWMPAGALLYEVSVDPCWEVSFSQEAWGDYFEHLYAQKLENLKEMAEFLETHYLSRFNQEDSKTLNRPIMSSEIESVI

SEQ ID NO: 931325 - protein, 321 aa, Homo sapiens
MVNLTSMSGFLLMGFSDERKLQILHALVFLVTYLLALTGNLLIITIITVDRRLHSPMYYFLKHLSLLDLCFISVTVPQSIANSLMGNGYISLVQCILQVFFFIALASSEVAILTVMSYDRYAAICQPLHYETIMDPRACRHAVIAVWIAGGLSGLMHAAINFSIPLCGKRVIHQFFCDVPQMLKLACSYEFINEIALAAFTTSAAFICLISIVLSYIRIFSTVLRIPSAEGRTKVFSTCLPHLFVATFFLSAAGFEFLRLPSDSSSTVDLVFSVFYTVIPPTLNPVIYSLRNDSMKAALRKMLSKEELPQRKMCLKAMFKL

SEQ ID NO: 931326 - protein, 150 aa, Homo sapiens
MKAEMVCLMVLTITSARGLLGCCGRDLVGSDWIMGVVSPFCSHDSEWILTRSDVFMTGSFFYTCTSSLACHPVRRVFASPSPSATIFENAKSSFKNKKFIPFATTWMNLESTMLSEISLSERLILHESTYDQKVHKCMVKKCFHLQKFYR

SEQ ID NO: 931327 - protein, 316 aa, Homo sapiens
MVNQSSPMGFLLLGFSEHPALERTLFVVVFTSYLLTLVGNTLIILLSVLYPRLHSPMYFFLSDLSFLDLCFTTSCVPQMLVNLWGPKKTISFLGCSVQLFIFLSLGTTECILLTVMAFDRYVAVCQPLHYATIIHPRLCWQLASVAWVMSLVQSIVQTPSTLHLPFCPHQQIDDFLCEVPSLIRLSCGDTSYNEIQLAVSSVIFVVVPLSLILASYGATAQAVLRINSATAWRKAFGTCSSHLTVVTLFYSSVIAVYLQPKNPYAQGRGKFFGLFYAVGTPSLNPLVYTLRNKEIKRALRRLLGKERDSRESWRAA

SEQ ID NO: 931328 - protein, 180 aa, Homo sapiens
MSHTGGEWLVDRQVVFSLTVLVALCGLVGNDVICWLLYSQVWSSPYVTYILNLATVDMVNLSCVTVILLEKILMLYHQAALQVAVFLDPVSYFSDTVGLCLLVAMSIESFLCALCPTWCCHRPEHTSAMVRWALALSLYAVSQVWGSAPPQRQGLPMHKAVKGIMSGKHAESSKEQGECS

SEQ ID NO: 931329 - protein, 202 aa, Homo sapiens
MLPDGITGLRGAVEGNVAELPPGAFSSLTMYCSRLIHPHTDFVEWVLMYPFEDEMPETLSVGSDGYCGTHQALEFSSLGAELGALCPRIVVENEETLEVWPKGLWNLPSLHQREAALETIDQAFSEPNILLLDWCYSSNGFTGHMDTGDEDVYIYKATLTTPNTIEDVEPQELCALLLQNAAAAECKMVQPPWKTVGNCSQS

SEQ ID NO: 931330 - protein, 216 aa, Homo sapiens
MAQFLSVFSGKLDWDNRTETPGQVNMSHTGGEWLVGKQVVFILTVLVAFCGLVGNGVVCWLFCFQVRSSPYVTYVLNLAAADMVNLSCVTVILLEKILMLYHQVTLQVAMFLEPVSYFSDTAGFIIFHMLICLVVGISSLTLIIRSLYCLKNCSPIRIYHIVRFVAISFLVWGLPLVVLVYLPGKEYLTFAFDLLLLLSMVVSMAQPAIYFLAGYL

SEQ ID NO: 931331 - protein, 169 aa, Homo sapiens [sequence omitted]

SEQ ID NO: 931332 - protein, 156 aa, Homo sapiens
MRFGALWMKEVHGRQTCLGKQQPQRFSPHGGQEWIKLERDTTEEKMFEQLKPIEPVQKTLPWVGEVAATLQEAMKRDCWREARVKKKPVTFEDVAVNFTQEEWDCLDASQRVLYQDVMSETFKNLTSVDVKGPYLGPTQRFLIPTHQPESFCISQS

SEQ ID NO: 931333 - protein, 149 aa, Homo sapiens
MVWGWMSPRYDPTVLAWRYLFPKAKIQSHSVVGGNKSIKKKDIHVSDKEKKCQQSSTEKGSYETTFSACGEDTSNGEKLPEALLRPSPGGCPSGYEALRFCHPVCPCDGILAQLGMARGQVIAGGLQAWGNFLKETGKGTSIPRCISFM

SEQ ID NO: 931334 - protein, 196 aa, Homo sapiens
MLCPCLCQSHWVPHILCTCIPTRLCTPLFCLPDLPSHRNLPSAPPGFLSPHQQNLLSLSQDVPASRSSSSNLGFPEDMTPSEVLPHGGVSPGTCTPGFRVLIVGTCEQVALRGKRDITHVMKIKDLKIGRFCWTLCVGPIKSQEPLKAESLPWLESDSAEEEGRGEAGEGRSEVPSRRIECALGTVCEYLREGSRS

SEQ ID NO: 931335 - protein, 141 aa, Homo sapiens
MNIPYHGASYLVRNQELRSWTAADKAAQMPWRRNRQSCSKPTCREGYRTFQKWAAVVVSSGEEQRYTCHVQHDGLPEPLTLRWLSSQPTIPIMGIVTVLVVLGAVFTRAVVTAVIWELACILPSHEAPSLSINTYSFVKNL

SEQ ID NO: 931336 - protein, 442 aa, Homo sapiens
MAPRTLLLLLSGTLALAETWAGSHSMRYFSTAVSWPGRGEPSFIAVGYVDDTQFVRVDSDAVSLRMKTRARWVEQEGPEYWDLQTLGAKAQAQTDRVNLRTLLRYYNQSEADHLLPAPCLTDGPGPLSLRVQDRPRGCGTCRDPRPGRAPGAFTWFHLQLRPKSPQVARVRARARWAGLTAGTGPGYHILQGMFGCDLGPDGRLLRGYEQYAYDGKDYIALNEDLRSWTAADTAAQITQRKYEAANVAEQRRAYLEGTCMEWLRRHLENGKETLQRAGITRSWVLGFYPAEITLTWQRDGEDQTQDMELVETRPTGDGTFQKWAVVVVPSGEEQRYTCHVQHKGLPKPLILRWEPSPQPTIPIVGIIAGLVLLGAVVTGAVVTAVMWRKKSSGPVITGTWMSPRVVPTHRSPSVEIGRLWQEYTEERASQAFNGGDIYEECR

SEQ ID NO: 931337 - protein, 117 aa, Homo sapiens
MGELGSGSFQVAEQVEVFGEFDFLKKIGEKMRRIVQETALEGQELGGSKNWSLDTTETPVCRGHPRACEDNDRKSNSYGCPRGDWRLGDQNSDTRRRTGIVFCQNKTMNKMGAEGQT

SEQ ID NO: 931338 - protein, 162 aa, Homo sapiens
MEGKVWCKIRKKCEPGFTQVWVKGPRYLLQDDAQAKVVNITMVALKLQDSGRYWCMRNTSGILYPLMGFQLDVSPDDTKQTPEWTAAWDPRYFIQDDRFYGVFTVTMTELRVEALGFHGCGISKSPEISIVRIICLVVSQEIFSFHLLITENWGHGEEKPLA

SEQ ID NO: 931339 - protein, 166 aa, Homo sapiens
MLRAAPSNRGAGAVPEELHKHPGQTLLLQCQYSPKRGPYQPKSWCQQTSPSRCTLLVTSSKPWTAVQKSHYTIWDKPNAGFFNITMIQLTQNDSGFYWCGIYNASENIITVLRNISLVVSPVLITSPEGTSGHPSINGSETRLQPWSPQAMTQNLVVRKGEEDAGC

SEQ ID NO: 931340 - protein, 324 aa, Homo sapiens
MLRGRVDLSWMVRTITSTRISGSETWIPTKWICWHLDFSHLGVGVLSVTAQFALLAALQINAFLSSAANLGVDVLALLCQTFRKALEQFPERIPSGTIRQIPQAAYKAVNYDKLKETTQGKEENPAQFMAYLATTLRRFTDTDPEGSKGCLILNMRFITQSAPDIIKKLQKLETGPQTPQQELINLAFKVYNNREEAARQQRISELQLLASAMRQNPATPPAHKNFKMPKLHKPKPHTPKPQQSSIPTGLPPTGSCFKCQKSGHWAKECPQPGIPPKPCPICAGTHWKSDCPALPAATSRAPKALAQGSLTDSFPDLLGLVVED

SEQ ID NO: 931341 - protein, 249 aa, Homo sapiens
MVPEGVVTASCCCQYMDTSLFLTNSLNPAHPSINFFINVSSFETKKGRKREKKYLNFDPSLEMTGRYLCLPHSCHRKTMMKTTCPQPAPCYVSIITTENLHHCLYHHHHLHHHIILITIIIVIFTITITINIIMIFTIIITIIITSIIIIIFTITITIITIVIFTVIITITITIIIIIFTITATIITVIITISITVTVETIITIATTFYSIITVFIITKNYTCTFAKGSTEKVNLPLSVGKLVIDDYNI

SEQ ID NO: 931342 - protein, 130 aa, Homo sapiens
MKRLLRSAPSKLASSQYLLSHMHYLSVEILPSRTGEGDSRYPPAWKWQELGCEAYRSLITNTAEASTGQLIQFGCLPPPNLMLKCNLQCWDPQCNPVSIGALPSAMIGSFLRPSPEAGASTMLLIQPAEP

SEQ ID NO: 931343 - protein, 144 aa, Homo sapiens
MSVRVKWGQDITSPGAGLSLWLPALMLPLCTCDPINCLFNYDTEEKPQTGLPYSRFAASVLHPGPYWAHILVSLPCDALKSLLKEYGPADTFISEFWPPDYERVNLCCFNPLSAWLFVMEAPGNKYTRLSTYLRRCPGFPHYTY

SEQ ID NO: 931344 - protein, 455 aa, Homo sapiens
MAFAVVDACPKYCVCQNLSESLGTLCPSKGLLFVPPDIDRRTVELRLGGNFIIHISRQDFANMTGLVDLTLSRNTISHIQPFSFLDLESLRSLHLDSNRLPSLGEDTLRGLVNLQHLIVNNNQLGGIADEAFEDFLLTLEDLDLSYNNLHGLPWDSVRRMVNLHQLSLDHNLLDHIAEGTFADLQKLARLDLTSNRLQKLPPDPIFARSQASALTATPFAPPLSFSFGGNPLHCNCELLWLRRLERDDDLETCGSPGGLKGRYFWHVREEEFVCEPPLITQHTHKLLVLEGQAATLKCKAIGDPSPLIHWVAPDDRLVGNSSRTAVYDNGTLDIFITTSQDSGAFTCIAANAAGEATAMVEVSIVQLPHLSNSTSRTAPPKSRLSDITGSSKTSRGGGGSGGGEPPKSPPERAVLVSEVTTTSALVKWSVSKSAPRVKMYQLQYNCSDDEVLIYR

SEQ ID NO: 931345 - protein, 144 aa, Homo sapiens
MEGNKHASGQDLAAALLGGSQGKWGDVLKAVSAVQSQLSGALKGTGQPNGAQEWASDASSKAGPKEDGPRAQTHAASSWEIQGFRTSHTFGNDLSKSQTPTAGCGPPGWVGGFLHIFVSPVPTQWRSHGRCQLDKELHEAQLEP

SEQ ID NO: 931346 - protein, 198 aa, Homo sapiens
MRFPENALQMCLLFPELPAQLVSVVSLMLLLLQLSQCPFPTCHPRPVPQSNESSSGQTDKATQEEICKKIGSRNSVLTSPLSEIYKTVVSMFQLVGVQVSEEQLRDTALNPGVYQGCCIQLHGLYTTQLQHNLSEAKEQKTSLIPTLDLQQVPAKHAAWQTQKMQPIFSLSSRPGSHHWKPQCLFSAPTAQTTYNKRQ

SEQ ID NO: 931347 - protein, 145 aa, Homo sapiens
MYQKAWVPRRNPAAGAEPSWKDSSKTMLSRHMGLDPSQKLYCQGRNISARGHNCDSIKLEVWTVTWSLWARHITESTSKEWDDMMSPERPDDSPNFQLNGITVVSPGRNIPPLAIGLKVMGTGSKSFASDSLGIIAREDTLISTP

SEQ ID NO: 931348 - protein, 146 aa, Homo sapiens
MHGKSHHLSCLIGYGLSSNRPSLLSGDLKSSGNGHQLSSALRGGCTVTGMAGIWHLYSSLALGDRAQQQLSSGIMCLQADCDAPAVTQPGLNNFDHNARQSGPTFKYHHNDEMFSTYTFGGGHKYLVYSTAHSLRERSNFPSLYII

SEQ ID NO: 931349 - protein, 135 aa, Homo sapiens
MATGPSRQLAAQPFGYYVLYQYEARYYQWTAGWLWLSKCKDCLVMSHLCTSPGQALGPVPLVQKGASGGPVDLCLHPIHNGRQNDLSLTRQDDSQVFVEPGLCIDSPSCLPSKSKVRAAACKLVKDLEVSMMFSM

SEQ ID NO: 931350 - protein, 143 aa, Homo sapiens
MWVRWDKLYTAVVDSSLNSHTFHGGASHQQHFIWSILLGLQLIIRVLVSKQPARRLMAVKPKDCTYLTVSSSFTPMLLWHFSLEEKHGKFLPCKISKGLCLDPIVGTTLTLIRAIGKALFQLKHPGQGDEFDGCCETLVVLSL

SEQ ID NO: 931351 - protein, 173 aa, Homo sapiens
MWKQLWNWATGRSWNSLEGSEEDRKIWESLELRDLLNGFDQNPDSDMDNDVQAEVVSDGDEELVGNWSKGDSCYVLVKRLAAFCPCPTDLWNVELERDDLGYLVEEISKQQNIQKESHRKADPGQVHVAVDSRQDPVSPESGAEQATCDGKGEEWGKQKKYCGTWSRKLPRKG

SEQ ID NO: 931352 - protein, 152 aa, Homo sapiens
MRLNPSPTGPAPELAPCFFSPTSLPSLPLPYGIGTSDWPTAFSLTLSSSARRLGVYPGPTMRPLEDKALLCSPPTLLADETSGEDNECGRGCQIPHNSLSPLGKKSFPTEVGFKAQQADSRAWTAGDNLAAVMPMTKVGNESGEAFLKRRTW

SEQ ID NO: 931353 - protein, 182 aa, Homo sapiens
MSPPLDSIPGLCRSTIHDTPRCSPAPCTSAIISRWHTICELPVYLFVSLSICSYEHVISNNSILSINANKSSNPKKGLADNLLRRPFQCHPLHPSGLCLHSHVTRGGRGLECLLGGNENHSAKPWTAEDVCKCLFLPSFSATFLPELTVNGQLGGKDHSRAHGTVAAATPGRTYNALSNHWD

SEQ ID NO: 931354 - protein, 167 aa, Homo sapiens
MLPSPSKTSPHPNKVPSGKAPGPCEVGLAQNHFRDPQMASEDSRSSRIPEKVGSITPPPDRAVPKPQGGQKPAGHRICHDKCLPGGAYMDTRWLSRSRQKEAEMRGQLQLNPWSTDNNFAQTSSANSAQSWLDLGTWPAPAARELGKGSLHKLLEPSFLHVRKARNA

SEQ ID NO: 931355 - protein, 135 aa, Homo sapiens
MSTIPVTYKRHEGRQEHPLGYGRGEPRQDGNTSGRRGDTVSLEASGNSGSRYEDLNWSLISRGRRRTMESGITQVKGRESNDMVALRSQVLSPTQSGGQSHLEHFPGQVSPEPPGDYCEPKNMSFVGRRLQGPWE

SEQ ID NO: 931356 - protein, 128 aa, Homo sapiens
MRGLCPYLQDDKSVGVSGTGNSASSDITEKEVTRGGFAIGSLKNGTCWAKPHIHLRPGLEERGMSELSNSLYVEPGELILSNLSVDLLAARFSWQKVDSWPTAEVSAFSQQQIFRLSGKGQPEGDGEH

SEQ ID NO: 931357 - protein, 136 aa, Homo sapiens
MENVATIADCASVIEGVSRSRNALLNGDTKNYDWDSGYTCHQLGSGAIVVQLAQPYMIGSIRKASLRRVKCEQIPKDGDSKSSGDEHHRQCQALEWSLPGRPQEQLGGQSYLHHSKVFFYHPQTSELWFPEKSYSK

SEQ ID NO: 931358 - protein, 217 aa, Homo sapiens
MDLVYGMERSVCVCTIKGNLREHTLCRMAQRSICMGRQQQDRKSASGYLSCPPGPLGSGPGVRQNLFTGFGQTSLIPLSLAPRGFPRQHPPEDHRLSPEAPQSSHMLAPGPEPPVGALCALWQSTERANGEAALSLQKLLVCREHQFQPSDSTSVWEGTWPSRGFMFQQLEMDAHKENLLGNRNNGNKLRFQMAARRPCMVHARYWAREEAVQGQPG

SEQ ID NO: 931359 - protein, 150 aa, Homo sapiens
MVTISPGKRLGPDAEMGVGDELGSLVLSVVRLQVHIQHADCHPGERDEEGRPSCGRDRPSSRETENTPTAAIFDLDCRSAAKHYFKIGADMPIFMFANFHGGNTLIVAIFKKKQVLVSSHEGGTGSKEHYVRQVDKEACPRANEAETGEK

SEQ ID NO: 931360 - protein, 159 aa, Homo sapiens
MAAGKRRSSLPRLGSQAEGLLTSQTMVPGTSWIVERLPASALLYSELQPCLPCSHHPDHPSTPSRCQLRRQLRRHLFMETLITAESLEVSDPVSTTMQETDDSIRRNRAATPLLQCEDTVRRLPSINQNAGPHQTSHLLVPGSLASRTVRNKFMLFISN

SEQ ID NO: 931361 - protein, 158 aa, Homo sapiens
MCTWDFILEDMDLAANEISIYDKLSETVDLVRQTGHQCGMSEKAIEKFIRQLLEKNEPQRPPPQYPLLIVVYKGTLITIQNNLPRTSRNSCSKASNNFDPWWTNDCEQNESEPIPANCTGCAQKHLKVMLLEDAPRKFERLHPLVIKEETSEQITNVT

SEQ ID NO: 931362 - protein, 172 aa, Homo sapiens
MAHRLLASYSTSTNPDPVLQPHYSPHEEVFAPLEDTATRTILEAETWPSPDTIPAGTLILNFSASRTVKVQRLKGNGVTQTSVYKRPWGCYSKCCHFARLLGRTSILLLTCSTTCNGSLLLPFPTRPHFMDDFPSSGPILKESGASCSESGFGLNCLVSHSHYASPQLGDDE

SEQ ID NO: 931363 - protein, 146 aa, Homo sapiens
MGFRHLGGWGPTTPSETVHPDMAPVVPTCLDPADFHECTYVSVPCGRGDSNDAQPPPCKHASQKSVTIPSKAVEELLTWTPKAEPGRLVSTADKGWLVGAKEPTSKLTLLVASGYQFLVNVDKSFSASSSGPLYWEPTFLAADFLQ

SEQ ID NO: 931364 - protein, 500 aa, Homo sapiens
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYREVPGTIGGMGAWQRSKR

SEQ ID NO: 931365 - protein, 138 aa, Homo sapiens
MEMQPSTLLSPLLLSYLRTCPSSDRMARTLAQSWWPLRLLEQGGWKAQGNSHGLVNHPWVVVPLHSEGQQEAFNSLDQELRIKAKMALGYSSGYSLTKEINPEMHIEPRYQQDVTPDSLRDMKTFFKNHLNQVIIHIQ

SEQ ID NO: 931366 - protein, 213 aa, Homo sapiens
MGVAAVPAEAKCLSYDECALMSHWLYWSHGFTGHKGFWEVDTAIVIIIIIIIIIIIPIFKRRRMGHREISPPWKTEPIRNVFQKVPSYCKENILEVLRVGKNNSCPGDGDGNGGDSGGGCDVLVMVVVVMVMVMVVVVVMVVMVVMVAVMVVVVVVMVVVVVVIGSSDGGCDGDGGGGGDDGVVVVVVLVMIVVIVMVVMMVMTEASPTEPQF

SEQ ID NO: 931367 - protein, 135 aa, Homo sapiens
MGSYIPVLKGLALSGVHEGIDKYTGNSTSVVSNASFWKLEKGLPCGGAGSRLLDPRYPARPTPQGRAGPTRECGQRPRTVSRPGVCVLLPAPRQPGPRPRLPPGPPPSAGEGGPAGAGPRRAEGAELGNGKETEP

SEQ ID NO: 931368 - protein, 133 aa, Homo sapiens
MSPHSWRWLLPSRQLQQGGVERDSTCSSQQRGGTGAVCADLGSGRVVRLVARVGLTLGVSRGCLAPPRGRGPLRRAYSAELLEGAGTRSVTVELRRAPGPALLSSGAPMALVAQCQQPASIFCLETPPSWQHD

SEQ ID NO: 931369 - protein, 298 aa, Homo sapiens
MSFTTRSTTFSTNYQSLDSMQPPRYSAQLNQKETNQGLNGCLASYLDRVRSLETENRRLESKIQEYLEKKGPQVRDWGHYFKTMEDLRAQIFANSVNNASIILQIDNPHLAADETELAMCQSGERHLSGLTVEVDAPKSQDLAKIMADIQAQYDKLSQKNREKLNQYCSHQTEESTTVVTTQSAKIRAAEMTLMKLRRTVQSLEINLDSPSGVLLHLELELAQTRAEEQRQAQEYKALLNIQVKLEAEMATYHHLLEDGKDFNLGMPWTAAIPCKRPPSNRPPSPRRQDSGWQSGVRD

SEQ ID NO: 931370 - protein, 134 aa, Homo sapiens
MLFGALQFLASPSFWAPPCSLVPTVEAACGTSGPAAAGSQCLCWRLERPASPQLVCPAVYAVAGPCACSLTHPLPLRTWLAFGRHGIQAGVKLRPGSDDSKRSLETQRSNTCDKSRGRGLCQGRETRWWLSLVA

SEQ ID NO: 931371 - protein, 128 aa, Homo sapiens
MNKGYSVFATGIMICPMPGEKEVLRCPRVCVIHGSCIIRDRGSCRHIFKAGVGTFYYGPSLGVIRDAYGTLDIPRVTKLLKLAEELAGGKIHDGALSFPFLGSSVYNGTKAALTKAHSIKDDTGTRYP

SEQ ID NO: 931372 - protein, 139 aa, Homo sapiens
MVCVFVCVCEWRAELKSHNTGAIKAARKQGIPQRSRSLLGLSACSVKQIASFVNATCPSSWRYPELPVIITELYEQTETNDIDIEKIWRKSVNPKVGFLRRSTKLANLFIIEKEEEETQIIKINNEKVVLLLIFQKVED

SEQ ID NO: 931373 - protein, 173 aa, Homo sapiens
MIDPAICLLKGKPHTGNTRHNAWCREEAGQLREKELGILTSVLEWVAKGGSEDRESVSWKREYGDCAAQGVTLQTELLWPPHIQDTSPMGTVVVTCMCQLAQAIECPDIWSMIRLGVLDMIDLDTGGLQAADSLPYVNGGLNGTKWWILSRAREFFLPDGLQTERSASSCLQT

SEQ ID NO: 931374 - protein, 199 aa, Homo sapiens
MDICQGFQVTAFIGFHLFLKEDRFSEWFEFHDNVGRPHGQLYKSYTRRNGLKGLNFQAKVLLYKNNDETLSLNKMAKAHFSLPHSAKSRISPGNKARVPEENSERWKEGSGLIWDQELKSNAIRGSYTPHPTDEGDRRWPRPREEDKKASYRLGENIANHISDKELVSRIYTFSKLNSKERDDSTTKCTEAVNIFLKSI

SEQ ID NO: 931375 - protein, 138 aa, Homo sapiens
MWLMVGSLLRHSTELSPRNVFGDCPVKGKPKNMCGQPHYSNINKYQVAVLEEENLISLSSSPRGILITPPDFPAAYGPAHTGDLDLHISLLCWKKQPAPGLHGPERKSNTKKRAEDITEKWQSWGLQGSVPPENQLMS

SEQ ID NO: 931376 - protein, 136 aa, Homo sapiens
MSRVELAVGEQVVVSEQDVEGSVVEDSSADFTRKAHPKGQGGHSSRLIGIFSVPCSVTCRTGSLLEMQNLKPCSRLPGLESGRDWKSLEDSEDRKMRENLEVLEDWLNGSDQNHRNVDSEGQADEVSDGNEEVTGN

SEQ ID NO: 931377 - protein, 124 aa, Homo sapiens
MMLSADVLRPCSTQLFPTPGTTLAHNRCPGKSPMLRSDSPGSASRRKPFSTAHSDSRVDLWGSLGVIYLYHLKVRGPSDNDLVQHCPDFVARTWRCRLRQQVFLENCLPVCVMSLFIPDDIPVL

SEQ ID NO: 931378 - protein, 145 aa, Homo sapiens [sequence omitted]

SEQ ID NO: 931379 - protein, 134 aa, Homo sapiens
MALPGLVFSWVSVSAEHVDSTWPTLSSKGCHGLGCTRLPPQKPTNTGYLSAVPICFQAPGASAFRPSAPSLQPPPLASTLSSMALGTPCSPSLQLQAQNSYCSRWLVHAAQRSSSLFANPSIFQVTEIQPPARS

SEQ ID NO: 931380 - protein, 169 aa, Homo sapiens
MDTIRHLLLPVGSPRDPCLLPSYRGSVLGGCCIRRGGSPSPMKALSNTAWPTLFKAFLSCPEQPSLRKVAKDCVEEGGVETFSSQFPGIALRTFALIPSSCEISVSLDNWLPPIGTKKVLSVPIAQDQDLTCVLSDFTEKIGAPKLTLHCYGPRITTGKADYGQDGGSL

SEQ ID NO: 931381 - protein, 262 aa, Homo sapiens
MSKEAGIARKTEGIFTWVHRVAPAALAIISPSRQEHSSDLCPTLSALQTLPSGSHSGLLQFSGGHSRPYLPESLLNPEVSPVEAAEQDLLDEALWLPLCGGGALCWGNPTRWNCPDSSELAGENTKSTDLWRPRPPLLAGTSFQGDQISVCKLLAGVPEIPIGRPCPVSGDGPRSGLKRQSGQDLPQPLCCAVGNSSWVQTAQSPQHQRRKTADWSRSDGSRPSPRELGSLRQPPAKWPPRISTALGLGPKALVVWAHEGIS

SEQ ID NO: 931382 - protein, 148 aa, Homo sapiens
MRLHFNVIKALECSQQFLGAQFCVLQIINHVYPYHCTLMLSIYSQSSSVRSGRKDNHHSSSYGDSKSNRVPRCLKPYRKKTPSQIRGAGVPREWGKLLLPLLSLAFHHLTRDVIRSAWQSRVTIAPGSKVISTGNQKVPGSSQIGRDP

SEQ ID NO: 931383 - protein, 139 aa, Homo sapiens
MRKKVPWALAASSCWLQSIPSALLSDRGYSLDLKRGRETYEFLLDSLTSSQPLPQGGKVRTQATLTAKCAGFFLQPSVKHNGEDTNQLKGKAAQLKEVRGSRAIKQDNNREERQAKAPNPALERIIRCLGYLHYIHGSP

SEQ ID NO: 931384 - protein, 183 aa, Homo sapiens
MNWVLFDPSSHKVGHAKQHSIIKWKWHMCDWAQACPEGTNKLHEEVAQMPMFSTPATLPSLPQPAPMASWGVPYDQLTEEEKTRALFTDGSAQYAGTTQKQTAVALQPLSRTFLKDSSEGKTFQWGELRAVRLTVHFAWKEKWPDVRLYTDSWAVANGLAGWSGTWKKHDWKIGDKEIWGGGI

SEQ ID NO: 931385 - protein, 168 aa, Homo sapiens [sequence omitted]

SEQ ID NO: 931386 - protein, 138 aa, Homo sapiens
MKLTILAEGLTDSSYMTRVGAREVGGSVHQLFGDDHARPLSSSSPCGYMYCDFFLTSTYLAFTASFLPFQAALLDWIQGHCLLHGPYLIHGKHKCILGPLGMCGLTADHCMPFSGGRRKRAKRMTQKWSWSLNTPPNC

SEQ ID NO: 931387 - protein, 170 aa, Homo sapiens
MDTSTCSDGGCLRLDSPWAVLAVAAVGLSQGACSSSPPPSNDLWILFTFLVLDLLAKGMSGEGTTEQNVTFAGLELFMDGLEESLGLDVKYEQVSDSSKPDFVGYTIHQTTQFGDDGSKQHGYEDNSHHDIRGNYVFLVSMVKFIKLKEGPKKFKRDSAYNTIVIEQKLY

SEQ ID NO: 931388 - protein, 146 aa, Homo sapiens [sequence omitted]

SEQ ID NO: 931389 - protein, 201 aa, Homo sapiens
MARIKAGRRTFKDYTGLVFWPTSFSCAGCFLPLNIGLQVLQLWCLDWLPCTSACRRPIAGPQLVIVVPSHIASLAYSKGSPRFYCELSCGKAHSKELMPATNNQQGPVASLQPWVGYLIYTRSAFDGPKAGEECCSGAPENLLFVCSEYDPLSLLPLVLTFTGKPRLSNSVCSQSLKIISFCPRFLHLVGEQDIIPDSAYK

SEQ ID NO: 931390 - protein, 124 aa, Homo sapiens
MISFQGSDFISSGYISEKGIVGHIVVLILISLEISILFSIMAVPIYIFHQQHTRVPFFLHPCPHLLSLDFLIIAILTSLRWCVIVVLICIFLIFNDVKQLFITPEHWERSRDTARQIHSFIFTS

SEQ ID NO: 931391 - protein, 140 aa, Homo sapiens
MQNLFQRKWEIKEKISHLIIGILSRVIHWYCFSFSWIKFNPFPDAICYTKLIPKSLCCLQISILLSVHQGLIQNDNLGCDGEKVGIPPFSSIFLSPSPSNLGRCHPWVQKWLSSTLTGGLGVEVSTLMLVCPISLAVDNI

SEQ ID NO: 931392 - protein, 229 aa, Homo sapiens
MAVACPAWWEGSWFPGELSKRKNNFKMNLVGTRSLKEGRETAGAKGMHSSPGCGHQGPVGSNLSSSTGHQSSQKLLPRGALAWLGSSELYLTLACLYLWSLLHLSLLDTVHPQLATTTQRSVSDSQVFIAVFILVLGNQLIQIQGRFLAVTQLLAVLGKSAHSWSRGAPGPSKLPQFIYTQSPCSTIHQGLQTQMPLGTRRAVKGSRPGEDRIELGEHSPSRVPADFCL

SEQ ID NO: 931393 - protein, 190 aa, Homo sapiens
MGLGAVEQGVVLVGEARAAQETMEWVGGSGMAGCRSRALPRREAAKARTPSAATGPGAKSLIAQSRQGRPAAPSAGPAKPTPTRNSSWPASAARSPGSRSRLSLHTYLQVEGVGSSRGQPRKGLPQGSGGLKGSSNAAKVGAQAEEVPRESEGSEDCQHAVTSQYDHNHHTRKAMGPPIKEARILFSLTI

SEQ ID NO: 931394 - protein, 151 aa, Homo sapiens
MILAVGDGPHVPEEHVLFQEAQEGPKEDARAKAIKALVKPKEVKPKIPKGISCELNRLAYIYHYPPQTSSEGRGNCAPPDPSGCRLVQDGWVNSSSLLPSWLGLGLPRVLHGRLASLPCYASMESSSSLAKGSSSIRQQLSFSPCCRNPFA

SEQ ID NO: 931395 - protein, 398 aa, Homo sapiens
MWTPHLITQNIKKSMYLLQDNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGDHGNISLQKKRIPACVVSMMGNHPVPAGVTVGMGLSIKNAHGKIIILYDDDERLASQAATTMCERGFENLFMLSGGLCHKALMLKTRAKGFLVEFSESHVTTDIFWYNLLNDEIVKKDFMSLCWPQLDDQRLEDMQASFQVLAWPCHINAAFSDDFPNLGLKVLAQKFPEGLITGSLPASCQQALPPGSARKRSSPKGPPLPAENKWRFTPEDLKKIEYYLEEEQGPADHPSRLNQANSSGRESKVPGARSAQNLPGGGPASHSNPRSLSSGHLQGKPWK

SEQ ID NO: 931396 - protein, 551 aa, Homo sapiens
MFVVPSSFIIQVASLSDQTLEVTAEEIQRLEGTEKYLQERCRMLWESSKEGKTLPVRRPRSPERALGMFGVHYTLGTYNDSAASDPDAETTARTNGKGNPGEQSPSPEQFINNAGAGDSSRSTLQSVISGVGELDLDKGPVKKAEPHTKDKPYPDCPFLLLDVRDRDSYQQCHIVGDHGNISLQKKRIPACVVSMMGNHPVPAGVTVGMGLSIKNAHGKIIILYDDDERLASQAATTMCERGFENLFMLSGGLCHKALMLKTRAKGFLVEFSESHVTTDIFWYNLLNDEIVKKDFMSLCWPQLDDQRLEDMQASFQVLAWPCHINAAFSDDFPNLGLKVLAQKFPEGLITGSLPASCQQALPPGSARKRSSPKGPPLPAENKWRFTPEDLKKIEYYLEEEQGPADHPSRLNQANSSGRESKVPGARSAQNLPGGGPASHSNPRSLSSGHLQGKPWKVQMSLRFQPPADPTPAGSLSKELSAQHIAGPVLSMEASACVLTEIEDEESSCTLTECSPLLDISWSQKGMHVGVFTPGRRASHGKALATTPACAP

SEQ ID NO: 931397 - protein, 136 aa, Homo sapiens
MLCDSLPGVCILAETALEVRGKRLINFKDLELLIGKMEHLQITKSSGDADAAGQRPALLTGNPVLVHSQQLSREPLFSVGLIPPCCYSAPSMVPVTQAWSLESQCSGKVDGYLCELSGFALKCLNNYDKQSVVRWR

SEQ ID NO: 931398 - protein, 343 aa, Homo sapiens
MTPFPCGSEDRTQKMWPGQPLTLRPTWDSCALQNKDLQTRVRQLESCECHPASPQCWGLGRAWPEGARWEPDACTACVCQDGAAHCGPQAHLPHCRGCSQNGQTYGNGETFSPDACTTCRCLGAFTDNGSFELGLHGKVGFHLKEREYVRFLWAQGQGGERLPQGHGVGETWHPGPCVICTCQTGAVQCQGPSCSELNCLESCTPPGECCPICRPGDLLPCPALPRHPFNPKGCDYEGQLYEEGVTFLSSSNPCLQCTCLRSRVRCMALKCPPSPCPEPVLRPGHCCPTCQGCTEGGSHWEHGQEWTTPGDPCRICRCLGTEVLNQKASAWRGPFITLSSNKS

SEQ ID NO: 931399 - protein, 117 aa, Homo sapiens
MRRMKRPATDWEKIFAKPISDKGCVSRIYKELWKSNKSKEFNFFSKSDFTCNGLIAVIKNQSDNQRGMSPGSWSPGRTLEDIDEGFEFVQGKSLWGLNAVVWNQSSAVSMALPELLL

SEQ ID NO: 931400 - protein, 279 aa, Homo sapiens
MAFQAAIYAHLETGERRMFSRTSRFLWASRPDLRDHLWTSVDWELYVDGSSFINPQGERCAGYAVVILDAVIEAKSLPQGTSAQKAELIALIWALELSEGPTVLSGIQAYGEAPFEDLNIDFTKMPKCGSNKYLLVPVCTYSGWVEAYPTRTKKARVLLRDLIARFGLPLWIGSENGPAFVADLVQKTAKVMSVDQRLERSPLAATVERTPDCHLDHSHSCEGRGNPSLGPPQLRKTCSTGDLVGETKPRQPLQSDSEEVDKPCSSHTRKPTGPLMAEA

SEQ ID NO: 931401 - protein, 163 aa, Homo sapiens
MHVTCREHKQTLRKQAGSAGHEEGCSELGPHGTCWDTGRGGESWKMSDPQGEEETPVGEHTDFLGSMPGWKAGHLKAAFVPEPKDHGSHAARGGVIRCVFWLDGSCGCVQNERRSWTWPLSPRWQRKQVPWEKDLGYMPRKEMWAERFSVVINSSIIAVPKYC

SEQ ID NO: 931402 - protein, 136 aa, Homo sapiens
MVVTAGMQRTHFGYDGGKLPSTEGESKVLFQLKEPRTGGRFEGLRLTDAWIPGKEPLSPFSLWALAQNGKMGMTSGTPDKLKENLELLACPSLVLHVQCDTGATPDSSSECQKGIKNSRQDLLQFTGHKHNIPRDP

SEQ ID NO: 931403 - protein, 138 aa, Homo sapiens
MWVGPDKGIKAGCPSQQWQSAPVPFHAGSFVLSLFAINLAAAHSLDSFLKPARPRTHQKEETLNTSEHQKEQTLDTPSLRTVTLTTRVHDFILEVMTKQKGKNDQLQTGHDQRVNFRENKFLLVLKSKKYFSSGSFYT

SEQ ID NO: 931404 - protein, 144 aa, Homo sapiens
MSRSVSGKSPSLKLTITTNQSKLELNLFTHRTFQSSKIPGPSPCRHADYGKAQQVHNQNFQAWENILGPNPERMGTAAFQWHMKGCSQGQQVTRAPSKGGELGLCNSSSVHEQHLNLHTLLRGLFSVIYVYGDGSLYRSNFYFL

SEQ ID NO: 931405 - protein, 155 aa, Homo sapiens
MDCGSTVRSEAPGDEASTWQILDTERTKEDVPERPGGPAVGFGVLDEPADWDTLLWALQAAQGEHFQETEPHSPKAPLSPSQGEHQSRESREQSIIPPPPPPPLLLWALFMVLMSRAGELPGWADMMIKGKALHALPAPGWGLWLEPPRTRDPDV

SEQ ID NO: 931406 - protein, 137 aa, Homo sapiens
MGSGKRRVETEPPAISPAPRPCWDSHCAVFPSYLWTIPQTPSSRQGIPKEVQIKMLLVVEATYSVKIHQGYWLRLEQDGGEGNTARGRQEGPGKRSLDSTSRRVLAWGLGGGRERKLLSDFRMGIMDAESPVLHLQL

SEQ ID NO: 931407 - protein, 152 aa, Homo sapiens
MSGKTKARRAAMFFRRCSEDASGSASGNALLSEDENPDANGVTRSWKIILSTMLTLTFLLVERDCLFIHGLLGLSATSIIYCPLSQLGFGSMSLKSFNRYCHFLESYRRGINTGLLNHQWLKETDVPQKSRQLYAIIAEYGSRLYKYQVIFC

SEQ ID NO: 931408 - protein, 209 aa, Homo sapiens
MMVTIVIIVVMMVVIMVAVEVTVMVVVVVVMVIAMVVMAMVSPKKVVVEVMVMVVMVVVVVVMVIIEVVVVMVIAIVVMAMVSPKKVVVEVMVMVVMVVVVIVMVIIEVVVVMVVMKVVVVVAVMVVVVVTVIVVVVMMMDMGVVMKKDGEVVVVVAVMVAVVAVMVVAVMVMDMEVVMKKDGAGGGDEDEGFDGDGGGGGGYGGREEK

SEQ ID NO: 931409 - protein, 172 aa, Homo sapiens
MSSPTRKEQAAARSEHPEDVGRSWSADCHTCDQLAQDMAEEAAQNISDDQERCLQAACCLSFGGELSVSTDKSWGLHLCSCSPPGGGLWEVWGEAEIWGPHFENNQDCGEWGLPLKRGVGAIPGVGSGCCPPGGEWELPRDGSSTDKASSSQSTETLLNLRSVGSSLKTPIN

SEQ ID NO: 931410 - protein, 164 aa, Homo sapiens
MEASCCVLRLLCCAEDVATGLLPGTVTMETPTKVARPTQTSSQRVPLSHGLPPGIPRTPSFTASQSGSEILYPPTQHPPVAILARNSDNFMNPVLNCSLEVEARAPPNLGFRVHMASGEALCLMMDFGDSSGVEMRLHNMSEAMAVTAYHQYSKALDPFYSDNY

SEQ ID NO: 931411 - protein, 397 aa, Homo sapiens
MLKAVIYNEFHGTEVELGPYYVEIGHEAVSAFMNSSSVHEDEVLVFADSQVNQKTVSVYTNGTVFATDTDITFTAVTKETIPLEFEWYFGEDPPVRTTSRSIKKRLSIPQWYRVMVKASNRMSSVVSEPHVIRVQKKIVANRLTSPSSALVNASVAFECWINFGTDVAYLWDFGDGTVSLGSSSSSHVYSREGEFTVEVLAFNNVSASTLRQQLFIVCEPCQPPLVKNMGPGKVQVQIEGSVVYSNYCVGLEVRAQAPVSVISEGTHLFFSRTTSSPIVLRGTQSFDPDDPGATLSHSDDFSNRYHWECATAGSPAHPCFDSSTAHQLDAAAPTVSFEAQWLSDSYDQFLVMLRVSSGGRNSSETRVFLSPYPDSAFRYLTLYSAQLSSPVFVPTWC

SEQ ID NO: 931412 - protein, 228 aa, Homo sapiens
MSLCMSVTFDMSHPPSVGHQCLEGWFISHVMVKELHTGQGWFFPAQCWLSAGRHDGRVERELTCLQGGLGFRKLFYCKFTEYLEDFHVWLSVYSRPSSSRYLHTPRLTVSFSLLCVYACLTALVAAGGQEQVRAIAFPYSSFQIRLHCGPFLPKKSTKLTVLREKFKPGEASLAAWGPEKEQEGSARCGTGWPCTALTLLARWTAAVWELVPRPSSRTFPERLAAGCL

SEQ ID NO: 931413 - protein, 115 aa, Homo sapiens
MYGNAWIPRQKFSAGAGPLWRTARAVWKGPSGAVRRGPPSSRLQNGGSSDNLHCAPGKATDTQCQPMKAARKEAVPCKATGAELPKTMGTHLWHQHHLHVSPGIKGDHFGALKFD

SEQ ID NO: 931414 - protein, 147 aa, Homo sapiens
MGIDCMGTTKLKVPSTKQYSLQADPSDSTFFRLLCSGCAGSRLDGAHHIEGGSSSPSPPTQMSVSSGSTLTDTPRVHQPQQVTWTVPTQWGGEVCSTHAVRSIRATGERVWVCNLRQRRWNGTRRPAGHRCIPRSVSARSQGMCRST

SEQ ID NO: 931415 - protein, 149 aa, Homo sapiens
MEARFCFTNLMLTTARGSCYRKIPWTEWFRRGRSSFLTVLEAVKPKIVVPADLASEHAQHVPAAAFAGLTKFLVLTGRVTPPGQLHPSLFQIPVVHIMQRLLKNSPLVGVDWTFLPFSFAVVAAVTDAGSACHSGGAQGWWEEWSGQGW

SEQ ID NO: 931416 - protein, 182 aa, Homo sapiens
MLLLPMPGCFLDTLILMSLSGVDAGIQNTWLARGCLQLSCSGGDPQNQHVASCSQHLPGGQKGLRVHGQPDISRGLQTGSPCFLPELGRSFSIQPETWLFPPVCWGPADPGELLLSQSANSQIVNHRPPHTGFPCANPAIHVQRRSPHLPPPLWAHTPGRCPPTLVTPGQGPDPGQLLSPEG

SEQ ID NO: 931417 - protein, 121 aa, Homo sapiens
MGCAGVQHTEEENLQAKLFSLSPKSHSTYRSGDKNANSTIHDSSEFEPTFSRAQLTDVLSGSKDIEADRQLCQGNEREKLWLLPRQSGVPSLQSLPTCTRCTKLKGNLNVYWTLGGNDVSP

SEQ ID NO: 931418 - protein, 218 aa, Homo sapiens [sequence omitted]

SEQ ID NO: 931419 - protein, 116 aa, Homo sapiens
MITGYISPFSYCYEEIPKTGQFIKKKRFNGLTVPHVWGGLTIRVEGGGGAKARLDVVRQESVCRRTALYKTIVSHETYSLACFATMRTEDLACTQKPPRSRVVRLTPWEQTSTNGV

SEQ ID NO: 931420 - protein, 128 aa, Homo sapiens
MNGKSVSAPSLIPTRQAIYLWLNMTLDSGTEANFTSFFFFFFLKTEFRSCCPGCSAMARYWLTATPASQVQVILLPHQVAVITGTRHHGQLIFSIFSRARASSWWAPAVPATREAEAGEWLEPRRQRL

SEQ ID NO: 931421 - protein, 245 aa, Homo sapiens
MTGCRSPALPRGEAAKAQQEFERSAGGPVVLGDPAHPLLLLLARVLSPSLPSQRHQLVALSGGPTQNSRWPMSAACSPGSRPRSPSTPPRKQREPAPARPAQRGAPSVQPGADGLLKCARVDAEAEEAEEEDQRHSKALSQVHSRGHLPHSRKLPQRHRPSRPSCSFLLPPRRPCWNTGSEIRLNELQWIILLTDLAGLWVRVGLTTTDDLRFTSFAPCHLRLGRWPPRAPCQVCLDSGSHTAGN

SEQ ID NO: 931422 - protein, 238 aa, Homo sapiens
MEELVDEGLVKAIGISNFNHLQVEMILNKPGLKYKPAVNQEKLIQYCQSKGIVVTAYSPLGSPDRPWAKPEDPSLLEDPRIKAIAAKHNKTTAQVLIRFPMQRNLVVIPKSVTPERIAENFKQAKTETDTSPVEPCAGAGLGPPGPRAVHAYTYTFAQALQPHREPGYDHLTQLQQELEGLCLVEVSEPQCEEQFPGDIQMLHSKRVIPAGLSANVLSSQLFLLCTLPCFLSHVTCIS

SEQ ID NO: 931423 - protein, 202 aa, Homo sapiens
MLIHVLPQIYMYSGPEGQLLIAPPELHFRFHRAALLLVPLLAGLSIATSAAIGTTALIQGETGLISLSQQVDADLSNLQSAINILHAQVESLAEVVLQNRRGLDLLFISQGGLCTALEESCCFYANQSGVIKNTLQRVRENLDRCQKEQESNTTFLIPGVPKYQSMFNWNPWLTTLITGLAGPPSPPLVRVSLQALYIKLVS

SEQ ID NO: 931424 - protein, 143 aa, Homo sapiens
MGILPGPGLISPLETNNTYFTGQNQNLKMQTKYEGTLTKLFIFNLYTNPEPNLRMQVGAWGTRNVENGSGRWKENSTVHCTTPGVVIHILVYVGCALQREGRVKTQMHCPGLTNLELVIGGTWQSKVSSVPKEEKEEKEKIFA

SEQ ID NO: 931425 - protein, 234 aa, Homo sapiens
MCLFLFGCLQQFDYAYKEPCFVYSRVGGNRTPLKQPVDYRDNTLMFEARFESGNLQKVVKVAEYEYQLTVRPDLFTNKHTQWYYFQVTNMRAGIVYRFTIVNFTKPASLYSRGNSSDAQLLRDTFVFKVVPMLNPDGVIVGNYRCSLAGRDLNRNYTSLLKESFPSVWYTRNMVHRLMEKREVILYCDLHGHSRKENIFMYGCDGSDRSKTLYLQQRIFPLMLSKNCPDKVSTF

SEQ ID NO: 931426 - protein, 197 aa, Homo sapiens
MLIPNWKTVCQNVTTALSCSCSVAAGLAASFGIFLIPALPVYSAWVSPCWFTKAQSGRSGSHKSDRVKSCESQNGFSERDVSGGRSPGPIDYFTLKVQPMGVEVGSYEWQLSRKHIERARGSSSKGKERMAGGRRKKRLRISKRTDLPPGEKEFSLRGSSEAPVRVRPLGQEAFYQSQQPWLALGRCHQPSGGGTSN

SEQ ID NO: 931427 - protein, 145 aa, Homo sapiens
MLHLCFPTQKGLESSQKGPAQCKMEATAQGHSLAVACPHPSTLRHGNSQPAAGHAGLQPIGKKWLDVGEDYTSSNSSWPRDQHSHADQGSTTHGGAGPFSPISFSSSLFPFSQPLAQLPDPCPTCPSLSSTVTALRRRLHFPYFI

SEQ ID NO: 931428 - protein, 145 aa, Homo sapiens
MYWSPRLHPRTLVEVALEAETQLLYHRKRKAYGGKSHDLTDFLKRQCHPMSINGKVINLISVLPFSGILRGYMKKRKGKNDILTWRNAHDMFISFVENGLEKGKNENGTTNEENISVIQMVVLNVVVAVIDCTPVMFYLLTENGK

SEQ ID NO: 931429 - protein, 137 aa, Homo sapiens
MPFALLGVLMKGNGLRRDTGILGQGFQVGNEGVQFRGTYVERQHDLPEVTQQTAGDMARTSGLERVTAAGASTHDGPEQSEGFVTDLHLQTSPACSAAATGLRGCGWHFSSPPPLAFPQAEGSHRKGSYSWGTGATS

SEQ ID NO: 931430 - protein, 210 aa, Homo sapiens
MPGVSDPAGLLYRKHGNICFWGGLKKLSIMVEGKGGVRRLTWPALEEEIREGGEVRESIVECWCGGRDRGSRRAWGGIWTFDLGQWEAIESFQQKSEEHVSCRRRAMTQRLLGGAECQGWAKEEEEGNWKREPKRWGLLGEHRVTGANGIEWQMLERINTITLKYPLDLATKRYLISTFGNSFFFSMNKYFLNICSSMPDITVGLKLTSY

SEQ ID NO: 931431 - protein, 147 aa, Homo sapiens [sequence omitted]

SEQ ID NO: 931432 - protein, 285 aa, Homo sapiens
MWGKMAMGGKGISGLDDIIGASFLLIFSSLADGLGCTSIWKEFLVMEDLEDLGNKRGVGLVYESCICAQGVLSPRNPQARLQTAKQHVVQALHQVDNAGTSVSRSRQANPWAYGQFSWMPVVPADDQAGGWVHRPLGSRPAVGYSSSGGITFWLPSSPHWCCQHMKMLSSFAAGGISVTANGLCFSPGKIKYRLLQQNNSRKSSSISLNNSLDDGLIIPKVRMYSHPNKLKMLTNPSTANSNLLLHQSDQHLISSSLEFIDDKFRGGSFLKKSPKQLKTAAKKPG

SEQ ID NO: 931433 - protein, 213 aa, Homo sapiens
MEHGAVPGFKVELHWGPTSFCPGACLPPATINHIICGNKVVPAEGHLQDCTKLPSALPQAPSCACWQPQSTWAEMAEGCCDSIAPSLCTPSWVVTAPGLGLNFAPELEPLPGVRRGQAQEQEQTFLSLHEERGFLGSQEHRDAWVHSCSCAQESGDPTLSTQKGAGLLPIASSCQIHGVFIPSCNSPAAAGIFTAAAPDGPPLPSMRGALRGS

SEQ ID NO: 931434 - protein, 141 aa, Homo sapiens
MSIFPSTQFLLERLKYTVAMKQIFIPTYWDQVLLAVWSALELTVSHREQGLTLSSGDIGISPEAFSGFDFKATAKPKWIKIGNNKIRKAQQVGPQVQVLQIPVYLSISSSNNTMTVKHKEGRGKSLPLRDKPPFQMFSGTV

SEQ ID NO: 931435 - protein, 165 aa, Homo sapiens
MGVTVALWTPHRAGLSEAPAGLWASRTEGRWQCEDGVVCQTPERGFLWLRAAHSVRGQRHQELDADEGVNKGRDREGHSMEWAEVKDRSRQSGAYQKQYLLLSASSGQISKGEGKGGTQLCEERKRACHRDPFYQDEKMWASPCVSAPPRRMQGEHVHRHQRAHR

SEQ ID NO: 931436 - protein, 147 aa, Homo sapiens
MTQNDTRTHVALAEAEGRKLENRTFATLEANANQQIKPLCASFWLRSFSQFIAFGQRFREKIDAILSIKARLISWRNLNHRVLMDPVVLNLSFASQSLGGLTGKQLAGNRPPVSDSENLGLILGSKNVFLIPKCQVQAARTHFSCAE

SEQ ID NO: 931437 - protein, 152 aa, Homo sapiens
MRQCKVEWSAFCSPFPPVLALGPKETEQIHSPGYMVDPLTLNSQCSACRMCNGARELQGCPGADEGWLELRRGNGVDYVGLLNIFTNTMRISEAIECLTHTKRKKEKTERKERKRKKKEKERKKERKKEKKERKERKKERERKKDRERKKEI

SEQ ID NO: 931438 - protein, 157 aa, Homo sapiens
MNLYKHESEPQLSLSLWTDHLNLSLTCCKEELTDNFPFSVGSMQSYTLKDENMPLTWWDVNLNKGSHSYLSECIDDQEMWVQNKSIQKAVWWKLFQSIPILYNIRWLLLHLGPKRSNIALHFSLHHGSQTFWFCEPFILLKCTEDNKDLFLMWIIAN

SEQ ID NO: 931439 - protein, 158 aa, Homo sapiens
MELHHQQSWVSSLRQILRLVSCHNHLLIIIILYICMVFQISKVLSHSLAHPIFKNLYVNKRFICQILNLDILGEFPTVKLLVGQVPGQALPNVIYILDVACTNNKGVPVFVVLFDGSTLTQDIFMYNSCSSFKFYIKVTFSESFPYRPYNVNPLLSFL

SEQ ID NO: 931440 - protein, 300 aa, Homo sapiens; identical to SEQ ID NO: 772931

SEQ ID NO: 931441 - protein, 137 aa, Homo sapiens
MTSTNEWLTRITNAEKSLKDLMELKAKAQELHDECTSLSGLFDKLEERVSVVEDEMNAIKSSYPAKISFISEGEIKYFTDKQMLRFCHHQACPKRTPEGSLKHGKEQPVPTTAKTCQIVKTIKARKKLHQLTSKITS

SEQ ID NO: 931442 - protein, 164 aa, Homo sapiens
MRYHLTSVKEVVHVPELFKLDVDRNELKAQRKPWGPSALYRRRNKKPTKATWKNGRCREEEGNGSQLASQAATDCSREAGGGGSGRRRSLERTQIPGPGGRKSGENWDGAQGKLLMEERKKGLTCQGHLSHPAEVAGWGMAAAHLLITTLPPPVNVWTSKTITK

SEQ ID NO: 931443 - protein, 173 aa, Homo sapiens
MVKAEGGYTGGFAVPDSAALRQACRESLDTHQTGCAVMIPGPSRGPAVFPALPLSYTTVYITLLLKLSAVCPDTFIIWLLVVASNSWHLDDICKGLISKESHVHRDQVDMDFGGHDLTQYRGLRLVYFNNNDNNDNDNEQQQQSYSNSLFLDSVLCLQNISSCFTMNMEQSLS

SEQ ID NO: 931444 - protein, 181 aa, Homo sapiens
MLQVLKTAFSTLENSVLTNTPHDTKARTSAALGYDMSLLTTQVIEAIRLCIIRGVYGAFSNYFCKPCIPCSHVVTEVFAPLFQWTANDLTNISLNTFSQKAKTKTRKILLYKTMYLGPDLRFFFNMKPGHLWLCFILHHLPAWSPQICQNASLGLAQVFPEHASGSEHMWLVLSFALHLLW

SEQ ID NO: 931445 - protein, 140 aa, Homo sapiens
MRTHLKQTPRSRCKSLTYIALRQVQAPQPEAHLCPTVPQVPKITHGEPTLRLYTSDGFTEDRVTILELTCNSQVSLTLMGALRVNTHTAGTCWMLQNEHVHKGPGENCSDIDEIPQLLFVQEGKEMLPFSNKKESATFAF

SEQ ID NO: 931446 - protein, 175 aa, Homo sapiens
MRFGWGHRANSYHLVTFHSQLFPRSCPWTEKVNHWLEVASKIAKERKEWRRQSSFFIMLVTKLNTCFCSHFIAYNGTHITMHSSWLGSCWLEHCGATTQIAIPATLQCRNYGRIGVSDKLPGLLSGGLSGPVRADVHKKAEKHLPAPGLAPKMGTSMKYQRKNNFKPHEIFSQVG

SEQ ID NO: 931447 - protein, 143 aa, Homo sapiens
MHSSPTTGGEGVTANDSHFSSDGNSLWQHPAMNKGYPWGSKGVEMQDLLGPGAGQARCPSWQEEDYKSMAHVDVHRHDCIDKNVKQEADGAGGARNRAEKPGHGEDREKHFELQFHKPSCIYDFTLTVLTKEMRRELSSPCHR

SEQ ID NO: 931448 - protein, 149 aa, Homo sapiens
MGQLAFLGCNTATFLCNGCTVWGSTPFPRPVDSAEPGDSKGEGFKRAKMATCPFHRELCPRELQSCYWLDSPSSKAACERGYLDTQANYRDSILNLNSNGNEMYRIVYQNYFYLLNETCSNKNLPVETFMVPMSVSSCSPKICFTGSQE

SEQ ID NO: 931449 - protein, 171 aa, Homo sapiens
MGAPAAPAWVLLCIPAGQGPLPGPPLPFHIPILKFCYCGILTTVSGNFLSIIVYPYVRSWKQYKKRLIHEISTEKWDIDIKIPEHVEATLEVVNGKRLEQLGGLRRRQEDRESFKLPRDFLNCCDSDMNNAVQAEVVSDGDEELSGNSSKGQPCYALAKRLDALCPCSRDL

SEQ ID NO: 931450 - protein, 377 aa, Homo sapiens
MSKSESPKEPKQLRKLFIGGLSFETTNESLRSHFEQWGTLMDCVVMRDPNTKCSRGFGFVTYATVEEVDAAMNARPHKVDGRVVESKRAVSREDSQRPGAHLTVKKIFVGGIKEDTKEHHLRDYFEQYGKIEVIEIMTDRGSGKKRGFAFVTFDDHDSVDKIVIQKYHTVNGHICEVRKALSKQEMASTSSSQRGQSGSGNFSGGRGGGFSGNDNFGHGGNFSGRGGFGGSRGAGGYGGSGDGYNGFGNDGSNFGGGGSYNDFGNYNNQSSNFRPMKGGNFGGRSSGPYGGGGNTLQNQGGYGSSSSSRPSAAGLLEFTGGPFQTLFAWVSAVVAAEHRILVNHKCCCLIIPLEALSQRSTRLCEVSVCPYWGVPPS

SEQ ID NO: 931451 - protein, 141 aa, Homo sapiens
MSKHNYDILSMFTLEQSAGIKMDEICLFTSKGIQFLIGKVVEKKVNEWNLLTTAGRICTKLNSLFQAERLDHSLPGEKVYVYMQIQRYKSISQEMYFKVFNGQLLWHELYPLMMCTSYDRSLCSEYHLSVIMYILRKVYFI

SEQ ID NO: 931452 - protein, 173 aa, Homo sapiens
MEYNNTKCSLVNSVFRESDGTTGTTIPLKRGQSSSKPKITSSHCASGKAKATQHQLVKVARKGDVPCKATEVEMPKTMGTQLLCQCDLDECVLKRADGFISGFPLCSHCLSCQPVKRCLPPLFFLNFKIIMSMVTVRSPAAGFQGSMVRAGQSLPAQLTPSPGVTGGQECIPV

SEQ ID NO: 931453 - protein, 160 aa, Homo sapiens
MWVGSHGLGQLCPCDFEWYSSAPGYFHGLALSACSFSRNMVQAVGGSTILGSRGQQPSSQSSTKAGKQGTKSLGCTEQEGPGPRPGNCFSLLGLWAYEWRGCCEVLCHALDTFFPLSWRLAFGSLLLMQISIASLNFSLENHFLFTTALSGCNFFNFYAL

SEQ ID NO: 931454 - protein, 139 aa, Homo sapiens
MGGHGKAWKKHQKFSLQATDSTWNLQPGPHAIGHFSPEGAGSRGTQVMEAGNLRDTGGFPGPQGCRGAQLCGETRGSGPEDLEVGEAPTGSAEHAAPLYRPHISRHLLRTWMKLEIIILSKLSQEQKTKHRIFSLIGGN

SEQ ID NO: 931455 - protein, 236 aa, Homo sapiens
MLSTWVMGSITLLMLTFLRFCENLYPENGRLALVTVRPGWRREVLPMRQGQSDLSGPPLSWPLPGPQPGYSFLQRSLGGPTGVFLKDPHYSSFTGRPCLTIGELLQIGLCRHAPAHQHSSPTAASPTLLCWYALAHSHLPCPLLCQHSHGQTSPPLLFQHRYSTVCVTAASQAHPAAPRLLMAGSMMADLEPVSVEARMKPGLTGADLVLGWDMSLSQQELGMCWDGPDPESIGLS

SEQ ID NO: 931456 - protein, 211 aa, Homo sapiens
MKRNSEHHKEHKSFLDWRSRRKKWFCRQGPWSPYCVQSRDLVPGVLAAPAMTKMGEGTAQDVALDDASPKSWQLPHGVKPMGAQKSRIEVWEPLPRFQKMYGNVWIPRQKFASWEEPSWRISARAMQKENVKWEPLHRVPTVALPSEAVRRGPPSSRLQNGRSTGNLHYAPGKAADNQHQPMKGARREGYTLQSPRGDATQGHGSPLLASV

SEQ ID NO: 931457 - protein, 208 aa, Homo sapiens
MEPGLYGGRCHHTPVLRASSTLLGKHHVSGWIVVKPSGTFSDGNTVWPKRSQPIRGLLQEQMTCLPGTSLFTMNAAISRDLMNGFNQNADNDMDNEIQAEVVSDGDEELVGNWSKGGFCYVLSKRLPVFCPRPRDMWNFELERDDLGYLAEEISEQYIIQDVTWVVLKAFNFIREAQYKSSENLQPGGLLTQCRPLPLRQLSLLAGQP

SEQ ID NO: 931458 - protein, 287 aa, Homo sapiens
MRQPEERINQCAPSMQWNIIQPMNRNEVLKLSTVQGAPKPLPSCREQEEEGYPNNPTGSVLLQPQTVLLEHGPEDGQAVVDGGAVPPAAAELVLALLDANLDALGHAGHDLHVVPAEAELLGDQARDAGTQDGLRAQGGILWPNSQRPAEGKIRWPPLKPAPLQSVLAQSAPLFTSLFIHYTQSRQLDDHPGSLGYGLHCHCPGPSGGDQGQLSVTWTVELAAYKTGTGLGDAAISKAHPFSEARCWIHFGGCHSAHPQNTMTSMEPGPPQLAGSGLGGAALSLVSR

SEQ ID NO: 931459 - protein, 151 aa, Homo sapiens
MRAPVDITDVGMSWQGFAEAVPLLGKVVGDMSGASSLALGCPAAQVGFYIVGMTSLMGIVVTTTPAETCMTQLIPETTGDAVSPSLEHKPEPRLRGQEQDSQGCCSHMGLGLGSLTVTLLLSTPITQDHGSWTPSSLEMLSFTLVHPQLHL

SEQ ID NO: 931460 - protein, 140 aa, Homo sapiens
MSLASGGGCLCPAGCPSSAQTPRQLRQPLYMLSCVGIVRVCGCGGFSTSQGRGLHEDGCLQERLDVMSIHRQLTFGFSLYVDLHKPLLCLGPLRPAGSPGINVGAGLCPAIPERSDYLLSPLHGHPGKRPEVPLGKAGRK

SEQ ID NO: 931461 - protein, 558 aa, Homo sapiens
MENHRAVGDSGLNFPWPWGAAVQSCPWLPAALSLQRSPQQRPQILLALLRFLFASYGSKVFLKEEAALTSSAASTPRDARSPRRRHVDTSSLYALRVALPHLPWPCALGAGLTSAAAILVRTSGHSPGGSGPTAACEGPMALHTERRSSRLWDLALHNQDFREEWGGGTTGILTSQGSTSLAAMVGSTQTFMKLGVVSAQRQVTVQEGPLYRTEGSHITIWCNVSGYQGPPEQNFQWSIYLPSSPEREVQIISTIDSSFPYAIYTQRVHGGKIFIERVQGNPTLLHITDLQARDAGEYECHTPSTDKQYFGSYSAKMNLVAQPGAVAWLWQKVGEKPVEVISLSRDFMLHSGSEYAWRQSLGEVRLDKLGRTTFRLTIFHLQPSDQGEFYCEAAEWIQNPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLNVAKESDSVFVLKIYHLRQEDSGKYNCRVTEREKTVTGEFTDKESKRPKNIPIIVLPLISRYSY

SEQ ID NO: 931462 - protein, 135 aa, Homo sapiens
MQSLADSVHSDSPKDDVCLIESGMTQLQSLTVTVPRRKLSKPKLKLKIINQNSVAVLQTPPDIQSEHSRDGDMDDSREGELMDCDGKSESSPEREAVNDETKGVEGTDGVKKRKRKPYRPGIVPEVDISISSTLC

SEQ ID NO: 931463 - protein, 254 aa, Homo sapiens
MSVPIHTLYLAALFRDCKRTNQRPVKTDHLALPISRTWVGPDKRIKAGCLSQQWQAAGVPFHTVKAVTLTAKVCSFTPEASETTSPPGGTNNSRRAALRAVNTHPEEGTNSRRATLRAVTLTARVRGFILKVSETKNPPLPDTLAPRASKMAEGPLQDGGNPCVGFLASRIPRNGILGHAPNLEQQWVPCWIRSTADTLPDPEVWKSAGDLRQPQTAVVDKCAVKSSVQVQRWFLNEELGHEVLAHAYVLNGIV

SEQ ID NO: 931464 - protein, 144 aa, Homo sapiens
MNLSVVSIIKSTAKFFHDLLSPFIKEGDTNFQFVHENKDVIFPLSFTIMDSLNSNHGPLWGGQNSSYCVNSLGTSGCPRDHGIELQTPWIQTLSEVAAPCGSVGKEFEKGQTKEGVIQERGCAQSKALCKVHDKGNHLACLQHP

SEQ ID NO: 931465 - protein, 145 aa, Homo sapiens
MPEPSPASVGSCAAPASPMSATSCSPAHSPIDHPRAEECKRMARDWLAAPPASLVGDPLGEASWAPESASLLSQRDYEPTRRKKLRTHPNIRRNKLQTRHLKSCNTHCEGKMHASFSSFTSKGKFGRFRSSLSIYQFLNHAESGS

SEQ ID NO: 931466 - protein, 151 aa, Homo sapiens
MAHVYIWPPAPVRAEELPRGSGSKGSFDGAMLGRKGLASHGTSCIGACSLEALAGSCGHIGRMVVMGLTYEKQSCFYCKLLEDKNELDTDCQERLSNIQGLCMPLADTCLVFVKILACGKQVCSTILAILYPSRKLLVYLEANGLREKVRL

SEQ ID NO: 931467 - protein, 134 aa, Homo sapiens
MEKPQGWILGNLPRPWDSTPCTSVHWTWDMESTPCMESIPRPCYSSLYTSVPWTWDMEMLSYLLCGVVKPGMWGSVSSVTLWVDGKNTDLAAVAVDTGCGSRIRCWKLLITSFRYFLSIGRLPFPGAGCDQLLP

SEQ ID NO: 931468 - protein, 174 aa, Homo sapiens
MGVGPGKCWIEKGSVPVKGSTLRPVPVDLTEHGEEQTVRPAMVKRCDREREKGRTSGYQGDFSCGKSEKSLAAEHLYAHKLENPQEMDKFLEIYNLPRLNREEMEVLNRQIMSSEIESGIKNLPTRKSPGPNGFTAKFYQTYKQRADTNPIEIIPKNLRRRDSSLTYSMRPASF

SEQ ID NO: 931469 - protein, 164 aa, Homo sapiens
MPGNPYLTFYFIFRFHICNLGSKIQQGTVVTRATGEITPHSGDSGHWSGRIQHWLKLCDAKCDDRKDPGMAGYSSDLNSRGLCFPECKAPHHSGARGYLVQLFWTRLWISERSDAIWAQAPVSQLLPWAEALIQRGKEVGKQGAGHNVGSSPGVMQLYELQAAP

SEQ ID NO: 931470 - protein, 191 aa, Homo sapiens
MHRNRVRNEKAGPSGGIPEKGIVITGDDSSICVINPEDFSARQDVEVEDSDIDDPGPVAVWYVDADWDTKHVLTHSADNHLWACETGKQLALLKTNSTVWICSFDFGGNIITFSMEKQKSYQCFVSFFDLQDLSQIDSNECYLKIPCSDSKITSAIWGSCGECIIAGHESGKLNQYSAKPGEVLVNIKEHS

SEQ ID NO: 931471 - protein, 168 aa, Homo sapiens
MIACGPWSLAPSLSGPLEKELANSFSSEKEGTTDPSRTLDASPESYDEQEKPIPKGSLLYDSVDMTFWKCQVYGNGEGVPGGWGYRASGEGGGDEDAGYLPHLPSLTRYHHALSTECDTTGCSRTVLISWSPRGTACLPVTMDPYSKSAGPSRALTSLIMTLHGSMSP

SEQ ID NO: 931472 - protein, 144 aa, Homo sapiens
MCLLRPTVLLGLLYESEVWQLPKRLSPTFLCRQEDNQLDGIHIVCHHHQLSLLVLHQGGDGVNSCLKDKWSPSGDVPFAGSFLLSPDQQPLLLLLLCLWSVVVGQLKQLSSCLEVQGLGELVNRTQEALSSRLRRMALCHCNLI

SEQ ID NO: 931473 - protein, 157 aa, Homo sapiens
MFIHWPLSFSHLFIVWASAEEKCVIFTGLAGVCGTSCQSVKKTQNSHLEFGDSQIIVTLENLRQRCSYYRINECRETPSPVPQDPIASPPVFGHACEQHLQGRLLTAANFTISKQKGKGKQYQMRKESICEHEVNTDNWKRATFCVLKLKRTKFAQK

SEQ ID NO: 931474 - protein, 208 aa, Homo sapiens
MPLTATCHAHYFFQYARYKDVVLGTKESAEQWGATLKRGADETQPILFRADDEKGWLFKRLVILEVISTCPLKEHVLTHRKEAKNLEKRLDEWLTRINSVEKTLNDLMELKATAQELCDTGTSFNSLFDQMEERISVIEEQINEIKWEDKIREKRVKRNEQSLQEIWDYAKRPNLHLLGVPESDGENGTKLENTLQDIIQENFPKPAR

SEQ ID NO: 931475 - protein, 134 aa, Homo sapiens
MGKTQSKPTPLGTMLKNFKKGFSGVYGIAMTPGKFKALCEIDWRALEGKRKETGEQQHKRLAEARKDQQREKGERERREREREEREREKKRGKERKQERQEETKRKSKRKRQRERGRDRDRRKSKRERERYTSS

SEQ ID NO: 931476 - protein, 147 aa, Homo sapiens
MPVALGIPNRITVVLRLWAQNANSQALPQTYYINNSGNLPQMYKIDHLLFATLSDVYRLGYAAPSQITELSVTFFLAVHNMVVCFFKPAGESCLPNLLRMSSIMQHNHRNDFHYLCCILLIRRKPQVPPALKWRELIKDTDIRRQEI

SEQ ID NO: 931477 - protein, 153 aa, Homo sapiens
MGQTSTHSDRPFAGPVPLLALTASPVHLTTTGCSQKVFLMCTIALVTIVPPATVNVPLLWIALLNTSVHSDSGQVPRSHSDLQECGGPPDNGASVPNAPDSLEKQLFLFLLTAFFSADADMGLKINECVWKGLDPTENRRLKPRSFISISKHL

SEQ ID NO: 931478 - protein, 146 aa, Homo sapiens
MVFPTLPGNVAPKQQRFLRACEDTEELRKSCTCKGLVPEHEGSCQSHGPMNDQRFEGNPASLPGQNVEWPQVLADTSGNPQRAYVYQLHNGSDLLLPLHPQPKVCFSTAVGGGFYFLPHHLVSQATPFPTSPHNIIDTGNVHSRFY

SEQ ID NO: 931479 - protein, 124 aa, Homo sapiens
MGVWGDLPGGEDHVFPLEASGDRALIVLAPGQSDHRGLLSCTIEPVLQPETGLATGGHCPGQESNCIPRGMKASGQLQDSNQLFSHAAENKAKKVNCHVRNCRKRSKISPKPIHQDSSVLRLLS

SEQ ID NO: 931480 - protein, 165 aa, Homo sapiens
MVETSAAVILPGLKTSPSPISLGKLLALINVLPDGHGPGLFGIYIHALAESLEGTVISFVDDKSLERIANSLADRIKTKKTDRLEQWDKSNKMDFISNRKKILHLVEFGKKIEVKSVCLRRRSVYSFYCSTLERQKTKYHKKALQLNKFWNSLWFIPYLGVLDSR

SEQ ID NO: 931481 - protein, 138 aa, Homo sapiens
MPPLAYTSVVFEGPTSDDPKQVELVVGVGCLCSDVEWSFWMGSTIWQNHWVGSAMRVLQLAEHRSTTKICMLVTTISASFLCFYVTQGGLTMPLSPVFPVRHSYGLWVYCKEPNRQDHFPHGIYITMEEAHDKQTCEI

SEQ ID NO: 931482 - protein, 165 aa, Homo sapiens
MHKYILHLQVYSSHKNSNTVKIFKSPFAISYRLVSCLVKIPCLICILWKEPVDVQMCPEFLPSSGLVVLLTSGVKPQTFTVSVTALKGALQTLPISANYSVPKPLPHFQEEVPPGSKLILKEKRVWQREVASLPSLWCYPGFQCSTEFLPFRWCSLLLQSLLVEI

SEQ ID NO: 931483 - protein, 169 aa, Homo sapiens
MQEAAFPFVPEQIATDRCSYAFWFTLIKNWKHPTSLHRGVTKGPQRAFSARTSHSCCKELDRALAPDTENPPGILLKEKESCRIRNKAIESEKKAVESESYRIILHCMMYLCKTATNKTHLEKLSIAASIRAQREPEERNCMYRLGVLRIRTHIVQYLKYYLKRETDLS

SEQ ID NO: 931484 - protein, 142 aa, Homo sapiens
MLPSAVSSIIVLSHQHRAPMANSWGKTPVLCTKVQLVCQFTPVEGGQALSMPLPPVLGIGLNQTRYSALAFHGYHHQVRGNLLQQPQEANTGLFKRYCTQESPREQDATGILIQWVWGGALDAAAFPMLLGDAGVGGPWTTL

SEQ ID NO: 931485 - protein, 189 aa, Homo sapiens
MRQSLQHPNSRSTKTEQSVETRSHRPHVPTYVDGLPQGFRDSPHLFGQALAQDLGHFSSPGTLVLQYVDDLLLATSSEASCQQATLALLNFLANQGYKRLDRRPSFAYSSEIARPLYTLIKKTQRANTHLVEWEPEAETAFKTLKQALVQAPALSLPTGQNFSLYVTERAGIALGVLSQTRGTTPQPVT

SEQ ID NO: 931486 - protein, 344 aa, Homo sapiens
MMKPCLGKPAAGCLPNALPAEGAVLQERGKMIANMSRRQLSLWRLKMMHMQIQRPADTEIDANTDVDADTDTDADIDTEIDTDTDSDADTEIDTDTEIDANTDADTDTDTDANIDTELDTDTDSDADTDIDADTEIDTDTEIDANTDAGTDTDANIDTEMDTDADTDTEIDADTEIDTDTEIDANTDAGTDTDANIDTEIDANTDAGTDTDANIDTEIDTDTDADTDTEIDANTDADTETDTDADIDTDTKMDTDIDADADTEIDANTDADTDTDADRDTEIDTDTDADTDTEIDTYADADTITETEIYIDADADTDRYSRDAATDRCRYSYRHRYRHRDYKYR

SEQ ID NO: 931487 - protein, 152 aa, Homo sapiens
MAPDGSCSISYRVWQPGPLGMKAPDSHLGAQLPGTPDFPAFQNSRPHMQQNDIPLCVAAFFAHGSLDGHLGCFPALAAEDAAALSTGKALKPRKRKNGVCSGKRGQIARWSRVSTTVLGSWLSHRHSESRALCCLSEGFMVVGVKGQGVTRM

SEQ ID NO: 931488 - protein, 169 aa, Homo sapiens
MLSEVINFGDLEGCGHLGTITSGDYYPVPEKVQVCAVVRTECVCSTRAPVPIDTKAGASEMERNSHGHLAGSVVSRFSYVISGKLASGLHGIGVLPAWPGFIEDQFLALWTKPYSSLKVVTNLSLNSILFGLHELAVKLSWFLQFCLLRPTANVLLPLWFSDSPQGCSG

SEQ ID NO: 931489 - protein, 166 aa, Homo sapiens
MRSRRLAPWGLVNAWLLSDRLGCTATLPGLSTQPEELLCPVLLRPCAIHLVTHPPRKATQGQTRSRADPQGLGPTSGASPCQVGLKSVHSCSLSLDHLLHRLQLLGGPKLMQRNSSKAQPAQTIRPKAQSMADTFRSMKHGRTFPSPAPTAACSLNRDQSPRPTAM

SEQ ID NO: 931490 - protein, 165 aa, Homo sapiens
MKSLKRRQLCFQKLLSKTFKKITPITPPAVPCDGPASPLTRMLVLVSVLGFGGRCLWVSGCESQSRLGHGGTLSVIPLVQAGVQGLTEPPGRTLGESTVAVEALLGMREERTCKVPAVFIPESGFHRLTASRWLSLPRAGSRPSRQVREGHTAILHALHLCVMHM

SEQ ID NO: 931491 - protein, 167 aa, Homo sapiens [sequence omitted]

SEQ ID NO: 931492 - protein, 170 aa, Homo sapiens
MCSVPGHLAPENSPHTYTRTLLREFTPRIHSHAPAGIHPTHTLARSCGNSPHAYTRTLLREFTPRIHSHAPAGIHPTHTLTRSCGNSPHAYTRTLLREFTPRIHSHAPAGIHPTHTLARSCGNSPHAYTRTLLREFTPRIHSHALAGIHPTHTLAQWAALPSDVASCGLM

SEQ ID NO: 931493 - protein, 191 aa, Homo sapiens
MAFNHMISKHWAVTSTVSRGTRGPEAMTTLSWAQRFPHARQTPAENATGAMVKESVVREQCGDVFLKPERPGPSSVHITGPLITNQESFVIERTLHLGILHGKGPTRRRMMGEAPSQPPCRSRLCGATDSNKCCTSDNVLVQNPGKASEAHGVCCLFRQITNFQDIPLHRNLGNGPVPQQPPSQRTKETQS

SEQ ID NO: 931494 - protein, 141 aa, Homo sapiens
MIPECVEGDHQDGHQGPSSAHTQYQFMEVSKPRKCFHAEYLIPSTSSTGEELKPGPLEGVAGCGLQVWFIDSLSSSFHRVKPINQDQGQTNQHRDNKPLKAQEGLFQLQGLLSPELIFLLSRAFPTPVLFISTVLARTPWF

SEQ ID NO: 931495 - protein, 122 aa, Homo sapiens
MGQLTKERGLIELTVLCGWGGLTIMVEGKEEQATSYMDGSRQRERACAGELFFIKPSHLMGLIHYQENSTGKTCPHDSITSHRVPPTTQSLAGKPPGFTEICEQENLPDLLKYVSRKTYRIY

SEQ ID NO: 931496 - protein, 145 aa, Homo sapiens
MPALLQGLGLLTICLLGVDDSWRLAWAESIKMVIVMAIDICDFCDDRQDNIQEQGSFPCFGHKSRWWKRRWLSHGYVLKKLPGLCPRPWNYELSLPDSLVFNREIIFQGAKFLTMVTSYLDPSYPIERSGLNDPAVPRVLDPPQT

SEQ ID NO: 931497 - protein, 140 aa, Homo sapiens
MLIATTQPEATEAKRQHSGIFVTSGPFGGDSKKAMPSAAENYMPVDKQFLVFYWVPVETEHLAIRHRLTSQRQLQCFSVNVNNDFAKNLSRYPCTSRFYVAIISDAALWAHVPSIAEAGDTASGDFVCYDVNLYVFFTRL

SEQ ID NO: 931498 - protein, 134 aa, Homo sapiens
MRRNRKHEGTNCSQQCLHSLHQDTLQPAADSLLCTKTPSSPRPAPCSAPRHPQACSQLLALEKKHHLMRLTPATGLICSTLCHAATFNNTDKTWFGGLDPIKHSINVMSTSTELFTHLVVDGVITFFCLSKGKT

SEQ ID NO: 931499 - protein, 138 aa, Homo sapiens
MCLPENTRPTSYGFSLLPPFFHGRAVETQSPPWSWPRLPDTPQTSPKPVGLTERGPKPVIRTQQDPCLSGGLGRQGRGLTVGAQDDVPGDISHVAPSTSPCRGAPSFPGLLSTSGLPWPPLGRMQKVLLKSTKYHFHK

SEQ ID NO: 931500 - protein, 117 aa, Homo sapiens
MDAGTLDAKQRKRNFALTTPTVSQCRPEHTHALVLMPWSSLHLHGSVTELLWTRLLCLLQGPCRQMLPAAREGSYCMKKGLFLGSLVQSQLTKCLGSLPCADAGDITDLVYDIAWGT

SEQ ID NO: 931501 - protein, 139 aa, Homo sapiens
MGERPPTAVPSAFSHPLVPQYVPPTATRHPGTITMDSLHPVCLSPGPLLPPDRCGLGTFYALSMDRGTKDAKLSLKPNTCLGSAPQGRLLGALDVSIPHAEAAGPHMQVSLKWASFCSRGRRTQQRGQEMDSSLSSQGC

SEQ ID NO: 931502 - protein, 166 aa, Homo sapiens
MRIRIEFLGASQSLRERVPLPGYLTLGTRGKMATNTVTQLEDISAPVTKIINTLTNNSVRLGSNDPSGRHKYKVKNGRLDFQNAISPSTPQQIKTLSVSIMKNHSIQKRKAIKITTEEKKKVTPDVKNRFYKTVTRRGRKAREEVSGRCAAEGDDSAQKVIVVMAA

SEQ ID NO: 931503 - protein, 149 aa, Homo sapiens
MSEGGMGAKVSTPTHDIYLIHECPLISMRVHPIYQDGGAAALRRGGSQATQGSLDCHGPPQRVKDVVAFKELFPPLCKPWIRHGAKLAALELLPGTPSTPPPSMGERGLQSPRGILGPPAPRAFCEADPKPTLLLDAYSYKPVLSSLFY

SEQ ID NO: 931504 - protein, 302 aa, Homo sapiens
MHLVAQQALTAFRPWVDSFRRLLVCGSLMGHREAAGAVLGLWLVLAQGTHRSHQVTPRLASQSSPADSPLSNLRQMHQSPEKDFCASISSEPPITGKQALIKSFRREVLHGAREELNLEEQLKSCWPWRSSWGGAGPGGAAGEELALEKQLGRSWPWRSNWGEAGPWRSSWGGAVPGGAAGEELPWRSSWGGAVPGGAAGEELSLEEQLGRSCPWRSSWGGAVPGGAAGEELSLEEQLGRSCPGGAAGEKLVPGGAAGEKMSLEEQLGRRCPWRSSWGRAGPGGAAGEKPPLEELTSEEGMG

SEQ ID NO: 931505 - protein, 165 aa, Homo sapiens
MRGVTASAQLWMSPARYLQRGTRSSPPPPPSAGENGEPWDEKSMTQVRRGVLPSGCSELSKPYLLQPSQHTWSSATLQTASESFRKVNSPLVKWLFIVEPGFALGQSDCRAAPLNPRGGTLSREDLGVQPPFQGCRENVEYSSLVTRSLTTWWNYQPGTHETVKP

SEQ ID NO: 931506 - protein, 116 aa, Homo sapiens
MELENWVLLVFTSSRAASAGMKMGNWLSPTNQADCRSSLCLQLCNFTLASEWLLSTACQTDGWLPPHLHELAHGKNTIASAIPNSWFRSKRSSANMGRFDLPEKKGSKIFVKCPVL

SEQ ID NO: 931507 - protein, 261 aa, Homo sapiens
MTSYLTTRTYYFPVMKMGTFSGQLGVLLLAMEDEVVKQTTVTLPLSTERDGCDCGPRTYEGSNGAGKSPDALCSGSQRASEDQGGKARPRVSPPGASVLKHCPLSCHNEDIALEGNAAWSICLRGLANANDGDDHCCDYWRSANCHCHRHHHHHHHHHHHHHCHLLIIIITIITIIIIITIITTIIIIITIIIATSSSSLSPSSPPSSSLSPSSPPSSSLSPSSPPSSSLSPSSPPSSLSPSSLPPPHHHCVVLLLIIITV

SEQ ID NO: 931508 - protein, 145 aa, Homo sapiens
MNMPRGQSEILSEKQTKSQTELGTFQIRFPPIWCSLSAPSSSKSTESKTYNVVIIDLGGGYTRVWDEALANSLPCRELSCDGEACEDNSQRRESFLDLCYENLMKFWSDMQLEEEECMSDIGQPVARTGLTFDSLTNHKCKDDSF

SEQ ID NO: 931509 - protein, 147 aa, Homo sapiens
MVQPTAPRLQTCAAYYCTEYCRQLQDNETIWRGNTWLQYTDTRTHDRIHILHVGQKKSPPSLCEEKLEMNDKEEKEESDMGAQESSTLDKDGVTTALRRGGDQATCTDLNFKLARASSTLLNRSDESGYPCFIPGLTGKTFNFYLLI

SEQ ID NO: 931510 - protein, 227 aa, Homo sapiens
MGSIFVNLFESIFGKKEMHILIVVLSAAGKTTILYKLKLSDIMTTIPTIGFNVETMEYRNISLTMWNMGSQENIWPLWHHYFQNTQGLIFVVDSNDRKCGKEAWEELFRMLAEDELWVQSSWCLPTSRASPMPGMQPRSQTSWGCITCATGTGAFRPPMPLVETGSVKDWTGCPINSGTRSECNTLSLSLLLFPFTLSSCGKCAALWCECQNLLPWFFVVKPLVCAT

SEQ ID NO: 931511 - protein, 171 aa, Homo sapiens
MSGKCAKDLQSGEWGETGQPPRTGKARHPWFEGLRLPGQARQDTAGAEVTGKDPIGFFKVCFVLPSPPPTAAPFPNLRSQTMTRLMPSDKSKVSVVKIGNLRQTIAIETGYKAVNAWLKWIKYSVHTLNKGNCYACVHSRPEAQIVPFPLGWSSSRPGVGCMVALFQDSAA

SEQ ID NO: 931512 - protein, 153 aa, Homo sapiens
MNSSVLESTYMCLLLQASSSELLLQHPISLGRCGNASWVGYSSSGFRECAVVYSSCSSIIEVSTGDNSRSPRQPRLQISEVMAAAAKAVGILGGKDFWDLPVSSFSSRERSPNRGDPSWCQVWYGLQAVAAALGSGEVDVAVSKDCTTAIYPG

SEQ ID NO: 931513 - protein, 243 aa, Homo sapiens
MCMNSTHQPSRFYLALAPCPVKCQVQTEIHLKNRKHGPVNNLQLTREIHLHWRTEEQLQVRTVSRKVLQLPWLPPTLSPASSPKPSSPLAVPQTCQATPTSGASPGYSCVLEKPSARPSQYSLPLFHPFSASIPLRREASPVTVSKTLSKLACNVSRVAIQYRGIAGAYLAWMVQDNHLSSEARCFHWWVIFAVTSDVATTNILDRHILDIEAHIVPRKSFTQSFMVHFDRFYFRSSTSHKSY

SEQ ID NO: 931514 - protein, 251 aa, Homo sapiens
MLKRPVLLHLQQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRMEIYVSLGIVGLAILALLAVTSIPSVSDSLTWREFHYIQETSPVGLGHTLMTSGELDHLQRPYLPVRSQSQG

SEQ ID NO: 931515 - protein, 142 aa, Homo sapiens
MGHLYIFECKYIASGMGTSQSQAGFWQRNGTLLSCWILSAITTITAPDCNSWCDLAYRGTRESVEPLAWSDAGTITMGPSPNFTIIYGAKIYHLKTESSLPELPGWCELQFLLLAKHLKKISVFLLHYNLMVLPSYMQSIVV

SEQ ID NO: 931516 - protein, 149 aa, Homo sapiens
MGELRMLFLGKGTQQQQGKKTWGSFSGQEIPEQNLKRWVENCQVSYPSQGRRYRHGKPASCPLPVPGGALCQNPGMLIWALQIFGMRSSRKLNPFDAIISASLAFCSHGDSRGLEVQNQGTSRFGVWRGSTSHRQPSSHSNLTWQKGFE

SEQ ID NO: 931517 - protein, 145 aa, Homo sapiens
MSESRGPQPGTSPWRVRNRPHSRRMVKMTNSDNTECRRGRIWRRTLGSRRLDHSYILVGMKEEGMWEEGGCGYRGQQGELHVLLAVVHGQTYTGGAHDRQVKLEKSDSSDVDAADLATLCKPLSCTRAMILEYACPLESAGSLKD

SEQ ID NO: 931518 - protein, 141 aa, Homo sapiens
MFPDRPLMLGVDSALCGKSPGTLTIPAQCLLNQDTQKLRVTLPSETFKSQYTIYNTPFSPTSVIEEVSVEMVPCHPGSLMATMSDVSLLTRARQLSDSSSEVDLECGGTGQKTSYRSNCEVGPAGIRCDRDSSGNGERVRA

SEQ ID NO: 931519 - protein, 172 aa, Homo sapiens
MKETLEPDSSIGNEYGENENIMHQIGRTEDGVTISGHKHRVCLSVFSGQLVTAEYPREEVAFLQMDSKASTANKKFLQNDEIRSLQPYLHLCPTGAGSRPKFGNWKKFHTGTVYKDIIKVKDTTRLVTLELLPPLGFNQQGEEGVYCQRELCGKGSLMGAMTKALCQGGARN

SEQ ID NO: 931520 - protein, 173 aa, Homo sapiens
MGGWRFSAAFLIGGCLATASESLAQHLLRFYYACIMVLAIALKFAIYLFLLIYIHFHMTPYLLDALQFSSCKMNIMYQTVETGKHISQSLLKEISSCGSFSHKPDIILQPCWKPSDHVKLIHYYEKNMRKSNPLDSITFHPVPPPMTYGNYYNSSSTWVHFRDADSETPLQTY

SEQ ID NO: 931521 - protein, 127 aa, Homo sapiens
MPFSSNSDSKYLLTSKANPTKTKLDNWDLIKLKSFCTAQETINSVNRQLTEWETIFANYASDKGLIFRFYVELKQINKKKPPDNPIKKGAKDINRNFLKEDIQSHQDKEYWRFVLVQEMSPNLTVIK

SEQ ID NO: 931522 - protein, 116 aa, Homo sapiens
MPCHTETGDCGGVAVWSETEVTQEWKTKHRMFSLIRPGCGERNLSFLVAVEMAAKFTSETVMPLCKELVLRTMQGWGNLCIVDLRFTEFAACQGCVLAASQVIEMPSRDTTISFLT

SEQ ID NO: 931523 - protein, 155 aa, Homo sapiens
MLQLVTALDQEIPRPGPPEGLPLFHCSPANESVSPPASWRASQELVTALFTLVIQQAVGSCPVTKNKVMWTTREEEINKSYQFSFSGELIDTGEEVAPVVNNFALKELSEIFPKIESTKNRTLEADSILLSSMTVHQNVHSVVHIVVQTGEGKHC

SEQ ID NO: 931524 - protein, 299 aa, Homo sapiens
MFMWRNVEPRSVAVFPWYSVPFLTPPCSHTRPGNLPVTQWPPTRANNLPSWQLLLMSVHQAQSLSALRKEQDSSSKKDGHSPNKWDKDHIRWPMSGGHELQQAAPGSGRAHQGHPNQDNWTVSQILSKRWYTLGPNETQKYHDLAFQVKHMASEDTASDEEPMVIHEEEGVTMSLLMMALAPLTLISSSRSGSLQSPGVWSGQQSRPPVAPTPGDGGPGMPSKATCFLPMDPATFWCKRPESVGDLELPGPSVITVGEAEDGLRELETEKAVSSSLHVPWTSAGPDHAALPGPLLLPVH

SEQ ID NO: 931525 - protein, 172 aa, Homo sapiens
MHVSTVLLMGTWAGGSAPAMKRTTVTQYSTCALLTALCLLLPVLQETAQSRRMVTSHPEDRPALARKHGASQPAGLGFPRTQTVTPAFTFQTPTAAEPALLSAWLGRAPETETITDMAETVDGAEPRICYAFSCPYVPHSLDMLDKGMTHVPGWTQQDDQTSSCYYPEEYAI

SEQ ID NO: 931526 - protein, 150 aa, Homo sapiens
MGVLQSAPSNHKGSEEAPAHQRSQQNTLLHTMLHHRLLLCKCSESTFPAMKFQLIKFTLSRFWYPNDAGQHIWQSLFQPLNWDLHHHLPWFSGLQSQTGIIPLVFLGPQLYSANHVTLTNVFYKLLFVHIIFMSPRSILALWGRQYISDT

SEQ ID NO: 931527 - protein, 171 aa, Homo sapiens
MKLPEEGSGSNICCSAIFAVLQPPLVTRRQTGSGEDLQQTPTDLQLRVLTVRRKTNKQKGIASTSTKRTSTPKPHLYVTIIKDQSSSPATEQSWTENDFDEMTEVGFKNLVITNFSELKEDIRTHRKEAKNLEKRLDEWLTRINSVETLNDLMELKTMARELRDTCTSFSS

SEQ ID NO: 931528 - protein, 158 aa, Homo sapiens
MAAAAAITIIAYCSLKLLGPRSYFAPFALMPCEDAAVSLRNKPHQTCVAPGALLPHVQSALSQQEGSHRSYPEINPPPLQSRALVTIWTNTVCTLKWTQGRGHAGSGTFSQGPECPACVLEERVRALGGPGYSQWRAREALSQAQDSGQGSSCQDRWL

SEQ ID NO: 931529 - protein, 163 aa, Homo sapiens
MVPATLTLTVLSMELFLPSQNVSSLRTGTSRCLGGSNTCLAWQCPKKHRVGGCKSPPGGAAAETEQNPQSEQEAPQGPAEAGHSLYVRPKPPHPWGRRGMPPVITGWVSHLLQAGGHSQPNLSLWPPSSPLWVRKLMDVENITLKIMTATAAISAAWNLSLEA

SEQ ID NO: 931530 - protein, 150 aa, Homo sapiens
MTDHLYLGPSAADLLPFAGSPLQTLFDWVSPAEAAEQQRLLAVPSSGSFVPVGHLPDASQSSPEIKQGFTSVILKIEHNQSNVYQEVKVVQAKQKQAGPEQSPSSYAIQSDNEGVLNGWENAREYLSNQCILRTYQLPGTVTGFVEISDE

SEQ ID NO: 931531 - protein, 377 aa, Homo sapiens
MCLLPIHLLPCLNLLLDHMVEKKNPFSVEKFKLAAEIYINNEELNVSSQDNGENALKTLGSTRGKCGVGAPHRILIGALPNGIVRSGLLSCRLQNGRSTSSLRPVTGKAAGTQHQLMKAAAGPVPCRATGPELSKPLGGHLLCQCSLDVRHGVKGDYFGALRFNDCPARFQTCMGPVAPLFWPTFPFWIGAFTQYLEFKMAMFRKCREIQDKTENEFRSLTDKLHKETEILKKNQAEILELKNAICILKNASEFCNSRMIQAEERIREFEGRQFENKLSEEAKEKRVKNNEACLLDPDNCLERANLRVIGHKEEIDKEIVVESLFKGITTENFQNLEKDIKIQVQDSYRTPRRFNPKKTTSKYSIITLPKVKDKERI

SEQ ID NO: 931532 - protein, 152 aa, Homo sapiens [sequence omitted]

SEQ ID NO: 931533 - protein, 146 aa, Homo sapiens
MHLSYIRGVSLHTLSIYCCHVRHDFVSHSPSAMIVRPLSHVELCARPIAQTDGTCYVISDVTKGPRPIHGHVTRSPVYVFSTPRGHLNSLVVCDYVMKPEKIQGSSCQVVYGDTKLQLNIVHWAAVAVPVQSQWLLKVNVVVPLSG

SEQ ID NO: 931534 - protein, 149 aa, Homo sapiens
MRSHSSAVGWSMGLGAVEQGAALLGEVRAAQEPAEAGEGSGMAGCVPHGPGPAGPAGCSECGPAKPTPTRNSSWPASAARSPGSRSRLSLHTSLQAEGVGSGLGQPRKGLPQCSGGLKGSSSAAKVGAQAEEAPRAASTLSPLNCPLLE

SEQ ID NO: 931535 - protein, 173 aa, Homo sapiens
MIHTARSVQNSNGSTSVGMQQDSKQVQADTEISDTLLVLFLDIHNLTCGACVLSKLSETVHLTENAVGGCEMGSGWSKKGKLSKPKALDREDILMKTIFNILLVYIFLIFEADSMYRVKVPEYRTTHRVYPEVAVSSQGKASETKTEAVGRFASRLSTKGSSPSMLKRSSKNK

SEQ ID NO: 931536 - protein, 140 aa, Homo sapiens
MDDEIQAEVVSDGDELSGNWSKSPSCYTLAERLAAFCPSPRDLWKFELERHDLEYLEEEISKQQRIQEVTEHKSLENVQPDDAIEKKNLFSGKKFKPAAEICISSKEPNVKSQNNGENVSRSEDLVPCIPAMAKRGQGTD

SEQ ID NO: 931537 - protein, 146 aa, Homo sapiens
MKFTELQEYTITQCKEEIWDYVKRLNLRLTGVPERDRDNGTNLENILQNIFHENFFNLVRKANIQIQEMQRAPRDLDSHIIIVGDFNTPLIALDRSSRQKNNKDIQDLNSALDQIDLIISYRSRHTKSTEFTFFLSTHGTYLKSIS

SEQ ID NO: 931538 - protein, 149 aa, Homo sapiens
MAKVRIWALHQEEDCTGVTLDVQGSEHLLHTLLQQGAPAQMSKCHTQGRRHQPSLRLAIHPGAFLGLRAMVTGVSVTWKDSTRDTLRHLAEAAVRRGRSGRHTTSGHGLVARSGLPGPCGLACWSKVFRACWGTLGIIVELWRTGIPNH

SEQ ID NO: 931539 - protein, 155 aa, Homo sapiens
MHAVMGVCEGFCVTYNEEWDGWLCGRCICKLTKYSPAVVQSSMPLHTHTSRAQGPVYSRLLYTLHKVETQFQLQTAGLWGSVGDESLSPQDPGNTLLSSLLGDRGSLRACVPAGNECFSPGGRPGDSCGETAVGDPPPQGKRKLEDWTGVEPGQF

SEQ ID NO: 931540 - protein, 145 aa, Homo sapiens
MRRKENSRRQAPRHLLVKTTKKRRCVLGYCDSCDWDRQVGKGSGYFPQKKQKTSGADMLMNLPSAAMENLGLGWGCGGILLAHAEGEAERNWAHLQVAGPGPLLSSPSSPSLSPSALTHAYSIFHFFYLDAGVASQVDSLSWWSL

SEQ ID NO: 931541 - protein, 135 aa, Homo sapiens
MEGERKRERRRRRGGGGEEEEEEEGEEERSKEKRSRGGGGGGGRGGVEEEEEEKENSKSKERGSPLTDKRGTTRDIEGRQAEMLCREVQEKPQRNPRECSEKVLLDNCVKFCQEDSGHKKIKRMNIVQRYGRLDM

SEQ ID NO: 931542 - protein, 139 aa, Homo sapiens
MVLLFLPVTESLIEELLEPSAWLSGPWEIWMLELTGSDRHSRGAKCAKLVRHRPCEKSAQNKMGDKDAEPILHQVRGGIQNPNLGAEVRAVLGSCVCLDSIFYPTNNQQALRGLWHVRALCHGAWINRSPSKCCTIAST

SEQ ID NO: 931543 - protein, 153 aa, Homo sapiens
MSWRRKCFVSRTYCGVCDPDLRASEEIWRDEGILRGTAKICLPGTKAAGAMNCKEHFSGDLDQLPECWLVSKISTCLRQRGEHYCEICKGSSTAKAYSAGENTFIRGLSYGSGAGEEIFQTPASSSFSASTNGMRECWGGRILQPRSTLKIGN

SEQ ID NO: 931544 - protein, 134 aa, Homo sapiens
MFLFILYAVNFLDSLISSKNFFRLLGIFYTDNFIYKAPWLGGAGCLCTAPYLISTDRSGGKGLIASQRGRVLALYSAFSDTTGEARSTSLPLDTMGYNGLATMALDKYTHSKWDKLAKIKVLKAPCKSEIQQGN

SEQ ID NO: 931545 - protein, 222 aa, Homo sapiens
MSSNSSSSSISSSSNSSRNNGSISSSSSSNSDSDGSVSSHSCSSSGSSSSDISASISSSISSNSTSSSCGGSGSISCSSSSISSSNSRSRNGNSRSSSSSSTGGSRSRNSSTISGSISSSNSNSITVVIAAVLVVLVAVVVLAAIVALSHVAKEGLRCEVSCTQLGPHVISIEICGSRSLALLRVHGTSAEKPVDITGYHVAFAFADEKSDAILNAIIIDTY

SEQ ID NO: 931546 - protein, 136 aa, Homo sapiens
MPLPPPSSNIPGGSQIVAVLAARISSQWILVSWAPWEWEPPSQTTWLPGFSTPFQGSEQFCLTGIPGTTGNLRRSPGTDYLSLPSDGTNPANILSCTSTLHNCERIKFLLCKLPGYTALALTTQCPETMIQQVLYL

SEQ ID NO: 931547 - protein, 134 aa, Homo sapiens
MSGIQMKGACTEEGPQLGLQALLPQAGRWSFTSLLFKETFSFTFQESQCLVAPRAFCFTWALNTRSPTFHSAPLCCCESNTFHDKPQRDDNVETPDPKEIDCSTNWLALWLRSWKKLLANSQECGNLSPTATGD

SEQ ID NO: 931548 - protein, 143 aa, Homo sapiens
MGTVDGYHSQKLKCRQAKTSRKGLSKSCNIGQMYREKDLLSDLPVTRGLQRTWRKSENFSQMPRGSWHRHVDGENQEDMFTTYCQSSSFPKLRVPSCRGTPCGRDIHLRPTFPTGYQLYHIYVLENTGKQKQKNKITPNTINP

SEQ ID NO: 931549 - protein, 143 aa, Homo sapiens
MLCQFLEICKGIISTVMRGGRRKSPAELHVLRCLPGKYGSSAAQGLREGMEQDHNMERGLWVGDGCGTYERGVDVAENVKDREKESSCTALGSGPGDSQPFVAWRLPLPAQLSRTGATLRWAFQRGSGGCTKEIELLSMEHGC

SEQ ID NO: 931550 - protein, 138 aa, Homo sapiens
MLSERPFQSTETVLPTEPSQGHCTASGMKQTAPAGDQPSRRAGTEHLTEGFLYESVLMLLITTYPRVGVGACTIAHMWSLEPHCDSQVHLLTMHVEPAGVLDQGEEPDFPRSAKLLAGHVRLWITHASLRAVRHGCVS

SEQ ID NO: 931551 - protein, 136 aa, Homo sapiens
MAFGLKYECEKEPTTHLANILGTALGGGTGAKAQRQGCLHWGGTEVSTAGMTWFPRGMPSALQARHQLVTLWKERAPHPPQCVARTVIQSTQHFLFHNQPKLPLQCIRKATLPPASSCYLLQHSCQKHVDLQDLFV

SEQ ID NO: 931552 - protein, 140 aa, Homo sapiens
MQQQGVILEEESHPHQTTKPDGTLISDFQPPELKASAPWDASAPGLLHNSVFVSLAPGSCPFSLEDTRKERVHSISLTAAGAASLATQGPLKNLYSGGITSSRFSCVVTNGKFTLFLRANNISLYVYATISLSIHPVTDI

SEQ ID NO: 931553 - protein, 208 aa, Homo sapiens
MDAACRDQLSRGDPNPAVLEELKTHTQKYRVKRRSFLFEYVDQRSCKMCFAEQKSALNDQIVDVDSQTVSPKNFINRAESHGESRASLEPLRFAIMNKGFLLGDMDQTCIPLYGAIQATVPGEVAVVDENTHVLGSWCTPNPWGQKLLCPGAFWTMPCAFYLIKKLDCPIEFPTLDFADCISLLIYLEELKTYVHTKAYIGRSQQLYS

SEQ ID NO: 931554 - protein, 458 aa, Homo sapiens
MECSQHLFLTVPEAGSPRSGNQPTGSLVGAPFLVCTQPPATSVLTDDATDLFLEKFQSQPYRGGFHEDQWEEEFEKVPLFMKKAPSEIDPRENPDLACLQSIIFDGEHSPEQAKTYKDEGNDYFKEKDYKKAVISYTEGLKKKCANPDLSAVLYTNRAAAQYYLGNFHSALRDVTAAKKLKPCYLKAIIRDAKEKKLLEMRAKVDKLKLIEQRDVRKANLKEKERNQNEVLLQDTKARNIRLSEAACEDEVSASEGLGELFLDGLSSENPHGARLSLDDQGRLSWPVLFLYPEYAQSDFISAFHEDSRFIDHLMVMFGETPSWDLEQKYCPDNLEVYIEDEDRAELYWVPAKSTLLQDLQHHRHFVKALTPAFLAILDLHALSSGYTDPHLCDFLESHFLDEEVKLIKKMGDHLTNLHRLHRLAGLEAGLASISLKGSPSSTTRSLLSPGTSGGPLAK

SEQ ID NO: 931555 - protein, 330 aa, Homo sapiens
MPRTCSWKSSRASLTKAPSEIDPRENPDLACLQSIIFDGEHSPEQAKTYKDEGNDYFKEKDYKKAVISYTEGLKKKCANPDLSAVLYTNRAAAQYYLGNFHSALRDVTAAKKLKPCYLKAIIRGALCHLELKHFAKAIDAKEKKLLEMRAKVDKLKLIEQRDVRKANLKEKERNQNEVLLQDTKARNIRLSEAACEDEVSASEGLGELFLDGLSSENPHGARLSLDDQGRLSWPVLFLYPEYAQSDFISAFHEDSRFIDHLMVMFGETPSWDLEQKYCPDNLEVYIEDEDRAELYWVPAKSTLLQDLQHHRHFVKALTPAFLVCVGSKLF

SEQ ID NO: 931556 - protein, 146 aa, Homo sapiens
MAGEVLEHPPGAIEPVMLRLGTALLNIPSALSAKFLGALVDAPLHTDGPRGEGSILQKGHNQAPVGTEEVLEAHGNLPVHSRTAEAAVGVSQGPSGPSAVGGIHVYALFRMRKAQVEMGKVQEDTDILTLIRALNKQFLEPTHAKR

SEQ ID NO: 931557 - protein, 241 aa, Homo sapiens
MPAHFSQDLASHPAGVSPPATVRKRRLSTLWASKESSLDLSAPGEEPPTSASLTQRQRQRQQQQQQQESLRAKSWAQNPGLPGILNTTGRKRRDPKKRAAAGSSQLGGALALSWQNSASSPISWFILWPCSSSFLRRGTFPASSLGALSQNWKALCAPVPDSHLPKPLQVPFVVLGGAEFHFGDLSNEASNRLSPVACRELGKYTSICQWFRLERGRVLIMDDEALGVLRSHITKEAAEGA

SEQ ID NO: 931558 - protein, 203 aa, Homo sapiens
MTGANTFPPKPLLPSGSSPESSPLSVGHPLLELEISVSGAKAVISNDIITPSSSWMTMGSSSCSLVSELWSVWAATDRRSEDTPGAVAVPVSDMLRSHEPLYTPASPWLVGLASELDFFRSLLQVGHLHLEGQVVALLRLIGPQGVPPLAQDLADGPVILVGVTLVRPARAWCRLLKIMTTTHGPPDVVLVPFVGAASILLRR

SEQ ID NO: 931559 - protein, 229 aa, Homo sapiens
MFQRRAPQGWARACAVTHVSLQQRGMKGRAHKLFYKAIVCGKEIIRTGDCAVFLSAGRPNLPYIGCIQSMWESWGNNMVVRVKWFYHPEETSPGKQFHQGQHWDQKSSRSLPAALQVSSQRKDFMESLALPLLLSLSLWLPGAPSAFVPPTCHPDVPACPQRVLYQSSHVDENDVQTVLHKCLVVGLEQYAQMLKTKKYQDSEGLYYLARTYEPTTGMIFSTDGMPVLC

SEQ ID NO: 931560 - protein, 416 aa, Homo sapiens
MISLSRILTELLLPDERASMLIFFLVSVALELLCFLLHLLVRCSGFVLFYTTRPRDSRRGRPGLGRGSGYRVHHDVVAGDVHFEHPAPALAPNGSPKDSPAHEVTGSGGAYMCFDVLWPRVQRSWPTFRAVLLHRYVVAGVIWADMLSIAVTYFITLCLFPDLESEICHCILGEWLPILIMAVFNLSDFVGKGGHVPGSLQILVALPVYWRGTHLLACSCLRVVFIPLFTLCVYPSGMPALRHPAWPCIFSLLMGISNGSFGSVPMILAAGKVSPKQREPAETASPKQNALAMKESEPWVRMDPPAVCVSLWETTAVMPAGHVRTSPHTHVMPQVGGCAGLGSPPIAFLAQDRRGEPLKDEGRRLHRRLQAEFVHGRELGLPSRDPGGTWAAPDKPVLSLPICESPRRALPLPEAG

SEQ ID NO: 931561 - protein, 139 aa, Homo sapiens
MTSSDSVGAGYSPGTCFWRHMEKGAQVDKKYPWKDLGGENNATFSFGFQKGVRKESTFVQESGLSAIAQYTGYGTSKFEFQSKTLSPNQIKRQGPRPCQHVIHQKCGVCSGLLLCWFALNMAVSKTFEESKVVLGFFTV

SEQ ID NO: 931562 - protein, 200 aa, Homo sapiens
MVLLLGSSDPPTSASQIVGITVVSHCIQPFITYLKTITRESQTSGARRESFLKKPEKSRLAPPGWNFQRQTLNHSLKMQLHVSTRSYPLEAEKGKEIDDPLGQGSSTPRLWPIRNWTEQQEVSGGQASEASSEFTHAPHHSHSCLSSTSCYTSCGIKFSQECEPYCELCMNERKGSEALSVTKGAHSLLVVYVTGKASGH

SEQ ID NO: 931563 - protein, 134 aa, Homo sapiens
MDLKLPAKLCCKILILPAYLFCLTCLKWSGRALEVTVVAIREHEFIKGQSLGDEIFGKPRLRTKGSELSENCMEMSVRYESETHMQDLKDVTNNVHYENYGSRKLAAVTYNGVDNNKNKGQLTKKYTHLAGLEL

SEQ ID NO: 931564 - protein, 322 aa, Homo sapiens
MLSHLNQHQVIHTREKSYKCKECGKSFNCSSNHTTHKIIHTGEKPYRCEECGKAFSWSANLTRHKRTHTGEKPYTCEECGQAFRRSSALTNHKRIHTGGRPYKCEECGKAFSVSSTLTDHKRIHTGEKPCRCEECGKAFSWSSNLSRHKRIHTREKPYACEECGQAFSLSSNLTRHKRIHTGEKPYTCEECGQDFRRSSALTIHKRIHTGERPYKCEECGKVFSLSSTLTDHKRIHTGERPYKCEECGKAFSLSSTLTDHKRIHTGERPYTCEECGKAFNCSSTLMQHKRIHTGEKPYKCEECDQAYKEKLYKSKECGKAVN

SEQ ID NO: 931565 - protein, 148 aa, Homo sapiens
MTALQKKEEGEEKKGEGEEEIEKKKEKEKKEKEEEEEQEEEKKKKKKKEEEEEEEEKEEEEEEEEEEKEEEGAKGREEEEEGGGAGERKRRREKKRKSRKNKKEEGGGGVGEGGVGGGFGEGGGGEGEEEKLQLVTCPKTRTQLSWGP

SEQ ID NO: 931566 - protein, 141 aa, Homo sapiens
MPSWGLAGLQWAPRTGQGCSGMAPPCRVDIANRLLSPTSRIGDLFGSSRERAWNCPGTQAVSDTSEVCVTQCCSPCILDLLQGLPLFSGDSPVGQGVHYLKLASFSCPSLCVWWVPDQACSPGLITPDGLPPPSGDTTVIS

SEQ ID NO: 931567 - protein, 127 aa, Homo sapiens
METVISTITEPVQGFMRLLVWRSSLCSPFTLGLQLARRPSDKTWQMGMVFQDLQGFSGRSYGIYITEDFSLFLLDSRKDKLKQSAKPICRSLVTQRANVVFALESVGRASRLDVRHSGFPGRPCGWV

SEQ ID NO: 931568 - protein, 141 aa, Homo sapiens
MSILCDAKVWGTDSVTQICASLVITDAEHILICLLVICISSCVRNWWVLGLTDFKNEAVNPPGVKLQTFAVSILAHKGSSDPKSGQQRKLPQRQKEHTFHRVEGDPSGLPLLARQPAFIPLSGPTHILLIGPLYRKLIGLF

SEQ ID NO: 931569 - protein, 150 aa, Homo sapiens
MVKALLWLPHVLEECSLSSGLCFNLQLHYMPLFQPLVILVLFSTLRSSKVLFHGLRTPCHFWCTGPLSNIGLSQYICCGALGGPLNHTVKTLEPASITAFSASTAVTTILNTNTITSATIPTTTTITSHSLVSLNYLAGTIIGDLMFIFH

SEQ ID NO: 931570 - protein, 134 aa, Homo sapiens
MINRFWALCEVNKQLPTKDVQMCPEFLPSSGFVVSLTSGAKLQTFTKEGSVLAVLFASSGQLVSQDPSDCIIFSSIDCAHQEPSTPTIRIPSKDLNLDMSICLAGWEWGHSIEEMQEIKRNESWEKDKGDKEKV

SEQ ID NO: 931571 - protein, 143 aa, Homo sapiens
MCCIHMQTLMCASQPSRGLEAEIEKLVLKNKKHSLAGTEGTWRGEVTDESGHRVVLGEGEFEGNGQKFIFGPDGFGHSLTEGRSLDLLISHARFQALDYDSSIRTLVDTHEEEAAVSVEFPLERKEGSLLEMQKLRPYPRLTK

SEQ ID NO: 931572 - protein, 137 aa, Homo sapiens
MAVVSFSKEAKKTLMDEMLCTYGMENCARLSQKAAPEERNVAAASQVPDPLPCDSAALCVWPCSSTPAGKGGRMDSVRQKLLEPLRIAACAKEDLLLLTLLSTHRSIEELNSSHLNFLPTSLLARPPLRSSCFSADV

SEQ ID NO: 931573 - protein, 175 aa, Homo sapiens
MAGQKELASLSQGCHALFEVPGVSNLLGANAFPSSRRGCLQHKPRALHMVQLQPCMEPAPVPGPGAACSTTAADVPGCVQRLDPVLACPHTPHHSAPGWPLAGVGSGSAAQAEHSLPGGVGRPSPAGMSNIQAEGAAGHRGFWLVKNSTTRSRDFRIYSKNVQYLQCKNNLPRCI

SEQ ID NO: 931574 - protein, 223 aa, Homo sapiens
MRKKRFPAETVACVDLSCVVQKISILGANSGKGKTEMERWRDLGLKYELTAISIRMPRNLKITVPGGAERAQLAGGKCGEGQEWQAEHPPGGHSKGRDRHCLRLWMQTMLIERRIDILHRRVCRCKRKEANELPDRKCLLFSKAGVQLSAGHEGPCMEVEPRSFLNVFLLHFSPPFLSLLAKEEPNGDIPYLGELLRSQAHGRGHPFTLLKMIKENTYFTGLL

SEQ ID NO: 931575 - protein, 178 aa, Homo sapiens
MYLAVMVDSGVVKMEDEAFQEVTKSNWCSLSINHIELDRQCVAMTQPSPQPELSNTVYHCLHFHRGSDRWLERHLKEEMQEDEQSAVQEVGDKEKVMSQKPTGTWSLLQGTHYTKVSMHVTEGALERGHSLPKRVITKGHVTEGDLWFGLEGLFRILLDKARWKEDVMRPCFLVVARV

SEQ ID NO: 931576 - protein, 167 aa, Homo sapiens
MTILHVMNSERIGHRGSPGRIEYEEYNLTYGLLSSRVTLKTFLCSDTVQGDAEVPMAPAGQDFLTSELTNRGHHPSQDAGLWTHRGSGIVTGIEDSEEQNSDIGLLRDKPTSRVEKQQKGPPATWCFRKSFLQVKMTDPNLKDDSELNGRREDSMSRGRKVTNSVKM

SEQ ID NO: 931577 - protein, 160 aa, Homo sapiens
MARSKGRGFGVDSMQILGLLLSSGAPWGLGTISFLSVPGGFGADEVALLLLKVGKPFGVIQGPRRNLNIPLLHENYGIMQRLLQEEGQTRAKKAKTSRVLCFRKTNVSRCPEERLCANFASTSELHYPLLCSVVVAYNISLTKLHMCLYLDLAHLSNMEF

SEQ ID NO: 931578 - protein, 141 aa, Homo sapiens
MLPYATSCSHHLLKGKQKEENCSQVCDLQKARSYSKCTLSGSLRWVQHQPLGASLPAKVWLRLWCSICFVSITNKTSILPITLLIGPGIGEKPIDWPAAYEEASIGRAFESAEWLWNHYTTVGTVEQNGHHGPISQYGSER

SEQ ID NO: 931579 - protein, 137 aa, Homo sapiens
MMTVGYSAPTSFVMVQTLTLFPLPATVAMKPSVAGAWSAWACLAVMGRVLPLPMMGGQQEASGSQELSLFLHIVGLLSCNSVLCSPCQGEGKERTTTQTFTEHLLGAEYARHFISTISSPLFQMRTLKLQGMNTLNI

SEQ ID NO: 931580 - protein, 147 aa, Homo sapiens
MLGRTGAKKQDLPSPALHQVRRELYVEFPVPRLPTLPRLCGAQLTLPSCSWFPFSYLRLPSLWLRSGLASLLTRLEGALQCRRAGQPHPGALRLEPRLAVNFRKHLACLDRRMCMDGLALLSSCAASAFVLLPHLKKDPLVTPIGRS

SEQ ID NO: 931581 - protein, 148 aa, Homo sapiens
MITGKMITFQKKLQQSQSRPGELEPSQKAVLVYAGLGLPILIPFAEDLSDGDSGRKVFSPSTLLSSQCGSSLALKIQLSVDNKACNHSITVQPVITESQEGRCSIWSGALALAPCTRSFSLQTILQSLQLHLNCVSNTVAMQNKMSSS

SEQ ID NO: 931582 - protein, 135 aa, Homo sapiens
MKQICFSIELEPLNKCKKGMPITRGALNGSDEHKYVCQKSVPRQAQLEAIPLTHKTDLLLEVLKSGLNHLLSGLSREDLQEIQQGPREVSTTQSLNQPASQPTNQPNLPTNQPTKKPTSAFNSKCNISLNQCLKG

SEQ ID NO: 931583 - protein, 142 aa, Homo sapiens
MSAEVVCCLLFSYALPTEVESREAVGLAELWSISDCFTSSEQGSMGMGPTEPGEGGNLLAYQLLRPWEKCSIWTEVYHCSRAVPIWPSWKRLQNFHFLNHEISWDSFTGVRIAQERPTPMTQTSPMGPSLNTWELWELQDEI

SEQ ID NO: 931584 - protein, 168 aa, Homo sapiens
MEQPLWCRPGAFSLKTHCTCKLAKKISNPIKPMQIPNDSFTTQRSVPTLVVNSAMRSEKSTCQWTSESLVRCLIYSKDERGVTLGPSSISCQIGHCPLGCSTCSKPMADLRCYNPIRTQELRNLEVEVGLAPQLAGYYIARLDILDAQPDETLQCPQGWGCGTFPSGL

SEQ ID NO: 931585 - protein, 138 aa, Homo sapiens
MRIWLSASAVRTRPVSLWRPAHMCPGRAVLWILQGGRKAGGTGHLPKDETHQKNAFKYSKILGWGPIGHQSSIFCQHTVAQPLIGEKVCSTHGAWPPGKETVVMEPAAHQGRTLSFPENGLTVEDPSSPNVGGYHLIG

SEQ ID NO: 931586 - protein, 256 aa, Homo sapiens
MGRNQRKKGENSKNQNAASPPKDHNSSPAGEHNLMENEFDKLTEVGFRRWVITNSSELKEHVLTQCKEAEKQHENFVKHTQLSIAELISGRKRILSKKNTAGGITLPDFKLYYKATLKKLSSCLAVQGLGELVNRRRRFQPLTEDGSLVLQPDTMGPFHKVPQLQVCWSELQTLFAWVSPAEDAEQQILQNSKYCCLILPLEALSQRGSHLYEVSVGPYWEVSPNCCTSSEQGSMGVADTEPGTGENHLVCQLLRP

SEQ ID NO: 931587 - protein, 153 aa, Homo sapiens
MAVLFLMGDGSLEGVFPRSVSSLNAIYFPVCPRLWRTPSLLEGSQGNTKYQSTFLVQKMQQKVGSGFELATEFCKLKQPKSYSVIPASKLSTGHFWLSGEDQNRRNEFPVKNCEGSEIPLYLQANKSAIYNFMYADRTHETPGSETEEIHLQR

SEQ ID NO: 931588 - protein, 140 aa, Homo sapiens
MGLEPPHRVPTEAPPSGAVRRGPLSSRPQNGRSTDSLHCAPGKAADTQLQSMKAAGREDVLCKATGAELSKTMGTHLLHQHNLNVRHGVKGDHFGTLRFDYPAGFWTCMQPVALLFWPISLIWNGCVYLMPVPTLYLGSN

SEQ ID NO: 931589 - protein, 173 aa, Homo sapiens
MGFQGRTFTHHFPRGRGGSPGSVLLLVPLSSCSLLHPPALWCAFPSNTQLLTPNCCQAAGANLLLNRDLEGVVLKTEKFDSGDGERKGVAGGIGKGANESEFRMVLWREDLGRSRESCGSWRGEEKAGDGRECVGLVNVNERNNTSHIPIYIEDSSEFTYHSCGVCYKHFPEL

SEQ ID NO: 931590 - protein, 215 aa, Homo sapiens
MSKVCSLAPEASKTTNQMGGRNNSRCAAFKSCNTHREILAPEKDVAVMVDCSLQALARYILEYRQQMMQSKWKESSKSLEKFVTTDLLKPTSVKSLKSFSIQLCSIADIKDTIFTSEDGYIKNAAFCVKDQHILFDSNHPDQALSSSSGIWVTGNTETISRKVKEKNTPDTVPPLLRIYPRETLIQRMFVFYLPNAVSYIYETNQFFYSTYSSNW

SEQ ID NO: 931591 - protein, 161 aa, Homo sapiens
MSDGFGYITISLSLSFIPGYPLFNPGWHQPAKKDSKAVLGLAAIFWDSQMPVIGMRPAGILTSSVSGFHILIIVPYLLPLGQPLHFSRSQYVTTLSHKMACQKSRGGNLGELLFKGLRPLNETSLVLLGILLLEPQGPLRKILGASWSLPSLKPKGRSSTA

SEQ ID NO: 931592 - protein, 125 aa, Homo sapiens
MKQFKSVEKLTEYAPYFNASVVNSLPHLLYLSIYVHHLKGCEAFPNNIPQKLQLTKFVVNFRILRHPEMGHCSWIPDSKLPIAKCLVKAMVTTVSVSLSNFLSPNGILSFKYCAADLGSQVSGPP

SEQ ID NO: 931593 - protein, 174 aa, Homo sapiens
MYACTLPSGVSVEQGRGASLVYTAVGREGLGTSQTFFQPQRKPPPRSQRKELSMAKLEQFVQRQQLKEITLDYHSKYKINIYESILMHEFFSPLHWTCGRGTTSTWPTVLSPMWRELVSGRVRDPDGCSGCQHRSKLHVGPAVRPGVLPQRERGGTQVRVPMTLKAQSRCHSAV

SEQ ID NO: 931594 - protein, 165 aa, Homo sapiens
MALFSIVASWIPFEKISSTASGFLTAGTQLQSCTLELTALVAVSGRVPPQGVRSIRSWTFKATQAFNVALTGLSATGRAHSPAPPRSATPIVNCACEGCRLQVPYENLMPDDLSLSPITPDGTKCDTHKCMVLKDLNKKLLLAVKNFTLSPANSILPTPHKFIQM

SEQ ID NO: 931595 - protein, 140 aa, Homo sapiens
MKLLMEGFHGKAAELQSGQGEIRAIINFVFHCVLQQEKCLLPLQLALESKNVKLAQHALAGMQKLLSEERFVSMETDSDEKQLLNQILNAVKVTPSLNEDLQVEVMKVGLTWPRVCVTGTGTHPDPLHLLSENASALWSC

SEQ ID NO: 931596 - protein, 150 aa, Homo sapiens
MGRNQSRKAENSKNQSASSPPKERCSSPATEQSWMENDFDELRQEGFRRSVIMNFSELKEDVQTYCKEAKNLEKRLDEWLTRINSVEKTLNDLMELKTMARELRDTCTSFSSRFNQVEERVSVIEDQMNEMKKYGERHKDTPREEQLQDT

SEQ ID NO: 931597 - protein, 224 aa, Homo sapiens
MASAEQWCMLAGFSLPGPKLNPRGSGGATGWKERVPEVHPGRKELVNIQGDLNGDLESLRKLELGFNVFGHGYPFHLDNPSQAARSERFHSDFLEGHIMITIQTLARLAFCQRKGKQEIPEGQRTPARNWAFEKPRGQISLSSHYSVTSATIHWGFFQGYKLPMIPVLETLKAAFDLGSHVVVESIGGISVKALRLACGSKNQIGSTGSPSQGSLEGKSPEQKQ

SEQ ID NO: 931598 - protein, 146 aa, Homo sapiens
MEVTRVVMTKQTGFAGWQRLLYTSKRDINWIFLLSFPGRLSDFASSGRLLGHCFDDTHSNCVSHIMNSKTTRRRIVREALSTRELARNHISDGALAEFKNLGPSSSFLPEQQSVSFKLSKPEIVPLHSSLGDRARLCLKKKKWFLL

SEQ ID NO: 931599 - protein, 132 aa, Homo sapiens
MNGSHLKVPPARHQAEHHLSVIVSECYTLQIHTLLFASGEIDGKGRRSAETEAISQQEAPRLMNNKAAHFLDFTAFLARCAPSPTALWPADGNLDSLLPNCECEIAPDGKAESTDPSRKVGFISQQMKPQAR

SEQ ID NO: 931600 - protein, 266 aa, Homo sapiens
MVVALIYRLLVCFYEIICIWGAGGATPGKFLLGLRVVTSVLIALSWVLVIPSSNVSITTSTIRALIKNFLIASFFTAFITLLFFQHNRKTYDIVAGTIVVKRNGFTLPGEPPKKVHTGVRGPLPSGTVDLLRGRSSLNLKGVTVHMRIIDCDYTGEIQLVISSSTPWSASPGERIAQLLLLPYLKLGSSTVKRTGGFGNTNPAGKAVYWVNQVSDKRPICTVAIQGKDFEGLVDTEADVSIIAINQWPQHWPKQKASIGIVGVGAA

SEQ ID NO: 931601 - protein, 129 aa, Homo sapiens
MIFTSTVNRTTKQLCQIVQTTIKISKLPKVEVRGSLLNTCIIGYLRSGDSDCPWINVESEVYQRPSMWFTCLAAFGFACTTEHVLHEAARWLLSSAGWIQQKDEEFKLYDLWVPYSPKLYTVLPVGMPH

SEQ ID NO: 931602 - protein, 152 aa, Homo sapiens
MEGQGYQILDTALSFPDPLKRLAIAIAVVLPARTGGSLYVQEINSKRLKSECLPRWLLKWHLPPSVNSARYFVHSGEDPPSMRAGTIQSAGGPERTKQGKVLWPLDFRTYTSDPHNPQVLRPLALDRKLHYQLLIFEAFELGLSHIIRVWRL

SEQ ID NO: 931603 - protein, 140 aa, Homo sapiens
MITVSLTLSVQVAIQVPSLFTIYHRKSPQKCRQKCKITTALKARIFVNELGFNNCRCASSFDRDGTFTKQGRERAPQTLRAAFSEGTPISMISTTLGWIGKTVTHCILKYETSVKKRQSLSEPLEQCTLEVCFAPTVFDK

SEQ ID NO: 931604 - protein, 145 aa, Homo sapiens
MTEGKEEQVTSYMDGSRQRRRKSLFDNGKCDDRDVPEDYTTQNSEPGWTTGKLGGKKQKCRFLENDLEEVDGSKEAVPVDLKVGGAQTIQVAILTSSSMESLCPLVAAFLPLELKPLDQQKLFRDDGDHGKTSESHEQELTAAFL

SEQ ID NO: 931605 - protein, 180 aa, Homo sapiens
MLRLVYSSSSCPSQKPGNHLTTSLFNVDEELLTILPPNLISVFPTLFNPAVNAPAWSSPALTCCVTADPNCPPFRPHLSQPTVFTAASVGSLSQPRYCFLQASLLQVCWSLLEFHSRSCLRQYHQQRLQNSKDCCLFLSLEASSQRGTCQMPAGALLYEVSVNPCWEVSPSQEAQGSRTN

SEQ ID NO: 931606 - protein, 239 aa, Homo sapiens
MRKNQCKNAENSKNQNASSPPKDHNSSPAREQNWMKDEFDELKEVGFRRWVITNSSKLKEHVLTPRKEAKNLDKRLQELLTRMTSLEKNINDLMELKNTARELREAYTSINSQINQAEERISEIEYQLNEIKHEDKIREKRMKRNKQILQEIWDYVKRPNLRLIGVPESDEENGAKLENTLQDIIQENFPNLARQANIQIQEIQRTPQRYSSRRATLRQIIIRSRVETTKKMFRAPRKV

SEQ ID NO: 931607 - protein, 138 aa, Homo sapiens
MCYRQISLLLFRSLKKREREGGRLARPVACFSHCGLPGSLGPFSETCFSQRPPNSSDIQPAPAPGPNTRRPAVTTFQDAPKFSKCVPYKNKIEDGECSGALCVKNITHPAAWAHYFHILPQLSVSPRASEQFSGKLKA

SEQ ID NO: 931608 - protein, 127 aa, Homo sapiens
MTNSISFSGQCSETVLVRVIQTNRNNKWNVCMYICACVCVCSVRIYAYKDLLYKKLAHSVVEAEKSQDLQLAIWRIRRASDINSSLNVDRLKTQEECKSNSIKKGLVTQTQNLQGLGLNMPSSKPLR

SEQ ID NO: 931609 - protein, 150 aa, Homo sapiens
MYLGKDSTNTFSVLSITLPVVPFLDQKSLIGQSSRSTIRPLFSIYCVLAIALNIFHILNHLIPVANMRKLSHREVKGLSKFTQLVECEMTGRCEYDFSKRGEFLTFQGHVHSPNSLGGRKALSGRIVNRLRCISNTTSKDVNLSFRILPV

SEQ ID NO: 931610 - protein, 141 aa, Homo sapiens
MVQSWASISIIACLHAKKHLAQKIREEILKEFTSINGLKAKFITLTLRQQCVILLESCEDPIIVCLKCLDPIALAHSVSLELPLLNNACDNKHKMVIFDAEGSFGFGRLLIAASISELVIGLFRIRLLPGLVLGICIYSGM

SEQ ID NO: 931611 - protein, 136 aa, Homo sapiens
MCLEIYLYTKIKSKWSKDLNVRPASMKQLDVNIGKFLQDISGQRKESLSKTSKALPHVLGCLQRGVLSHVEADTEEDPNCHEQHPSNTATHLGTDQEAVTDGGRKPEESGTTSQNELWFYGNEGKEHLARTGRKTA

SEQ ID NO: 931612 - protein, 157 aa, Homo sapiens
MSYREVQNESSEKSSWKNCKNNPLDRLQPCLSTRTAPGSRPVTVVPGSSGPRVWDYPSRFQFQNNPNRLSFWGYPCRTRLKAHTSTKLTPVETNFRLHAVDTGSRPALIDPINKSIPVDPGSRLNPTDPDARLMHLLTQAPASLPKDSSRKPAHEEY

SEQ ID NO: 931613 - protein, 152 aa, Homo sapiens
MERVLKVHQYHPYPCLLPQHLVLLEGLQGQARTELLSSTITMPSSGILPEELACGYFTVIDKNATKIHETQSHQTTSKSFIHVDAWCHKGMMQIVLNISSIRSCSTLFFYQYDILRDKLSSQNVQSIKASRLQVLVFLREEIRPFGDSHASL

SEQ ID NO: 931614 - protein, 172 aa, Homo sapiens
MDSEKTENNLNFIHLLTMKSSRGNNLGDKKQTKELNFSESYCELELNVHESDVSKIFIIDDLGPRCCSPQAVKTPIDFSGNFTCPRSSCLVPVAVSRFSPYSLSWIPLARKGKSPNPLCFREQVGMAENTGGMDPTLGTEPYNQERNLKHSASPCGEEGLDFTYTALTLRSS

SEQ ID NO: 931615 - protein, 152 aa, Homo sapiens
METGLYDLGGTGLPRHTLCKLENQESQWYNSGMTGVRQRPYGKEKYIRSILLAFQQFNPNDVNTEQNPKVGKFMFGLLLLLFHKLSVLKINAAHKVSEGAFFVSKDIELATDIVSDQNESCFGSSIKVVDHKETIEKLNLEEGKGFALMISK

SEQ ID NO: 931616 - protein, 161 aa, Homo sapiens
MEKNPWKPKYFISCGSFGKPCIQTVHESPRINYQSFHIMFIFECIHLTFIDLIVQNLQKARGPKGGQNNTLLDTFLQGGVEGEALAGTGAAHGTCGPARVLGGRGLSGLHSERLAGAVSLGQRPPPTPQPRVPSTAQGLSTAAQCGTGGQLHLQPSAGSTR

SEQ ID NO: 931617 - protein, 142 aa, Homo sapiens
MLPQNSAYLSRDQQELKSPSQFKHPSAKARETCMSAKEVEIPPRRKRSKTPKSNSIFKPFHEETVLSSIYVLDTFVKNQFTVDSMDLFLGSPFCSMGLCVCFYKNVPEETTRPRGIHKESFQEINRAPEEIGSSHKFNTEEA

SEQ ID NO: 931618 - protein, 144 aa, Homo sapiens
MTPDGTAYPGILRMLGIVFKYLSGKEKWLVRRRIKRYLYPESNTDKQDIDYIDYIDIDYIDCITQIANNLKFFQIVFMCVSIEIYEEDSILMNKTLKISNSETITLRSSSRIFQPCISELAISLKYQMQAHCQSTYESEVTLNI

SEQ ID NO: 931619 - protein, 166 aa, Homo sapiens
MTWIVPLECSGMITVRCNLCFPGLIDSQFCTAGEASGNLQSWQKSPLHRVAGRSECKQGKCQMLVKPSDLVIVMRTEWGTWYKLLVDLPFWGLENGGSSLIAPLGSTPVGTLSEGSNPTFPFHTVLEDVFHQVSAPAANFCLDIQVFPYILRNLSRGELDLTSYLR

SEQ ID NO: 931620 - protein, 139 aa, Homo sapiens
MLDTWSSHRSRRYYCSDVMIALECLQQRTLLISFMMFLYNLREWQDSEVSFLLFLSCFLSMNDFFFSGKGSFIWLRSFATNSSFSAVDPFQCPFSENHWERFVQLIGDIEHRIDASLLWESFLEETELSNKMQESISSG

SEQ ID NO: 931621 - protein, 154 aa, Homo sapiens
MRPQADGKTDVEPKLIHLCKQGAYKSHGLSSKLDPFSQDWSSWDTRQYLFSNAPLYWYQFTALVHFHNADKDIPETGQFTKERALIGLIVPHGWGSPTIMVEGKEEQVTSYMDGSRQRESLCRNPCSKWHQWVLAVPELSIRVYCEVSYIIEVM

SEQ ID NO: 931622 - protein, 480 aa, Homo sapiens
MQVIHTPHVDKYCSRSLLKELLRGLLIQTQQEKYWGHCALSTRQLTTGPHATPLPLFGRGRFGQVHKCEETATGLKLAAKIIKTRGMKDKEEVKNEISVMNQLDHANLIQLYDAFESKNDIVLVMEYSLMKSPTVPLGPTQDVNHPFVQRLHHSLRVDGGELFDRIIDESYNLTELDTILFMKQICEGIRHMHQMYILHLDLKNENSHHHHSGIHVVALSSGQVGLQESPAAPRVTQEAPDFGTCFSVGLLPCGIESYGECSRGQSEGWGQSAKEKRGWGIETKLSKTLELLRLKNDWREKPSSAVRLSHRRLCLNSGIMVNCEAVQRTGWIMQGWQDTRNLIHHIIKGESTHTDKPAPKYKPREKLKVNFGTPEFLAPEVVNYDFVSFPTDMWSVGVIAYMLGLSPFLGDNDAETLNNILACRWDLEDEEFQDISEEAKEFISKLLIKEKREGCPWSGPSQPPYIFFASFLSLEPPSHV

SEQ ID NO: 931623 - protein, 160 aa, Homo sapiens
MRVVPVMKYVHANYTPRDSEDDYGVGLWVLWTPVAQTCARTPLINWPLHALLHQGSSGDIMTFGIPGSHWLGPAAVLRIGPNLLPKTSTPPARLGCDLTPENVLFLYFMQSVCQAVNEHALLHIFQTPLLAPALVAHGWAMAIKVWQVSNPCSPQTQGKA

SEQ ID NO: 931624 - protein, 178 aa, Homo sapiens
MPAESLGRPRFLHLRDSRPSVQMGLPATVPKISRGSAFHVVISGPQAFGGPYGFGYQAEPSTGNAGRWLEAGMKNDLRLPLGTHIASTAPQKFLMVEVNTQDSLAMGFPFPEEFSLTEPLRIPPAARRSTQSVCAGAMSKAQKARHAAGEFRGRPCGSCLNGVTFGSSAFRNSFPLAH

SEQ ID NO: 931625 - protein, 129 aa, Homo sapiens
MGTRFRWSKLIIIWLAEKLVGSFFLNSLVPMENKPAAKPHSVRGTNEPPAIRPLMSDLLAGANIYTHGNDQSLEMDNIYQASSHVAHFNKSPSQKGPTYALYGNINLQKLLTYLQFVTQDSLCNRNRVL

SEQ ID NO: 931626 - protein, 139 aa, Homo sapiens
MVKVPHLLPPCPLPPQKPKIPLPLRLPQPRFGQSGIPNVSAFNLLSSAQVDIRGIGRSIFCTRKLNFSEGYGGVLRVDGAEDALVADLCLGDVADLAVEERGDPAHGATAAPGARRAADPRRLSGDPQYPSRLWQPPQT

SEQ ID NO: 931627 - protein, 152 aa, Homo sapiens
MKKTEDNNTLVFIVDVKANKHRIKQAMKKLYDIDVAKEVNPAMAVIVFAIIRLMMMLLRQKDRTPCSLRIRTYMVYNALVLLICGDLLAGTLYLQQQLDPLDGSNLRLGDGRGHSTCQEVLERKEEAGCCQKGLGREPALTPGLRVHLKLLN

SEQ ID NO: 931628 - protein, 234 aa, Homo sapiens
MAIYFTWVQAGENKRVSEREIRVGLFYRIWVGKGKLQSKGVCSLAGRSRDTYFGYGFAYPACNASSKTIICGLMECLIHHHGIPHSMYSDQGTHFTAKEVQQWAHAHGIHWSYHIPRHPEEAGLIEWWNGLLKSQLQYQLGDNTLQAWGKVFPKAMYALSQCPTYGTVSPKARIHRFRNQGVQVEVEPLTITPSDPLAKFLLLVPMTLNSAGLKVLNPEEGMLPPGDTTTIPSN

SEQ ID NO: 931629 - protein, 128 aa, Homo sapiens
MVKKDHQSVLKAPRTPNLENVADFFDGATCVFSFLFKHALMENDFVWTQEEISTMSAFACEPYGLPGLCVQELDPPTESPFRRLLTQREEMQRGHQGKDVAFQGPEDISQHFIGCIAFGTEHADPLAA

SEQ ID NO: 931630 - protein, 143 aa, Homo sapiens
MVLGESLYEDVHLGIMNIELVCQTIIMEDIIREVNVDGEEKDPNTEPCKIPTRRAWRNEKGASKRNQRVGDLVHEGGRGLRGRTYFPSIATGRKTEYKGLNAGVGGCGGGSLQKVSSHGFQFPQDMEAEWEDRGGGCGHELGE

SEQ ID NO: 931631 - protein, 160 aa, Homo sapiens
MPPSKGISLNGKKCVFFNPPEVPLNDFLFCNDISSQRGQRDKTADLKTFSSAPGGSLGTNSQSAQWGSEIDGAKQHHLNKQNPEGDMKTSSFLYGCETWTSRDIMEDSQRITVPTDELNNTTRVSAPNPPYQRALAQSSAYQASDLGCHLCDICHVRYLL

SEQ ID NO: 931632 - protein, 137 aa, Homo sapiens
MIKMMLEDNGSCCSGCCEQSGLDEGDPQAGGADLRLFHKPGVRGRGLEQDSGDGVEGAELEYVMWDKHSFILRTGHWETNVTGKGSGSRLQERVLGSCERKYLGRESTNIYNLFSLNTATWKPHLHNKNLGLYNPLS

SEQ ID NO: 931633 - protein, 165 aa, Homo sapiens
MNQQQPQEWDLGFILHCVPPMLGPNGYLQIIELIGCSQAVREASVMEQLSFAHPGNVFWNEHLEKVWWFKGKEPKEQNESEGMSLVKTTLQQGRHWRRHLLEVHWKPEEGYSPMHSPAAGLQHNLLPPAMWLNAHRGALTLAILQRSRGQWQLVAAGVGSPQQRD

SEQ ID NO: 931634 - protein, 285 aa, Homo sapiens
MAATGAVEVGSPGSAVAPSPALDLLPALGHLFWPISAEDKEQQPTQIKSLCMNCYRNGMTRLLLTKIPFFREIIVSSFSCHHCGWNNTEIQSAGRIQDQGVRYTLSIRALEDMNREVVKTDSATTRIPELDFQIPAFSQKGGNSFVENPQAAQKDDALVITHYNQTRQQEEMLGLQAEAPTEKPEEEDLRNEVLQFNTNGPECNAPTQTNMKLVQIPHFKEGPSTRTACKFTTLEGLLKDIWELVTKNPFTLGDSSNPGQTERLQEFSQKMDQIIEDLPGYGSHI

SEQ ID NO: 931635 - protein, 164 aa, Homo sapiens
MFPWLKYHSLISSISHFKNSNFFYYTLSFRVHVHNVQIKHTTLQQIILQWLPLTAKLRTSAFVLNSRISMLGLNSFIVLSHCSPFENNNLAKRCFSQEDCTNLSSQTRPSPLLHSQEFVCLPGIPLILSCNICIYLSFNPPSNPHSLGPWSMRTDVTLLFFFFF

SEQ ID NO: 931636 - protein, 161 aa, Homo sapiens
MTWPTSFSCAGCFLPWNIGLQVLQFWNSDWLSLLLSLQTAYGSSASCWVVAEVLRQGSSGFTRAEVLQAGCAHHSHLSSSKRLAPLSHTPTYPRQRISSSGWVLGRDGAEALQVTPLCSQDGATVRPGTRRHLRVSTKIEHPALCYTSSSLQVGQATATIS

SEQ ID NO: 931637 - protein, 302 aa, Homo sapiens
MQEYNDTLQRAERLSVARENFLMGKNNPPNLVTQEDLTIYTKWLVCHLHSLGTVHQYLQALQYLPISKVLSVAFNRVAEAGQKNENVCVNDIDPDIQGSASPDPVDTSISVMKVPPQGPTLEGEEGMFSILTVGTDVVESTCSLSLKVSQKFQSVFMEQQRLQMFPDCEAGIAKADNLGLAGPRMTLKKKANWISFIKVVVFWKVTRNTELANIESLPLGEIELVPVNLSAMTNSDGFRVPAACGWYGVIPDRSTASYSPGTNRNWCCCLLQWICEPMKTLSKSSLVLANLAPKPDTISEGP

SEQ ID NO: 931638 - protein, 225 aa, Homo sapiens
MTLQLLGLEDGTDPSDRNPVLMRGAYLSFLYLCHLRIRELQHICLGILNYFRSVERTLTINTSGLTLVSGKLVPTMEDSSWVNMAKGGLGTLQGLGAHHYVRETPAEHKDTLLFWVSYPKKHPPTPTPSRHTDFLSDLPLPLCPPPWVLAHQAQLVWPSVELERDMGLREEDSKLWQKEKEYVCLYKGFGQWDVDGKSGKMTTNIDDGIKVGILTILLLFISFRT

SEQ ID NO: 931639 - protein, 177 aa, Homo sapiens
MMLIICLWSTELGAGNLKRTKTQYPRLLQECQHQQTAHKVTVFIQGGHQIFHSLTWKCMCSHSHVTPLDDKHSDFVSSLPMITFLQQPSEQSAHKNFQMPEPQQTGVPPKPPPPGACYKCQKSDHQAKECLQPRIPPKSCPICVGPHWKSDCSTHLAATPRVPGTLAQGSLTDSFSA

SEQ ID NO: 931640 - protein, 141 aa, Homo sapiens
MKLYQTHSPTLPPLSPFFAPGFHSVQCLIPSMKVSTSNSLALPSTETQKGHITGPEESMLSETRCSLFRGSWSTLSFPIRNSQFLETTILSKLSQGQKTKHRFSLIGESFHQDNFGVTFLGQGSYLAHLLLVNGAFQGFGV

SEQ ID NO: 931641 - protein, 144 aa, Homo sapiens
MGTGSLVSALLRAASLSYHSCGRAKVFPPSPSFPNQSLHGSRQGFQFHVASPEEHTRFMQFLPHHAGEFRTLSLEAGSQVNAEQHMGAPQKPPSPPAALHEGFGASVQNSHSYVPSSGELRKPYSCIAVAQLYQYSAKATIDNM

SEQ ID NO: 931642 - protein, 153 aa, Homo sapiens
MVVYSNCTSRLSNEDIPILLNYSTLFLAAELPKQCCHFQGQGKGSKRCIFVRRNHHITGNTENRRGERWLTESGLTGGGWGPGHSVRGKRSIDRRRWGHSSPTLTGGKVGIIGTDRSKFMGGGRKFIEFLPDNLDSSEGGVPVKRLLQEVSRT

SEQ ID NO: 931643 - protein, 191 aa, Homo sapiens
MFLLCTDLSVHVPPSYSDLRVHVPPSYSDLRVHVPPSYSDLSVHVPPSYSDLRVHVPPSYSDLRVHVPPSYSDLSVHVPPSYSDLRVHVPPLYSDLSVHVPPSYSDLRVHVPPSHSDLSVHVPPSYSDLRVHVPPSYSDLSVHVPPSYSDLRVHIPPSYSDLRVHVPPSYSGLRVHVPPSYSGLSLYIPPA

SEQ ID NO: 931644 - protein, 138 aa, Homo sapiens
MRSSLSARGPNSSLQGFNMSFGEAHCHPYKESSQNGRCVSIHQSSLKPFPSVCGTKLPHNLTPLSKRQLILWTQLPLRRAAAPLVKEKVEKEKEKLREKGQQRGGRLPLSLRAVSEPRHREVVDWGVGKKNLPTTVQL

SEQ ID NO: 931645 - protein, 159 aa, Homo sapiens
MDSWRQRGLQEISSESRHLGMAGWLWSPMLALRRQGGSDSGKLDTLDLIKRWSCSCCSKSTQSLPDSEGSPDCELNLILHKGPAAPHSKALPGCGPQEASRRNYKEPPAVFLTTRSSCAKTILLISCRGSKMTVGLHVALWSPETWPRAHSHDFPVLLS

SEQ ID NO: 931646 - protein, 124 aa, Homo sapiens
MSECNFDHGHFKAFETGFVAGLGHHELAQSPQEAEPSEMTAFSLRRSLQFTHGLPSISLPWGYKTFHNSDAICRSSWEIYKSCNPGFHDSGSGSNLWKNKLNDDGSLFNSATSSSAKFNTLPEF

SEQ ID NO: 931647 - protein, 123 aa, Homo sapiens
MCMPEPTHRIPELPITNFKYFLYIVKLPLPGPVTNYRSSVTVVGHQEIASPWLQLPIIIFREALSAKDRVLCPMAIKIQACKQFEWQKLGSTGDSLDLPLATEVGEHSCGTEHLTCGVRTNSK

SEQ ID NO: 931648 - protein, 150 aa, Homo sapiens
MREEHSIQMKEMEQRHEINWAWFIRKTPLGMVKGSNGVKPRKKIMDILQNAEKQSMEIGPLKTHLAIQSGMESTSGEDAVNIVEMTMKDLEYYVNLVYEEVAGLERIYSNFGRNSTIGKTLSNGISRYKEIFHKRKRESIDASISIVVLL

SEQ ID NO: 931649 - protein, 128 aa, Homo sapiens
MRDGRPVQETTMAHVYLCNKTAHPAHVPLNLKVEENKEAVGNVRPCRMVHYICKGPSGCQSPPRDQKKAPHEMAAALAIPCSDLQSRFSAGHRDSVCISSIFLGELSTSFPRALSAVIFFPSKIGENA

SEQ ID NO: 931650 - protein, 154 aa, Homo sapiens
MHCRGHQKGTDECGKAPSEELNLSTPLQKQNGPLLEGIHFGPQDGDSRRMASSTCQPLANGKYLQNDNGPSFKAAVTQGGLKSTRHRIPSPLCLKTRILRKDQETSELVKQVTSLAHLQQELAQLAKPQPQEIGPPLFNPGDLVLVKALPSLSS

SEQ ID NO: 931651 - protein, 168 aa, Homo sapiens
MTLTSWKNEIVVEAIYCTLEQKVRPSRGYNKFSYSITDPKLGSASERCKRRRWRPGSSPEMLRRWMADVWVRTITTEEDTDAQRDSICPGDWKPIHGSSKALSLANAPHEGLRVVRPPCLLFHILIPVPERGNPFTTHLKTTRPPLRRPPHRHHCSQLTAHPAYGSLL

SEQ ID NO: 931652 - protein, 141 aa, Homo sapiens [sequence omitted]

SEQ ID NO: 931653 - protein, 194 aa, Homo sapiens [sequence omitted]

SEQ ID NO: 931654 - protein, 193 aa, Homo sapiens
MWRTDKRRGRRKKQAAQHSCWCPFRPRDACQNQHQPLGGAVVAQQALTWVGDKSDPAPGGTATGSLPCHGVPTSLAARSPRPVAASPWEHTSGARCPQRLYWMSPWHRAAPMYPLLSVFSKSTNATAIHVATLTSRGQHPRCPPVHFLTKPPGRSALTCPWLCPHREFSCEIPSGLCKFFLPPKLSLKKFLNI

SEQ ID NO: 931655 - protein, 134 aa, Homo sapiens
MARILVYIRQHSLGHCQWVTLSPLKENDDNTMLLTQGDHKQLSFSALIQPILAFLGLEHSTAFPHNVEGILNGKITNTNAKNISLNRLQKGHLVHSTGADTRGRPFFLTCLIELKSVRAFLWIKPWPTGMLWLV

SEQ ID NO: 931656 - protein, 211 aa, Homo sapiens
MPIVHPWPLPTRSVVLDAFVARDQFHERQFFHGHGAKGAGRSKKEKKLKDKAGRVDHVDSLPSGPECFCSLARTTSLPDKDTDTRTKTQTHGQPVTAWDPLGSFLRDFTQFKVEISWGKVRSDMYNYGHIEGGRDTIWNAGRKPCEAPCEGRTVELSIMTMSLMPEHSFRSQDSCVELPWVRGLPQNYAGNNFQGNKKENMIGSKILSLFY

SEQ ID NO: 931657 - protein, 156 aa, Homo sapiens
MATASSVQMKHLTHSLIVALNSPEYRRAGFLDQGSLPRATGYWQRTARGSTNAWENMLNRKLTDLIVRIRNRNLRVEGENSVNLQDREQDMRKLRLGEVGSKQAFILYTKLPPEKVPQSRTSLGMLSYPWPILRDAAVLPSQRPVWKENGFKAPKK

SEQ ID NO: 931658 - protein, 166 aa, Homo sapiens
MKSVRELLLLLLMVGIHLKWNCIPIMHIVKKSYKVLRLKNKIPSGPYSIFMGTAWNGPDCCDEFEFVAIFAGPYSIFMGTAWNGPDCCDEFEFVAILAGPSRKSKGMSYMGEDKRACAGKLPFIDPSDLVRLIYYQENSTRKTHSHDSITSHGVPPMTHGNYESYN

SEQ ID NO: 931659 - protein, 137 aa, Homo sapiens
MSCFVYLRNTSSSQTLLFSSRKTERENLAVFAVTKGWSQNWAGEDFQHSSPAQQVNGDFDKTIMKMMRGAGSSCFPFILSNFPAALPCGTQGHLQCVVQDGSRPFLMSSINLIPWEKHHDWALGGHLILVIFTGRNG

SEQ ID NO: 931660 - protein, 159 aa, Homo sapiens
MFLELSSMCQKFLPFTEIPPFKDTPWKFQMTLLIIDHWPQVGIFTSGIFTCPHLASEEAGNWSYSNPEWCSHQAAMWPVKESGLHFLEEGNWVVGTLVVCNTGLYQITLLSTEYGSSFSSMFSFKFDVLEKKGKIQGGAYIKKSFPESSAYVSLRVKVT

SEQ ID NO: 931661 - protein, 135 aa, Homo sapiens
MISGVICENSISLEITVDPHAWEFGETQCEYKSSPVGEEVKEPWNGKKRGSLMSRCQVNEKWSLLSELTAQVEDLTCKMIVGVHRPPEGLSSVSCVTHTTMPRKVDRINQVFSQVLQPDLCGEVFSLIQSLSFQA

SEQ ID NO: 931662 - protein, 145 aa, Homo sapiens
MNRKDTISEAPHILASGIGFVRPVSLRRDPKIPSSPQDNGALGKNYVFLIGEPRCLKKAQPRSTRKVEAGSRHTNAPNSKESGVVREPYPRKPDTHVFSLAATLVAFNWPTADSFSVVQTPTYMYPTYVRASTVLAYPPALFASF

SEQ ID NO: 931663 - protein, 143 aa, Homo sapiens
MLSPTTSPGPLVTLHILRQRWSPLFLANCHIAKESQKDQNGMYTPISRFFLSPIWYIDPQFLTNLAALNSIHCFFWFPRPLTPGWVPFSCTKVRKMPFWKILANVVLTSCASPSLKISYLTCYNNVLQCLLIWFGCVLTQIPS

SEQ ID NO: 931664 - protein, 147 aa, Homo sapiens
MAASPQLGPLWHKVSSSFTAQDNPFSNDPPACSENRVGWAALTGIVLALMSWLPTLKVAAITCRQRPLQCSVEGALHLSIPQTVDQGVQNWVQDTVKQGQHFLLLLSLIRVWDYVNHHGYAKEESNHTQVGGAGREGLYAAFLCLDL

SEQ ID NO: 931665 - protein, 241 aa, Homo sapiens
MLLGPNIIWNLGFNVYWESGTALHVSRLLCCSSKQGAWLMYDTLLWYCLAPVIYGVWGGLAFKNQTAMETVLPKILVHSLHWIVCWGKVKPASWYCYLMAKVPSYWNKTSLTVPLYTSNTMLNQSGSQCQSDADFPGHDGRISERVADGHVPIIGHHHQEETFCMCKTQKQKHLGHAASKGDGLGWMQEVHQHLGHRAASTGDVDDRQFVMITSDACLLYSFIAGYLYPCMWKCAGVYVYI

SEQ ID NO: 931666 - protein, 181 aa, Homo sapiens
MLFISYFLSLVFSAAGIFPPLDFKFWVWESVIYLCAAVHPIILLFSNCRLRAVLKRKGRADMLKGLIGSISPTLNIYIDDFPEDSRSRHWQIQCLVRNCSIDGILSWCHSHLAKVMEEQKGKRQKGKRHVGTPFNFFWKYIQGKGSNCLGSSTHMSPPEKAAFSPQVYGGNIFFSSQSPEI

SEQ ID NO: 931667 - protein, 272 aa, Homo sapiens [sequence omitted]

SEQ ID NO: 931668 - protein, 313 aa, Homo sapiens
MANLSQPSEFVLLGFSSFGELQALLYGPFLMLYLLAFMGNTIIIVMVIADTHLHTPMYFFLGNFSLLEILVTMTAVPRMLSDLLVPHKVITFTGCMVQFYFHFSLGSTSFLILTDMALDRFVAICHPLRYGTLMSRAMCVQLAGAAWAAPFLAMVPTVLSRAHLDYCHGDVINHFFCDNEPLLQLSCSDTRLLEFWDFLMALTFVLSSFLVTLISYGYIVTTVLRIPSASSCQKAFSTCGSHLTLVFIGYSSTIFLYVRPGKAHSVQVRKVVALVTSVLTPFLNPFILTFCNQTVKTVLQGQMQRLKGLCKAQ

SEQ ID NO: 931669 - protein, 194 aa, Homo sapiens
MYTPWKRGIYAAVEKNEIMSFAATWMELEAITLSQLMQEQKTKCCVFSLLFKKCLAAALCGPCPGSSPVERGRLCAEEPIRTLAGESKIPFGVFLQSPSCVLESSKRERSSIEERQVVSWHRGAKNIDKVVNAIWFQDIADLAFEKPVRKPHPFPSVCKIIADMLSNLLLQALFLNQGVFVGLFPIHIVVQLRC

SEQ ID NO: 931670 - protein, 138 aa, Homo sapiens
MWDGTQCPGEPSPPLDEQFVIGTIYNFVSRSLQVVHAEELPAGFPSSQVIQALEHSEKHCEKFCRMHMLNTEGLERKEEPILVIKGQRGPENLRACSAMLLALSLERRHCLTEGQSSDDPGERTRGASGILKRSISFC

SEQ ID NO: 931671 - protein, 137 aa, Homo sapiens
MSSSLLTHLFSNPSMHLSSQTLQYWILEYNNSQVETELETLRESSGHTCIQDPPGLPGQAVTELNPGGHREDSQEEKWGWDLIFVDRILIQYPLALLCTGHLPGRLVFGRKPVGNRGLHENSELIGQSGLGVDGTGA

SEQ ID NO: 931672 - protein, 145 aa, Homo sapiens
MALGLAQGPHCNHNLGIACIYSGFCGSTISWCPSLKVDEFPQAPGKGASPHGHHHHRPTGSTAMLLSMFSSGPRNLQSACKCYLTWDSPFIAVSVPLNVQDPRPGIRNSKSPLGAIPVAKLVPNVQEKVLIAFPPAFLKQKELTS

SEQ ID NO: 931673 - protein, 146 aa, Homo sapiens
MERENILLKTKQKKINCKQTEPLYLCSLCFCYQVALELWLLFLAMIVGKWAKDLNRLSSKDDTNGHGYLERCSTSLIIRSGSQANWEITNNITLRELVQKELNEAETKKSKYEKTIITYRESERVGISHLQDLRENCALVSVKNKQ

SEQ ID NO: 931674 - protein, 164 aa, Homo sapiens
MAVLGQTRSQHSTGSHLEPAVMTPWLLSMFAQGSTALLSAGGKASQTLSFPSGWQAPPGQGDMKLKPGDRGPQAPPPRCCHRAHMEYAPARAQKRWFQLLHLLNCVLPPTRGGTQWVRVRQLMGFMTRTAGRVYGPGVWVHRCGVGDAPPSSTIIAILGVLHIA

SEQ ID NO: 931675 - protein, 137 aa, Homo sapiens
MVSHHQHSHTQSRECSSLHSDLSPEKRNKEEKGCYQSLGVVARAEDGPFWTFSASWDLRRKNYLVGDGATVDICLPLEVPPEAERENKKHPGFISASTLFPLAESLQKSERKEPGETVPRDTEQNRGSQETDLQTGK

SEQ ID NO: 931676 - protein, 142 aa, Homo sapiens
MHLLVTLVEKHVYEKTTDFFFCCYSRRFPRSSYCHLNSRCRSSEQMPPEDFCAWKISVNRLLLHLHEETEAQRVKVICAGLCEELVAELGILALGSAFGHLTVQCHRNRKLEKINCQAVFWSQYFNTVTISSMICGTHRCAL

SEQ ID NO: 931677 - protein, 130 aa, Homo sapiens
MADFSLQTFVFVHKPADTNQGTSAHRSVWPLEMSVQMDTLETCANDHVGKEHANRHGGNERANAHVGNECANGHIGNEHANGHVGNEHANGHVSGRQVVKCVQSPSFYPMISHVGIYLTHILTRHMHDDV

SEQ ID NO: 931678 - protein, 463 aa, Homo sapiens
MEPRRLEPAHLAQLLLFAPDADEEQRYQAFREAPGRLSEPDQFVLQVPRPQPRPEASAGSTGAVAVARAAGVPRAFGGRHCAQASESQFNTFNGRVLSGVQVPEYKTRLRSLHFQATLQEKTEEIRGSLECLRQASLELKNSRKLAKILEFVLAMGNYLNDGQPKTNKTTGFKINFLTEVRGPAGSNRLVCSTSKALTPGLAQLWQRAEEDILNSTKTVDGKSTFLHILAKSLSQHFPELLGFAQDLPTVPLAAKVNQRALTSDLADLHGTISEIQDACQSISPSSEDKFAMVMSASSEQPVPAPGWILGWLDPGGTSGLAVSLTEACQSFLETAQPALRALDGLQREAMEELGKALAFFGEDSKATTSEAFFGIFAEFMSKFELRDGFTPGLVTVATPRPLRPEQGDGGREGSPDTAEVRGHCAPGSEHTASLSCSYLSRRAVVGPSSASPCSYPQAQSQML

SEQ ID NO: 931679 - protein, 168 aa, Homo sapiens
MGQCRQSRAPLVHMSIYIERGGDMHLGLTGAAFLSCQVTGQCREVESDITPFYATPPQDLAEGNLQGYCNLHARNPLGTWIRSGGALHMVVLAAPPDSYLLYTQKFQSKGNLFFKQCQPEAWTDSEPHSQSHKIIFIQSLQLQALGNQGWPCHLDGQQIVAEGTVYQL

SEQ ID NO: 931680 - protein, 165 aa, Homo sapiens
MAMDHIWASPCYYTLREDQCSSTHPFLAYFDVLPNNGSTSLKHEKPKPIYQTGGRDTVTNRDFLGQTGTYSPHIFSLADMKNLKEKNAHFSKILTGSSMYHKKEQDHVHCRDMDESGSPYLQPTNAGTENQTLRVLTYKWELNNENTWTQGGEQHLLGPVRGVWG

SEQ ID NO: 931681 - protein, 154 aa, Homo sapiens
MHSTSAFTLAGCSSTVSLTAKMEGPAGYAKAGEPLRKLGTQVRKLMVPVPAAGNRVDCKEDTWVWDQLHIYCRGPGGAQRGPEGNGSKNGKKVHLLNGIRERGRKGGGERERESEREKKKKKKKKKRKKEEEEERRRRGGEKGGEGERERERPH

SEQ ID NO: 931682 - protein, 143 aa, Homo sapiens
MQILRPQPSLWIRHSRDGSPKCVSPGLRSGSATHGALGITGPKKQDLSWKRNVTEIMKAAHYLKLSKKTHLADQRNWENGGSNTSGRYTTFISSGFVLLAYVVSSLGYHIPPLRSTANSDKVLIFQHQCPTFIIFLLWIHKVR

SEQ ID NO: 931683 - protein, 200 aa, Homo sapiens
MAQSSSRAASLPENCCTVATYTVFPPVSLATLPTLALEASCPGGQRSPHLRCVQLCIFPRAWLEEARCWSHCTASSLGKPHGVSVGEGNVGFLLCISSWYCDVGQSGACLRLQGTLSCLGLLTTPVGIQLWVGEMSLKEGHCDPECQIGPDDWGLKPHVKARTHGWSHGCSFHLLLGSLSVSQEVEGTSTFEAASSSAGC

SEQ ID NO: 931684 - protein, 169 aa, Homo sapiens
MVGIADGIALCNSGKGSRSIRQRYLFCSTALKIDLYANAISSLIKYLYNKPRNQHNTNLMPSLCLPKLMMFWMEMLNLLYYKKGVKQKSRCVASPFFLPSFFLNALQEEARDLTSYSQRLLNLSQEKMITTGLRGLALRVKWPFTVDTDLSFGHITAPTSVLLSGKYGQ

SEQ ID NO: 931685 - protein, 174 aa, Homo sapiens
MGGLLWKHSHWSSSSRPAVELSPGVHWDDTDIKRKHKTIILAMLFNSFLPSPSPSPSPPPPPRPPPPSSSSSSSTSSSSSSTSSSSSSFFFFLVHAVPSYHPHGGTLAAGDFPRPPLLHLVLLSEAAAPLGMRRRSAASSFLSSSDRAEHGGCQAGVLITALRPPGTRVVWIYI

SEQ ID NO: 931686 - protein, 164 aa, Homo sapiens
MLHTHTAIGSLTTAGGELFLKRPYQLSLLGGVGDLKPEARNNSAESSPVSTSCHTQHAGLPAVIQNKSTSLGHSKRRSGPRPRYPSIRSPELSVPRNYPHYTYKSIQLVLVSNEAGDVTGLPSFLQTLNTLEKQTHKGQETKTMLRLNVLINLVYKDKGSYGCD

SEQ ID NO: 931687 - protein, 222 aa, Homo sapiens
MATVRIVLHSTFHPLGSSPLRACNGGVARFFGALLLISLGGACRQAGRGEHRPHGNIQAVQLLLQLAGMFLRKPQYLFASHQPLHESDNLAAVVCFKRETEHKSLKSLQPDNVIEKKISFSEKKFKPYAEICISNDESMLIPKTMRKMSPGHVQGLQGSPYHHRTGGPGSPCCVQPRNLVPCIPATLALAERGQHGAQSMASDGASPKPWQLPCGVEPVNAQ

SEQ ID NO: 931688 - protein, 142 aa, Homo sapiens
MWPMEADTGAMKLPGKDGWPLPAQRRGKEGFYTEPQGGCSARLDALSENLTRLALASRGLAPPWHLGEASLTPTWFWHIDITFSKSRFSDSLQTYWIRPSKGGAQPSVLQGALQGVEGTHGAHVECGKKPEMFRPRNGHHFS

SEQ ID NO: 931689 - protein, 135 aa, Homo sapiens
MCFFSGISFPLFLCPLTSASAHQHGHPYVANTNSGAHANQASALPACHRHTCILTGDPQGKSESSTPGTWLHGSSFCISLLPCHLTPECVSFLRVENQDSESTGSITLKTDPLGPGSEERTEALTSGSCTMFLEL

SEQ ID NO: 931690 - protein, 148 aa, Homo sapiens
MGARLWTPALTIPCHCLLPSLLHSPFRPAIPAAFSFPTCHPCCILLSDPLHVVFIPYTSSPDQQTHGSRQGDINRLKYSHTNGSPWPNNLKSSGQRINRFPNNRSSSPLIRPYASPEEDKREDACKTYLVTECSFHGGFYRLVFGMFC

SEQ ID NO: 931691 - protein, 118 aa, Homo sapiens
MSIFIMKYEERSSGGRGRWKFRTGKPWQLKGFPGLRSRSVPYLTYSLNSSRMSTAGFPFCQVSLQNPGCKAKLKILLAAGLLRAFNTLTWIVKSQKYINCVVDLESTEKHWTKTSTLL

SEQ ID NO: 931692 - protein, 130 aa, Homo sapiens
MAQRPTSVTTGIPLSLGNSKENCYISYFRKTHLPGTMERQVLGVESRLKGETNKLRNSKSCVNQYWIGAKVIAVFAMKDNWESMQQDAGSAETPYIKIILDGFNRFCTVQAKMKYEDGVVEDDLDDTRKW

SEQ ID NO: 931693 - protein, 155 aa, Homo sapiens
MTMTFLFAKAELDQNSELLSLISVPVSVTQLLKSSCFGLDLSILLSVAPAPMRLDPEDKTGPHPTSSQGASVEMPSLHCTGLHHPHKKHPGISSRLYNHPSVNGTLVHKSRCCLELFCLPLCSSSARGREVLIAEDFQKVPLVKIINARNGVPGF

SEQ ID NO: 931694 - protein, 141 aa, Homo sapiens
MSPCILPLILCSSPPTPSPAPRHSNFIVQGAGLNQNKAAHEHSTKQYGTEVPAPKDLPAQERRGDGGGEAMGQNDPACPSEGSQEEGQMAMGTPPVHGPLTIKNVAMGFSRKNWDHQALIKGVYTRCEDGRSVPGNISFPN

SEQ ID NO: 931695 - protein, 154 aa, Homo sapiens
MQAAVGPGYLYTSQLDPLPVARTEGFLYPGFLPWCTGRIESHVGLENECKVLSSGSSSPPMGEPEGRWFFPGVPPIAPAKLCLVLRVVRPARVRVSLCWCVLLPACSPRCPLDIQLLVFFRQRVPLTNSIVHMFNTLTSSHTDDNLAVSILLLL

SEQ ID NO: 931696 - protein, 198 aa, Homo sapiens
MSSSGLRFLTLTGKQPTSRALFWASHLHARSIQGTTLGAAPQSPGCTFSTAPTLLASRFQGGGWRQQGEDGESSGKMTRPRHLCADMLFSTRTAQGVLKCVSGASGGSLGVCLPFWPLLPPGAPVSPSCPGGPHAVSIHHAPVLQGGPPILTDYLSKSSQSAAGYRSQVMYLHFGLSGFKAFTWKEPMASGACSPVAL

SEQ ID NO: 931697 - protein, 154 aa, Homo sapiens
MMGLLFLHSTQHLLKACPGQMHCTGHRGDGGNLEVYNKGCPKDLVSSLDHSFVTQWVKSAQVGASDSPFKMALPFRATLLSPANTTTLLPSLRFSHHEWTPFSSCSGSGIPVLAATPLIPCVGDYLAWLYLRAFGLSYSGRKKGSEKRKALSYF

SEQ ID NO: 931698 - protein, 321 aa, Homo sapiens
MRDKHSDNRSSVLESSESYVRDKHSDNRSIVLESYVRDKHSDPSSIVLESYVGFKHSNNSGIVLESYVTDKHSDHRSSVLQCYGSLSVGQTFRPQQECSGTLSVLKSYVRNKHSDPRSNVLESYVTDKHLDCSSNVLESYVRDKLSENRCSDPRRSLLELHVREKHSEPTSSVLESLATDIHADISSSALGSYVRDKLSDGSSSVLESCVRDNHSDPRSCVLEFRVMDKHSDPHSSVLETYVRDKHSDHSRHVLESSVRKKHSDPRSSVLESYMTDKHLDPSSSVLESCVRDKHSHPRSSVLESYKGTNTQNPAAVFWNHM

SEQ ID NO: 931699 - protein, 291 aa, Homo sapiens
MKALSKPMVLPRFSFSWGLDPVKTQILSQGWEVNPSKIQGPAQTVKFLGILWNAGKQSILPKAKAKILEFAALPLKRRSKIVLVCLDSGDIIFPTWVTFYNLCMRSLENAMTFTEDRKPRSCQRLAKLILFEKQLLTCYWALQETEHLCLNHDVFMRPQIPNMTWVMSSLKPHWIGYTQESKWKWHIQDQAKPEPKQVSFLNEDVQNLPAQQTTEQVLQIGKETSPAQWGKSFKEPSPDDQRHAWFADDSTKYIDGTRCWEAVSYNPVKNISISEEGRGVSSQLAELESVL

SEQ ID NO: 931700 - protein, 145 aa, Homo sapiens
MMDNHCFFLKRLSTLWLSLSGTLGIIDCIFFFFCELRFLLLFFYYLEINLYLSIFSFCCDGLNVYVPFANSYVDNFRRVAFGEVVRPRVLHPHEWNQCFFKGKRFSPKNDAHPGQRTQHSDPCTGCTEHTRHWVNQEQSEQHCLA

SEQ ID NO: 931701 - protein, 125 aa, Homo sapiens
MKDLNRHFSKENIQTGNKMQRYSILLGNSSQNHNFVLTRMATEKPKTEYKLWQGGETGTHTLLAGNKQKPITPETAEKLAHDLKIVKYVECSALTQKGLKNVFDEATLAALEPPESKKSHRCVLL

SEQ ID NO: 931702 - protein, 152 aa, Homo sapiens
MASAGLLSCHFTKEVPGLPGQCTRRRPGAAQRGVLFSVGGKGDSQPRLGVYVDNLLLPGASCPGFEVREGQDRLALSGQAFCLIGTRWCGEGVQAAAAALVLMNGAQPTRGSSWDQIGRCWPSFPLAHYSEAHTRKTPAGTPAATLLLQIYM

SEQ ID NO: 931703 - protein, 123 aa, Homo sapiens
MGRSESCVIVCTHTCAHRAGRAWHLRRGSEVLLGWPLSWEQGTRAPCEFSPCQGMPEAGLQLPCQRVREAGPQLRSREEKGGAHSWSESLEPTGSDLPQNELERVWGWRTLGMLGVVQSKPHP

SEQ ID NO: 931704 - protein, 260 aa, Homo sapiens
MVKGILAFPRSQCRLPLMAEVRVDLGTSKPCSQERGVCSSITTDKRGDSYYYFLGPGTSNSNRLLSKRFGKCAGTFLLMDRHTMCGHTKTPNVATQRVIHGPTSTAWPGSPFPTDECDHQLKWEFKGHKIKSLSGSFTKKESYSCSALPSGSGEETEVQKEGVYTNVHAEVHQKYTVASGALLFTLLRMYVCSIVENSFLFMFISDVWSGLSPFVKTGTSALCQTALMLARPKEESYHAHLFRALTGPYSHSDITGHTPV

SEQ ID NO: 931705 - protein, 137 aa, Homo sapiens
MPASISQSGSFILIEQFGNNPFLKSKHHTTKRNCPNKLCQNSGKWSKDYNNQVKADSRKRQLENFTTFLACLCLSKLAVLKCQKPTFPVRKPGPSSKGTREDLTRKLLCVCSDWEFKITKLTFLKECIWAFNKYVNP

SEQ ID NO: 931706 - protein, 196 aa, Homo sapiens
MNALCSDKETVAPMSYLLGCIASAHAGLDAAQSVKGAEGSRTPRPGDNANAGRGWRSSERHNLRQDGDEVGCTEKIFRGDGDDKDGDGKVIMMVMMRKVMVKVVIMIVIVMLRMMMRMVRMVKDGDGESGGGDNDGDGEGGDSEVGDDTDSYGEDAAADAGENGEGETDDNDDGDDPKLHGGKEYTMFIVVSSMPS

SEQ ID NO: 931707 - protein, 155 aa, Homo sapiens
MDTSLQSDIRPQENISPPVDISFQVDIRPQVDTGLEVYIRPQMDIWSLKAPGVQQAQVQIKAQVTPCPRWLPRLQVDIRPQVDTWTSGGHQALGGNSGPRCPSRSKWTPRPHGDTQVPGGHWAPDEHQAPCGYQNLGGHPALRWISGSRWTSSLR

SEQ ID NO: 931708 - protein, 170 aa, Homo sapiens
MVKLLVWQKSVHKLWKLLEKNETTSFESLTSANGSTFQHVANAIHFPPLSQEKLRHNYTILPLYTFCACVLVKTPGSKWTTRPQADVYWGQMSTRPQVKSPGSKWTAWPHVPGRHWNPNQHQAQDGHAGLWWTSDSRRSSGLRWTSSPRWIPSPQVDIRPHFDTSPWVDT

SEQ ID NO: 931709 - protein, 167 aa, Homo sapiens
MVDSLTSCTMSLEKLRTLNISPTQHQPMKTATRWAIPCKATGTELPKAAVTAIGHDSFDGSGQSQLETFWKGFTMIDATMNIHDSPEEVKIAALIGVWKKLIPTLINDFEGFKTLAEEVTTVVVKIARELELQVEPEDDLPRGSGKLSRTVHLKHEPAAFVHLSHTG

SEQ ID NO: 931710 - protein, 390 aa, Homo sapiens
MVLKMGVFLLKFFLPATMHVRHDLLLLAFRHDCEASPAMWNLRTCDICLSVLGLFKITAFSSIHVAANDMMSFFLMAKQDSIAYKYRIFFIHSSVDGHVGGFHIFAVGTSAMINMSACFINTLPPFEIEAQLTSININTDLKTDGLFKINLFKCLTDFLFIDTSMPFHVKGCKIYHLLYQAPWATTSHPQARPLSPSLVVENGCGKQVFLLCSDNASPEVSTVALASCPGTFPRHCGAAESTHICATGLGELTPQGHGECQGSYGYLSLHHYCYCHYYHYCHYHYHCCYILKSLLPLLPPHNNSYHHHSYYHYSYHFYHYYYNCYHHHYHCRHYYHPHDYYHYHAATTPSTTAITFATTTTVVTMITPHTSTTTTSVCRESDTLLNIYSI

SEQ ID NO: 931711 - protein, 240 aa, Homo sapiens
MLLLGNLTAWSSRPLCVSGVWILGPEGPGEKSSGGLGGSGKRLLPAVDLISSPMDSHWTEQDHLSLPLDPKGDQETGSRACVGKSSVRVSLGVNTPARVGKSSVRVSLGVNTPARVGKSSVRVSLGVNTPARVGKSSVRVSLGVNTPARVGKSSVRVSLGVNTPARVGKSSVRVSLGVNTPARVGKSSVRVSLGVNTPARVGKSSVRVSLGVNTPARVGRSSVRVILGVNTPARVGRSSV

SEQ ID NO: 931712 - protein, 142 aa, Homo sapiens
MPPSPPQSSLLTKGEDLLFSVGEIFVLSDEGGSVDTLWGEDKGGSRVPLALSLGLLPHFPESWLLPTLPPTQTFIPSALRTCWVHIRRKNLGNAIVNIGPGKDFMTKMPKAGAAIHGVIGNLQNGRNICKLCIQQRSNIQHL

SEQ ID NO: 931713 - protein, 134 aa, Homo sapiens
MNTSRVISSPTPSLCFLHSLEAVPRSWMFLVTFPLCPLLSHLELHATPSCCTEPGPRCPLRGKSLSSHGFLLVPFPQTLRNNYTILIPNGNWRHGAYAGVSSFSRGRNGHSGLHCMLVDLGECDPSKPCENLHD

SEQ ID NO: 931714 - protein, 337 aa, Homo sapiens
MGPLDGELHHGTPGRRITPWDPWTENFTMGPLDGELHHGTPGRRITPWDRSMENYTMGPLDGELHHGTPGRRITPWDPWTENYTMGPLDGELHHGTPGRRITPWDPWTENYTMGPLDGELHHGTPGRRISPWDPWTENYTMGTLDGELHHGNPGRRISPWDPWTENYTMGPLDGELYHGTPGRRITPWDRWTENFTMGPLDGELHHGTPGRRISPWDPWTENYTMGPLDGELYHGTPGRRITPWDPWTENFTMGPLDGELHHGTAGWRITPWDPRTENYTMGPLDGELHHGTPGSRAFGLNCTTSLPGAPACRGHITGHHSLRNSVSRDKCMTDAYR

SEQ ID NO: 931715 - protein, 138 aa, Homo sapiens
MYALINNVSAITPYHCQDLEVELHNLHPELSDSMGAVFIPELSLGLTGTALEPGLGSRVKLGVLQELAWIQSEASEIPKSLKCRHLGNDASEGRKNGNTVEKNWQMENRKVLSICINKRLWPSEQVTLSAKNTIWTDQ

SEQ ID NO: 931716 - protein, 269 aa, Homo sapiens
MSKRGEQLGQPLRTECNLGGEMSEDDEFIAKEMPWVVSPFQRHLHCLQHGKIGDIQQGVEELELDAGILLCQKENPQEIRQPRRRTHRKFSSPGEPTGNPAAQKENPQEIRQPRRTHRKSGSPGEPIGNPAAQKENPQEIQQPRRTHRKSGSPEGEPTGNSAAQENPQEIWQPRRTHRKSGSPEGEPTGNSAAQENPQEIRQPRRTHRRFGSPEGEPTGNPAAQKENPQEIRQPRRTHRKSGSPGEPTGNSAAQKENPQASQLLEEDAT

SEQ ID NO: 931717 - protein, 161 aa, Homo sapiens
MYNALCKTLQRGCLVLQIFEIMDYSLLMFVKKLEHSWKALVCDGDTVSVHRPGFYTERFQCFMCNTAFKKIPARCPLHISQLPFTSPPTCAPVLGNGLLQSGLCFSQACAMKTSMQGAPHSILKAACGFLGDAGNRELKIEESMSVWVPGLMNGMEKTPLF

SEQ ID NO: 931718 - protein, 209 aa, Homo sapiens
MCPSTATKWKDGTSAYSPISQAKDQKAELCFGSYGKRVTDEVLRQCGTENKTVYNDGIVKHCTLKSPTLSCQSVGVSPPDLFAWVSAVEATEQRILVNSKCCCLIVPLEASSQRGTQPCEAMPRPALAHARWAASTVLPPLSEEPQPYSSDSLPCLEMSLKEAGEQQRWMPAPSSVTSDLKGHQPDAIGLLLYRVCDYPCWRVLPSWVA

SEQ ID NO: 931719 - protein, 140 aa, Homo sapiens
MASSSICVPAKDMIAFPSNSEDPQLQVSWSLLEVHSRPFAWVSAAEAAEQRILVNSKCCCLIAPLEVLSQRGTQPYLRLRVGSNSTLFQAVKQGHEREFPDPLHFLGEVMPRLASAHAWCAAPTVLHPLSDNPHKTVLKL

SEQ ID NO: 931720 - protein, 134 aa, Homo sapiens
MVKKRRPLYPVDGNVNQYSRCGKPIWRVLRKVAGPTCYLLPPGVRAAPWFLEGTHQGTQDWKPRMASAARDEGQGEAGALQWPGKVQPLRPRGFLFRRCRCSGSPGRRWLHRLHIAHGRLSKVVKQRSERGNGT

SEQ ID NO: 931721 - protein, 333 aa, Homo sapiens
MESHSRHSFVYLMSWCYVEESLIVSLKVSFLILSFLDHTFNVFLAQMALIISDSNFILFSCTFVHSRDTEDTIGINVKSDFNLRNTLGFRRYAREFKLAKQVVILGHGTLTFINLNKHTRLVVRIGNEGLCLLGRNGGITVDEDGHDSTSSFNTKGKRSDNNRGYLLWIEAFGLSLVFYLDLGPVSIIHYHEGPMLHIRLDNSIIKSASNQTFGIKNCVGGVHCNLMLCGITNQLFSVHKGDIAWSGSVSLIIGNYLYFSVLENTHVRVGGAKINTNCRSLGHGCWHVALAPIKKKATGTRELQASGREHRSISHFWGSVTVMAAGYLSDESS

SEQ ID NO: 931722 - protein, 141 aa, Homo sapiens
MQGQCLLLLTELPYFIFILRGLLDGFDKNTVSDMVNEIQAEVVSDGNEECVGNWSMVWEPPPRFHEMYGNTWMSRQKFAAGVETSWRTSAKAIWKANVGLEPPHGVPTGALPSGAVSHSSPDPKMVDPLTACTMHLEKGGS

SEQ ID NO: 931723 - protein, 145 aa, Homo sapiens
MVAFMDRGCSHFMDRGHASIHGIDKTVREGSRRASDPPHRCLYQMFCADKGTCKGGLIKHASSRLRAHMHTGGIGWRHQEFSPYTNKEVSPISPNKKTYYFLPVPCGKKFKFSKFYKGCNFRNILPFIQEVLEYLLNANHSFLDV

SEQ ID NO: 931724 - protein, 155 aa, Homo sapiens
MVTLTILSLPIHEHNMCFYNFFQQSFVVFFADIFHFLAAFKHLFNKAHLAPPLIHLTLSGHSTCFREHRVGGKVTDQQDPKAEEFFLVQNKMKSLPSLLLSTQTRQPSNFSIPSPHFPPFYSTKPPRSSWPVLNELLGTPPRRGGGRAEGLLTSQ

SEQ ID NO: 931725 - protein, 148 aa, Homo sapiens
MGLYNQQETKPARFVSFPAGRCECAESTFKPTSLSPTQGPQHSTRVLPLVRQGPWALQLAEAYNPLREIDKKIYGDNSVINIVREMQYEKDLTPPHLLANFEDGRRGSQMPVAARSWEEPSAYMQQKMVTLVLQLQDLLKENAALQTP

SEQ ID NO: 931726 - protein, 412 aa, Homo sapiens
MFRSPSIGKGGVPEEGIVIIDDSSMCVIAPDDLVVGQDAEVDNSDIDDPDPGVCMEIVRKGDSHCGGGLSAAGSSPAAEGLSLPLALSLGLVVWGVLLLGGHVGHEVHHPVAVAKFIVISGNELDKVVVEGNASPRIEGGRMASQVHDRHVGSGNMEGHASELPIQLRDDLAYTFGSSSRCRDDVLISPQPSYHSFPEGPSTVFWMAVTARTVVMTVGGTGCIADNLEALILLLMVHNHNEHGGISRGGRDDDPFGSLLQVSPSLLHGGEETGGVHYVLSTSITSFDFGGISILEDDDGNSIDDKLPVLSLDAAMAFATGRIILEHVHHVVEVNEGVIDGDSIHFTRVKSSADDQVPNMAKSIDLGLYFHHSVSGMPMALHEKMQLSVKLEEQRAYNFHVELFYVNFIVTLV

SEQ ID NO: 931727 - protein, 144 aa, Homo sapiens
MSTFTCVMTVAVSITGFAVGSHDPPTLEDPYTNYEILMKNQTTPPTDTVFPICWHEVFMYVCFDELPAFQGVGHCVDLGAGAMTATPGPAFAVTLQPSEWMWLNIYHLKLKYCSQIKFSPTGYQYTSLIISFIRLLSADLLNDM

SEQ ID NO: 931728 - protein, 145 aa, Homo sapiens
MILFWIVKRPGGTAINKPSAIRVRNREEGNVGKWGERQVDQRDAVMRVRCGIWNNVGGRIEVQARNNGNCGRLNKELPRQSGIVSLQLLSQEDLGRSQSESWARVPGALGVAASPHPDIPLPNTNTFSLLSSFQKMPKIAEGIIY

SEQ ID NO: 931729 - protein, 150 aa, Homo sapiens
MSLEEAGEQQRWVTAPSSGISGLEGTDLMPVGTHLNRRLTTPVGWSHPVGWHREEDTFNQALRLSLGGGETVAAPPSRAQAQGDQHSVSEPLVGVVGVPAGKPHPVRRDGSGSGLKRHSSHSLPQLVCWAVGKTSWDQAVSLSGSSRGKA

SEQ ID NO: 931730 - protein, 160 aa, Homo sapiens
MESFYEIEWNYHRMESNGNLEWNRMESSSNGIEWNHQMELNGIIIEWNRMESSSNGIEWNHQMESKGIIIVWNRMESSNGNQWTLHQMESNGIIEWYQIESSSNGIEWNHRMESNGIIIEWNRMESSNGMEWNHHRMESNGIIIEWNRMESSNGIEWNHH

SEQ ID NO: 931731 - protein, 147 aa, Homo sapiens [sequence omitted]

SEQ ID NO: 931732 - protein, 130 aa, Homo sapiens
MGFFSQRWQHCERKTEAFKTAKPQTGTLSWSHVFTALSKQGQPDLGFGKQILDLNGNSCKNPWQRATTLIRKFKVYRVTIAFTVKSATDPIIGDKFLTIASFTLNHGKKDLKIMPIQRSNGFLAMLPNQF

SEQ ID NO: 931733 - protein, 142 aa, Homo sapiens
MSREDGGERSGPSAASLLEFAGGPLPILLAWVSSAEAAKQQRLLTVLSSGSFNPEGHLPNASQSSPVRGVSQLVYTGEIFWRKNDLIVQILSVKKMAVMQERAHHQTDLKPLGKKIIFTLLFERCIWNEIGHFRTSGLPASC

SEQ ID NO: 931734 - protein, 116 aa, Homo sapiens
MQITVIVLKTTGKRRDWELVREKGKSCRQSAIRNIFQRGVGTIKAGAGLQQPAGVTFFSDLHKGTVWTSSSPVRSCVGHYGGSCVLQTEKPSSDWVLLTSTFQGCTIEHVRFRWAK

SEQ ID NO: 931735 - protein, 151 aa, Homo sapiens
MDQSAGSGSAASLLKPARPLTHQKEETGNTTEHQKEQTLDALPFRTVTLTARGPRGPEGVPGERGLPGEGFPGPKGEKGSEGPTGPQGLQGLSIKGEKVLYNRVYTGNNANKIVIVLYVIWEQVVIGYMILKVLCVFLMPLRPHNLAPTYE

SEQ ID NO: 931736 - protein, 220 aa, Homo sapiens
MPYVSFLFEELQITLFLCFHPQSFVRELDHHRKSYDPLQSLGVVELSLIFAQRRSNLDLGLGPLNHQVVGISLLAEKTCWIVVVITEGVTGDVGKGLLQFHSQTAEVFALNDSWKKVYGKGEPGVRGPPGPSGPRGVGTQGPKGDTGQKGLPGPPGPPGYGSQGIKMVFKVLRLDEDVWRVRVYIEEKKSKDWALGPPAFGSLYDEEDLAKKAEMEWPVG

SEQ ID NO: 931737 - protein, 145 aa, Homo sapiens
MACLTWLLAGDLRSLPCGPILGLLGCSHNMAAGLPPNLIIKDKSLATTCGKVGLGPSKTPKDQIFIEKVKKQHPHVSLFLLVHSFMNFPFTYCPEHSQHKVDIGRGEKVTWERAVLQIKTYLVIGKEVPPPLHSHHHPKPHHGVT

SEQ ID NO: 931738 - protein, 382 aa, Homo sapiens
MTSQEIPVPGEFRQITISKEAFTSEKNNECNKPEKSFSLDSTIDADQKVLRIQNTDDNDKNDMSFSQNSASGKHEHINLTQDFQSSICKESLMDLSLLNKWDSIPNTEESYKCDVCEKVFHQSSALTRHQRIHTREKPYKCKECEKRFSQSSSLSRHKRIHTREKPYKCEASDKSCSPSSGIIQHKKIHTRAKAYTCSSCERIFSHSVHLTQHQKIHKEMPCKCTISGSDFCHPSYLLEHQRVHHEEKSYEYDEYGLAYIKQGIHFREKPYTCNECRKDFRLNSHLIQHQKIHTGMKLHECNEYGKAFSQTSCLIHHQIMYRKEKSYKCNEYEGSFSHSSDLILQQDVLTRQKVFDCDVRKKNSSQRAHLVQYRSIHTKENS

SEQ ID NO: 931739 - protein, 138 aa, Homo sapiens
MAASKLAQRAAQRSVHGSRQPYSQKSSAVLARLQGGEGLRAQDQHRTAGAVTRLALRELPGGAERPEASVLVNSWQRLSRWKRGERAGTAPGDPAVDESPGHTEGKSLKEEANQWMTPGAPLSFFLSHWLLQPITTPF

SEQ ID NO: 931740 - protein, 142 aa, Homo sapiens
MARSAATLRRFTALDPKSSGPQTPQQDLINLAFKVYSNRKKLQFLASTVRQTPAASLAHKNFQTPEPQRPGIPPEPPPPGTCYKCQKSDHQAKECLRPRIPPKPCPICAGPHWKSDCSTHLAATPRAPGTLAQGSLTDSFSA

SEQ ID NO: 931741 - protein, 154 aa, Homo sapiens
MHTTPLNTLCMLPLPNADKRHRHKWRDVKRAEEHSNRHQQTTSGHRWLHDVEFGWGQLEESLAIGRPDSRGRLPSHSIPLGAPHASHESYLHHSIKPCTHPPSPRVIRLLGRMAKYQKEPLTFTVSYQEVNWDCGLSKQDGKIEANTIYYHPPH

SEQ ID NO: 931742 - protein, 134 aa, Homo sapiens
MLPLLELAVVEEATADVVEIARETEVETEDMTELLQCYNKTLMNEELLLMVEQRKWFLERETSPDEDTVKIIEVTAKDLEFSINLADKAVAEFERIDCNFERSFTGEPDSADKGCGSGTCVIQKPLVHSDAHGP

SEQ ID NO: 931743 - protein, 151 aa, Homo sapiens
MVYDSEYLSCTLQVIITQAHSSASVLRVKKPLVSRESSEKELKHPNSAQFHFYEKPLDRSFNAGVPNPRAMGLVLGHGLLGTGPHSRRLAPLILVGWGRSPNTSRTWTQADVQTFDTIVRRNLRMNPKIMKVGRFICKTKLHTQEKEVQAY

SEQ ID NO: 931744 - protein, 210 aa, Homo sapiens
MECEASSILCSTFNLYEINIFSFQAILIPLNLFGATVSQGWWSVLFLSTEATSQPSKVSGFQHGTGEECGEEWTYLNAGRKELKQNERRAFQKSEGSINRANHKMGRALAFTPRSSAVPSPTASLLKRRWDRVERNLKSTALDGFKSTAGDWQFPGLSGPSPQSRAAMGASLDQEHSRHPARSRGVEVSSGSAMAVNINGGRRAKAQVQP

SEQ ID NO: 931745 - protein, 150 aa, Homo sapiens
MCLTGILTKPLHPPLSHNIPHTQQFPSRGTNGTSRAQQQVELWIKLPWPVSKPSNPGHPHFSCTASGIPGASAGPASGHLTHPSAVQEPGTQFEQFWAPSLVLTRIPELKEQSPMSRCTPAHTIAKAAGIFLIKVKSAHGLKKYYVLSSN

SEQ ID NO: 931746 - protein, 137 aa, Homo sapiens
MCMHVCTCVHVCVPGSALWREPSLRGGEAVLCGRREARTVLARHGPREGMNVHALAGLSPRDGSVDTHGYSQRGLNQVWEATGTGSSGTRSRDTWVPVVAPTCKAGLCLQPCSPKAQSGQRVEWTSRSERAEGDTCW

SEQ ID NO: 931747 - protein, 168 aa, Homo sapiens
MSRERHCAELFIKWHLKYSPGLCSWGNTTKSIGREHNGSMVRNKCIVKKEKQQLLRGNDLQMTQQAKHQRNSDGSSDVTISTCHASVKVGTRLVFDHDGKIIQKTPYPHPRGTTVSVKQLFSTLPVRHKEFQRNVKKGLGMEVMLLLRLHAEQGTESPKVKGMKLLGF

SEQ ID NO: 931748 - protein, 145 aa, Homo sapiens
MTSVTCFCPSRSISHSLCKFPRAAENEHIAVIRIEYQASHNILLSQSLIQSKALTVFNSVKVERGEEASEEKFEASSGWLIRFKKRSCICNIKVQGETASASVEAGVSYPEDLAKITDEDGYIKQQIFNVDKTTYIERRYHLGLS

SEQ ID NO: 931749 - protein, 211 aa, Homo sapiens
MKEKTKKYKNTRTKKQSNTGESQDDSGPSGFKVVVLECHRRMLGSGRETNEEKRRCHAGDSVIEGMAQSGELPMHINNRNIVISINSAETTGYYYGKEMGLHPYLRPYTKTDSEWITGLNEAEKWPHKDFHLFAWKGLISRNYEYITFLRKRDFAGVITLKILGREIILDDLDLDEFSESKEPEKFIWDIKYSSNCDLYLIQRQRTKPKMC

SEQ ID NO: 931750 - protein, 149 aa, Homo sapiens
MILEVTQVLGWKAPRSQGQRPRPAAPGPATMSSTVNNGAASMQSTPDAANGFPQPSSSSGTWPRAEEELRAAEPGLVKRAHREILDHERKRRVELKCMELQEMMEEQGYSEEEIRQKVGTFRQMLMEKEGVLTREDRPGGHIVSTHSGM

SEQ ID NO: 931751 - protein, 130 aa, Homo sapiens
MCHSWHFITINNKCLSGNPVDCLQHVLKIPTQQLPGLLPNFSPLTISHHHHDPGQDHYHLPPRCCHNLAPMLLSKSSHSLSQLSSQRMLLNRQTDHVASLLRTLLNFPSSPAITSQGLHSLLVVEGMTSG

SEQ ID NO: 931752 - protein, 641 aa, Homo sapiens
MSHQPQPQEERSPQRSTSGYPLQEVVDDEVSGPSEKELAPEPEETWVAETLCGLKMKAKRRRVSLVLPEYYEAFNRLLGRRTPQRAPPILFFLKRKLPITTLFQWEKYAPVEDPVIKRLLAWDKDLRVSDKYLLAMVIAYFSRAGLPSWQYQRIHFFLALGEEKERRSGHDTSPSKQTFPVVLSPSHINRKSHQPPPGSRDREADLSRRSLLVVPLSSNLISVLSYLANDMEEDDEAPKQNIFYFLYEETRSHIPLLSELWFQLCRYMNPRARKNCSQIALFRKYRFHFFCSMRCRAWVSLEELEEPLGVDPSPPRRSLGWKRKRECLDESDDEPEKELAPEPEETWVAETLCGLKMKAKRRRVSLVLPEYYEAFNRLLGRRTPQRAPPILFFLKRKLPITTLFQWEKYAPVEDPVIKRLLAWDKDLRVSDKYLLAMVIAYFSRAGLPSWQYQRIHFFLALGEEKERRSGHDTSPSKQTFPVVLSPSHINRKSHQPPPGSRDREADLSRRSLLVVPLSSNLISVLSYLANDMEEDDEAPKQNIFYFLYEETRSHIPLLSELWFQLCRYMNPRARKNCSQIALFRKYRFHFFCSMRCRAWVSLEELEENTGPRGDVDFQQELYSNANGRHQEGGEEPFVQII

SEQ ID NO: 931753 - protein, 458 aa, Homo sapiens
MSVSKEYNLRRHYQTNHSKHYDQYMERMRDEKLHELKKGLRKYLLGLSDTECPEQKQVFAHPSPTQKSPVQPVEDLAGNLWEKLREKIRSFVAYSIAIDEITDINNTTQLAIFIRGVDENFDVSEELLDTVPMTGTKSGNEIFSRVEKSLKKFCIDWSKLVSVASTGTPAMVDANNGLVTKLKSRVATFCKGAELKSICCIIHPESLCAQKLKMDHVMDVVVKSVNWICSRGLNHSEFTTLLYELDSQYGSLLYYTEIKWLSRGLVLKRFFESLEEIDSFMSSRGKPLPQLSSIDWIRDLAFLVDMTMHLNALNISLQGHSQIVTQMYDLIRAFLAKLCLWETHLTRNNLAHFPTLKLASRNESDGLNYIPKIAELKTEFQKRLSDFKLYESELTLFSSPFSTKIDSVHEELQMEVIDLQCNTVLKTKYDKWFSESFCQSFDGQPILLTTICSPYDFL

SEQ ID NO: 931754 - protein, 146 aa, Homo sapiens
MPAARLGPGSPAHSGPPQPSYHAAQTPGLSLQKEGKHSLSWDPSVGADYPQLCPAPCSATPVRQLDIGWEGRGAADGPVLPSGSCALDPNGGILGRQEGVSAAPASQPPGGAELAELFQAVDGSPLGRRGPQAVNTRLESALWALG

SEQ ID NO: 931755 - protein, 162 aa, Homo sapiens
MANDRDWLMSNGRVQSTLYWDTTQLTHDGACWLHGRLMYQVSVPSTLHFIKVFPKVDRFRKQTIRIPDSIKELKLTRLLHADNETPEPSSGMSGPSAAGLLEFAGGPLQTLFAWVSAAEAEEQQILVNSKFCCLIIPPEVLSQKSTLPCEVSVCPYWGVPPS

SEQ ID NO: 931756 - protein, 153 aa, Homo sapiens
MILSQMTSMSRLLQKRGPYSRRKNLGILEEAHGRCGQHSAGAHLKSGAIEACLLLRAFWSLALLTMARKWVDIEAQKADTSCLNHMRHGNIPGAGGPSGRVPGKVLCSLAFCSSKSTVSPCTVLPGLGVKVTQNYLEGLQNKTERHSLNFKTW

SEQ ID NO: 931757 - protein, 160 aa, Homo sapiens
MVWLCPNPNLILQCNSHSSHMLWEETGGSHAPSQCSESVGSSPAEVLTADLNLALPGCTPQSLGELRLCFFLSEISGAGPIYNIDKSRAAQDKTGPGLLGLLHAPEATHQMESFSELDRDTKGLFCLNRAFQLTLITCTNNNNYFGYDCTLVKVEMLLKG

SEQ ID NO: 931758 - protein, 153 aa, Homo sapiens
MHFLHSEAHKNPRLRLGQIIGQHAYEEDLPTVGLLAAESCTLIAATCLRKRATHSRSSLSQGCDTLFGALQFLVSTSFWPPPCSPVPTVEAACGWPDPAAAGNWYLCQCLELTAPPQAVCLAVRSDLSLRSLTHVPLTVLCLASPWRSWDLGW

SEQ ID NO: 931759 - protein, 155 aa, Homo sapiens
MLERSGLTSEGQLDGVTSEKNPSRDGQTSGEDYLPAPSPFYFPFPLKATFIGNKMPRIYHPSIRSCDLIFPGSQTRTQVPQMWIQKTVTLALCPRWWKGWNPAGLSEWSLIPPAQSGQAVPVLLHSSSRTCSLTCFLLGGVENGGLSKRGTPVTI

SEQ ID NO: 931760 - protein, 203 aa, Homo sapiens
MQSYDSYNFVLVVGCCAGSSNWVAVHWGKGNDQTFQGLLDTGSELTVIPGDPKRHYGPPVKVGAYGGQKAVYALNQYPMYATVSPIARFHWSMNQGVKVEVAPLTITPSDPLVKFLFPVPVTLCGNHLISCRYSQNKKQAEEHGEIRMAQPRSLHLSPMVNASGPQTSDSRFFGFETQTGSLAPQLTDGLLWDSVIILSNAQC

SEQ ID NO: 931761 - protein, 142 aa, Homo sapiens
MDCFLLFSTADSLLAQGASRNAVQDLWPEIRGFRDLLCALVYCSQTGAQVARQSNNILGFNTDNFVIDISRLTSINKTVTLTVMQNDADCPQWSIVKESPCFERSKRLCVPTETIEYKWTAQIREPWEKTRGQQYSRVIYLL

SEQ ID NO: 931762 - protein, 155 aa, Homo sapiens
MSRTSNSILNNNGESGHPACPPDLGEKAFSFFPFSVILVYKLLVDLQFWGLEDGGPLPTAPLGSAPAGTLYGGSNPTFLFHTALAEVLCEGPTPTANFCLDIQKDMSVTSPFSFLNTVKKCEGSGIFPIYKMGKQHSNCQNTYAVSLTTNFPRTT

SEQ ID NO: 931763 - protein, 138 aa, Homo sapiens
MALEQANNVNCKKSQQCVNCTAVDNQVSENGTITCNVSYSPYSLFTDDRQFRIRLYNGGKRLHLGPVTPSFPEAEISIRISNICSVTIYVHFVSELPYRSVDIRTTILIEVEVGLYILSPLTNILLIFINFEASLCDF

SEQ ID NO: 931764 - protein, 156 aa, Homo sapiens
MGRCLWCVVAGACENGGASARWTSGIQQGSTGAWAGLVSGALEPAGFLESTAAMVFRGVLPCILQYTVGSTQNANGFSTCLCLVKLVANILRILFWFRSHFDSPLLWQSIIMILTMLLMLKLCTEVCVANKLNKTRFFADFWPHHLQHWSQKFRGL

SEQ ID NO: 931765 - protein, 357 aa, Homo sapiens
MIIGTSQADRAVLIVAAGAGESEAGISKNGHTHEHALLAYTLGGKQLIVDVNKMDPTETPYSQKKYKSLKKSALSLRKLTTAPGTVVAFVPVSGWNGDTMLEPSANMPWFKGWKVTHKDVNASGTKLLEALDCILTPACPTDRPSPLPLQDVYKIGGVATLPIGGVETGVLKPVTLPQNNVAFNVKNVSVKNVHCGNVAGDNKNDPPTETTGFAAQVIILKHPVQISAGYSPLLDCHTDHIACKFAELKEKIDCHSGKKLKDGPKFLKSGDVATKFLNSGDVDMVLGKPMCVEVFSDYPPLGCFAVHDMRWRIAMDVIKAVDKKAAGAGKITTPGEQGRIFNLSAHGWCYLRKCITM

SEQ ID NO: 931766 - protein, 160 aa, Homo sapiens
MSHRQNLSDTEIVKGVALISWEHRQASILKSELVRRRLCFSLVEEPLTYLQSSSPKALGSNGPPFHVIRTSNTDFCDFLLVDISSAARLLFLLPNTLLTDYWKTDGQVLQQTEESWILKQLLRRHLTCQKIFPKGSPEVLVALVTSDNRDEGGAKTKMIG

SEQ ID NO: 931767 - protein, 182 aa, Homo sapiens
MYLRFLACLPWVRTCSFSSEKFVITDLLKPTSVNSSNSFSSFFPLLSCQAGMFKSAEAVCCLLFRYALPPEVESREAVGLAELQWAPPSLGFPVALFTLTALNSMTHNCCVLSPTVPRDALRTKPQMWRRQLAILFLLLGAFSPFTFKVSVYMYVFDAVIMMLAGYYAKLVMWLLHSIMVCT

SEQ ID NO: 931768 - protein, 202 aa, Homo sapiens
MCLASPSPSTMIQCENGLIQRIGTKVVWYCYKDNLRMWKQLWNWITGRGWNSLEGSDEDKRINESLELPRDLLNCFDQNANSDIDNEVQAEMVSDVNEEPIGSWSKGHSYYALAKRLAAFFTCSGDLWNFELKRDDLGYLAEEISKQQSIQEGPGPCCSVQPWDMVSCIPATPAPAVAKRGQGTAQAIASENASPKTLAAST

SEQ ID NO: 931769 - protein, 156 aa, Homo sapiens
MNSFSSNCIYFLRKIYQLGISGDTIVDFSGRKMCNSSFNRRENRVLIEIHEDKPVLKVLPPPSLSLPRVQTALLAARISSQWILACWDLWGGTHQARPLGLPGFSLLSTGVNGSVSWEGELCLEKEGTGLTASCFLGAVPSTPGGPSLTWHMEYAL

SEQ ID NO: 931770 - protein, 164 aa, Homo sapiens
MTWAQVILVLWPPSCFFSHSTCSPLLSKRPSHVHQSSALNVSKHLLNTNFKTAFFPIYVLFLMCLGPLDVESGEKESLWAGIWGHPDKLAKTLRSHSSREEEQTGPVTLEKQQDEPLNGETKTPRSCEEFQLPAPGGPYVNAEVLRFPGSKNNGSIKREMVLSS

SEQ ID NO: 931771 - protein, 139 aa, Homo sapiens
MLGYCQVCWSLLEVHPRPSLPGYHQQRLQNSKDFCLLLPLEASSQRGTGQITSKEGCLIPLKLCPQLPLPPGALSQGNGSFIYKPLTGAAAFLSEMPCPERRNLERQSGSGSFGELQWAPPSSNFPLPCSNFPAALFTL

SEQ ID NO: 931772 - protein, 244 aa, Homo sapiens
MKWAQQVLQRLQMFWSNFASLRYLFLGNPDHALVYQKYVEMTTLLDQFESRIYNEWKSNVDEICEFNLNQPLVKFSAINGLLCVNFDPKYIGNLDLLVQGYNKLKQTLLEVEYPLIEDELRAIDEQLTAATTWLTWQDDCWGYIERVRAATSELEHRVERTQKNVKVIQQTMRGWARCVLPPRREHRREAAFTLEDKGDLFTKKYKLIQGDGCKIHNLVEVMAFNLSRFIDLFIEFREEQKSLT

SEQ ID NO: 931773 - protein, 236 aa, Homo sapiens
MHDLDFFLKNTEKQLKPAPLNELQEFIKETDSGLQRELNEGDHDGLVDIMVHLLAVRSRQRATDELFEPLKETITLLESYGQKMPEQVYIQLEEIWSLNKEVRVWDAYTGLEGTVKDMTASLRAITELQSPALRDRHWHQLMKAIGVKFLINEATTLADLLALRLHRVEDDVRRIVDKAVKELGTEKVITEISQTWATMKFSYEVHYRTGIPLLKSDEQLFETLEHNQGTRAQCAG

SEQ ID NO: 931774 - protein, 325 aa, Homo sapiens
MGRTCLRDSVTSHWVLLTKHGNSSILRLDELDKETKGDKPAENRALEKTEFGEQEEETKRRQQESEDIRIQLVKDARRFDGVDAEFKKRKILCGPKVVTVLITFIFIKTVCFYIAFDLHLRVEKQNLEKIVLISTAPYCTFMQELMFKTAKVENVLEATCRPNLYEKLKDLQSRLSLCEKALAEYLETKRIAFPRFYFVSSADLLDILSKGAQPKQVTCHLAKLFDSIADLQFEDNQDVSAHRAVGMYSKEKEYVPFQAECECVGHQVLNTYYASDARSGFGEFRNGPCLRGALRPIEKMDMHIIMELPKPSTPQPVVTTILLFM

SEQ ID NO: 931775 - protein, 141 aa, Homo sapiens
MIVFNCYSDTMGYIRIGDKECEFNKNFRLILHTKLANPHYKPELQAQTTLLNFTVTEDGLEAQLLAEVVSIERPDLEKLKVIEAKENERKINEARECYRPVAARASLLYFVINDLQKINPLYQFSLKTNVYYDQSRQMLVT

SEQ ID NO: 931776 - protein, 146 aa, Homo sapiens
MIPPEEETSDTSEHLKEQTLDTPSLRTVTLTASVHGFILEVSETKNPPEGTNSKHNMTLVGHLAMDISEIPKSQKVAHTGLRVNVAMTDIFDRYVLGVESHIVPRKSFTRSFMMHFNRLYFSCNVDWSKAEEHNWFARLDDQYQVR

SEQ ID NO: 931777 - protein, 147 aa, Homo sapiens [sequence omitted]

SEQ ID NO: 931778 - protein, 139 aa, Homo sapiens
MSCFSLQAALNDFSVLRRRDRPAQKEEGSVGRDMQLWKLTGGCPRETERTQCWHCVPGLRLSQNGKTTPNPLTSVRGPRTRTAAGGRREQRAEPGWVGVFPRRELSGQSFLPAGKQKQKQKTNQNQNKQKKKTWLGVDL

SEQ ID NO: 931779 - protein, 143 aa, Homo sapiens
MWKRGRGGSSGVNFRISVGLPVGAVINCADNTGAKNLYIISVKGIKGRLNRLPAAGVGDMGMATVKKGKLELRKKRKDGVFLSFEDNAVVIVGNKGQMKGSAITGPVAKECADLWPPDCVRCWQHCVILQYICKSKTKQTKKF

SEQ ID NO: 931780 - protein, 190 aa, Homo sapiens
MKMKVTVYGHFLNQVPLRNDGLNSVLGPELLAWLHSGQAECSCCRYHHPLLCRHTAEHSSRCLWVVDNTVQRQRETKKNNNGFGRKDNKSVQERIMFKSVQNMQRDVPNRRLETQAGSLQLYLNLHFLLVQSLKVIQRENVALQKASGYHSWGGGEDAGIYKAEAGDAAKHPVTLRTAPHSKQLSSPKCQ

SEQ ID NO: 931781 - protein, 202 aa, Homo sapiens
MEASSCGRRAGGCDSGQKLFPLLRTLDAHELNIDLTPRHQCTICLFGQLASHVFMVPDKEICFFLDLNSLTKQNQVAISYKYQIPGNCLLGKRDLSRTTGIASWQGPRIRCGEAVLVIPGDNLYYLREEGSLPEIKMLTQGQNSPESKFKGTVVTEQSFHMTTRPLNPIPSLHFQNGWLAQLSALQNQKANIVTGAPISANS

SEQ ID NO: 931782 - protein, 176 aa, Homo sapiens
MFHLLAAGIRLRFFLKSTNKMIFLKVTLLELAHAYELPENFDQVQILMQLSLGSNLEFSVSYKYSCDTAATAMTEPQGGERRAAGVLVVSCLILTVPAAPHVALVCRAPSSRDCTWGNWLTYKAKAPPEGVGRGFSQGAKGGSDQLTQQPWEESPSQSPIWRLINAGSAGMETHTT

SEQ ID NO: 931783 - protein, 142 aa, Homo sapiens
MWREECEQLACRSCKKHVAVTSTQPTVVKGRMRPCIGEDRKRGKGTVGVSSCDLGAVEEAGVAQARSPPPHNRPQRVMFPSLCTCVLIVQLPLMSENMRYLVFWSCVSLLRMMASSFINVPAKDMNSFFFMAAMDKFFSGDF

SEQ ID NO: 931784 - protein, 174 aa, Homo sapiens
MCNLHILSVTSAFLKCTPAFKNLSLQATGEVSSLARAARILLLGALQLNAFFSATAKAQCSIEKLFMLVHEKGPLPHLRTHLVVIKTLLIKQAAVKKLAKTHQNQDGDESDLWSSSLLRSHQRHDSLQMPWQRQEVSAIKHGNLIVKLEILQRASELPSWVLPVSASLVMRENS

SEQ ID NO: 931785 - protein, 536 aa, Homo sapiens
MGRATQQRPFGEHYLGLTSTGKSGEQFCRSREAKSQPTVSLSPGGICFHSNYNLGRLLPSDCPRKIFSLHYQFWMARKSTEYKMQNSLGLREVEQIASITTEPGASSQQPPPDDNNDDDKSNNDHDSNDKDDDDSNDDDDHDEDDNEDKSDDYNDNNDRIMMTVMIWMMTVMMIAMMIMMTMMMMMTMMMMLMTVMMTKMTMKKMMMTVMIIITMMTMTKMMTMIMMMMIMMTDDDNSDNNDANDDDNTDHDNNDNDNHGNSDDNDNSDNDNNDDNRQFSNSDDDNNDHDDSNDNDNDDNDDDNDDDNDNDDNDDNNDNDDNENDYDNHDDNNDNDNDDDNDNEYNDNYDDNNDNDDNDDDGDNDNDDNDDDNDNDDDDSDEDESTKLNCNVHTPSRPVGGVSGHFKRSCAVGVSTPHSQSPSLWQWIWGSEEEQQPRNQKPGAWALFLHTIKFYQRIPGNQSFYGDVFVQRNEKFRTIPNQEDEHSKEKTKEGHLEKVLRVQAIPCGLICHLQIPGLLSVDGFYGSTTASILAKA

SEQ ID NO: 931786 - protein, 142 aa, Homo sapiens
MPADTACCVGDLITANPISTSQIPRKLQTSILNRCEVIAPCGVDLRFSLMISEVKNIFLYVCRPDPAIPLPGVYPKEKKSVSRRDHVHGSIINNSHETETAKMPVDGNSYLSQYPHPLPKILPPSKVFLKYRNPELSKNPKL

SEQ ID NO: 931787 - protein, 181 aa, Homo sapiens
MGRKAAETIRNINNAFGPGMANKCTVQWWPKKFCKGDESLEDEEHSEEAPKHFQEPNLHQKKVMVTVWWPAVGLIHYSFLNPGKTITSEKYAQQIDEMYRKLQCLQLALVNRKGPILLLDNAPPQVTQPMLQKLNELGYAVLPHPPYSSDPLPTNYHFFKHLNNFLRGKHFHSQQDAENAS

SEQ ID NO: 931788 - protein, 154 aa, Homo sapiens
MPPRANLVSMSFKGQQLGLLRGLCSADKLNGECEESRKVLCLYRVLGLTLSRRLECSQRKRKEVYQGESGIQEAPGASHLEHKLDKQTSPGRFPSWEEERLHGKLLLANPTNSKAWQARSSSTELLNRDTMLDTGDRKVGDASLEVSMKDTDIK

SEQ ID NO: 931789 - protein, 209 aa, Homo sapiens
MNLRTLAWLSHWVCRWSCLPVPRHALALLSPWVVDGTGRPGAGGGTRRGGSGCTGAHGGGGRLRHGGLQSQGLPRGKAAKAGGEKSSTAPVGGHCWGTQYTLRSRWPGCQVPHCPGPAGPAGCSECGAHQAHAHPQLRVQPRFRSRHSLHTSPQAEGVGSSLGQPRKGLPQCSGGPKGSSSAAKVGAQAEEAPRASEGCEDCQNAVTSH

SEQ ID NO: 931790 - protein, 133 aa, Homo sapiens
MGGEIALRPVWFSSQEIKRLELGCLGQTTSNCYLIFSCTDSSSLMEQKNIIHGPCPARHLGSLDGGPSFPSGHLIYNGEENEDNCNKNSCSEKRGERETTAITNLDKLSNPAGQLLSPAGQDLVSDQPEVHGL

SEQ ID NO: 931791 - protein, 167 aa, Homo sapiens
MYGVFVRILTERSQRKAFLQARSCIEDRLRLEDENEKQADGDSFMLVHLLYFFVISTLQPSVPLHSDFPGSRVNFSLYNRDTDASSPRFPSSGNPRVSSLSFCGQCCNIAEEDAGAGCRLGLWEALRHVLGGCEEMEVVANMWLLDTLVFLVLPDGTAQAQKPHAKI

SEQ ID NO: 931792 - protein, 157 aa, Homo sapiens
MKAFAYPPPGSEEHFCPAANHLGSEEHLCLVANLLGSEERLCPAAQSLGSEEHLCPAAQSLASEEHLCTAANSPGSVELLCQAANHLGSEVHLCPAANHLGSDEGLCPPTIWEVRSTSARPPPHLGSEEHLYPAAHSPGSEECICPVANHLGSEGHL

SEQ ID NO: 931793 - protein, 137 aa, Homo sapiens
MEENLIIRVNVQDLTKRGLLFKCKDKTSCDKKQLEMPVILQNNVKNTDLSPPTLLLNIIPGFPTNLPPTSCLKAISTTELATGERHSPLFMYEKIKFEPALCLNPFSLLRIFTNLNIARILCCSHTSMIPYFKFKMS

SEQ ID NO: 931794 - protein, 130 aa, Homo sapiens
MDLRVSSHLPAWLPAILKLFLCCKPCCLRALDCDCITGTRTCGPTCSSSLLSVTSGHPTWPPGSGFGKEDGAWIAKAFQSHALRHGVNCTLEPPTGRPRAAKNPEKQVRGRHKIQAPAGSVSAEGFLVPF

SEQ ID NO: 931795 - protein, 213 aa, Homo sapiens
MSLEVLHQAVSPLPPMQAQAYPRCTAWTSGCTKHASPSPAPASLVHCGQSRAASHGADPSPARDQLTPGPCRAARAHDSPALGPQDGEIMRTPMHPQRPLDPPWEDSAPPEPPGSPVGGLCTSGAPGIPHGRTLHPRGPQDPPWEDSAPPEPPGSPVNAFPSTSTCLPSARHSSLNRNITSSDAPPRTTRPGTIAPLHVGTVVALIAGNGLTH

SEQ ID NO: 931796 - protein, 239 aa, Homo sapiens
MSPSGCVGITVTDNYEVTMAGGPFEGARRLIEASPGAGVTASAPAEQKTVLDVALCGRKGIALKSEHCPLSRPQRLPWAPCSSLTVSPQELAGWRRCLALVCVVTGCQAAVKEDLGRALGGQSQLYARFGIAFKAGPLPLAVILSRPPTGPLPLAVILSPRSRPDRSPSSGGGRVPAAVPTHMLPAGASLLCRCSSPFPPIDSFKALKTVGSGAGTTAVGDPAGTMALGAQQVLNLLKE

SEQ ID NO: 931797 - protein, 187 aa, Homo sapiens
MFKVALSVQMCPASTLPFGFKLADCAVRCVQRRAHSSGETIWIRHVFLSASSSVGNGGHSQSLKTYLDRCQEWKDIPDLNKGCYPGLLCFGELIHNQQTCERLMDQPTGQRPSAQTASTTQILNIFFGCPAPEGSAVSQSLRPGGPLGAWEQRAWERRTYSLSTAPSSSTTQLPVNDFTLKMLHLVN

SEQ ID NO: 931798 - protein, 134 aa, Homo sapiens
MKSSHSYPTSTSSNLTHSPTPKYPDIALKPPMPQLTPFVTPRLLRDSFYMFGAQLEEVTDPCTWYPEEFVIFDPSGVLSSTPNHFSCSYTSRDFYHHHHSLQAQPNMTTLCARSPCFYIPAKIRAQAGHGVAYL

SEQ ID NO: 931799 - protein, 173 aa, Homo sapiens
MKRVNTRRADAIPMRRLHERRSVSGRDWAHKTTMGVNGGKRLCLDLEGGQTAIVLLKTQLSSGEWQPQGDGPSFHFLACIIFWIAYLFLSLTGFTLQLYPMASRVKSKLPNMLCRACLTASSLTPGASHSIILYFGHTELLLPGMDLTSHGLSSLPASVLSGSFFPALHRKAH

SEQ ID NO: 931800 - protein, 175 aa, Homo sapiens
MEFFSWFWGFWSWLLNMIRPQNAKDSTANSTENTNSHWCELFRELCKINAFDTPDSPLMRDFNQSVIEEMVGNESGTFYGKKTETRTACPTEAEETVMGTITFMGWGHWLSSHPTTSTDFPGARIRHLRTNSPIPSRTTPGLQAERNNFQGAYLNELNPGHRSSTQDKWIWVGCR

SEQ ID NO: 931801 - protein, 152 aa, Homo sapiens
MWGDGDILRNPEEKHMNNSQYNFTFIKSIIYENTIEKEEEPSENHPIKCELSAFFFPCPFSHLQRGGGWATLVNHGETVGVITVTGIQPIHNSLRKQVLHVSLGLRSLGHAAFHIPSVLVRSHAAMKKYPRLDNYEFLHLILMLVDAFSINH

SEQ ID NO: 931802 - protein, 181 aa, Homo sapiens
MELAVLGPCRPCPFLRDSPKSGKGTNTHRDPGFSCTGLCPPPAQGAVAAPHQDPPAPPTSQPPLIYDAKYLVRGWGLLQRTWLKLTPGWDRPTYAPKKLGSRSEGWATTWLLPAYTGLLQVDEEKKQVTMEAGILLANLHPQLDEHGLALSRDATGALQVCHCLLWLTVTMRKGPCCMSVL

SEQ ID NO: 931803 - protein, 149 aa, Homo sapiens
MTDFYTFPWHLQRKPLLTLFKHFTLRYLLILMEIAFDMCSWWPGAWGERTHKAELILINSEQRPEIGNWQKWGTWGAGYHWAPSGSEPSFEEEMRMSMLGSGESGPTHPSMLCCKASYLGGRKNDGCEWPQSFPFRSPIPSDAPMTHVV

SEQ ID NO: 931804 - protein, 169 aa, Homo sapiens
MRKIDTEPIPLPTQKSPPSVLGSGYSVLEGTPQQRPKDRPGAWFPGYETIVARDLKGAPDSMGPRGPDEQQILSPWAECRKKTTEALLELKAVLEAHPEVVSHYLVGVGLRVRASRSGGAAAVHHALPCPAEGTALPCASATPGADPGDAGLSPNYPSTLSWVLVPTAQ

SEQ ID NO: 931805 - protein, 150 aa, Homo sapiens [sequence omitted]

SEQ ID NO: 931806 - protein, 212 aa, Homo sapiens
MTDTPGTENLSVEISQVLFVNFEQPWKARLGHWWYPHWIILCHLEFLPVAHTKSRKIRNSQMMRTGEDPELFLNWAPSQSSPEPLKTDSSWTMDSPQTNLVRAKLLRLHRRGLLAKWAQVSEVAAGVPFVTGKGCEIVKTQLGSAFQDQTTMALTILTASLKNPQMGGKEPALGPLLQWGCQQPGCKSARHERLSSFSLTPALCPCPRGSSG

SEQ ID NO: 931807 - protein, 151 aa, Homo sapiens
MVRPGNSNPVVQHVKTQVQRSFVTCLPHRAEEGGDGSQDQASWLRIQCLLHEASLKSTIHITNRSVGLYNTGKGYNMDLLRAGFTSRLFRPNGRIHGLMAPPQTPPVWASFTMWHLEHYGTLGTFPNISLYFCICKMEQQHLSLGGNVRIQ

SEQ ID NO: 931808 - protein, 159 aa, Homo sapiens
MIVSLTVLGVSCKISLTWVLKYDNPEQSGLDSYHLGNTNFTWKPGASPTSSRTSYLPSQQHVKEKQKKYRLSIVQNSRFHAHGFCVSVVLGCHNKLPETGWFINNGNLFLTGLGAGKYKIKVLADSLSGEGHFLSHKWCLLTVSSHDRRGEGNLLDLKI

SEQ ID NO: 931809 - protein, 139 aa, Homo sapiens
MLPKDPDVGPLGGRHHLEATCICDSRLLIKEGPSHVSTSFLTASTLVSSVRTDEYTHPSGLLVYHGQSPQISELEGGGEILVHNAPVGAPGAWSGDLCPLPGHYPPPRTVVPKEDRTFCRALSVACALHTPSKQSGSEE

SEQ ID NO: 931810 - protein, 142 aa, Homo sapiens
MSTVCGSPPSGFTPCGAVKQEANVSFACNNPPSAKGNSLCFPEATQSQTGRCPWGVELVQQEPRGSAGERDWGRAGPDISAFAMVARELAATTLRARPPLGPRPHSQPNPDGVIERGCRGAQGRVSEQDHRGHFCRRTSPVR

SEQ ID NO: 931811 - protein, 180 aa, Homo sapiens
MPSACLFCAPKHNSVTPFPPPFRGHLSSPWSCEHCQRYSLVLQWGRALISPRQPTVGKSPSHLLLGDPFIQARPPEARRLQLSPPFPQFRICFSGHGPIGWLLAEPKLAVTFSPTQWLKSRTLTTPNADEDVEQQELPFIAGGNAKPNITLTIPPPQSFINYSKAPLWCGMLITRKAVGV

SEQ ID NO: 931812 - protein, 174 aa, Homo sapiens
MEDSGADWPGSRPRTEPWRIPMAALGMLMDGMAIGNVHLPESRQLQQRRLHIPCVPGPQGMVAEGDHLPSAHLGGTRNAIVWMGGDSYQEERRAGEALGPAMVKREGCEEPAWTCELPGDSGERGFANAVTDKRCMVLFLSSLLLKEHRGSFLFIFLPYADLETAMKILLLQGP

SEQ ID NO: 931813 - protein, 161 aa, Homo sapiens
MTDPSAPALPFQDPMWPQPHTRTPVSWFAALGAQVSWFVALGAQVSWFAVLGAQVSWLLLVLRRLSRLPKSVTGPPAPVLLPEATVPHLDAAPMALGPPLPSPPPGCCLGRPGKGEEAGPDLPSPFHGLLMGWVTALNPSTWPVLEQAALFFNIILIIVFI

SEQ ID NO: 931814 - protein, 134 aa, Homo sapiens [sequence omitted]

SEQ ID NO: 931815 - protein, 147 aa, Homo sapiens
MASWEGKDLTVPQPDTRKGLSFHLTRNTHSTGFTYNFWTSKFTTIPILSEIMCHGPEGSHDPSPKDGCGCQDTASTHNSLLVKSASVLPSLCLTPEQIRCQQCECRRHPWSPKESEEPRGIQSWDKDLCRHHTSLAPPIVECWAKPT

SEQ ID NO: 931816 - protein, 485 aa, Homo sapiens
MWLQEAVVFEDVAVYFTRIEWSCLAPDQQALYRDVMLENYGNLASLGFLVAKPALISLLEQGEEPGALILQVAEQSVAKASLCTDSRMEAGIMESPLQRKLSRQAGLPGTVWGCLPWGHPVGGHPAPPHPHGGPEDGSDKPTHPRAREHSASPRVLQEDLGRPVGSSAPRYRCVCGKAFKYNSLLLRHQIIHTGAKPFQCTECGKAFKQSSILLRHQLIHTEEKPFQCGECGKAFRQSTQLAAHHRVHTRERPYACGECGKAFSRSSRLLQHQKFHTGEKPFACTECGKAFCRRFTLNEHGRIHSGERPYRCLRCGQRFIRGSSLLKHHRLHAQEGAQDGGAGQGALLGAAQRPQAGDPPHECPVCGRPFRHNSLLLLHLRLHTGEKPFECAECGKAFGRKSNLTLHQKIHTKEKPFACTECGKAFRRSYTLNEHYRLHSGERPYRCRACGRACSRLSTLIQHQKVHGREPGEDTEGRRAPCWAS

SEQ ID NO: 931817 - protein, 193 aa, Homo sapiens
MRQRQKGAGTQGFLGCWCVSFQEVVTFGDVAVHFSREEWQCLDPGQRALYREVMLENHSSVAGLGEAAPWGPFPCIISQHPPSQASIRGWVSSLNSTTATGSHCGALYVHACVLTSCILSLDCNLRTRILGSSRDMVGEAEGLSLSIPNMELGSLGHGQESTKVRASLGNQELCHDPFHLGQLPTCPPLGSIT

SEQ ID NO: 931818 - protein, 243 aa, Homo sapiens
MRESLFQKQLRHPKNPFSRVDTGPHLQELRMRSNSSEASGPWLRTATRWQHSRFTALPFAGPRSLTASQGGGQPTRGVLASQSGPDGASDPDSRLTSLPDRFRLAGREGRTGEVGLPCCSAALRPSPARCPCARSSRGAAGVGPSRHQRHFLFEGPPGQGPEYGLRLAALCQPWGRSSRGSFRSRAPDNSLAPRGVPWTPAAQSGFCVPMRSRPLGPSGPRLPIPAPSHAPLLSAFQGRGSPF

SEQ ID NO: 931819 - protein, 164 aa, Homo sapiens
MACPQPPGPSCWGETPADHLSRVQLRPCPSTCNHDAMVASFVVASFEGVQGGCRAEASRWTGLWARGLVRRSWAHVPFMLKEMQGHQLLRQLVTWGRCSSQPLWPSARGSSDILALTIIFLIDRFFSVHTQGYLPAGAGENAMGHCSARASLHSLHAACMQAFF

SEQ ID NO: 931820 - protein, 196 aa, Homo sapiens
MIVRPLQPCGTVCNSRGWNSLEGSEEDRKMWDNLEPPRDLLNGFDQNAENDMDNEIQAEVISDGDEEFLGNWSKGPRRHLQFPGSNTCICEKQVQLEGKTLRSPKIKDSILHRILRPPKEGNATGWDRVMLPQCTSQQRHSLSLSGRSPISPSPTGGLSLSAISKTAALTRDLSTTIHPKVLVISQYKIIPGIPQS

SEQ ID NO: 931821 - protein, 150 aa, Homo sapiens
MGGTRKWTRSVNIEAQHHGGGGRRFRPPDDCGQPWIISSLPQEAGRADCSLTPPRKGDSLSRSAKNGILRKNLCEGMKMWTLLLTLLCSPGDDPWMELGHTFPSFPRSPGVSLQEAIKVGRYWEQSTLPCKVTALRIMCVAAAAYESNCC

SEQ ID NO: 931822 - protein, 499 aa, Homo sapiens
MGQTEKPFQTGEDSVSVSDAPESCVIDCEEETGTEFKKGMESSHYKNVVESVMAQSMQNVDYNQLQEVIYPESSKLGEGGPELFGPSEFRPRWPPTPSPVVQMPVTLQPQMPIQTQYLQYQLVENKTQPLVVYQHWPPAEFQWDPVPNSRALYQQPTAMVFDPTVPASGQDSALHETVDTARKQGDLEAWQYPVMLQPIPAGKGPGKGVKQERLSERRLETRDKLIDFYMFLQTEVANTGLTIASDKIQTSTPFNYLGMQVEERKIKPQKIEIRKDTLRTLNDFQKLLGDINWIGPTLGIPTYAMSNLFSILRGDPDLNGKRTITPEATKEIELVEEKINSAQVNRIDHLAPLQFLIFATAHSPTGIIVQNTDLVEWSFLPHSTVKTFTLYLDQMATLIGQTRLRIVKLCGSDPDKIIVPLNKEQVRQAFINSAAWQIGLADFVGIIDNHYPETKIFQFLKLTTWILPKITRQKPLENALTVFTDGFSNGKVAYTGPKE

SEQ ID NO: 931823 - protein, 224 aa, Homo sapiens; identical to SEQ ID NO: 803990

SEQ ID NO: 931824 - protein, 140 aa, Homo sapiens
MVHVSWVDMWVLGSDQEKAKILWEAEFKEIVKKVSFKSSTGKCVVEEGLWESGVCGMRVECWMNWYYHLVNNSEILDQVVQLTAGPVGPQTHPVVIFQVPGCIIGIDILSSWQNPHIGSLTGKGYYGWKRQMEAIRAGCT

SEQ ID NO: 931825 - protein, 241 aa, Homo sapiens
MVLKMGVCLLKLSFLPAAIHVRCDLLLLAFHHDCEASPAMWNFAEKIPKNVEATLEPGNSRGWNSLEGSEEDRKMWDNLEPPRDLLNGFDQNAENDMDNEIQAEVISDGDEEFLGNWSKGPRRHLQFPGSNTCICEKQVQLEGKTLRSPKIKDSILHRILRPPKEGNATGWDRVMLPQCTSQQRHSLSLSGRSPISPSPTGGLSLSAISKTAALTRDLSTTIHPKVLVISQYKIIPGIPQS

SEQ ID NO: 931826 - protein, 737 aa, Homo sapiens
MGFSGHNPINFEYVIHCLLTSISSDKKSAVYLIGAPLYMISCFSLAFKIFSLSLTFNVFTMMFLSVGCDSRIEKEEMIPKQDISEELESQRAKSEDHVRNIFKETEEMSKTEGKLENCWRKYAVEGVKNSFSQKSNFREITMRYVKTLSRENGQKFNAVGENCITDSNPAKHLRGSREESLHPSVSSVENLQQHEDLINLQSFQLGERAYQTDVLVKVPRQSSVLSENQRMNNPERWFESTGCGKTYNQNRAFNQHQRFHSGEKTYEHNECGKAFSWPSILSKHQRIHTGKKLYTCEDCGKSFSVHSYFIQHCKIHTREKPYECIKCGKAFSTHSSYVQHLKIHTGEKHHECNQCGKAFSHSSNLIHHQRIHSGEKPYKCKECGKAFNRQSNLIQHQRIHSGEKPYDCKECGKAFSTQLFLIQHQRIHTGEKPYECNECAKSFSLNRTLTVHQRIHTGEKPYRCNECGKSFSQCSQVIQHKRIHTGEKPYICNECGKSFGEKPYECSECGKAFSQSFNLIHHQRTHNGEKSYECNECDKAFSLLSSLVQHQRIHNGDKPYECHKCGKAFSQGSHLIQHQRSHIGEKPYECNECGKTFGQISTLIKHERTHNGEKPYECSDCGKAFSQSAHLIHHQRIHTGENPYECSECGKAFNVCSSLIQHHRIHTGEKPYECSDCGKAFSQHSQFIQHQRIHTGEKPYMCNECEKSFSACLSLIQHKRIHTGEKPYVCAKCGKSF

SEQ ID NO: 931827 - protein, 164 aa, Homo sapiens
MRLIAALHACHMRLGVKAEYTKRCASAGDCEDINELMFSCQSETLPTPQDKLRDLVMAVMQLLLGGLQGCIKILSFHIVVSFEDVAVPLSQEEWDCLIPAQRGLYKDVMMGTYGNLLSLVGEWLSKLWYIHTMGYDSTIKRNCPDFTTMQYMHVRNLHLYPLNI

SEQ ID NO: 931828 - protein, 171 aa, Homo sapiens
MRNTHRCGGATHPYSIKAFLCKRADVITVDYYATVYFHQKLEEFGDLEEDKKMRESLELPRDWLNGYDQNDGSDIDSEGQADEVSDENRNLLETGSVGCEDHGKSVVLGPDNTVPHGTVTHGGFPCLGEEVPQLLALPGSIDEKNKMRTSFLILTLPLSGHRSLLAWFCHP

SEQ ID NO: 931829 - protein, 138 aa, Homo sapiens
MLLLPLLLGHMNEDAPCCHCVGEVVLDNILKSVFQLGSVLPITFSKCRRNEIITTTLLDYTTIKLEIKNKKFTQNHTITCKSNNLLLNDFCINNEIKAEIKMLFETSQKKNTTYQNLCDTAKAVLRGEFIALNTTPKS

SEQ ID NO: 931830 - protein, 162 aa, Homo sapiens
MADCGQIASSGQTLTLLPHWCGNTAASCKEKAPSLDQCEWVFVVVVLAGWDSLTSGPEARAAGTGLPVGLPVGLSGACAKTAGVSLCHFRGPENLGGSPMARIVRVHVGSVDPLGTLTHSTFSRVRELLLAPCQSWVCSYLALLLSVLCEAPGFLGGSRGDF

SEQ ID NO: 931831 - protein, 171 aa, Homo sapiens
MLVQRQMSVIEEDLEEFQLALKHYVESAFSKVDACGSPHSDLKSSLVDEAPTLGHLAVIAPLAVRPPMSVKCHRKYEDFKEKDTGCFGCAFWLFTRWPTVRKKKGEPTSSPLMSDPEDANVFPESLLPSILPLASHWPEFKSHGHCWPLGRLGNKCPAERSKVIRVFSVQH

SEQ ID NO: 931832 - protein, 141 aa, Homo sapiens
MGINQSRKAENCKSQRASSPPKDHSSLPAMEQSWTENDFDELTEVGFRRLVITNFSELKEDVQTHCKEAKNLEKRLDKWLTRINSVEKTLNDLMELKTTARELRDACTSFNSRFEQAEERVSVIEDQINEIKQQEKFREKK

SEQ ID NO: 931833 - protein, 191 aa, Homo sapiens
MGVDVGHLHVSAKSTCGQSESPLCWEKVTVQDDSSALPSHPGVASGFCAASELPRWAARVLQSTAISLRAGALQTSGCDYSQRRVTTTQRDTLGANLVKGACLNQLQNPCASNRIYLQTSPSQKIVPTSPVHSDLSPSLSSGCPCNPDRAFTLFMAEESCKIWKPREKWLTNTDYDFPDCTAQEIEFNHLN

SEQ ID NO: 931834 - protein, 209 aa, Homo sapiens
MFMFFHASDKENQQTFQNVQNTGEDRCKDHSWKPANTTNRSCLGHATLVWARGETKGVYSNMKTEHACELSSDMQHACPLILAAHSHTVFAMPPGHRIPVDPPRVGIQGRLKANTRKHETEFLAKMTLEDMMRDQNARARTGDESTNLGQNWKSSEGQLCHVVDLWSWDLLLAPFYILGKYDPGNPEPSKYVPNVKCKANSVPVRFSGS

SEQ ID NO: 931835 - protein, 135 aa, Homo sapiens
MADAYQKIRFSIYGNVFIFISFYLKIDPIEVATSGSGLSQICLYQQCENGLIQWKKARWGQVNQAFDFKTSSAFQMRDVLRGRSSIPEQSFNHPHTPSQKVCHDHRVARKAPSRTGENGSPLGAISSEPVIPSRV

SEQ ID NO: 931836 - protein, 136 aa, Homo sapiens
MEFQAQQANNGRKLGPQAGCTGGLLSDSLLKEAALGQCDSVMAEFYTFHGLQIRSEEYSQKQPQTFPSRTLSRTETWTNIKTVTDCTSNGALDFLGQQVNYQNHSQLPQLTPLDPESWVSAQCTHVYPDQSDVPSS

SEQ ID NO: 931837 - protein, 151 aa, Homo sapiens
MDGVHWNWVFSFFHMEESDQAPRGETHKYLVVALDWVAPEFLTLRLVRPDSPAICKLELRFSCPSTGPHSGFHRSVVALDSHKSDNPIVNYACEESRLHAPYENLMPDDLKWNSLIPKPSSAPFWSVEKLSSMKPVPGAKKVGDGGRTSFN

SEQ ID NO: 931838 - protein, 151 aa, Homo sapiens
MAEWPGLEPRTFSLWLPASCTTWPGEHADTEFLPPNILFTIPNEKTLQGPGAPGPPLLAPAPVCLGPLRGLTSLSKRHKRVNTSEHLVSHVFCVGVKGRPMQRSWGEAVGAAPRDDGLVGSLVGLLLSAIQCCWCLKEAAVEAVDISDISL

SEQ ID NO: 931839 - protein, 164 aa, Homo sapiens
MGFLMEFKGLLLNGAIIASSSSTASQVFPLVLNINAVSSNLLLQTVQMTFPELDFSTAILQGHQHSGHGIQHTREQPSWMVLNNDVLLDYPNTGHLLSTAQVPPPPVKMNHPGEKGGPLMQHEWYPCKEEGRDTGRRRPRKQSLGSHQHPSFHCVAPGNGSGTL

SEQ ID NO: 931840 - protein, 152 aa, Homo sapiens
MQVNWGKPGFGCKSVPACSVCLILGSRMKSQWLPEAYTPCVGVKTHKVPWFGSLAAPHIKGPDTTMVKSRSGERPLSKKRSILEGSEDNKIHSTTVSNGVGSFASWSRTSQPLDSLLAAPADKPRTTAAQTSSLCVPGCSVLLQSRWGTEGR

SEQ ID NO: 931841 - protein, 136 aa, Homo sapiens
MFTTHRHEDLCPGDMVHSFMGFTIWCGLQTYQQAVIIKWKGTMIGEVQGSIGTLRIGTRPDLAEWRVRKGLQGEVVSKLNRNWPGKGRRKKSGYQAEGNTLKVRKRLTQYLGIANAHVAGYKKQQMRYQPGEIINS

SEQ ID NO: 931842 - protein, 165 aa, Homo sapiens
MSCWDRAQPPATLNWKKQGTAPLAAFMGWCCVPVAFPGTWCKLLMDLPFQGLEVGDSLLTAPLGRAPVSTLCGSSNPTFPLHTALVEVLHEGSAPAADIPEQLQECFGQVDGSPPAKVQEDLHLTGMASVLSHWERAVWRKCGSDKEVGDPEVSGWASIQCSGST

SEQ ID NO: 931843 - protein, 158 aa, Homo sapiens
MVYCPMLLCASPESTLDSPPLRRKTAPSLCYLWPLRDSALGYGEGFIGSTLLEAPAMESVCADLFMCPPSGEGDWSAAGEAHKIKTLAVDPGTDRHKQAIVGITCTSVEEQGGLLLSTWEDHQGNPTNNWERSGVDTACQRRGMLGGERGEAQSLCQS

SEQ ID NO: 931844 - protein, 116 aa, Homo sapiens
MFISMGVEKPSERETHESHSPLGFGYSDRSDGWVGSDGEQGGEVLDRAFLDGLALMLVLATERNGQNVNGEVVPEFEKWLCHLQYVRPGAQLPLLKNEDEKSHHLIARGEIRGWVI

SEQ ID NO: 931845 - protein, 123 aa, Homo sapiens
MADMGTLISLRRRKCHLYLQGESALGVNQDHISDAGTWIYRQLTVCLMWFGCVPTQISSPIVAPTVPMCRGRDPVGGNWIMGAGLSRAAVLVIEKKKNPVALSLLSRNSDSKAVQIFAISLRC

SEQ ID NO: 931846 - protein, 157 aa, Homo sapiens
MYVTEKCTNHHTLANYYKVNTPLFFLILSLFPPFVLQRAPVCVVPLYVSMCSHHFLPLTRENVQYSVFCSCTSLLRIMVSSSIHVPAEDTISFFFMRSLSLWCHSSIPGLYSVLLFPKLGFQVTVSEVASKSPTLLPLLSILNRCCDYRSTLCPVSF

SEQ ID NO: 931847 - protein, 172 aa, Homo sapiens
MKSSNLASLQINTNGIIHLDEGIRVADGVSIMSHHMRDSFCAHKDFSHFAQLVLGFLRCNTMYSKVTLGVIDQTKILSHLVNADDIHESSRMNWKNWIFGRSQIKLWTDNPTKIPPSWGSPVYEGSLPLFLRVPTLNPVFFCDRHPAPNVNPLDALLSILSPVPPGDSSTIM

SEQ ID NO: 931848 - protein, 153 aa, Homo sapiens
MKQTCVGGSGVAEQRHEPPQTLASTEGARSLGIPKVITILTLCHVICFWARSAAATIQAALTTGIFRIVSFVIIKCLWSSVMWVDAVYRTTWTNQPPPQRNTGFPLFQWIIMLTVSGSVLSAATNGKANSNEFNQKGNVLAYVTGSSQMGQAD

SEQ ID NO: 931849 - protein, 154 aa, Homo sapiens
MPSNNPGRQTIILFIRPKMTKINVWVQTVYFWKARPCEKVMTWAFSMFFSQPVPLKHPFYVWGVNSENATQKASSQAPCNLSSTNQTSKSESDSAVDQGRQEDPRRISLLVVKVSSLQKQQCLQTWIPKVQKWLQWLEFVEISVVLTCWQQCKL

SEQ ID NO: 931850 - protein, 143 aa, Homo sapiens
MNERRPLLHRARSHRPRRAEIAGPQAAGLSGSSTCGPSGRSTGWKVWLASITISELAVTSAICHGGSALAFFQNGNINAIVPCEIGEVNYTLKLFSVALKMLALVYSLNQRLGGGVNPENKGLERGESELAGTVYCSCDRNRR

SEQ ID NO: 931851 - protein, 166 aa, Homo sapiens
MAAQKEHPGWAVLRVWPQELLASEWQSQCGLTAHKVQVMPTAWLMDTEVQVMPPAWFMGAMVQVMPPAWLLGTMVQVMPPAWFTGAMVQVMPPAWFMGAMVQVMPCMVHGYNGAGDAPCMVHGCNGAGILPCTCSLIALTPGAEPAGSPGLELGPNGYTHLEAGSS

SEQ ID NO: 931852 - protein, 186 aa, Homo sapiens
MALWVNPLLPCFGRQLAAEQEFSCVRPMAVIALFLPFRLHFKAPHDAKRAAGYSRSTTSQMLVQGKRGRWPLTVAAKGYEKSLTQLLASLYRSTFWTHVPTQACLWNGRELTVLSCLNLQGRSIRLAMRHEKGCLYLCDIIIFSSALRSVHVGETFPGLPQNHHVCSIPRATRQQGSEEEQATTWC

SEQ ID NO: 931853 - protein, 144 aa, Homo sapiens
MPGIEDVTKNKGDPCSQGAPIPPLSASLCEKEYHILFLFLLPNTHREQIEKTPTNKNWPNKHTQVKAALVEVSSGTFLHGCQPCLCNVNHAYRKPPEKPKRTRCFPESCELLQQVNQILRGGYENANLKTVDQKFQRPAHVTDV

SEQ ID NO: 931854 - protein, 138 aa, Homo sapiens [sequence omitted]

SEQ ID NO: 931855 - protein, 458 aa, Homo sapiens
MSAKDGSSKSLTAQTYLRHYSHTTIYSHTIIFSHTTIYSRTAIYSHTATYNHTVIYTHCHLSHTTIYSYTAIFSLTAIYSHTAIYSHTATYSHTAIYSCTAIYSHTATYSHTAIYGHTVIYTHCHLSHTTIYSYTAIFSLTTIYSRTAIYSHTATYSQLPSAATLPSTATLPSTATLYTTIFSLTAIYSHTATYGCTATHSHTAVYGHTAIYSHIATHGHTATHGHTAVYSRTAIYSRTATYSRTATHGHTATHGHTAIYSHTAIYGHTATYGCTATHGHTATHGHTAIYSHTAIYSHTAIYGHAAIYSHAATYSHTATYGCTATHSHTAVYGRTAVYSRTAVYSRTAIYSRTTTYSRTAIYSHTAIYSRTATYSRTAIYSGANIYIHAAIYSHTTIYSRAATYSCTAIVITWGGTARPPSALPPHFTFSFLHMPRSCMNEVFTLHLYFKRNKEKQSH

SEQ ID NO: 931856 - protein, 134 aa, Homo sapiens
MSQGYLFQMEEVKGPEGTAVLRVPVFCELTQQRTARDTQSHTVAGSLAAVFLIPGADGQKGFLTRCFPGAWEEVTLSTDTTSCSRPWSRLSRHSQQRPHRELLGRQGDVGHRHQLNGGWHSASTIQPVPQIKEK

SEQ ID NO: 931857 - protein, 185 aa, Homo sapiens
MHVVLLQPSGLCVFSAAGASRVPSCGLALLLLLLGSWGLLSRNWEESLRNWEESLRSWEESLRNWEESLRNWEESLRNWEESLQNWEELLRNWEVSLQNWEESLQSFEESLRSWEESLRNWEESLRSWEESLRNWEKNKLIVKQLQAGPVGGVQKKALSSQEVTALCVSLPLQTFQWDQMLGGRQ

SEQ ID NO: 931858 - protein, 156 aa, Homo sapiens
MVKEKPQSCPQSCGIEAAMAGFIWLRRVRWWVEGVRVTGSESARVRSNLNSCLLRRNNSKEGHKAEKDRGKFQSRSGSLLQSLRAGKKVHSEEIQAGFYTLVHLRRSEPLSRDSSLRVGCPPAQNPPHAWEVSVRSGLEVGRMPIRGLLPSSVCRC

SEQ ID NO: 931859 - protein, 147 aa, Homo sapiens
MFETCRQTRAFSKAAQEMFHGPRLPACLASGFGDADTQVQLLRDRGTCSVWGMAWGSGAISGVRGKGEEQCLSAEIFPHGPHGHVRVGSSPSSTLLVGFGNGNHVKAQPNKDPEVRKAFPVETTCLSASDQFTPGPDRVILVLRGME

SEQ ID NO: 931860 - protein, 216 aa, Homo sapiens
MLQRQSPVYNCSFRYTGNGIKGARDVGPYSYLGPAPNTGSCQQAAGKFRGISDAKAPEEDSNPCGRNIRHEECIVDLPEVVALKKKPEASLHLDEAHSTGARALQLSCCGIPQPGSEDADVMMGASAKSSRASGGHIEGKEEQTDSPWTPSLSATHATLLSPPVVQRSLYGVCHGAGWHGPGDALLTYGNKDSLTLCGMPKLVPLDQLLEQNLVYR

SEQ ID NO: 931861 - protein, 156 aa, Homo sapiens
MSILSSFVLFSSSSLGQGPRNSGLAEPQSWCFCWRGSGAQGSALNVVTCRSQDCRPHGLQSPGRWGNIALEVPEQGRTRYKKPHTVYFHVHESPEQANPEGEKVRQWLPGAGGWKGTAKENAVSPGRLEIFRSQGAVMVAQSRECTSTTELYTLNR

SEQ ID NO: 931862 - protein, 140 aa, Homo sapiens
MAKKHAFGLILTEAPLLVVVAKETGLALPSAPTRGSPYLTRRDRCQHFSPQHPVEEAKFLVSMTDSPLPPASPYSSDGALAQEQRAKKAGIQLLCPAPLSNELVCEGCQNKAPQTGGLNNRNFSLTVLRRKRLSSRRWQV

SEQ ID NO: 931863 - protein, 124 aa, Homo sapiens
MLPGRSRTSFVEKCFQSRETHSLSREQHGKDICSHDSITAHQVPPATVGIQDEIWVGKQPNRINCPLTSIIAEEKTAISPFGFSCTRQLVPTFCFQDFHVGFKHLYYDMCECESLCIYPTFGIH

SEQ ID NO: 931864 - protein, 210 aa, Homo sapiens
MSFNAIAAAMDGSYEARTATQRVHQGDARCSNTGCAPGGCEMQQRSVCTGGWEMQQHSVCTGGCEMQQHSVCTGGWEMQQHSVKERKVVRYRKSPKLTETGGPATHDCCQGPGQGKLLSPPVTIALAHHANPAVTIKLACYEKSPVTIALARHANPPETIQLACHANPPVTMHWPAMLSHPSALCMPTLACCDFFSHRTKFSRETTFTAV

SEQ ID NO: 931865 - protein, 225 aa, Homo sapiens
MGIPFSKPLGWEVNEAAQQVPRGERTGWRGSVGALQAFGLCSGISHGGSQRDPTHNGPEGVLPIRIHLSSRVHEGLSELSSSDPRIRAAHHGFTCPPGPTRGSQSFHPQIPGSVLPITDSSVLQGPRGALRDFILRSPDPGGGSVWGGADCRENPLAMELQPPRSGPSPSPRLILGPPGHEDPHQVPGHPRTTRKPPEPQQEGGIYTFRMKSGEASLTLQMPTQV

SEQ ID NO: 931866 - protein, 133 aa, Homo sapiens
MGRNQCKKAENFKNQNTSSPPKDHTSSPAREQNWTENECDELTEVGFRRWVIANSSKLKGHVLRQCKEAKNLEKRDGKSLPQKSRGACIGYDSVMGTHVSTAQFRCKDCGLVRGLGDGSSRQNTDSGIQEFPS

SEQ ID NO: 931867 - protein, 135 aa, Homo sapiens
MISNTHVRGPTDPPVPLAASSPPGALGSLAPLQFSVNTFPLLRSFTRRIRRFSDLIAPPPRPQRATPSSHAGIAESHVGIPGLTRSPSSRTFCLPAPGRDPQAQPWGCLPDGSCGSVPRAPLDHLELSPPCSLLQ

SEQ ID NO: 931868 - protein, 287 aa, Homo sapiens
MAYGQTGSGKSYTMLGRHSDDGPVLPLDPQSDLGIIPRVAEELFSGDTTVEGGDVVWQHVPDVGFAVFPKRESEQTRTVSSLITSTHDLERGALGQGWGLILENTSRSPKVEVSIVEVYNNDIFDLLAKDSIAAVSGVKREVVTAKDGRTEVALLASEAVGSASKLMELVHGGLQLRAKHPTLVHADSSRSHLIITVTLTTASCSDSTGHAEQVQARLQLVDSAGSECVGVSGVTGLALREMACISRSLAALAGVLGALLEHRGHAPYRNSRLTHLLQDCLGVRQSS

SEQ ID NO: 931869 - protein, 158 aa, Homo sapiens
MGRNLGQYLAFLGRGPCGLPQFFRARALCLEIRCCLQSWQTGMVKSAEAVPRAAPSPRCSVPDKPLTGAAAFLSEMPCPERRNLERQSGYSGFPELQWALPNSNFLAAAHSRGANGSVLLAFQEPLGYEKKFLQLAQCLPKQPLSFVLETQDVGGVDT

SEQ ID NO: 931870 - protein, 154 aa, Homo sapiens
MIQWTLGTQGERGSGARDKRLHIGYSEHCWSDGCTKTSEITTKELFHATKYHLFPQNYIWVVSSLDLLCIKLLWMFLHMSFCGLRHSFPIVRARSRISGHRIGISLNLVNIAEEFFQNGGTTLYSQSNSIFSALYTLKYISFLKVMKIIYKTNF

SEQ ID NO: 931871 - protein, 144 aa, Homo sapiens
MNKNLLYIFLGDQMDGLLLSECWEYNCQELKLGPSMKKTEALVQVYTSKVHEQFAKKSRQTTWVITRALTFANAGWAQEQKSWCQQCSHAWKPLKAVAGSSEWGGDPHGTQKCILPGLEDPTSCGLSIPAVLPCQPWQSRGELC

SEQ ID NO: 931872 - protein, 179 aa, Homo sapiens
MTSEGASPKPWQFPHGVEPEGAQKSRIEVWEPPPQFQRMYGNTWMSRQKFAAGGPSSRPRNGRSTNTTNNLHRAPGKATNTQCQPMKAAGRKPVPCKATGVELLKAVGVHLLYECDLDVRHGVKGDYFVALRFDCPTGFQTCMGPLAPLFYRFLPFGMNVFIQCLYSYCILEVIQMGFP

SEQ ID NO: 931873 - protein, 150 aa, Homo sapiens
MPFLCYHADSAGSSWGLPEQPCGHRDCSPFPCLPQPHHLLPGGHLATLLVSKAEAMRKKDRRGMRTSFQIRQEEQGPGEHVVEAASGELWWCQIPWREEAAAPGSREPWRKLPLQTRGNASSGFHSFVHCCFPSARRSLELSGCSKDTVE

SEQ ID NO: 931874 - protein, 136 aa, Homo sapiens
MCRAHTHHTEPTDTAHAHDTEPTGRGHAYHTELMVRGHAHHAEPTGRGHTHQAEPTVRDHARHVEPMGRGLTMQNPRAEATLTMQNLGKRPGSPRRTHGKRPHSPCRAMCRGHAHHTEPTLTMQSHGPTNQKTRAS

SEQ ID NO: 931875 - protein, 197 aa, Homo sapiens
MRTFPSGSWSTWVLICLCSWLLLDFARMNGTSLHLHQVHTPKDDYAAIPTEVQRVQAVHLSSVTGSSGLRVCVAPTSVTVLSVSPCYICSLLAFKFVFHKVRKRENGWGVLLYLQNKQNAEVLQDKGVSMTWLVNGTARIQIQAAGPSPVCSELLCCPPVPMGTRTCLGNNESMKVLKNLDCRENPLRNLQTAFHSG

SEQ ID NO: 931876 - protein, 157 aa, Homo sapiens
MWSARGAELALLLVPCARNGHCICLLLSWRDIGLGPAKGWASIRSHLIDGLARNPRSHPDLNESIPTLIYPVAQHPRKEQVQADLQALHDGCSRHDQFIGSQRLLFPYPFSRILVGFYALSVVPLAEACAEHLTSYSQLAGTGPWKCLTSTPAAVQR

SEQ ID NO: 931877 - protein, 153 aa, Homo sapiens
MWSARGAELALLLALHDGCSRHDQFIGSQRLLFPYPFSRILVGFYALSVVPLAEACAEHLVKFMKHVTVTCRHGTVWVVSPIVKPAPDIVLAAGRNRTVEVFDLNAGCSAAVIAEAHSRPVHQICQNKVTNQFSNIFKRIILENDMMLFGVIL

SEQ ID NO: 931878 - protein, 163 aa, Homo sapiens
MHRRCSAGSWSTWVLICLCSWLLLDFARMNGTSLHLHQGREMTWLVNGTARIQIQAAGPSPVCSELLCCPPVPMGTRTCLGNNESMKVLKNLDCREKSLFLELDVIYSSFCKLGRWLSMNKETGLSACENIEEKDSFKNLPSGQEQWLMPVIPALWGAEAGGS

SEQ ID NO: 931879 - protein, 141 aa, Homo sapiens
MAMEETVPYIDTDSEHTQHSGNFAPGLQSIVTYRKVSALVRGNAVWNTMMVDKAFRESPDGRVGRSIVCRTGKPVSALYIMEEVQYNQPITSTIGSAGSCGPNGRAAAQQPGPVAEPSPILDPTQSWQCFGSLNKRARVTH

SEQ ID NO: 931880 - protein, 137 aa, Homo sapiens
MSRSRVRHYLTREMQGVREFPFLAKERGDRRHLENRVTPTLILCFSDSLSKRHNRRLYPAHSSEGPMPTEPRSLLAQQSEIKLQGGNKTSRGTIRQQHWLFSNTRCSAASAADTQANRVWSGPPANSNKPAAEGHDC

SEQ ID NO: 931881 - protein, 143 aa, Homo sapiens
MSPVEAAEYQRWLPAPSSGSSVPKGHQPDAGGNGPVQSAAEWPLRICTALCLGPKALVPWAHEADVLIHGLHRSMEKNVVSQIIEKGPSCHTVECMSCLEVEEKRLDEKLSQHQERRHVSVCMNDCDPIHMQKSGIHSLNSFS

SEQ ID NO: 931882 - protein, 136 aa, Homo sapiens
MSENHYFLSKFFSNYEQLTLMFLREFLIHESKAHLVSLPTHLDCSVLEPACTACKKLLVKFQEFGNVTLTSVKVSVPFKRTLFFAAVFIQFLLVSAKEQSISPNGRIQIGTSTKLWSSCAAELILGELAGSKQEAC

SEQ ID NO: 931883 - protein, 138 aa, Homo sapiens
MPSLHLGGLKHSSGWSSVSFRNPTCQCNLKFVLCALCKKPYLENSLRGDFLAAGYQSSFHKPVAGVAAIPAGRTLLSKLPSLPDTSREKWLIGATVMAATPLPGNSVALDSVQPAAAGCSPSRLHSSVLETQGPGGVG

SEQ ID NO: 931884 - protein, 168 aa, Homo sapiens
MVNIDCQLDWIEGCKVLFLGVSARIKQAEEGKGADLLSPPAFIFLLCWMLPALEHQIPSSSAFGLLDSGLTPVICQGLSGLARLSGRPKAAEDKGAHAQKEVDWECLRTQRLTIKEDLFYTFWHMNNGSISLEQLLLLTHYVHQHNVINVMDECDILWKGKAIKILAN

SEQ ID NO: 931885 - protein, 155 aa, Homo sapiens
MQKGNVGSEPPHRVPTGELPSRATVSRPPSSRPQNGRSTDSLYHALGKATDTQCQPMKAARRETVPCKATGVELPKTIGNQLLHQCDLDMRCGVKGDYFGALRFDCPSGFLTCMGPFPEITTTDMLEWKKGKKQDGRIEGPRLCPTMGKPNSTTS

SEQ ID NO: 931886 - protein, 143 aa, Homo sapiens
MKNERLRKNSQFLCLGLLKNGQPCRNVTGLKVAEELFPITASGLHQVLLGYYWCSLKAQGLFSQLVVNAARPRILLSGQWAPLCPTEGPEMLSKSSDLKSGTQKACLVLYPTVAELDPKLKDKILFTLPSLFLKQKGSLPVAT

SEQ ID NO: 931887 - protein, 140 aa, Homo sapiens
MSWYTLRQLLKSLHLLPCPTLEDTLVIPLEHPDLSLDCFLLGVSTTLFELRLSGIDHSSVRPPHTLVGLQNDAAGCTPLRVLPQPHTATFPWDANVEIPSLLRNSSSPQSASLTLLSMDSLFGLAPPNSLWTVSYLTSFP

SEQ ID NO: 931888 - protein, 130 aa, Homo sapiens
MRKEETNSPLKWMAGGRWGKTYDYLIGSHRKQTQQKSGFRLEKKGEDCSLKMTLQKENRPSSDSKKKTEKEGAEDCLDIKGAKENGPNNIAYLRELLCKLKTGKCCKSFSVFAGTSEHSINVNYCWQSKG

SEQ ID NO: 931889 - protein, 138 aa, Homo sapiens
MSKLSTIPQVFFQLPATRPPTPLGPQLEPDISIWISKKSVFADFQSLKFQSGSPQHDQSFFIVKGNGLGIELPLFQQGPQPFRVKPWLPSRSLILRAASVRSMLIGRPLGFREKTGGVSGLQIQVPGEIGLNRSEEAL

SEQ ID NO: 931890 - protein, 270 aa, Homo sapiens
MRTAWERLAAMIQLPPTRPLPQHMGNQENFSKDWLQSMSIHVSNRRRSQQLKEGGKVTQLFIKNALSNCYMHALTATGWAQRESSKNTCCALFPGLLDRMKAVKQQCPGLSSIREAGSRHSIIKFMIAEKKIKVTKQQGGMIPVLCSSCTCIPMSMQPEAPTESGGKGRATGNTAELLDKFSILFVSLAPSHVRATKLSKNYPRHLLSKAEKLQLTSPEPNSARIPDVIYILGREKVYFILVKNIWKNFDVHTFKKAKNLGKSLGIILTT

SEQ ID NO: 931891 - protein, 146 aa, Homo sapiens
MENGLQSASHSTALEQRGYRVQGDKVGSRKHCTDIKTPLLGKQAATAGILLNVLSGRNTADKEANTDRKASHALELTITALNVPETGGQCEWSGAGQEDSGRRGSQGSTMEDQNSRALGALVVASCCCYWKGAVALTVSPETLSVL

SEQ ID NO: 931892 - protein, 143 aa, Homo sapiens
MGWPEKFSEKWILERRPELCIGVVGRMGFPGRGHSKSKGRKAGVCLACESFFNEARVAAAEDNQSDFCTSYIMMTPSEAPLSQTEWQLISLSPCFYEKTSPEECMQLLVKTPWIHFENLWIHFENLWIHCGILAKVTFSPGCS

SEQ ID NO: 931893 - protein, 141 aa, Homo sapiens
MEERAANSEELAAPPPAGVCTSGPTIRTLPRDNQEDSSAAPLCLGGGGCFSCSGNYLCSPCQAIDVVQTLTLRRFYGISIPLPDDEKKSPIDTGLSMHHGSPGEESWGPVPTGCQHLLNLETVSEEGRRVCEQVEALRGQT

SEQ ID NO: 931894 - protein, 161 aa, Homo sapiens
MRSCSWQSFEGKQSLLTTGKREKWQGFGREVDPTDSHSFTLTFQDAGARPRLKQERFPRPLSHALRDDRGAFPVSGIANHRLGADYFAANDSDAGIAASVLRNEVELCVICVVASYRESNNNIQGADLHDLSEERAIQKQEFQEDGASHRPNWIQWLYGYQ

SEQ ID NO: 931895 - protein, 164 aa, Homo sapiens
MKVMLRLLPQETGDVVMLLSDMGNVEEGEWVCRENGVSAVTLTVKVCGFTPEISETMNPPRGMNNSGRATFKNCNIHYEARPQTHQKEETLDTSEHLKEQTLDTPSLRIVTLTARVCGFILEVSKTKNPLEGTNSRHILVTQMGLLPIAKQIPPQKSRPNKSYS

SEQ ID NO: 931896 - protein, 143 aa, Homo sapiens
MLVYPALLKFLLWFLLICDTGTCNFCKFFMQEYKRELKGSKEMEKEGRKEGRKEGRKERRKERQTNRKRKKEGRKEKEKEKGREGKKEKEREKREKERREGGKEGRKKQKEEKRKGEKKRRRGENKKERKNEEEMREKDLKSE

SEQ ID NO: 931897 - protein, 147 aa, Homo sapiens
MAGGGPRALKSPCVECCLAWSSPFRKVGSPLAQARSGKAVQESSPGIKDPKGPLGALPSEVMLILKVQDTTEFSVSKLLCSFSLSAQETLSASCGCLVLGRCGIGNHNCVCYLFSASFSDRKNKAGNVGCSQITKNLACQPKVFAIY

SEQ ID NO: 931898 - protein, 150 aa, Homo sapiens
MPITIPLKPNHPYPAQCQYPIPQHALKGLKPVITHLLQHGLLKPINSPYNSPILPVLKPEKAYNFSIHTKPYPGHHQSFYTTNVSSNNPTISPLTTRSPFSLISPTLGSHTAPNHARSSPEKHRPFSLHTTPQKFSPPQHFNTILFYFSY

SEQ ID NO: 931899 - protein, 137 aa, Homo sapiens
MGVPEHIPFLHSFHNGSTIGCHAAPAQMPAALKNMEQSTNLGSGFCGITLVTRKNEVVSDGDEELVENWSNGDSCYVLAKRLLAFCPALNGWNFELEMIQALSVQLHLEHKTGRSHVVSLEFCYMHIFPLLILICIF

SEQ ID NO: 931900 - protein, 165 aa, Homo sapiens
MSGAMVAEEIVIREVQLETSAASGAFAGVLLGPTGPSWPGRLCLAYATGLISCQEQSERLVVCERVSVGSGHYTQPGMQWAALELCVGARGKYAAATSTGTSNGLALQRYREESGLKAVITISAMKCMACGRRGSYTLFSNINPSGLRTNSIPHRDHGLLRRKRV

SEQ ID NO: 931901 - protein, 228 aa, Homo sapiens
MDNFNSVLTFTKVSVLTFTKVSVLTFTKVSVLTFTKVSVLTFTKVSVLTFTKVSVLTFTKVSVLTFTKVSVLTFTKVSVLTFTKVSVLTFTKVSVLTFTKVSVLTFTKVSVLTFTKVSVLTFTKVSVLTFTKVSVLTFTKVSVLTFTKVSVLTFTKVSVLTFTKVSVLTFTKGSVLTFTKGSVLTFTKGSVLTFTKGSVLTFTKGSVLTFTKGSVLTFTKGSVLTFSM

SEQ ID NO: 931902 - protein, 143 aa, Homo sapiens
MRDVNFSLNWSRFSPNFRGGGECGGEREGGERLNEATIAQKTSKEPSLSAFTDDSVLMRAEASQAARCAIRLRWLSASFAGPFSVILEKKNLKDFFKDSPTLRLASHVKNLSSNFASNTYTFRYLCLFVHYSEGLHQHPGPHL

SEQ ID NO: 931903 - protein, 212 aa, Homo sapiens
MRSHSSQWKPDTAVRWMHQIINDPVSFVRCTLMAKLLASVPLLQKTFLVALYRIVNLINLAIKKRDLWNFELERDDLGYLVEEISKQQSIQEVTWVWLKAFSFKREAEHKSSKNLQPDYAIEKKIPFSEEKLMLAAEICMSNEELNVNPQDNGENVSRYIQCIGGIVGLEGSDPPGPSFHYLVCVYYFSTCRSASEGRESPVALRAAGQIPQ

SEQ ID NO: 931904 - protein, 151 aa, Homo sapiens
MSCKRYSRRSLIIIGDSSFMHVINHEKLPVGQDVEVEDSDLDDPCPVKHGCRGLRKPIIIVEDKGETGSTPLSQLVETILEYGEQLCYRKAYFSSYNRATEDTRRWESIEPHFPPLSLPFQLPLEVLQGKGCIFNIATFPPGIFDSLCTQW

SEQ ID NO: 931905 - protein, 165 aa, Homo sapiens
MMRGTSDFANLFRSCHVARLKETHREGVWQLGQRQQKGGSRRNGEEQKPLLLSSSLSPDVASGKPKFKPWGKTPSWRRRAKEKLSKEDKCKEDENKNLCFTVKAYTGECSPSAQCNDFLTLSPQIGHIYQPRHRQLKQPQASQHYAFPKGLMTWWSRSKCAAGRS

SEQ ID NO: 931906 - protein, 168 aa, Homo sapiens
MVIFMLEEAGEPPGCDTTAWPNCEGRGAAICPLTGTPVFMPKYCIFQDHSGPPRPQSCAYKSPETLAGTDTSSWTSRRTHGQNTLAEHTGTHQQTPAGHIQWCHVKFSQRRAPLLGGLTPGEDHFPTPSSFCLPHPPPWELLPLNKNLAPILQAPEILQSAQALKDDF

SEQ ID NO: 931907 - protein, 240 aa, Homo sapiens
MNPGGIGHQAYRRSWRWSMGFQFRELKKFVHVDVESGVIDTGDSEGSSVIFPLKHSQKDVTGNAELLYMKDTKGSMNWDIQSRRGKAKEKKCGLMALIFIAPSQPPHQKYSEGEVDATGAFMRDQQWGSFSYHQRFYFQEKSEEERKLRESLELPRELLNGGDQNSNSDMENEAQAEEVSDGNGELIGNWSKEDVWKSLDVQPAAGAEALERASTGVMQRRNVGMNVYDIKIPCYPTLYN

SEQ ID NO: 931908 - protein, 140 aa, Homo sapiens
MMDDRQGVSGLGKQETPNVRDYYHPWTVAQKLWDLPRRIHKEKFAQFAPITSCPRIQRPVGKGLIAACQRGTKPVVDPIPRPARHPPHHALANACAVILLSHYTATSIHKHSKINVLEIRYLYFVVIAGFLASLNLFPYI

SEQ ID NO: 931909 - protein, 174 aa, Homo sapiens
MLCSSLVGNPRRGNKTALFLWIHKISLKSDPSCWTNSRGSGFCPLTLPLSCQPSESPHNTKPSPDIRLLLQGKNTYFQVRYQELGFPGNSGREREFKMIRNIHSDQLDPFSSLLLRLYLQHKAGSQASPSHYTFKVKRKVKSATKFSSPAEILGRLLLPSGYISPPFPIPIRRL

SEQ ID NO: 931910 - protein, 235 aa, Homo sapiens
MQTGMKIDSKTPECRKFLSKLMDQLEALKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGVASNTIQPTPQTIPAIDPALFNTISQEGRIVNYICLVYHLEPEP

SEQ ID NO: 931911 - protein, 139 aa, Homo sapiens
MNFCKAETFSPLQAAKVNIKYIKFKFIRLIYSITYIVYVVFMYVWAMQKKNVELELPHRVPTEELPSEAVRRGPPSSRPQNSRSTDSLHCVPGKASDTQCQPMEASRRGAIPLYPAKPQGWSCPRLWEPASCTSMTWMT

SEQ ID NO: 931912 - protein, 160 aa, Homo sapiens
MGTTIQDENWVGTQPNHITKTWKVAGLPNIGIKIYQTFNRAVIKKLVTRAQNLPQATSLITEKQANSQFLGCSTELTEEIHIIQRVCEFFWLSWYVSAVVPGVKVHDHASTKERPCEDVRRRQLQTRKRPLTRSAGILILDFPDSRTARSNDLLIKSPSL

SEQ ID NO: 931913 - protein, 141 aa, Homo sapiens
MTPFENVHAVLTTIFMGHLSCPRPSRQDLYESAKITALLGLGCPLNKNSLDLNTKSLQISEKPFQKGQAHVASWRWIYHSGVRSMVVLFSQFILGSAPEENLYVDSDPTSPFCTALAEVLHEGPAPAANFCLGIQVLNREQ

SEQ ID NO: 931914 - protein, 148 aa, Homo sapiens
MEFPDALHFPSWRKAKEKQSHVLHGSRQEREKEHMCRGTPLYESIRSSETYCHKSHMGKTYLHDSITSHQVPPTTHRNYRSYNSRCYLGGDAAKPYNSISGSSEISCPHISKPTILSQQSPKVLTHFGINSKVQSPKSHLRQDKSICL

SEQ ID NO: 931915 - protein, 205 aa, Homo sapiens
MSSLKARTGHLHFFCVTSGHLGIYVQVTGDAGGLAWAQRPDTLPHFLFDENKVAYHICSSLGEENTCTNPGVRNILSTYLRYYSSRTETLTALLQWLIADKSIGIQTSRKQPATKAAKSVPSAGMVEEPHSRLVVGCFLKSNTRIPLTNKLYFWDLVQKHCLGFIVMLVEHYCWSSTQEEEKIVGTDDPEGKVKKLLLVQVWNGP

SEQ ID NO: 931916 - protein, 156 aa, Homo sapiens
MVEDKQELAMQAMKTAEAGSCTLQSHRVGAAQGCGSPPHASAEVGMIRFQTCMGPVAPLFWSISPICSECVYPMPVLSLYLGKDDPKQGIVKSSLAKSCFLIYFKVDIKVSLYLVNYHLNRSVNRLEPALVLIIETGPIKEAQLFKPCSNKANADL

SEQ ID NO: 931917 - protein, 134 aa, Homo sapiens
MSENILVFLPNENFPAPFPLEENTILLPVNIAEEGTLAVIVAKGLLLELYPREMQTCRFPSRDVCLGQMISLSHFHSLGTHSIWGVFRVLQEQSTSFRGSVVPSVFLIYSYSRSGAKVHEASLHMLHVVRAFSG

SEQ ID NO: 931918 - protein, 152 aa, Homo sapiens
MDTNPSLKSTPKIKFFFFQDAHATPYVTTEKQEESRWEDTYPGWKTRTPEDRERSRLDIHHSDITNIDPQKDDCFNPLTIILCSRPFLLDSQIHALQEHWVPQGTCLHVYIKDSLVTWLLLVQPQEALAGSQGEKEDYGQANLSNNYYIFFS

SEQ ID NO: 931919 - protein, 155 aa, Homo sapiens
MRLAGAWGNILLGVRRRSRVRANIVAGKAVPVSKGQCKERTRGCIARDKEGFLHCSEFLDRPLEFCTRYRACSPRQNRQEAVLKVSSATGIVCQDLGNLDSRDCFVHLIEAAVSEWRLIGLPASTFAHPGEHCLQGSQKDLLTSCYYFVKGKKES

SEQ ID NO: 931920 - protein, 144 aa, Homo sapiens
MALTRRELYSRGCRSTVNGSLGPYQRSLLTPGAHKERSEGLTGTSVSFCKVSKRSSPTEADVSRKDCPLNRCWEGCVSGKGDEESLVKGYKLRLDKRRKLWGTGSCQNNPFRSDSQVRERVGGRWKVDWRGKRRSLTHADTIQI

SEQ ID NO: 931921 - protein, 162 aa, Homo sapiens
MIIYRDLISHDEMFSDIYKIWEIMDGLYLEVEGKMQCESRLIHYAWVGPNWSHYELTPATQNNLLPMVRMRAVVHLKEDESSLDAICPGTLPTHANSTWESWVMLTLCRLLISQTKEGCQSHKQSTISPQRFDNYQDKAQAAVDLQGQLQQGENLQLQARAV

SEQ ID NO: 931922 - protein, 169 aa, Homo sapiens [sequence omitted]

SEQ ID NO: 931923 - protein, 134 aa, Homo sapiens
MGPVEPGMGEYLLVCRLLRLWEKCSISSEVRCFSRTEFFPSMQKFPFCLGVCLEMVSMSLTLEQGPHDSAGCSVILWLSCYPKCKTKFSLIFDLKQKEGVTFIAMSCTACDWGMSGSSTPLAALAGVSLGQIQP

SEQ ID NO: 931924 - protein, 216 aa, Homo sapiens
MEDAPPPARLAALKFDLGLAVSKALWPWDPLSQAQDIISWCAVCYNRLKSTVFSWQCPNFSGTVCHGFPWLGKGNPLTSSTSWVQATFTPMAVPAKVTRTWGCKDRRGKEDAPPSLPHVPIICKEEKGTRDTCSPFSRWVAIHLQSVIVSPSYRSLPSDASSKLESANFPNHKLVGLRLGSGEGNPEAQHVGKRGIKLQTLMQLEPLMMPLSAGNP

SEQ ID NO: 931925 - protein, 153 aa, Homo sapiens
MCGVISQASVLFHWSIYLFSINTMLFCLHLAPGKAADIQQQSVGEAKGTASHNATGAELPKVLGAHSLHQCALYVGHGVKRHYFGALRRQIEKDPKQLVVSQRSWREESKVIFENTWIVSCKATNGILIYLTPKSKLVTTMFSFDKLIHGSTQ

SEQ ID NO: 931926 - protein, 139 aa, Homo sapiens
MIAPLTACIVCLEKPQTLFPLSKDSCSVLSAQWAPCHVAWGGCPPPLRAKGQCDSLFWVPTICGPQALVRHARRTRLPGYLKDNLTVIRAHMATKEFDDRSELIKLLGFLLTRENVVANKFCHGEIRSSKDLCPTITFL

SEQ ID NO: 931927 - protein, 164 aa, Homo sapiens
MPVKLSKFKDKKRKTAREKSVVIYKGSPIRLSVNSSAEIQGSTNHHPQGTDEDEAREGLGDERQLNFVFLCDRNFDIAIRPGMSHSWVHQGAAHKGPAGKNSNEEDASTTLNLVMARGECCYLCYTEGFVQGMGSKPHGVVSPTVPTHLARQIYSHSVLPATVN

SEQ ID NO: 931928 - protein, 151 aa, Homo sapiens
MPRFALAHTQCAAPTVLHPLSDTRHLKYPNKENSRLRGFHYQILPKFKKEILPFIYNLFQKLEDRALDNSFYEARITIIKKKKNSLPTGGDFRCLQLYVGASALKFHIVQLTAFVFYLVLRRSAFYNGHVSFHATEHVKLSPLVILVSLSG

SEQ ID NO: 931929 - protein, 182 aa, Homo sapiens
MGYVSSQLEAQEPKSSESTLTSMEDSGCDLSNEQRTESSDLSQHFVESCTPTHFPPLPLVKRPCAILQNPLSSHMQFLQYLLELKNLTESGNLKRDLTHFEKDSSTVSDSVFQLLDGLITFYRNPKLPFSRFWTEAVGTLASLISDYNLSSHILKKCSKKLEEFEKTLLHAILGNNHINQFW

SEQ ID NO: 931930 - protein, 912 aa, Homo sapiens
MGQTKSKIKSKYASYLSFIKILLKRGGVKVSTKNLIKLFQIIEQFCPWFPEQGTLDLKDWKRIGKELKQAGRKGNIIPLTVWNDWAIIKAALEPFQTEEDSISVSDAPGSGIIDCNEKTRKKSQKETESLHCEYVAEPVMAQSTQNVDYNQLQEVIYPETLKLEGKGPELVGPSESKPRGTSPLPAGQVPVTLQPQKQVKENKTQPPVAYQYWPPAELQYRPPPESQYGYPGMPPAPQGRAPYPQPPTRRLNPTAPPSRQGSELHEIIDKSRKEGDTEAWQFPVTLEPMPPGEGAQEGEPPTVEARYKSFSIKILKDMKEGVKQYGPNSPYMRTLLDSIAHGHRLIPYDWEILAKSSLSPSQFLQFKTWWIDGVQEQVRRNRAANPPVNIDADQLLGIGQNWSTISQQALMQNEAIEQVRAICLRAWEKIQDPGSTCPSFNTVRQGSKEPYPDFVARLQDVAQKSIADEKARKVIVELMAYENANPECQSAIKPLKGKVPAGSDVISEYVKACDGIGGAMHKAMLMAQAITGVVLGGQVRTFGGKCYNCGQIGHLKKNCPVLNKQNITIQATTTGREPPDLCPRCKKGKHWASQCRSKFDKNGQPLSGNEQRGQPQAPQQTGAFPIQPFVPQGFQGQQPPLSQVFQGISQLPQYNNWEPPQKIPTGVYGPLPEGTVGLILGRSSLNLKGVQIHTSVVDSDYKGEIQLVISSSVPWSASPGDRIAQLLLLPYIKGGNSEIKRIGGLGSTDPTGKAAYWASQVSENRPVCKAIIQGKQFEGLVDTGADVSIIALNQWPKNWPKQKAVTGLVGIGTASEVYQSMEILHCLGPDNQESTVQPMITSIPLNLWGRDLLQQWGAEITMPAPLYSPTSQKIMTKRGYIPGKGLGKNEDGIKIPFEAKINQKREGIGYPF

SEQ ID NO: 931931 - protein, 698 aa, Homo sapiens
MNPSEMQRKAPPRRRRHRNRAPLTHKMNKMVTSEEQMKLPSTKKAEPPTWAQLKKLTQLATKYLENTKVTQTPESMLLAALMIVSMVVSLPMPAGAAAANYTNWAYVPFPPLIRAVTWMDNPIEVYVNDSVWVPGPIDDRCPAKPEEEGMMINISIGYRYPICLGRAPGCLMPAVQNWLVEVPIVSPICRFTYHMVSGMSLRPRVNYLQDFSYQRSLKFRPKGKPCPKEIPKESKNTEVLVWEECVANSAVILQNNEFGTIIDWTPQGQFYHNCSGQTQSCPSAQVSPAVDSDLTESLDKHKHKKLQSFYPWEWGEKGISTPRPKIISPVSGPEHPELWRLTVASHHIRIWSGNQTLETRDRKPFYTVDLNSSLTLPLQSCVKPPYMLVVGNIVIKPDSQTITCENCRLLTCIDSTFNWQHRILLVRAREGVWIPVSMDRPWEASPSIHILTEVLKGVLNRSKRFIFTLIAVIMGLIAVTATAAVAGVALHSSVQSVNFVNDGQKNSTRLWNSQSSIDQKLANQINDLRQTVIWMGDRLMSLEHRFQLQCDWNTSDFCITPQIYNESEHHWDMVRRHLQGREDNLTLDISKLKEQIFEASKAHLNLVPGTEAIAGVADGLANLNPVTWVKTIGSTTIINLILILVCLFCLLLVCRCTQQLRRDSDHRERAMMTMAVLSKRKGGNVGKSKRDQIVTVSV

SEQ ID NO: 931932 - protein, 162 aa, Homo sapiens
MHFIAPEDLPVGQDVEVEDIDIDVLDPVKGIQRKGYGNGLWKWLKSMGSVEFGKADQEAVVESMVYFTVEDVSELQRMDVQKWYLRTSKLALALAIIRSKPADKSSREYTEHLAMLLSEEQSKWRSKVEILEAEVMQLRQKLLVSRLCSGSFKSDLDKWSNC

SEQ ID NO: 931933 - protein, 135 aa, Homo sapiens
MNSFNQLTIRKPFNPLSQQKGEASGCQGLQLDLRERSGLTSEKQLDGITSEKNPARDSRTSGGDYLPTPPPFQHSFPLKATFTCNKIPHTYYPSIRSCDLIFPGRWTRAWEPPVRIKKAATLALCPCWVEGSRLA

SEQ ID NO: 931934 - protein, 169 aa, Homo sapiens
MALGNSLACFLSLPARFLTVGLRIYNPLEEKRCYGFWNFQPFCAGFSSSSWIYLPLVFAVGDLSMEFLHGLLFVDVDATAVAKAAEQQRLLLAPSSGSFVPEGHLPDASQSFPGDESFVYKLLTGAAAFLSEMSCAERRNLESQSGYHDFVVWWWALLSQNFQVALFTL

SEQ ID NO: 931935 - protein, 145 aa, Homo sapiens
MTAEVKGHSVGYFNIFSSCFIKKALFVQIAKTCWSDQLTKIKRTFTYYQFLKENNQASVKNKYQRIEVPGNTEGLYLFLNPLLEIAGTVDFKAPGELSIVLALDSPLHNLNLGTSICPGVSYHIRPSNRFLAFQLNRISLRLPEK

SEQ ID NO: 931936 - protein, 143 aa, Homo sapiens
MLRGDVANSGFPLMVVTEEWEASLQGEEKVECTSHTPTSAAAFQDTGFYHTTLKGKKMQVAGHGEDFLTSAGKRAQRRNPRIRKALCTCNKGKEGDPAGIQCMSAKYAVKLSTMQRMVPYNKELYGPKCQQIWSLMTEDSISS

SEQ ID NO: 931937 - protein, 181 aa, Homo sapiens
MPFSSLCSRQQEGEKSFGPSGVPDLGASQAWAVTYCNTVFGGLPSWSLRALGHEQTQAEVPPATEVSGWAASFLWPQSSPEMMTGSQGLESKTLEIYLIFYVTVAKLAFKPQYKVLLALPFPFHRQRNLSLWPPRPAAHGSFCHDTAEVLQSARGECHQACDSPFREVKSPLVQGRSRSTL

SEQ ID NO: 931938 - protein, 143 aa, Homo sapiens
MKLPEERSGRNICCSTIFAILQPLLLIPRQTGSGVDLQQTPTHLQLRLKEEVQTHCKEAKNLGKRLDKWLSRITRVEKSLNDLMELKTTAREQRDKCTSFSSRFDQLEGRVSVNEDQMNEMKGEEKIREKRVKRNEQSLQEIW

SEQ ID NO: 931939 - protein, 243 aa, Homo sapiens
MVTLTYFNGGQAIRHKRSVPFSLCPVVGDSKNVKEERYKSSMRSKKLLSPFYFAENDGFRLHPCPCKGHELILFNGCIEFHAFLLTGPSAAGLLEFAGGPCQTLFARVSLAKAAEQLPVPSSGSFIPEGTHQRPVGALLYEVSQSSSTVLGDLLLSSQPPGSALSQGDESFIYKPLTGAAAFLSEMPYPERRNLEIQSGYSDFAKLQCAPPSSNFLVALFTLCEGKTAYSSLINGGRPSPYQA

SEQ ID NO: 931940 - protein, 184 aa, Homo sapiens
MSLFYRTAVVCWGFTSGLILLVHSHAWKCHSVRLEDSKNGCLLLPLGSLSLRGPNLMPVGKLMYRISDNPCWASHPAGWHGKQDPFNEVLWLSTGGGGVLYWGKLTHLGCPDSSELAGGKSKSAGPWGLWPPLSLEAQAQGNQSSVLELLVGVGVLQGGHAASVLSAAPHQHPPTVNRQGAQMA

SEQ ID NO: 931941 - protein, 136 aa, Homo sapiens
MNDWKRASKRQTPWNHQRTFLEASLQSIPLAEGVSLIIGTPKVPHTRYSPYLRLQRGLLTQRKRRQKQSSCKDKKAGRAPDLLARDDTSSSSCEAAPWGHLETTFYSERSQCPSPLKRPSDLRQSSALIPALIFLK

SEQ ID NO: 931942 - protein, 142 aa, Homo sapiens
MVSAFMLELRGKQQVSNRPRSRRTSAANNRYSLESTGDPIYNSFRNWEKVYRTKRCSHHLGNSKKYRSSVSDTPITSYHSGNDKDVRSSVSGTGGQRPNIRTKDSPSTPIYKGFRNCISENKDKDQIYISQCQGSITRVFIA

SEQ ID NO: 931943 - protein, 182 aa, Homo sapiens
MRESGRHCRELEEQFCFLALPQSDVAQIYQNGISTRASTLKILGNPLLGIYMFRHVDIALNYSHSQSITVESILIFKVLFGKVKKIQPSVDKNKVSLDPSPNFDCHMSRNAPSLKDTIELQAYSSAVYFYEYSVLSKPVDKPRQCLPYAVVTVKFLGSKVDNGRLMTSLRFLSTGFPKRAGY

SEQ ID NO: 931944 - protein, 150 aa, Homo sapiens
MISESLLLDLQNENSTYLPEALHTFTSAGFCGHSGRAACTATALVELPLTPGVPNLAAFRILQGALEQGWPFTCPKLKQEERGAAVKIGRQCAQHLEDRAPDLKRDWRWSTTASTAHERFTLNEGNSTVLENGEGTLKFDNSPLRKLITR

SEQ ID NO: 931945 - protein, 140 aa, Homo sapiens
MLMVVVVVVMVAVLVVVVVMTVDSAGGGGVGGGGNGDGGRGVVVGGGGVGCGGVGGGGVLVVVMMMVMMVVVVMVVMTVDSASGGDDGIDDGDVMVVVVMTVDSSPASGEAFVASSLAEGPPRTPANVTQGALTAVLKSL

SEQ ID NO: 931946 - protein, 135 aa, Homo sapiens
MLGLRARDRLDPTAVNILQQIIELGAETHDATALASVVAMAPGTVTVVKQGGGPGTQECCGEHQGPVYLGLGWGQVLSREALVMTCLVVTWAKDSKSRKYLSLVSPFRPSAHLESKQFIALWHVLGHNVLWPWAS

SEQ ID NO: 931947 - protein, 263 aa, Homo sapiens
MSFLKLGPVVDHDIPGLAPGQQLCSLVPPSQAPAVLEASRCSQSAGNNTLTGDAGKSTLAGSAGKRDMAVVTGKLRLHCKQMWPRRDPGRGWKTGGAQVRLSLSQGQDSPVLPRSDSQQRLEPPRRIWQAWGMGAHGRTLYSSHSHAKPLGLWAGWSSVSANSLGSSSCQLRCLWGSWGLLWLGYQRSITRVGHSTPVSLTFSVGVAQGQERVLALRNLVRGSQLPLPTLQPTVHVLPLSTLNAIPLKICAECASLLGSLVSF

SEQ ID NO: 931948 - protein, 165 aa, Homo sapiens
MYQKGSSIFELSSQILCLVWAYPVNEERIYPTARCLHLATVHFQAAWKRASHNIEQRQPRYCRVIRTAPASVFLWSLLPLQGICRMGLHNSVVHSVNSDLLTTYFVLGTVPGEPLWLLCENRAREEIGDLLGDNWSSLGEILQCQHLSDMGRKRSDTQNTEMAQK

SEQ ID NO: 931949 - protein, 141 aa, Homo sapiens
MWPGTGEFIPVPVLLPNTVTVGHIHACLTYQGTVSMCSCCRTLRPRDSSCGTGSSLSLPVTCGHSVDGRPGMTARLVSELGSLVVTGNSPTALERPTDTWVFSQRHNEPCRKVESSDALSNNHRTEDPEGSLGAACCTVVV

SEQ ID NO: 931950 - protein, 149 aa, Homo sapiens
MTSLPRRNVFTEKRTSRDTVALKTRTGPWGRNEAQRTNRKQDGDCQGLGKAEMGIAVQWLKAIAGSAGKWSPEQGGHTGGGWPQHHPSCLQLPWHKKQSLRQGLSLDASLGRSSPRVVRVKEEGNESKKEGKQCKLLHATVLARPHNEL

SEQ ID NO: 931951 - protein, 177 aa, Homo sapiens
MTCLGNVEYNKGVCVDNLPSLVLIFRSQRSFLTKHKGWLPAGHIPKATSIQDREGLAVLEWDWVLIALCFLSLLASNPWARKRGQPLWILIRSFTNQVAKFAEHFDLKFASPTSLRDLIAAGARIVMIRLVMGTEERPFALPGQSGLGTGPEGTHLAADPQVPCEKSRQARGQSQRV

SEQ ID NO: 931952 - protein, 166 aa, Homo sapiens [sequence omitted]

SEQ ID NO: 931953 - protein, 133 aa, Homo sapiens
MLNRSGERASLSCVSFQSWSCRISHTVRDDVMNDKGVCTTCLYSLLMPSGPGLLFIMDGHNFKYTTVIYNQTHPDGRLPQSQIYTQDADFYRKMQPSQKKKQLREQTVPTTVKPWFPLLLRMEHHMKEAALVW

SEQ ID NO: 931954 - protein, 131 aa, Homo sapiens
MLLTSQTGWRPGRGCNLSTLGGQGRLILEPALAYWKPFGEKDTTNSHYQPGRADIDRLQMYNEPNQHHLEQKNCLVSPALSSSHRGFCPRRAKHYPSALSPGRAMPIPPSSPYGERVQQFQRQLVKNKSCE

SEQ ID NO: 931955 - protein, 163 aa, Homo sapiens
MFHCIFSVDKVIKENDELGDSVSQLQQQLLSLKSAMIALRESLISCREEAEIVGKQTQALIMRVADLQQKMQEQPHQVSTVKAENPKKKEVKLFKKVGAKFHMARLVRTRWPGPCAGRADAGQQAASESEIKWHENRCEKKVESSLNRPTGARSLREQLWLLN

SEQ ID NO: 931956 - protein, 157 aa, Homo sapiens
MEQSWTENDFEELREEGFRRLVITNFSKLKEDVRTHRKEAKNLGKRLDEWLTRINSVEKSLNDLLELKTMAQELCDACTSFSSRFNQVEERVSVIEDQMNEMKQEEKFRGKKRYYPGELPQSSKAGQHSNSGNTENATKILLEKSNSKTHNCQIHQS

SEQ ID NO: 931957 - protein, 176 aa, Homo sapiens
MGTQSLIFTRELGGRILDHTGTTRELGGRILDHTGTTRELGGRILDHTGTTRELGGRILDHTGTTRELGGRILDHTGTTRELGGRILDHTGTTRELGGRILDHTGTTRELGGRILDHTGTTRELGGRILDHTGTTRELGGRILDHTGTTRELGGRILDHTGTRKKEREELHRKTRI

SEQ ID NO: 931958 - protein, 556 aa, Homo sapiens
MEWSAGAAANIHTQVTSCPRCSHSPHRHLRRPDLFQAWLHNSGKKAQKLLSQFLELAREVRHYGYLQLDPCTCDYPESGSGAVLSVGNNEISCCITLPDSQTQDIVFQMSRVKCWQVTFLGTLLDTDGPQRTLNQNLELRFQYSEDSCWQWFVIYTKQNWNHYPRTPVLSVWSLDQQHLYHVDLIRNSNSQAPNLLDQQLWGKAAAISLTRPPDKSDACSSLRATVLGQQITLSTTVISSVVLSDECPFGPYGGKHVQALIEELTAEKHATGSGSAQKSSPIKWKLFLGDHATWGMQEGDIHEQGASLPPGLTQTAQNANKNCPVCQQERQKLPVAMGQIAWWEGPDQSWQVKLMLLLPHEDTGRRRYLGSREKTSPDTESADALILDFSASRAGDYSGLSKCAQYNHKGPYKETGESQRKCKDRSRSQRGVKMLYTASFEDGKRSHEPGTHSFDAFPNSEQAFPESLTQSSPSHREDRPPAGGAPGAAARDRSGPAGTPTTPVWPLPSARHRLLEAAAVAAARSSRRYLARGLWAAPGLEPLDISCTVPVALEVQ

SEQ ID NO: 931959 - protein, 140 aa, Homo sapiens
MTVPPPASSRASHLAKSSRKWFVCEFQNFVATAHSKKYILHCKPKPDPGQSPNSLQFYEVERGKETAEEKLEASKGWFMGYKERSHLHNVKVQGEVASADRETAASYPENLAKIIDEGGYTKQQIFQCRQHGLLLEEDAI

SEQ ID NO: 931960 - protein, 228 aa, Homo sapiens
MERRKECGFDQQILLSVTCLPRAPSAWSSGSGCLCSLPAWVLWLQPAGYFQGPTQAWSTGLNPGVWLQLGILEAEQDLTSLPSCGRRGLGCIEDSAAVAEGGIAIGGIVGINTALQEVLTTLIHNGLAYVLKPHTIKMQRNNAQLSRRKEPKEGLCGERGQDRMSRAKGSSSKGKELPPGCRRVTMKPLLVRETQEGQAAERGAEEQLQTLGPFAVYRVGMFNSWATE

SEQ ID NO: 931961 - protein, 154 aa, Homo sapiens
MLNVQTKTFVLETVHQAAPATATIQRDPGTTRASALAPEGVSSKAWQLPHDVKPVDPQNARVNKAWKVTPRFQKMYEKAWVPRQKPAVGAEPSQITSTRAVQRGNVELEALHRVPTGALPSGAVGRRPLSSRSQNGRSTSSLHSAPGKATGYQL

SEQ ID NO: 931962 - protein, 177 aa, Homo sapiens
MAPAPERQIFTSRPLKQCFSTFYPSGHTEKILLLRTVTNWQDLKPQGKLQKLNVTSSGLQPPRVNVLGSAVDLHLFPGATEFAAPYYHSVTAGVSELVYGSKGRLQWVVRVKGFVKPEYLMVVFLDLDGAKDNNGTEIGGWNFGTSHYPQGMKEWNKEIRCQRLAHDDEDEDEVADD

SEQ ID NO: 931963 - protein, 210 aa, Homo sapiens
MLTQCLYSHCILEALMIYIGFSFKGKNTSSKRYNNDPWTWKLRLPPSHFVLLMAMNPQANSYCTGWGDWAHSGEVNGKLQQHNSGRTTNVSDPLGMKAWVTLPGKELQPAQVLAKGKRNMEWAVEECSHKYYDQVITYHRFCFASRLVGFDEQAAMLKKPIWQGTEGSLKPTANKEQALSPTALKELNLSNNKKVNLEENPPQLSFQVRP

SEQ ID NO: 931964 - protein, 134 aa, Homo sapiens
MTISMPGQRTSSENQKSILASEVSWESNRKTFKEYVPWTFGAVPSVSLSSQLSKTKIHKEKALMARFLFQGASVKENYCEAFKTPEDLTDAYLISSNGLRDLQCQCPLFLNNYTFQPQLLFLWAFRLLDWSTRI

SEQ ID NO: 931965 - protein, 143 aa, Homo sapiens
MKKWNMTSTSQAFLMPPPGHYLYPKGVGILTSNTIVVTSEIMMKGTSAQPSQDLLLLLSQQALVSVLRASASCVLVEQGVGLAYIASRSLNREKTLTKIWNFTQKRNGVSGTMVNSTSLDVQREAGNIASRRDIVEGVQAPNE

SEQ ID NO: 931966 - protein, 141 aa, Homo sapiens
MHKNIFFPMRNTAIRVGGGVRCEVIGSCGRISHEKFITIRLGAILSISLQNGAYIQEGFSTLVGESLNIPWPKVFSTVTQSCSDSDVFLFGVWEGLWLSQGQSFFALFLGHSEKLHLKTDLFTSSARFFFCYPLDSWANFS

SEQ ID NO: 931967 - protein, 273 aa, Homo sapiens
MHLHALGGAIVCEKGLMKEELRGVLLGSPGSAHLFLSPFMAVHWASHLAAFGSPEHFPPSRLSPPSFRVDVVHGLSPSVEYDSGYGHHQSAQCCLLFNSAGARIQTLGNVNVPIWLTIMEWDQQMEIGGFIFFILVLRLHQPGFQHTLNPERTLCEDEDRDWSDASASWGILKSASSHQQPGEGQGANSPSQPSEGTNPADTFVLDFQQYDSVVATLSLGPADNCTHYFLVLRKDKLPSKASGMTDAFLGQHSCHTPPQAQTLDHVLPPSIIT

SEQ ID NO: 931968 - protein, 146 aa, Homo sapiens
MKEAQLLCWRDNMERLSWEKKKGSAEHCLPAVPTKAPAKRKFFKTEFPDIQRFYPQNGQAPEPREKVGRKELLQCKIQEATVNLGQAGLKFNAKSFPAWRREAMPTCSDKVQTSPSGEATWGGTDDLSQQPASTTRHVNGQTFRRF

SEQ ID NO: 931969 - protein, 134 aa, Homo sapiens
MGGGGPPAAGLLEFSGGPLQTLFAWVSAAVTAEQRILVNRKCCCLIVPLEVLSQRSTRPFSVTWHSAGLSMVLLCLVMDQEQVFSLIAPDKVVEATMRCFSPSTYMHRKATRHEDGNRFFKCFLLNWHFSRWTQ

SEQ ID NO: 931970 - protein, 171 aa, Homo sapiens
MLRLSGLTQGGEQRRNLCCVQKPQGFSKVYADLCLSQAIRPFVNEFTMTLPEIWKLSKDRSSNLTEVEPGFNPSFLYFGVHAVNHHAQLSPDPPFCHLDLHNGKSESRAAGEGCERSQQPGDAAEEVGNPPAAAALLHSHAYMATNMNNQLYAERLSTRGYENEGTGTPPF

SEQ ID NO: 931971 - protein, 142 aa, Homo sapiens
MAIVKGQKERPWDVLKVLSQRQNSQLTSEVKASSSPDSSRQSEMVIDPVFKGLWGQDFHSLPWRAYFIAIAAQKYFLVSAEPSLPASEASWRTCEGGKPKNMAPASGEDFVLCYPMTEEQTISWTERGNSSFYQKPTPKIWH

SEQ ID NO: 931972 - protein, 137 aa, Homo sapiens
MEPPLGPGIVNCKDYINLELLVIAFAFTRSGGKNLPKNGAEKWQDNSLIVSCEPLGLSFEGLLQSAGGPLQTLFAWVSPVEASYQRGTGLMPAGALLYDVSVNPCWEFSPSQYIPKEMKVCIIDFCKAVHSRFLDDG

SEQ ID NO: 931973 - protein, 146 aa, Homo sapiens
MSSVNGAVTRSVFTVWGIPIPRHTASAVPFLLIRFPRSSSSNHPLDSGTLPEPCYPSCLEDPGIPVRPDPQQGYEVGEARLVPAHEGIWEWTEEGKRAKALGTSWNRERERGEIQKQTEECVLRSRELLAVSNAARSALMLRLEIV

SEQ ID NO: 931974 - protein, 155 aa, Homo sapiens
MSMCHCEWSGEEVWAKSVSHRTATLDLLPIPPPLCFGNFRLLAFMNSSAVQPFQHRTPHGETQATPQLMGPSPREHLLGTVSPELADGGNKDSSDGRSRQVAKERTRMVADGVQGELNDENTWTHEVQGEHTHWGLQECGEADAGTMLLVQPAEP

SEQ ID NO: 931975 - protein, 127 aa, Homo sapiens
MLPFNVPSFAFIKGGHRKMPIQRMSPYLLHNHCKEISSYIVNLNDREMLSKIKYLFGYRSLQWEYACHNCCKTESVTYEGLFWLVAVKPPQGQVMREGHGHGVGVEVVTRTSHRLGTAFTVATVQVY

SEQ ID NO: 931976 - protein, 176 aa, Homo sapiens
MDSDKDEEGFGWLIIQQEWKTEYREDEHAELYWKTWPDYGRDNQTLGNLIIPGCWARAWDPLSVGTRKGRYTGLLPSLAEGSCPKQQGKGPTELLTHHCPQTAKLKEHCNTLWDLGVMGTLTQVPLQGGHRNPHLGTTRSPPWSLLLPAPGAADRISHSLTHVDFEMGPQFVCDEL

SEQ ID NO: 931977 - protein, 131 aa, Homo sapiens
MVIPVTSPFNSSIWHLQKTDGSWRMTVDYCKLNQVVTPIAAAIPDAHQKQFAFSGQDQQYTFTVLPQGCINSPALCHNLIQRDLDNFSLPQDITLIIYIDDIRLIGSSEQEVANTLDLLAALGLLLDFGEN

SEQ ID NO: 931978 - protein, 153 aa, Homo sapiens
MGYVTNQMVKEANFLKTLKSLLSAYYYLDDLQAPKIDIIKMNLIVSLQTLYSQSPYLSELCSYLYRPDVSAFCLFPLNQAPQLSFSNVHLSISTSTSDACVRVYSCNKDYVSRNMCVPLCFFVKTLFDTMKYIILQHRFAQIPKRINFRPLKT

SEQ ID NO: 931979 - protein, 135 aa, Homo sapiens
MDKMQIRVIFLFEFKMGCKAAETTHNITNAFGPGTANEHTVQSWFKKFCKGDESLKDEEHRDQPSEVDNDQLQEKLSRNSTSTIIQSFAFEEIGKVKKLHKWVPHELSENLKIVVLKCHLFLFYATKTNHFLNRL

SEQ ID NO: 931980 - protein, 143 aa, Homo sapiens
MCQAFRVVGALAWVLPHSPGNDMPALAASPSQSLLLCQQSGWLDLALAYSYAASCKEPRTIKLQMVMKLKPQRMACLHWGLLDRPLRRSVGCFPKTAPPASRKQLRSIFVPILTAARDIPLQKGELIVAGGRQIPRQIGMPPR

SEQ ID NO: 931981 - protein, 212 aa, Homo sapiens
MAARRPGLSSDCPGQTLRCSAGRWPAGLLVPAGTLLSTSSCLCICLLGDMPSQRYLLIKTGFPNPNAIKAEFLDRYLLPPGEDGGGKLACQLSERNLKQENRHSGVLLQGQKPLPGRLAPHANSRFSLSCGTGTKFTGWCPSADHAWSSMTEDKEPLGISKQGNNFIKFCPRKVTLAARWRKVFGQRLSQGDNSRHQKHQCRQEMRGSDPGP

SEQ ID NO: 931982 - protein, 141 aa, Homo sapiens
MGIPGADFNTDTTPATNVFRFHFQELKMSSDCAMRHWVFCESCVLAAPSDTIPVGEGELPHFTKWGWMPRASTRPLLTVGGMGSLLPQTTVPGRGEFQSPLVIGAYPVSAGRLSNINLLAGTASSTPSSSSSGTGLKHLFP

SEQ ID NO: 931983 - protein, 159 aa, Homo sapiens
MFLLWVLAEFCLVLAALHPKAKSSYKAGLVVANFLKIHLSEADLISPSLIKLSFTGYKILAWNFFLKTMLKNILTCFWPLFHRAVEVSWGSSSDPSHLGFSSTWRADLGLLDSLHVFAARASCRASVAAAPLGAVTGLSLLLELLLLAVAMVLGNYISY

SEQ ID NO: 931984 - protein, 129 aa, Homo sapiens
MAACLSPWEIKTLFAREYKRGWLEALVGRSCPLRQNGSGSQLKKQSIHVLVEQLCCAVLGDPFVPPVLGKSVLTLLSPQAGTAESCKQQRWQPAPLPGNYIPSQVPGLHQCHTSHCGLRFQAYLNGPRL

SEQ ID NO: 931985 - protein, 138 aa, Homo sapiens
MAEGDSGIPPAPLTAELALEFTIPLRRGTVEKYFSKEKLDREGAPGSHPRELEFMERLPSTRELEHTPEPMLGTEHTQRASKKDSPQTPDTETQSRTLRLVQPCWEGLSLNTLPNVTCSGHTGPHRAEPTGGNSSIFL

SEQ ID NO: 931986 - protein, 149 aa, Homo sapiens
MWVGPDKRIKAGCPSQQWQLSWVCSFTPEASETTNHLGGTINSRHATLRAVTLTAKICSFTLEPVRPRTHQKKETANTSEHQKEQTLDTPPLRTVTLTVGKSADTAKGEQVAKALSAPLGWVLLGLECSSSPATPKIYHQAGMYPPGPS

SEQ ID NO: 931987 - protein, 249 aa, Homo sapiens
MAETSVLTCLDINAKVILCSQAALKPAMPPVIKSQPFNIFWAAPTMYCMPSFNVDINLQVFNIISNPLETQSGSKIAIFYPNELGYYPYLSQDGKSFNGGIPQNVSLSEHLRKTADDIGEGVPWWRSEELVVIDWESWKPQWDRNQGSRIIYKNHSLAFTRNHHPYWSEMKVETVAREEFENAGKNFMNITLTLALEMRPKCLWGFYLYPDCYNYDYRINPETYTGGLSACNWRKCSIGGSRSNIVGRI

SEQ ID NO: 931988 - protein, 158 aa, Homo sapiens
MSFSTSSHLCLILLTYSSQISSKDHLNFGKHVFFLPLHGHCQFYTLFHQWLPKTPGLLYPTERKPQFFTGHRPPRMKTAFSILLYTGCGHINVKRLATFKISDIYLIEEENIKCLRLTFYTLSNKLAHSDTCADRMITKVENSAGSLSSPLQNFYMEL

SEQ ID NO: 931989 - protein, 148 aa, Homo sapiens
MGANLLHQRYLDMSSGDIGMQDHAPETICFPKLLHSIQSSNNKHSFAIETGSEQNRKNKACWLKHWRLAVTTPWLLPMFTEGSGALQSAGGKACQTCVFPFRAAQGLLSQLVVNAAWFGTHPSGQRAPLWPRKGPEMLFKYQKLHELN

SEQ ID NO: 931990 - protein, 143 aa, Homo sapiens [sequence omitted]

SEQ ID NO: 931991 - protein, 134 aa, Homo sapiens
MQNCESIQPLSFINYPVSARLFITALCDLGMENCPPDSPCPGSENTRESTRSGSQCQNDGQGGMMGVELPSRSYGLEFGALGICLLLHFTVAELVPKEMMINDCNIIKRDNIGHDVPFDDKKQPHLRSIPDKKK

SEQ ID NO: 931992 - protein, 174 aa, Homo sapiens
MIRFYFFQGHHPGTEEARLLPAAKGANFPKLHPVFPANRKMHIVLISSILLFPDEEVLLFPLNFIAWRPYNSQFIMGSSETLGPMIKNSSLFGPTVNNGDRCGMYTSAYNLQIDESGLGKVSAILGKSIMFWLMEMKKELNFDLSFKEIKTWHLEEKQIRTFVSSDKSPETARG

SEQ ID NO: 931993 - protein, 139 aa, Homo sapiens
MQQRRAERPGGESKEALHSKAALWNRPWPGCTYFGFAQTANFSFLLLGPRDRAPGQSKRRGATSPRGASTSLLLSPAQTKGTGRALLGQRGVGGSLSHDRWVAVKTLIADFWAGSDSFSYLPLPSSEKSPSCCTPPPPG

SEQ ID NO: 931994 - protein, 239 aa, Homo sapiens
MHSMIPLPKGSELKGKKRTSLSKEEEEEGEGEGEEEGEGEGEGEEEEEEEEEEEEEEEEEEEEGEEEEGGEEEGEGQGEEEEGEGEGQGGEEEEEEEEEEEEEEEEEENAVQDAKGGSGNQCTVNLLHTNTREERRKKKQKQQQQQQQQQQQQQQQKKKKKKKKKKKKKKKKKKKKKKKRREEEAEEEEKKRRRRSRRRRKEEKKKKRRRRRRRRRRRRRRRRRRRRRRRRNAAQDAMG

SEQ ID NO: 931995 - protein, 133 aa, Homo sapiens
MAQVAEQLSQQPGPVEEPSPLLDPTKNWQPSRSLNKWARVTHQNEECVASKIQIGPLAEGKLLLVGLMDRNGKKGICQINGCIPDLECREEQSQSPSKMQVLPSQIYFTKHSSRLHLLDPPSWDDEERNKVFS

SEQ ID NO: 931996 - protein, 134 aa, Homo sapiens
MAPAFARMPLPNKGVGLSGIIRKACEKSKVPQSQLSGWEKYLVTACPRTPRIVTDLEDSSPGQESFFPVFFSSSSTQVSKCLRHQSPCSDSVSHHLGGTIYLLSRREFFLGLEGYGLSVVSVFWATPLFTLTTT

SEQ ID NO: 931997 - protein, 145 aa, Homo sapiens
MPDNKSNFVDVVKMKRKRNSLREDDVMFKDYKEKATDTTLLLSKSFYLSMTRFPASSTNEKRENPPKALERSGSGVNPDEDRATAKGTKERVAGSFPISGKRRECRSKKHLVSSKQQAGVDSGSSLRLREGSRSKTWGKGNWKRS

SEQ ID NO: 931998 - protein, 145 aa, Homo sapiens
MSQLVVTLRELTSPLTQGRSRNAIQQPRPGIQMFYPPVAELVPKVQVTGLEQGPHNCDWYPILLWLSWYTICQTKSSALFPPLSSTEGRDLFWSHKLCSLIPIDTSADGSAGHVPSQSTVSGSNSTLGITQELQFLYPRLFLKFT

SEQ ID NO: 931999 - protein, 148 aa, Homo sapiens
MTFLEDCPHANGAACWRAQTANHLLQITCRQKREENCGCSTQDCMLMKILASLSGIIRIILGGTWYRNRIIFKKALAWKCQKMDEGLEKRMNGEEDKKHWIRREKLTILQGWGHDCMEEAKLFSNTTVVTKHFHFLPGAGNEIPLLST

SEQ ID NO: 932000 - protein, 123 aa, Homo sapiens
MTSWSQELSPFIKNAPVWSSHYGQGTVLGVRGVQRMRGMEKARIAMRPTLMVERRPMSIEYVSDTRRGTWHTFLINPHCILLFMSISQARKLKLRKLKQVFHSQTTMIGGGQIITEHMTCIVC

SEQ ID NO: 932001 - protein, 147 aa, Homo sapiens
MGSCLMATNDKIECLVVKRTVKSNQVGKAHSTVLQVSTGYTEVPDMQNPRRRSLGRGGPRGCQEESTLSGGRPLCRSSQRGKLAVGNSPFRGRPQCPLKVYLAAAPESLPGPDGSSTPSGKARDKPLHAELCRELEADTIHSANLQW

SEQ ID NO: 932002 - protein, 145 aa, Homo sapiens
MMSQQHRRFVTVKNVAEHGIQRPACCVCPLLLLAVPWLTWDLRNSLASLSAFHTHPSTPSLDQPHSHSVSKRNNEKPCKLMPPKAMVFNLIGASAPPGNPLGCPHFSWQLFSMFIICLKSSPTNPADNLAPTALTPTKASSCALL

SEQ ID NO: 932003 - protein, 193 aa, Homo sapiens
MQSFQISRRNAESLINPTEEGTCFSFAYPHDCKFPEASSAMWNCVETSYSLDFKSSLVKSVKMQTETNSKYGPAAAPASFTPTPLQQSFAVNGTIIELSWTPLSLTPVPCKLPQSSSETSVQPCDSGSSLVKEVAVLERSISKLRTGLSGKRLIYKKWGSDPLRPAGVVSYHPSEHSNCFGALSTGILRDTSN

SEQ ID NO: 932004 - protein, 143 aa, Homo sapiens
MQFYSSRHPRLLQGRSTCAEPQGHLTEPTPGRQEMSCSTHSGPRFQSLALFHREHLGYMSLGNCAPAGHPSGWTFLDFGISAYTKGAILGMGPKSKYEIHFFSYTPYAHSLKNPPLVLKLLLVLGDIPGYVSNCVDSTCLFNI

SEQ ID NO: 932005 - protein, 162 aa, Homo sapiens
MISFSHIPHKYHRYQKVENHLFPLYSKSLFHAFESQMLEAKCCPRAAQQKPCWHAYPVLWPLPLPHTSWSYGLELSGKEDESKLKSKSTTKNMMTVESGVDPMSAPWSSPQISACVMLTQAKELPEASRKAWSRSFPGAFRGSMALPTSGSQAFSPQNCEAI

SEQ ID NO: 932006 - protein, 136 aa, Homo sapiens
MLLWHYSQSATFWAPGAQNSQSKQPYLQVHPIVPPVEHPRTKGRPKNSHFQGCGHSLVLQAEEPHTGMRGPLARCSGVEPLPSPGMGKAALEEAGVAGFFSLSMPNAPTPPQHAKPLGLVHGAGVGERAPGKFFID

SEQ ID NO: 932007 - protein, 216 aa, Homo sapiens
MVVVMVVVMVTMVAMMVIVVVEGMVVMVVMVVVVMVVVMMVVVVVMVVVVVMVVVMVMIVVKVVVVVVMVVVMVMIVVKVVVVVMVIMVVMVVGVVVVVMVVVIMVVMVVVAVVVVMVVVIVVVVVKVVVVMAMVMVVVVVMVVVVVVMVVVIVVVMVAMVVVVVTVVVKVVLVVTMMVMVMVVVVFVIVVVVKVMVVVLARSQAAVRTYLRLANL

SEQ ID NO: 932008 - protein, 154 aa, Homo sapiens
MGRYSFSKVFYWRLLVAEHGKLRLHLSSHGDRTVFVSAAKAIISKSAIWTQAYLLKSTFLILGLTWVLHPPTWIPKLPQGTLIWWLTVKLLFTGSSCRAIRQKKDIECIQLGKKEVILPLWRHHFLSIEKPRSHKICLELMNTFSKVIAYKINT

SEQ ID NO: 932009 - protein, 139 aa, Homo sapiens [sequence omitted]

SEQ ID NO: 932010 - protein, 191 aa, Homo sapiens
MDRAACGDSHREFLLQELLQKHTTKTKRIHRPFEGKRWIAPAGSVGQLENCESACFLIWEAYSLGQVLSAAHRLPRNTLSVLRGTVGVRQAFWPVGCMGGPSTPPDPPYTTTADALLKAPPLGWRPANTKLVHLTKIQPRTLRKSHFTPLLLPLGQVLVSMAERPEDESHHKTVCKHSPVQVQSSVSLLGG

SEQ ID NO: 932011 - protein, 191 aa, Homo sapiens
MGRNLGQYLAFLGRGPCGLPQAFVTFPTTNLHVMKFYYLPLVLCVCLYLASDEVRLQTMPKSYNESRECQVLNRFCIHTGTVSLGELYISTPLTSGLAIELLWQMCCEQRREVQDNQPAQNIRRNHLQEGAEYDHLIEKTQSSMDKNLAIKVNTLVEVYCELVKENKRPRSHRYSSLSQFTRPSYTDSTRS

SEQ ID NO: 932012 - protein, 243 aa, Homo sapiens
MRAEKKAEFISTIDNCKTELKKAGCPNKCSAQQSGDTGVSLAESRVFIGLRKQEVCSNWTMGSHGQAQKKHHKFPLQSAGLAAYRTGNWQPRPQASGPPWLEGGVLLGTNPLPSRTLSAIHGTQAAIHGAQAVHAKWHMQASAELPSAPPQAPSHAHRCPKSGGGQGGRGPPRVPGSEDAAWAAAAMRGRAGLLPAPGPQEHGEAWVCSHDLVAAAVPREHKAATLLIQKGAGLPPVPGSRWL

SEQ ID NO: 932013 - protein, 153 aa, Homo sapiens
MLTQVNICEFSKIYQLSSSFGCSWPGEDHFLTPSPLQLPIPLTATSHHSIKYSTFTTLSIRSHDLILPGCRTRTGARSGHTDPPLSCVTLKPSMDGKAKRSYCNTSPLGLQGSQATPRHHCGPTRSSVHAGCPEALILDPAPTPLHTLHAMRV

SEQ ID NO: 932014 - protein, 168 aa, Homo sapiens
MGHGLGGILGRGHSLAQWTKAGVPAWSDTFETWVNNQRGVPAVIKHQGKAAFPVRDRRWSFGATDKTNEDPKKQEKLYLMLSFDEMWTVMSTYDEQKEKYSKGYRKWNNGLKKVMLFTENILKVYKIITGCTLMEMKYMGKNDMGERKGKCWIDPPDLEGMRKWDLGQ

SEQ ID NO: 932015 - protein, 167 aa, Homo sapiens
MEDKGKTGTSLGKSRSKNFYQIIYSITTIIIIITTIIIFLICKPLNLELLSPLSIRGDRAPENYICWWNGQNPNVSLTPVLAGLRNKKKAYKERNFTAGPPGVSSHIGRTVMVTSSRKTSKFLLGILKEEGVYEQGGPEYCKSDVLHTTDPLESKWMSITKISASKS

SEQ ID NO: 932016 - protein, 151 aa, Homo sapiens
MPTGLVPGLLSQLRGLGFNNTLLAKSKNSNPYEPGSKKVEHHASLYLEPGQFPNDGTERRNQEEPNGIFQAKPLVHLNNDSKLVNSNNATNTIKGTSHIGLVSSVIIRAKNLFPNNSKHSQITGMMTSELTVRNNFLITIITGFYHLVQKA

SEQ ID NO: 932017 - protein, 164 aa, Homo sapiens
MSQFTQNIDLPLHSAFDIIIFMKYFLFLQEIICGGSLWPRMRVPQKIFRYLWLLNLLCDLIWACKCSEAQFIFLTSLGFYQSSTLLTAKAIIFTLAWLRKNLFSLLSEAQAKIEVPQRNIKMSWFRAPCKLPDNNAKDQPCEKIILDIVGKLNIHMTSVTAGTT

SEQ ID NO: 932018 - protein, 140 aa, Homo sapiens
MLLIYYYYCLWRKCLEQDAKIKMIPSERPVTICYKRPRVKPQTFTVSVTALKGGVYGVVCSSRWVHGLTDFRTEATDLRMWKGTQAVCHCWLGWPAFIPLFGPTHILLIGLFYRDLICPFYRELIGPFYNPLARHRVLIE

SEQ ID NO: 932019 - protein, 138 aa, Homo sapiens
MRFKHSRVGYFSPGRWQAAGNTAKNHNEVHHDEEGDVAGEAAAADHDEDDDDDEDDDYDNVRIHLILKIQMTLKMTYSGKEESVAGLQAAEHPEETEDSQNKKGTRILGHNSKNTIRYLRSSFWSQICHSEVCNLTIC

SEQ ID NO: 932020 - protein, 153 aa, Homo sapiens
MGNGELGSEAGTFRGQPLCPSCLEHECDKKGTLLHCWWKCKLVHPLCKTVGRSLKELKVELPFPKVELLAIPLLGIYPKEKKSLYEEDKCTCMFMAAQFTIAKIWTQSECPSIKEWIKKMGYIYTIEYYSAVKQNGNSGFCSNLDGVGGHYFK

SEQ ID NO: 932021 - protein, 141 aa, Homo sapiens
MDSVRKMSQGYRANAETFIQENLLKLSINNETVALEAMIHCHHIPSPKPKQLSRSSTLDGYGPEDELPLLLSSRTSVTISHLKQQPTSISYPLRLKCEVTKFWKAENTKTLNSFTPLAERQRFHAVRSKPRRPEATAPPST

SEQ ID NO: 932022 - protein, 146 aa, Homo sapiens
MTIGDVSLVQELLDSGISVDSNFQYGWTPLMYAASVANAELVRVLLDRGANASFEKDKQSILITACSAHGSEEQILKCVELLLSRNADPNVACRNKSSWDTKSWDPMESSSGKEEEDWDESIEVPILSACTLATTKDLYKNKELAI

SEQ ID NO: 932023 - protein, 136 aa, Homo sapiens
MIIIEGVGHLTTDLQEGEASLTAGAGSFLETEEERDHCLGREITSCPDPSLGLIADLRQMKGNTRPVCKRRGVQETTSFDRTRIQYAAKLHKQALKAAVKHKPSGKKKRCSIKLEVFKKSNGSPKSRCWHIWFLAL

SEQ ID NO: 932024 - protein, 136 aa, Homo sapiens
MKFHVWTDINALEVQHMLWTQAPQMHHRTYIIQWSRKCFFNINYLRICKTMASNGQLNPSHDAIPLVLALLLPSSLFKGPCSYIGPTAGVPLPSHADTVANSFMVDSSKCKEYRRSWNTLGNGEYSQIYNSKSIVP

SEQ ID NO: 932025 - protein, 144 aa, Homo sapiens
MILSVLEKVDSLICVPLSDLLIFRYLKDPYEHAQRQEFDFLFIYWVFAGGEIFTFFGPELESGLIIMMKKKKKEEEGEGEGEGEERGGGRGGGGGEDEVTEEPGSYWSSPNCSGPIAAEFWFGFLGWLLPNSVVIYVNSGNQIE

SEQ ID NO: 932026 - protein, 202 aa, Homo sapiens
MQPPKLWLQTWASLSSRGPEAGNGPTLLGTAAAAQAAAADLGISALSGTQEGSPLSPVPFSIKSLGTTNSGKRQTGSWAERGRSPVKPHLQAGEGLKPGNQAASPMDQSGYLQCFFWACPWPPMDPSACTFSPLRPIKNPGLSHTRRDDGTTSCRRELPSLLRAQEMMGQPACREELPSLLKAEHSSGHHGYVEELPTVGFL

SEQ ID NO: 932027 - protein, 146 aa, Homo sapiens
MENVYLQVLFLLDLDVWLALANGILEDLTQQIRNVPKLLGSGIAVIVTMMDISKTIAVSDFLVSAVSVATNPVEEEGEGEGEREGGGGGEGEGEEEEEEEEEEEEEEEEEEEEEEEEEEEEEEEGRRKEERRKKEEGRKKRRRRRR

SEQ ID NO: 932028 - protein, 178 aa, Homo sapiens
MSKPLSEYKFSITAQGLGNQRTSKPSRKAPPYEASIKTQKEKEQRPFTQIKQEKWDLEMEKGNQKQKGRYESALLTLHRCLTNSCSCSWRTGKLSRVNLSPQQCKALDLVKLICQSQRLSLLSGERWKAKVPSDEAHEGDPALEPGRTEKGSKWIFGVFSWKTESDLHTHQAIPEEVS

SEQ ID NO: 932029 - protein, 140 aa, Homo sapiens
MVLQEALEPAMCLDRYPHVQLEASELLLEDGGSALATELNTAKLALAYAGMEMNDLVVSCGLGLAPGSVPTWLLDPMRLEEEHTAPGVTLALLPMLNQAWASRAASPRPHAAAVPGVGCLPQGHHCPTLNQKPEQRQTPR

SEQ ID NO: 932030 - protein, 152 aa, Homo sapiens
MRDSEKGLGSIDWRFQHSQRIVGVGHKREGNGEAEDSCLRENACCPGNVKVAVPSNDWGMVIDMSVPELGGKFQWEKKISERRQLKKPHSDIRAMGSESGRTMSSLIPGPFCGNMKATTVLSHAGTDFFLLMVHLKFQEKEQMCKELQPGET

SEQ ID NO: 932031 - protein, 247 aa, Homo sapiens
MAQTRWRWLSGKSICKAHSQPLPLPPKLFPWWAHGVNTGLAEDGGWLTSRQSCSRSPTFHKPGPDCFLHQLVIGSTPQGHGQKLGRRMDARALNDMGQSLFLGAAYGGDNHLLDMMADLRPLMKPKIVKKRTKKFIWHQSDRCVKIKCNWWKPSSIGNRVWRTFKGQILMPNTGYGNKKTKHMPPSGFWKFLVHNVKELEVPLTCSKSPCAEIAHSVSSKNHKAIWKGQPSCPQSHQPQCQAAQQRK

SEQ ID NO: 932032 - protein, 151 aa, Homo sapiens
MGPGGRLGRSTAAWRAWSLRQYATLALHAGRLPEVSSAPEARTRLPKRVRRVKGIDEAGGGGLGLESLNNGRRIKMPGVAAHEVTKDVYRTRCEIKVREFQDQICECRVCSNADVTNIHDSLSELCRAGQSVNATFNKTGERLGAHNSRRC

SEQ ID NO: 932033 - protein, 137 aa, Homo sapiens
MEQGVEGWPPVDSWALASGRKKMSGFSIPSFFLFLVLLIYLKITFVHVKLPLDTHCWISLGHPAVLSVSQGFVCLPCAIHFPTALLVASTEANILCHTAHCGQFASFWAWRKNDLWKSREAQKFTEKKALKFFLQQW

SEQ ID NO: 932034 - protein, 162 aa, Homo sapiens
MRYHSTTIRMLTFKRLTTSGIGAFEIPKKNNQGDCLVQWSRASLSNPQPTGHMGPTTALNVAQHKFDGKARELETIGEQVGGDSKKTFGDTMMKKGLEYDHKRGGKIRVSVKTRNYEGPSPKQMSMWENRKSEGPSDRVKRGWWCGAALQTEESREPAGSAF

SEQ ID NO: 932035 - protein, 124 aa, Homo sapiens
MILCISTPLLRYSPTLIFSGSILFIVFNPNLDLALKVYQILSKLAFPNLFPATSQKELSMPSGPVGCTHWPTDELSAVSLRKTVGRSKGEAPTGKRLTQDSEFLLCVILNLIECPQNSYFEFCV

SEQ ID NO: 932036 - protein, 144 aa, Homo sapiens
MVTGCTPKTKQGNLNSEMDLQQPCGYTTAEVIRTEAITQGPSRMWYITWRLACSTSMSENMSASFYTQESPGASPRVQRLKNLETDVQLKEKREQVSGTGRKREPEDSSTDSNVNLLWQHPHRHTPKQYFTSHVGIPRSSQVNI

SEQ ID NO: 932037 - protein, 256 aa, Homo sapiens
MNILELEQSHFRTCSERPTLPRHPQERSHFRTCSERPTLPRHPQEQSHFRTCSERPTLPRHPQEQSHFRTCSERPTLPRHPQEQSHFRTCSERPTLPRHPQERSHFRTCSERPTLPRHPQERSHFRTCSSPAPHRLPSPHPWSWVAPVFFQLLSATYTFSDVPSLLSSLWKPPLTGSIHSPADHRKLSDDHSVISCPLPSVGLSPGRSSLTSMPVVSCRLPTCLLPTVGLSLGWSSLTSVYVISCPEQGCPLDVPH

SEQ ID NO: 932038 - protein, 131 aa, Homo sapiens
MGGASQRCVFRRDCGGQAEWQLHCKMDGGSWAIPDGARGMGGHNLHPQPSLMEPGGWVVTTCTGQWRPREGSPCIFRQGIPSKGSGGWGESSCDGGTEGLTCDFGMYPEWELCFHGVHSASTSSEEIPEAL

SEQ ID NO: 932039 - protein, 180 aa, Homo sapiens
MSSPSLSPRLNKKMQQSQQQILGVQKLNSQWRLAQDFRLINEAVIPLYPVVPNPYTLLSQIPEEAESFTVLDLKDAFFCIPLHSDSQFLFAFEDPTDHNSQLTWMVLPQGFRDSPHLFGQAQAQDLVHFSSPGTLVVQYMDDLLLATSSEASCQQATLDLLNFLANQGCKVSKLKAQLCL

SEQ ID NO: 932040 - protein, 135 aa, Homo sapiens
MLPGLGLLFWVSGLPYGRGKVQKCEPSPRTFGALPPVAELVPEAYNSQSLTQGPEHSTWVSLLVIQGSRALQLAERGPHDSDQYPILLWLSWYPRCKTMSSPLFHLFSSSKKKWSLLDPRATQLGVRGVVMPALS

SEQ ID NO: 932041 - protein, 127 aa, Homo sapiens
MRHAGSCSFQLSYVIFVTLLSLAKFHSPVKNIVCLRQVIECSSARLIYIEQLVTTSYNFEFLGNSTMNTGLIPPPKTTLPGIPIGFLVIVKLPTECFANCFSSPVDCELLEDKAMKDMLDIQSLLNK

SEQ ID NO: 932042 - protein, 167 aa, Homo sapiens
MHYTLLLWVKEGYYPHYPHHTWLCALHFPEVMGATSQWKLLELSDTSLLLLSQQAPRQELLLQPAVPKINRTQSRAPAVGDACTAVARNALLSWLAAEDVGPLTTPAELSRHSKQAASRSLASIQGDQLVSVYPGLCGFKTGSPTFEEAPPSQRTGAAVTLTGENVP

SEQ ID NO: 932043 - protein, 180 aa, Homo sapiens
MQNAQCGALGGTIKMNGTRILPPGVLMELTGTLGLVSPLGGPSSCSSARLASTAGPAPSLASVTQGEFSETSQIKESSENPVSPEEKPDPGQVSLESVTEQIQEKQVAGASSKQPIPHLCASSCDAQGMGFEGAAQLWHQRTLRGERRQTGRGEVRPASQSLLHTVAKAESCGNTFPPSL

SEQ ID NO: 932044 - protein, 159 aa, Homo sapiens
MAQMPHEQPRPPWGTQLSTSGYQCSLYPGTYQCPLYLGIYQCCLYPGTYQHPLHPGIYQRPLYPGVYQCPLYPGTYQWSLHPGTYQRPLHPGIYQRPLHPRTYKTYQCPLHPEIYQCSLHPEAYQCPLNPGIYQCSLHPETYQCPLNPGIYQCSLHSGT

SEQ ID NO: 932045 - protein, 160 aa, Homo sapiens
MWVAGERIPKQKAAWLLWREKTVQATGKEQGSTVRRPSCHQAGGDSAQARVGEEQWQEGIVISGYVLKTESPEFADRLDVGSERRKGQHGSTWNDPTYWDGRGREGLGKQFAFGYSKLQTYIKHPSEESRETGVRVTRDACLEVVNQGMEFKAVRWEEMV

SEQ ID NO: 932046 - protein, 155 aa, Homo sapiens
MAGPDALHAASAVGTHNWMRETQWHLKIWRCQEPQSPKEGVTALAQGAPKSGLPEGLQLFCPHHPQHGEHGGVFQPCLCYSSFSSAIQWVQNSRPASRKNEVHRQLEEGRKCMLIGPWAAMDGPAKSTISSHSRLWTPPETDSPAPGFQAIHGLK

SEQ ID NO: 932047 - protein, 177 aa, Homo sapiens
MDHSPAVGPSVRLGIWVLGNESIFFLWNYHLAWSPSVGNAPSVECPQHGKCPQRGKCPQRGVPPAWEMPPAWEMPPAWSAPSVGNAPSVGNAPSVECPQRGKCPQRGKCPQRGVPPAWEMPPAWEMPPAWSAPSVGNAPSVGNAPSVECSHRGVLPAWSAPSVECSWRFLVPFDTIA

SEQ ID NO: 932048 - protein, 137 aa, Homo sapiens
MANIKKMKEASFLKKLKTECPCDPAIPLLDISPKDLKSGVRHPEPQGGPWRWFGGVPPGNPRETRDLTTDLNTINSKVRDPSLGTMKNSGDTDTDRNGGSRLRKDILQHKHRPGCCADVSCARQDLNDPFPDRVICV

SEQ ID NO: 932049 - protein, 137 aa, Homo sapiens
MVMLLIVSIFLSELWTRDPAITPCKTPKLHCQNEPASNQKKFWESMDKMTARVQEAGEGLKPADTRGAKVALTRRLCPKRDGAPSLGTTLGRGKGELGNILSLSRQGNCLNLSTRQVYFLNPERMCSTDQPCHGLGS

SEQ ID NO: 932050 - protein, 162 aa, Homo sapiens
MRQQKVQGKREESGKNSSVPITKTVEGVNLENSSGPTLVAAEHARKPLSSPSGWEAGCGTSGTVWEAVHGEAAEHHCVSFILDKHHRSKKREKKTGTKKRSPFLLQSPLIFTDKASLWAGWQRRNIYKIQLQDHQQAMKGNQGRKEERKNRCQFITTAGKTT

SEQ ID NO: 932051 - protein, 169 aa, Homo sapiens
MDPTLLNRFAILNIGHLIKCELQISNLLKISTCSLKSCFWYKILILNYVRYPPVQNPFILPSPKNTLHLSPGGKGQVASTLQPRCRRDKLLSSTEEMGETWEATGFSNSLHLDLLIWGPTSPPFPEVLGAIMLINVNLRKPLPSPGKGVCTQIQEAGTDVVEHWKQDDE

SEQ ID NO: 932052 - protein, 155 aa, Homo sapiens
MIQPSEGGNLNPCYTMDDLEDIILSEISHSQKDKYCMTPYSGCGNNTNENQQYLGNNWVLDGTVRSGDSGAFDRWPTWGRAIPEQRALTPCEGRTLAGGSPPMLQGGSPGPMRGPSRCGNGMQGVELKAHQRQTRLTTLQFCPRRCSLQLIHSWK

SEQ ID NO: 932053 - protein, 233 aa, Homo sapiens
MSLGTAVTLGLEGFEGGVHSARALRKRVSLAPPGTQPLNFIAPMPPMRNMDRAFPGSFLGPRCLLFLGEHTGSVHGTLCLKQHEDKARRPQQGCNQNPQGLHGDAAVPPPPNGRSPQQSWNMNVIAGTEAAMLDSEVKASCAGEQGTDRKRGHVAMSSSCHVPSTSQMCLVGPLPPAGSYMWLLATLSPGNYIPTPPKHLGPHSPTYPHLHAFLTPRRTLLPSRLLLSAGISD

SEQ ID NO: 932054 - protein, 153 aa, Homo sapiens
MCKICGSSCNYFLHAFLLLLSQETVRGNECATLTSTESPPLLSVLGAQILTPGSRGQHHGKPDKRTRTHVLDSTVGVLRSSYQWGMDPGLSDGVGDHVAPSFSPSHCSLWGSVEVVYGGYPITSSATLLSNLTRSPPHQDPSWLGRITLATIH

SEQ ID NO: 932055 - protein, 166 aa, Homo sapiens
MAIASLPASLDALPSKVKGPVIPHLYHSECTSKKGQQEVPPRWQGFMARGIGALQNDIIEAQVKGCKELLQGSNYKIRKLSKVGRSRGQKKKTERHCSIIQGAKQMRLARVRSSSDLVRVLPSLLHLDIYTMVARGRLIRQSLIGELKNLFILLVLLLPLFSFFLL

SEQ ID NO: 932056 - protein, 296 aa, Homo sapiens
MGWRDHARNLEVTHPEVHKGPKCDRGSYQKAGGDFLPGSKPGQEERRREACVPSRTRLASVATRGAQQGPGFGRRVLHSDAALSRWPQAWGAGRSTPAARLQARRERGAGMLASNLTTRAHGTEAGGPAFPSEFAGASAPPAAAAPGASACSRRRNEGRRLRQASYLHSPAVIFICGGNEVVSGAPSVAEPDIQIALPAPPAPARWSREPQAARARTASPLCPATARASSSSPAPLFPSPSPFPPLLCRARLSPRNQPPCRVRLPGIPHAARNPTHSYSVRLPRKGCSAVAALVRQ

SEQ ID NO: 932057 - protein, 144 aa, Homo sapiens
MLACLASSEKFVITDRLEPSSLNSSKSFSIQLCSIAGEELLSFGGEEDPQLQVCWSLLDVHSRPCLPGYHQRRLQNSKCCCLVLPLEASSQRSTQLYEVSVGPYWEVSPTSLRWVQTSSFSSEKFVITDLLKPTSVNFSKSFSV

SEQ ID NO: 932058 - protein, 140 aa, Homo sapiens
MPLLSQIALSFKSAQISPVPTTTPPHTVESHALDSLLDLVISWQAAHMAYWETQESCELPRANSSRPIPHTLAFLAHKDLSLPLPIYTLYWSIPWYCYLSLLSAGYVASLRYNFPEGKPCPVSCVPILCLSSAGQSIFMC

SEQ ID NO: 932059 - protein, 173 aa, Homo sapiens
MLVMWSKSPRLPEEPPRRNDAHGLLSQVAQSALVKGSPSCGLKGELLPTPFNPQLVAKGPSTQEQFREKGSLIPRRAKPHPAVYGFSEFLEPGPGTQMFDKYPGEVSSILKSEARRGWPTCVKLKSTTAARELDEAPLTVGSEQQLHRKRQQMPFSSGLSSLGCQCLLPVAQS

SEQ ID NO: 932060 - protein, 241 aa, Homo sapiens
MGEFGIGFIENINLAEGTFKQSPEEGEGAGQVDTWGRGHCLGVGYELSCAIPQKRYVEVLTSSTCECNLIWKQGLCRCSQEEVTSVGPHPMAGVLLRRGKSGHRYPGRRPCGDAKTHRGKRPWEDGYRDWSDAASAKERLGFQKLGEAGQGPPTEASEGTWPANTLTSNFWLPELLIRCSGHRRSPCGLEESGRGEVRSGAGSLWEEVEGPRGIQLAKGTWHLDHSSSMKQTNNTLQTLNK

SEQ ID NO: 932061 - protein, 181 aa, Homo sapiens
MKVQSKTASAGVEAAASSPEDLSTTIDEGGYTKQQIFHIGAFPPFARHFLQPPCGEGSVCSSFCCDLSFLRPPQLYGTLIALAGGESSMHSILNVTSMRQVTSPSIPSSQQVHPTLCPSSCAGETTSPEAASPPPYLQQTKALLITRDCPPENEAKGLAFPQLPGGCASGPDHFSVHLHDF

SEQ ID NO: 932062 - protein, 168 aa, Homo sapiens
MSQSYIIGESKFKARSPDSQSKPFPNLGHTTCFSGGVYCVGPEANTAILDVDEGTASQPVSLTVEESSESFIYSEHNLRDTLELSGWGRKTWQKQLKDSGLTLCLLKRLQFLEGFQSEFGEFINRKTNSWQALYLLCPSQGCNINLPTWKALRPRRHFVSSGTLLQSA

SEQ ID NO: 932063 - protein, 190 aa, Homo sapiens
MPTFYRKHGSRAHHLQPEDCVRTVDTRRSMHRRSLGHGQSFSEGCGYQPYGVLEIWTDLSVCLLWGEPKVKGKDKVGEPPGEAFYSAWGLSSGMEDTGVVRIPESSRKETVFAEWWALDIQQCGWLLWAENVCECERMRARACWCWAWGTVLFERRREQTLCTQMHQFPTAAECCFWLKEKEESEIFISA

SEQ ID NO: 932064 - protein, 161 aa, Homo sapiens
MTTGPFFMRLSSLDFLSPPGLTHSEVGLGWGIWKVLIISTFKYHYVSWALTSMWWRKGGQSLHHENVFPGGPVGTAFRVGHQLFLPREYNGGAEKWGSEAVIQRPPGPLRRLICMRSQKPQRSPLPMTGKVWYKLNSSGGVQGTANIFFSGAFIFKGQNWP

SEQ ID NO: 932065 - protein, 188 aa, Homo sapiens
MSMGTKEDLMDSRETRCPALVCCQGDADAAGLGTTEQIAPRVPYTQRGTDVAERGPGPMRHSTGSICGDENIKEVIVVCLCVGALHKGTNWDYDEVVGHLENVGETNRNIVAKSQLCKRAGDICDRFSWLAERHTIAWGERLQSCMGENDLPPSLADGQLAVDYVLISSGHAPVQEHRVPVKNLKHKH

SEQ ID NO: 932066 - protein, 145 aa, Homo sapiens
MQGPGSRIINRLLRRGPRSKMLSGRAWLSEKTSSRKRFDCCLREGVRYLKVSELRVIPSDWVGKHKAGVDEEEGDVIRTARLSEETNLAARWEVSNWLEICKTILLVTSSLTEVENKMCVTYIKLFQTCVGGSERLKRVKPKQYY

SEQ ID NO: 932067 - protein, 200 aa, Homo sapiens
MLIAPKIALYGSNCIYSPYVLLIKYREGEVTQHAVCKLRTQEGSLSPKTSKVGKLTVQPSVCGRRPESPWKVTGVCPELVPAGGFFVSLTSRMKLRTFAVLQFLKACPEFVPSDVQMCPEFLPSGGFMVLLTSGMKLQTFAVSVTAHKGNVDSEGAAVSFMANSERAKLPKLQSGSLSTVATAGSPGLLFFPYLAPPTSC

SEQ ID NO: 932068 - protein, 142 aa, Homo sapiens
MSAGHTGNHVAPEFSARHLAHTAPRQSILPYTVLLCEVQFLSWEEEEERGAAPGHKYQLRSLTGESQFCVPIAPSFTLMGLPEVAEGETKHCPLALPYPPTPQTLFPYTSLPTPPPCPGIVMEPSPAETQKEASCLALARSR

SEQ ID NO: 932069 - protein, 170 aa, Homo sapiens
MYLKLPEIKAFILGQIQHNGTIEQQGQQVPKVLVRSKIPSRSQGLELETLEVYLVLYSTVADLALKPQNSPFHFSLFFSQTEESLPIATTIPGLHKMEVIDDIDKQGSGEVVESRFWQQPLGAYIAHLPAESVTYLRPLQTAGCWRLLLPVACLPTAYQSPPKVTSSSFV

SEQ ID NO: 932070 - protein, 151 aa, Homo sapiens
MPLYSGLASWRHKASLSSPVLCPTRSFLRGVSARFPLHKESLGLSLGHIFSVPSPRDPLNAGSCGTHKTHLFFTYLAGKAVLYFSAPAALKTTVSSILPLLREGIAPGSSLFFEETSLCFIVFSILLTVLTPPAYFSILYISCKMLMGLET

SEQ ID NO: 932071 - protein, 142 aa, Homo sapiens
MTAFMSTSTPEEWMRRSCLHRLKTELGCVNWGVLQVPHSSGRIWGWDEKGPPRVVLGGGSCTSGVPNPQSCGPVMVRGLLGTGLHSRRAIDISAVTAPVSGSRASSSSSESGSGAAADTLQLQILIYIFLRTAPHLKICELK

SEQ ID NO: 932072 - protein, 152 aa, Homo sapiens
METCRSLRQGDGVSEAAGQQSTKKGVPSPHALTQPSTLCGQVGIQPDISVNLRDTRKEDEENLNCNSVLKPDAREVAGSDSVYLKIANLSFPQWSEKAQDEKSELPKAEDLRKATYVLCPWEFCDDNDDHVHIGSGHPPPLLRPFLRTVQPW

SEQ ID NO: 932073 - protein, 142 aa, Homo sapiens
MSLATHRAAMWKRPLEFQSSNRDPVQHGEPPEGLLYPNLHPASGVFTDKTHFCLSQSSEPLSEWETRVSIRMTPCYHARAQSLYSSKDPVEMQTAWERLYHKHDRQTDISSQEELLSHLRGCPPPQSPGCWPLLFPSDCHLT

SEQ ID NO: 932074 - protein, 241 aa, Homo sapiens
MREAELKSLEILQPDNAIERKIPFSEEKFKTAAEIYISNKELNVNHQDNGVNVTRACQRPLWKPLPSQAQRFRRKKRLHGPGPGSLSCVQPRDLVPCIPAALALIKRGQGTARAIASESGSPKPCQLSCGVEPAAAQKSRIEHHAPGKATGTQCQPMKASRMEAVPCKATGMELPKIMGTHLLHERDLDVRHGVKGDHFGVLRFDYPAGFQTCMGPVAPAFWPIYPIGTAVFTQCLYPHCI

SEQ ID NO: 932075 - protein, 198 aa, Homo sapiens
MSCNTHSSLLSQRDHEPTRRKKLRTHLNIRRNELQTRHLRSCNPHREVWNLDAAYVDASSSREFTHKAAINVLSRAEVSSEGLTGGEHMIASIFTHVVVGGSQILGDCWAETSLSFLPCEHLHRVDSNISASLPQNKWVREFSAKPTRDMDCLAESLGQRIKGRKKDPDVSIGVIEFSDTSNLDELYPWTSMSSGTTG

SEQ ID NO: 932076 - protein, 277 aa, Homo sapiens
MCKSFKCYQTGRSICKTMPGLAGWSRDGVSCLAKHPKILATLLSRGCDGAVRIWNLTQLKCIRIIQAHEGFVQGIRAHFCGTSFFTVGDDKTVKQWKMDGPGYGEEEGPLHTILGKTVYTGIDHHWKEAVFATCGQQVDIWDEQITNPISSMTWRFDSISSGKFNAIETFILGSCASDRTTVLYDMRQATPLKKRCCPEELTNKKFLEMEQECMAEEESDPPQEEPQAGPSGGIPEEGTVIIGDDSSMHVTAPEDLPLGQVEEVEDSDIDDQEAVYA

SEQ ID NO: 932077 - protein, 145 aa, Homo sapiens
MPLDTIPSPVENFEKHHSSQENTLALVWKGVCCSKCCTSSGLQDSSFENDNYSVIKKVKFTHIHWMSTTEPSSTVPQCLYAKLYSAPVFISQETKENMQQRLSGLYEKQKVSIVSGNPSEKKSFEEERVIVVTNAADRSRKIRGN

SEQ ID NO: 932078 - protein, 144 aa, Homo sapiens
MRKMSSEIKFFKLTNARNVTKLGCLSWWLGGMDLKERDGGWRISNARESFWSTGPQPAGASAGNWFKMQILGPHPRPIESETQGWGPAICFNKPPDDLEAYSSLTTPDGRGEWNPVVHLDKNQGDGTEKVQTDEAVLGVEEHHM

SEQ ID NO: 932079 - protein, 145 aa, Homo sapiens
MRPFKRLFGQKNFALISGIDAFIKERGLEDSGPLLTAPLGGAPVGTLCGGSDPTFPFHNALAEVLHESPTPAANFCLGIEALPYIFCNLLEVPKPQFLTSVYSQAQHHVEAAKVLGLHPLKPWPELYVGPFQPWLDWLGCRTLSP

SEQ ID NO: 932080 - protein, 145 aa, Homo sapiens
MKHVLSTWLLQWELRVILAGRAGGRSYGKLPQSSGRLASARVWAPDKGLESKIYKDILKLNSKKTNNPIIKWAKDLNEHLTKEDIQTANGISTYSGPSAAGLLEFAGGPLQTLFAWVSQAEAAEQQMLLPDPSPGNFISEGYLAI

SEQ ID NO: 932081 - protein, 154 aa, Homo sapiens
MRVPLRESGNPVDKFQLTIEEENLRIDALKRPHPAQLSGWERLEAEKRDGDLQQPGHGIQPKALDATNCFGDLIRKPAHELLGRPCLQTPSAGSWAPPTLCTSLLPLTVAGSVHVPVNTKYRPLQMAYELAQTTSLILKNRKKLYKLEHFRART

SEQ ID NO: 932082 - protein, 137 aa, Homo sapiens
MTFGADEVKELRSHYIGKINYIDIIKNHNRKKMGNETMSQEIKFSRNDGIVEATVDSGKGEVANNWDVQSPESNLAIRLAPVREGQQCKSHCPQGLCDLNSFHARIDTTVVQEGSGWGPFSSNRSVRSFYGSIWTKS

SEQ ID NO: 932083 - protein, 151 aa, Homo sapiens
MIVAELFDKYVVEKDAHINHKSLNDEDTSEKYVVRLFYHHANIIECSYTNLDGTDYCTPMLDDIAYCSHAVKLYSRETHPDQATFEQRAEGGEGSSHRCVGEEDSRKDYIDALQKRVKFHNTLTRHEKDSEHLYIFWKHPLLPAVIYICYY

SEQ ID NO: 932084 - protein, 167 aa, Homo sapiens
MGRNQHKNAGNSKNKNTSPPKDHNSLTAREENWKENEFDELTEVGFSRWIITNSSELKEHARNLRTLKKNINDLMELKNTAQELHEAYTSVNSQIKQAEERIPEIEDQLNEIKHEDNIREKRMERNKQSLQEIWNYVKRPNLCLIGVPESDDENGTKKYREHHKDTP

SEQ ID NO: 932085 - protein, 145 aa, Homo sapiens
MELSHRWPERTSDSLENSQSSCSRVFKLLFLLVLKTAWKHRMPCLMVITIFSHQAAVSCILYSMVHTGALLRDRRQTQSSLRRGCGLDCRRKWKHLDHRIGEVNKVLSYSELAPESYSVKHMQNPEKKPTGNGKAYGEAPPYKGR

SEQ ID NO: 932086 - protein, 150 aa, Homo sapiens [sequence omitted]

SEQ ID NO: 932087 - protein, 200 aa, Homo sapiens
MGSCAALASPTSAAPRSTVRSPIDHPMAEECGHTAQDWQAAPPAAPVRDPLGEASWSPESSGNLENLYLRDCKHTNQRPVKTDHLALPISRMWVGPDKRIKAGCPSQHWEPAGVPFHTVEAFFTPEANKTTNPPGGTNNSRRAALRAITLIGKVCSFILEPARPRIHQKEETPNTSEHQKEQTPDTPPLRTVTLTARTRN

SEQ ID NO: 932088 - protein, 329 aa, Homo sapiens
MVALDILVQLDLLAFEALRVTKALLSTENLLPWMSLTVTKYKASPISLSPLQGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 932089 - protein, 178 aa, Homo sapiens
MQLWVNYLTFLCLSFLILLKILEKDTRLYQYIVLLQTSIKKTWHQLTAPVCINYYYDGCYMIILYFSFFWLLLTEFYQERAFLYPLPHYSSWSLYSPPYDPVSAATALSPSLAPLPHNPFTSMPAFGHDADSKERGVRKPIRHRILELQRTMAVTSSGGPSIGAHLNFTGCVRIAISY

SEQ ID NO: 932090 - protein, 154 aa, Homo sapiens
MGVAHLLSHHTNPTQEWEHAGKRVPGPGCLFDIQMLLFFSPSLLCCSAPLPEEFGVFMGTQDGGMAGQGAIKTNEATKDTKSMHKKSVAFLYTNNIQTENQIKNTIPFAIATKRIKYLGIHLTKEVKELYNENYKTLLKEIIDNTNKWKNISCS

SEQ ID NO: 932091 - protein, 151 aa, Homo sapiens
MGIWFNVFAIVNSAAIIIRVLTFSPWNLLERVQTQGEQSSVFDPLNGVGVPAGRPCSGSVGCRPSPKELRQLRQQELGSTSADYTKTTQINNTIITEITEPPSVFICFNALLAANLSASPSSTPVPGIKVRCAWDAFNICSLNLEYPKTSL

SEQ ID NO: 932092 - protein, 158 aa, Homo sapiens
MWTKEQRLKAPLMPLLGSGPLVWAVQMKGGTGPASGMYHLLLSLDTDALWVGEGAAASAHAGAPFWRDAHSSRCCSLEDEQRSKPPTTAAVCPVLDKLSAFVRCGRIVVPTSNVAVGIGPQPQTSPTGVCSKRHWPGPAHRLPRPPPPHSTFPEFCRH

SEQ ID NO: 932093 - protein, 166 aa, Homo sapiens
MNCFLLSLVASYSNDTEKYTVVRNYSQGQRKSSISKSCVLHLQNTSQIRPPFAASADNTLSKHQLSYPSPVNWYPPSPFPTAYLPHSSHSDASGWPSSVSETGPGCCPIKDPAFAGPLPFHSPRSSHSSSLSNQDGAPTSLLKHTALPLPTDAPIYLLCVIFSLDF

SEQ ID NO: 932094 - protein, 146 aa, Homo sapiens
MSLTATFCSEGQGWKTNETRFTLSSFIDILLVSIGEIITTVFCKADAEWNLSGIGYTKKKDRNLSGARVIPILGAHRRCLKVDPLRKRQRFGCRKFTEVCSQKQHSEGGGGRTGPEELDGNVLATEASAHPPEREAFQLSLIKARG

SEQ ID NO: 932095 - protein, 137 aa, Homo sapiens
MKSSFFHLVFSWLLEETLTNIFRIQKECRLTSRYSMLDIQLKDKVDNSPSHLGSYSLAHHRRPLWKLLNHPPLSSSNPNLGKLYDTITIPSHGKTDHLWGQREDGNQHLLNLLVSDRDTLGAFVFTISFNPAKPLKN

SEQ ID NO: 932096 - protein, 139 aa, Homo sapiens
MTCTGLKRNTSVKWSASEFLLPASYGSRYEYSPASFVFSISILPQPEMQQNILFAIKENTVFLFVFAEENWCCLFGLDVGAWKKEVADSQFGLEFLVMIINAILHDSFNAEMVVEEGATPRKEPGPKPEDGAESPPHPH

SEQ ID NO: 932097 - protein, 157 aa, Homo sapiens
MIQFQSFSGLVPPDYELHKCFPLPAYPYSPIHHPSSFFSNIHCENLVKLLEEKLNNSMGPPVTEPTPLEFLSLRLVHAEPPVIDQLQFSFPTLVMVPVDVLVLVNCYSLYLPVCLSNSKGSNLSCDIIIIKLILCSNTAVFSVLAFLGSRQEEPIRL

SEQ ID NO: 932098 - protein, 165 aa, Homo sapiens
MLWDFSDCFPYLIIAQDVKAAPGFRIYSAMRNALKVQKNRSHAQRGNQERILSMKHRTNNQRMKPHDIGKPKSHGEHITSPNRCHGGHCETQQPAVMLRALASKEQTESSSQLCPWLTALSESQPIPSFKVVGGTYGHTINHDTEDKGNNRQTDARRWSRPMTTL

SEQ ID NO: 932099 - protein, 398 aa, Homo sapiens
MIKSQIKLPQRKKSKSDTGYLQEPTGKAGHQGDNVCKSWKGRNAAATPVNTEDARESTAATPVNTEDARESTAATPVNTESPRESIAATPVNTEDARESTAATPVNTEDARESTAATPVNTEDARESTAATPVNTESPRESIAATPVNTEDARESTAATPVNTEDARESTAATPVNTESPRESIAATPPLKTQKVQENTQLPPLPENTESPRESTAATSPGKHGKSKRIHSCHPSPENTESPRESTAATPVNTESPRESTAATLVNTENPRESTAATPSTGKCVTNAVVTTQEKKECATNTHIMSCNILTVCERAQIAPLPQFHTPPGPTSVSPGVCEQIHWGFLDRAEGRKGQSQDTRRPGGDGHIHYFNSKRLPSEYLLNMWPNTHYFIIFNKISS

SEQ ID NO: 932100 - protein, 269 aa, Homo sapiens
MRMSGSHASPPDLAACCCDLHGFVLHECVPSQFLGHVHTHNGGFIEGPVHYSLLSPEHRNRQTHNKMCTVTRCPTSRASTGVDLQQTPTDLQLRVLTVRRETNKQKGIASTSTKRHPHQNPICSHHHRRPKVDKTIKMARNQSRKAENSKNQSTSSPPKECSFSPAMEQSWMENDFDKLTEVHFRRSVITNFSKLKEDVRTHRKEATNLEKRLDEWLTRINSIEKTLNDLMELKTMARELRDTCTSFSSQFDQVEEGVSVIENQMNEMK

SEQ ID NO: 932101 - protein, 147 aa, Homo sapiens
MSHIILVLSSEHKHEQGRGVYSRDSRCSRTHSCEDDGRVARAVINHGGLISIWTPGLSQGAENLKRAGNDQAIVDRYLSFLTLFHPELFWANPGAARAASNFLTLGLALLLWGLEFATEKAGRRSGRGPWHGLEHREGGGLASRRSL

SEQ ID NO: 932102 - protein, 185 aa, Homo sapiens
MNWRGKRVGIRDLLEAKLHTLDDLTLSKIFDDFLASLPSCIRNSVWMLLPCVDTQNLQELLVLNLESALEIPNETAGTTITGKLIPKGSRASPSYIFTAEYTQGSEASWKPLAGWTGLHLGLECSASGICIAAGHFLLSPQEFGNTFSAVVLNDFVSYNWEVELASSSTDPGDGHISLSSGSISY

SEQ ID NO: 932103 - protein, 143 aa, Homo sapiens
MIPVFSSGLTSNYFLSKACPNIPKGYYSSSFITYLYFSCVITRLYTNVEKEEVVQPIPYMVSTSGMHLASGGEGKINPASSVKECITLDGFGLVVVFRSGLTPCVKVNNTEEKAGVKPSWTYLRFQPLHALMDGIKCGHDWTP

SEQ ID NO: 932104 - protein, 138 aa, Homo sapiens
MSRNYKFFHKWRKVDSYYSIHVANIRKPEEWKQQARVKGSGVTVDRAGKGQAMGYAIVRGELRSSLSFMWTTSMETLLEVGPGKKCLGHGGGSLMNGLVLSSQGLPYPVPMADITSQSWQSFLLNLRITIIGFFIIVC

SEQ ID NO: 932105 - protein, 186 aa, Homo sapiens
MLPQLLLLSSPLLLLLLILIVRGLTFRTLIDLKLIFVYSDRGCELRRCWVGSFGFASIALCTSDGNFYTGPFSLTYKLADGTYREELASVNVAGYVLFLVYQEKLSVTSGNGLICGVHSDLSSLLSSGGAGAKISSFGSFRYHIIKHKDSFLSSPKIQYVYHPLSKAAVFYFFGHILAIPSRRQVG

SEQ ID NO: 932106 - protein, 140 aa, Homo sapiens
MGKQGNLLLVDVPPGPHSSTPDSFQTPAGPDPASGPLTPQCFIVSSPAGTDIIPRPSEASAWAEQAETNCFTATTLNLTHIPFPKCAPHWQLLSEIHGKVFSKSHADTFILLAVKMTRKIYQKPYVQALPQMQAKKPWGR

SEQ ID NO: 932107 - protein, 141 aa, Homo sapiens
MGNYVLHQCDLNVRPGVKGDHFGALKFDCPTGFQTCMGPIHYWASEEPLPNHWCHTRVSFVRCSRPGDFLRQRSQLADRLFPSRERRHALFPGQPTNQVISPLCVLRMEAPPLHGHHPNGQVLPARSSGRVRWGAVTQSAA

SEQ ID NO: 932108 - protein, 144 aa, Homo sapiens
MALVMAVEVVGTSWDLPVAYMGTVVAAVDLEGQFPGLQVAHEGKETCVWHSGNNEVEGYGLMDDENEMFGGQEREFITIIQLMNNNLNQEVAVEKEKEMSIIKIFWGSLQLNCISTFLWYSTDLLNIYFSFCHMAYYKHIVFKG

SEQ ID NO: 932109 - protein, 148 aa, Homo sapiens
MLYLPPPPTPQQAPVCDVPLPVSKRSHCSIPTYDSVEFVITQLLKPTSANLSNSLSVQFCSLVGEELWSFGDPSTAGLLEIAGGPLQILFAWVSPAEPAEQQRWWPVPSSGRFFPERHPPDASWSSPQSLSTVLGDLLLSLELAGRNV

SEQ ID NO: 932110 - protein, 169 aa, Homo sapiens
MGRNQSRKAENSKHQSASSPPKECSSSPAMEQSWMENDSEELREEGFKRINSLEKTLNDLMELKTLAREPRDACTSFSSQFDHVEERVSVIEDQMNEMKREEKFREKIVKRNEQSLQEIWDYVKRPNLLLIGVPESDGENGTKLENTLQDVIQENKSNSKTHNCQIHQS

SEQ ID NO: 932111 - protein, 147 aa, Homo sapiens
MNSSSVKDMRQQFWQVTILDSHFAMPFAQSRTLDGIYFFACQNLLLKKAMRELCDQPASLLWSELGHMLIPGPIIGKGQDEQGGWGQFRKVSQWNSNVIITWELIRNSDSQTPAKNCGIKMSGCGLPPKSAWLLSGDYDANLRTCLD

SEQ ID NO: 932112 - protein, 178 aa, Homo sapiens
MGSRKVIIVRFIQLFVVVRVYTDQKPWSHTWHLLSDPTSNPSANLVDSALKTYPELTASHSLHCFYPYLSHSYLGLDSHVNEKVTGNWSKGHQCHTLSKSLAVLCPCLWELWKFELKSDDLGCLVEEISKQQSIPESVFLLLTAYNQMWEQRNDLNLELIFKREAKHTTLEICSLALW

SEQ ID NO: 932113 - protein, 156 aa, Homo sapiens
MKKNEKESRKQEEEEEEEKRKEKERKKEEREKEEREREKREKGRKERKRKQRRRRRNKRKKRRRKKRRRRNKGKKELSWSNGKEQQFFHMPGKRQVGIFLSKQVLTEICDFTKDLHFSKCIIIIYLPMTPPQGGFKVEFDLHQLDVIFYNLYVFRS

SEQ ID NO: 932114 - protein, 162 aa, Homo sapiens
MSSSGIVYTPIGTLYLAQGLDCKCTNQRPVKTDHSALPISRMWVGPDRRIKAGYPSQQWQPRDHEPTRRKKRRTHPNIRRNNSRRATLRAVTLTAKVCSFTPEASETTTTSPPGGRNNSRHAALRAVTLTARVRGFILEVIEIRSSTGGNIPPGVHLAFSRR

SEQ ID NO: 932115 - protein, 139 aa, Homo sapiens
MERAKVPVTLKNWPTSKFCICIQLLAEVWGHSFVLLTDKLPGTPEPWPQSIQMLGQLRQHYNIHVKDEKMEALAGYVNRASELDPGLNPVPEALLLSASLFYTLSDLLKVTPLKFRREKSRADMGISSLALIFMGQDGY

SEQ ID NO: 932116 - protein, 166 aa, Homo sapiens
MGGQPQLCPGNVRLLPCQLRSGAGLLPVPAFSRCSPVFPVFICENFSPVDCSFAFLGPNGGGGGEVKIFFKDEGKIKIFSEKQQPKILIAKREEIFREKLRKYSWSWGHLLILGEGECGDPGLAWVENPGWRTNKSAEILVVTWDRSNNIGKLRSILPWIPEKFTA

SEQ ID NO: 932117 - protein, 150 aa, Homo sapiens
MGRNQSRKPENSKNQSVSSSPKDHSSSPAMKQSWTENDFDKLTEIGFRRLVITNFSELKEDVQTHHKEAKNLEKRLDEWPTRTNSVEKTFNDLMELKTMAQELHDACTSFNTRFNQVEERKLYKPEESAGQYSTFLKKRIFNPEFHIQPN

SEQ ID NO: 932118 - protein, 141 aa, Homo sapiens
MADRPRAGHQIQARPIQCPISPATADCSRGQHLSEVVPDEEKHHDNSHAADLETNLSILEQNRGLSERFLQEDENHKILHMLKYTEKRFMLLKESLGLNNQNVKTKQRKTNEERRYLQCQGKTNARQLRMSCPHCPCLCYE

SEQ ID NO: 932119 - protein, 141 aa, Homo sapiens
MWRDRKASKVNIAELEKSCSKESGIMKSKHCQPPFTFCHEWKEPVALTRCRCPILNFSRRQNYVPNKPLFFVNYPFSGGKKGSTWYYTPMQSLWDTIALRRGDLHPQAPARNCLRSVGAGEGGAEAMKLVSEPVPWSVDLC

SEQ ID NO: 932120 - protein, 346 aa, Homo sapiens
MGNWGTKRGWRERHLKNNGPKFSKFDENYNPTDPRSSTNPNPSKEKEKRKNLHPAAASHAAPAFNSGKVNIVAINDSFIDLNYIVYMFQYNSTHGKFHGTVKAVNRKCVTNGNTITIFQEQDPTKIKWVDAGIDYAVESSSIFSVLEMAGAHLEWVAKRIIISYLSANAPMFLKTVDVPSGKLWCEGRALQNIIPASTGAAEGVGKAMPELNGKLTGMVFHILTANVSVVDLICHMEKLTRYDDINKVNIGNSRQDLVKSKFRITAILKRAAGLEFGNWRENFMRKVSRNNIKLIHHLALNMKFFHTLAKIYCQENRHKRGLGSDDSLELPVISTPSIRYVVKAVQ

SEQ ID NO: 932121 - protein, 139 aa, Homo sapiens
MVLGTQAKQQMLILCSTAAALGPSPVRHCSQSFCLKVAHHRDDMQPSGSFHWKCIVFLSLARARAGYGESTSLLTDGEMEERGNESTKVKYLSKRWPPFSLTEHQLSLRGFSQGCWQLFADFLSTVSLERKRTIFPNSI

SEQ ID NO: 932122 - protein, 137 aa, Homo sapiens
MKLRHSDEISCPKLNSLLVVDTFVIALKLSLGFCDSNVVQRKRQEDTKVCRMRQNIGKRIHVEYGDPVQELASRLISGHRNTGMSRPESAYSQDTKDNEGQHQLFCPQSTQPANHPWSHLKSGLEVWPSLIKQAPEI

SEQ ID NO: 932123 - protein, 165 aa, Homo sapiens
MQEIYWKKIPVKDKRQRAGMGKDSLRLQGGSDICERRVSDNVIEKKNPFSGENFKPTAEICVSNKESNVNHQDNGENISRAYQRSSQYPLPSQVGKPRRKKWFNGPGPGPCCFVSSQDLVPCIPVMAKRRQRTTQAIASEGASPKVWQLPCGVGPACAQKSRTEV

SEQ ID NO: 932124 - protein, 134 aa, Homo sapiens
MAENRENMHAKVLTKQGIEAGSEAGSFQKKRCSADTLRLVQWNPFETSDLWNCKIIHLCCFTPPSVVICYSSHRRLIHTPLPLSWQWWLNSGLERKWGYKEATEYRDSGEKPPGFRTQLSHLFAVTLSEGMQPL

SEQ ID NO: 932125 - protein, 136 aa, Homo sapiens
MDTRGDKGSSPGGQMEDESIWAGSWLLLHSRWGPTGCGFYVVKVHTHSLTCEYPRSFIAIATPLPSLPLCINLRHFPKNALPSPGLSHVFQLLEAVLAAAVVGSIVVVKAGPTAGRLWCYSSSSNVVLMAAASVMN

SEQ ID NO: 932126 - protein, 170 aa, Homo sapiens
MEGSSLWASTLRTPAFHFPPGFLYAVDTSTASQTDTSSPEVLGAIMAPGTTHKQCGQGADGEIVLQSVPRWITLRCILCPPQRLLARLNVRGNLEPVRRTAWQHQAPATTVHTLPGVRGPECNQNNYLNSQLLPPQLACFPGKDGVLSHPERPKCAHFLAPLWTESWELC

SEQ ID NO: 932127 - protein, 142 aa, Homo sapiens
MTLGVKISLGENIFLSQTSFILHKDSLEGVKCYQKEWFRAYRGVRVTQSRCGACDMNVSCPFSLNGGPAPGGTEYKGLWHVEFLKQPAGKVGPIVSKGTDNSICVLCEGCNQRGQGLLRITWFIPVPLTRWLPRAGLGPWEG

SEQ ID NO: 932128 - protein, 155 aa, Homo sapiens
MRNARSPGRDEEGQMFALVWVWDFARQVQQEDRWSKGFEDIGKGAAELMSCRIWTRKRRTIINGKWQLQRSNTESSLHAQKRRQLLLTVSRRCQHLYTLRKDTGLHLTGAVEFLHPRLVSGSKSPGLTGAVWSMNYANSNDDGFKSYRSLQPPKP

SEQ ID NO: 932129 - protein, 197 aa, Homo sapiens
MNFIESCFWRLENPRPKGQHLVKAFLLCHTMAKGGRARERGRNYNIFWMARYPVCSPAGHEKKAYLGLSTVCRIPDSYSGFRASSINPGQKVFGEQVVFGYMNKLFGGNLQPVNRAKNLPRTMNLHIEEASRLTVFRHLREPAVVIQFLQRVCGLSQLSWYVPAVVLEAKVYDVSLHMLLCPFKWQLQASPTSYPPS

SEQ ID NO: 932130 - protein, 145 aa, Homo sapiens
MLRKRAAHHLEIYQNAIDRIGNNFALEPQKDLDTAFQDLETEAKFFITREMLSAMIWIELVPRDIIWWVEPTAGSPNGHLTLERQDVSLRPKDSGNPLKYFKQPDRVGLQGGACHFPTAAVTASRFMFFLFCEPRLFHNIYWSVS

SEQ ID NO: 932131 - protein, 141 aa, Homo sapiens
MTDFVCAHIKNGVLLLVLDLGKCLQLFLVSFPHGVSKTFPILTLAQEKQSALPWPGLLRSPVERGFVRQTGYSLIPSSPSCAEILTPFSGTSVYGVESLLVVGVDKGGWTDSVIGWLVCCNKEIEEGNFRFFSITQFLLPI

SEQ ID NO: 932132 - protein, 140 aa, Homo sapiens
MVAGKKRSSLPRLGGQAEGLLTSQTMGGQAEMLLTSQTGWWPGRGCNFGTLGSQGRRLGGGGCSEPRSRHCTPAWATLSTEETLERERERERERERERERERESIKFVLAIERGAVKADMNCSDRSSLISCQFSKQNVLV

SEQ ID NO: 932133 - protein, 135 aa, Homo sapiens
MGKCRGPHTARSLCSHQQDQKWHDKQYKKAHLGTALKANPFGGASHAKGIVLGKVGVEAKKPNSAIRKCVRVQWIKDGKKITAFVFSDGCLNLIVENHKALVAGFGQKAPTNGQLAGYEDVSSPGLLLEGDREEL

SEQ ID NO: 932134 - protein, 160 aa, Homo sapiens
MKCQILGYDVCGLSYSHFSRCYRYYGIWETIFQCKEGKVSCFDIDLVELPRDLLNGFDQNADSDMDSEVQIEVISDEDEERTGNWSKDNRVPTGYLKQNLTEMKGEIDNSTVVVGDFTIPPLIMDRTTKQILEERQVPVVVQTPIVQMQLYHQRRRGVKI

SEQ ID NO: 932135 - protein, 134 aa, Homo sapiens
MSCLTKYTLACCGCSSSRFSQASQTGPFPKAPDSADGSSRFTRPEQRANLLQVPQKEEKNGSSRYKGKCALSPEFRAANWGDGSDTGSFLRTQRNGHCLPRSICFSHGDGGAPRDAEEATPAEMVNFNLSTGLG

SEQ ID NO: 932136 - protein, 161 aa, Homo sapiens
MSLAFLLAALFLVQPHLSPNQLHRHLCYYEDLINEELFQDEELFQNEEPFQNGELFQNGEPFQNGEPFQNEKLLQNEELFQNEKPFKHGELFQNEKLFQNEELFQSGKLFQNGELFQSGKPFQNGESFQNEKPFQDEELFQNGELFQTDELHLVPASHLIT

SEQ ID NO: 932137 - protein, 396 aa, Homo sapiens
MKNSQHAFNLQQALCCILEALCLVDPPNTPQGRITPPDLQQALCCLLEALCLVDPPNTPRGHITPPDLQKALCCLLEALCLVDPPNTPRGHITPPDLQKALCCLLEALYLVDPPNTPRGRITPPDLQQALCCLLEALCLVDPPNTPRGHIAPPDLKQALCCLLEALCLVDPPNTPRGHITPPDLQKALCCLLEALCLVDPPNTPRGHITPPDLQQALCCLLEALYLVDPTNTPRGHITPPDLQQALCCLLEALCLVDPPNTPRGHIAPPDLQQALGCLLEALYLVNPHSCYPRQSMQQQQQHHLGAGPELPTICKIKGETAADVQSLREPDGGQCHQRATGTTSAPGKAQACLLQPPVVLRSQDLLSGLASPPTTSTAQRCPPGSTVTSHVCSLRC

SEQ ID NO: 932138 - protein, 145 aa, Homo sapiens
MWMCVEIRNQQPRTPETGGAGRVPSTGGDSQPLAEIAVLSFHPGLLVGTTGSESTAGLPSSGCRRSPRTAQGNTDRGAPGKAPTATASLDGAPGAARKSRKDPGKHCRRTLTEVSDKRAQLGITGNPASSSSARLPGRLLRSWQA

SEQ ID NO: 932139 - protein, 192 aa, Homo sapiens
MVTHPGKTQRGLFRNSRTHWSRLNIPDVIKPINFADEDSKAEKARPTHLNSSVCWLMAVARIHMLLAALYLGAVFKYTKILILMSESTWVSSISSLLRTPSLRSTTLQPPLQESHRERPVSEASGLFQDFSATETWEFYPNKIRAGNDACHTAVLGNYQNLSLAPLAWTQPLHKPGVSLKRLVPGRDFCTVE

SEQ ID NO: 932140 - protein, 258 aa, Homo sapiens
MKNSQHAFNLQQALCCILEALCLVDPPNTPRGRITPPDLQQALCCLLEALCLVDPPNTPRGHITPPDLQKALCCLLEALYLVDPPNTPRGRITPPDLQQALCCLLEALCLVDPPNTPRGHTAPPDLQQALCCLLEALCLVDPPNTPRGHITPPDLQKALCCLLEALCLVDPPNTPRGHITPPDLQKALCCLLEALYLVDPHSCYPRQSMQQQQQHHLGAGPELPTICKIKGETAADVQSLREPVVSTPEVPPFPAQER

SEQ ID NO: 932141 - protein, 162 aa, Homo sapiens
MVALPVQVLPGQVKRQAGEDLNADRMLEPAAMWPGDRFASRLHMNLFGQFNQCHPETNTQGSIKNSNTLSKQHLQLLRKEQPSFKCTAERTAGHIGLSAFLLHIFSNRVGGSFFEMGSSGLRDSDPGPAPPPAVLCGLHQAPLKPLDVPSRPPSLVACPLAI

SEQ ID NO: 932142 - protein, 139 aa, Homo sapiens
MGVFFYITGGRCSAGLTPFPVSFALLPMGGELALAKAGTLQLTHSAIVPYLTPQKSDTRNMIKKGVVGKTVEVTQRCWHELWPMGDPMPNLKTFTFQENKEVKFQEITYLLAANSRPLDQMVEPSCGCSAYTVQGFQLR

SEQ ID NO: 932143 - protein, 145 aa, Homo sapiens
MCNTCKMTDGEIRYTPDITGTKQCPGGMLWKVYPGKSGKAPKAAGQQVYTDGRQHAGAEHSPGPVMFDKIEVGGQQLYRELREKDSGRMRIPPKPIQAHFLTWVNSTRGELNYYKTIILVLQNVLDYWFRPREESLHGLPAIFAG

SEQ ID NO: 932144 - protein, 161 aa, Homo sapiens
MSTLCLAEAWQPVGVPLHAVEGLFFCSLQSILLLFTLCVCAAFMSCNTMKVCSFTPEVISETKNLPILDTLWSPISVKAGLSEHLQTPGYTVCGLQKPLTQTKAKGPSSGKSQKVPAEVHFPRALTLGIWLAKLNAVFHQGQLAHMDPMKMHSDSQKLSTY

SEQ ID NO: 932145 - protein, 168 aa, Homo sapiens
MSGLLQQCPQKWQLGLQRISGAGILGSHLGQQKFLMVLYEIRIYTGTMTGAETESNVFINLIGTRGDSGKRRLHQSKNNEIKFQRGQHLLNAFQGIGFMVKPELHTDTHLIPTASLQKEPNQLGYCVFPVHVLWVHLQFELRAGDRVLQAESSRAQGRYLTSIGHFFS

SEQ ID NO: 932146 - protein, 136 aa, Homo sapiens
MKIWNYSILRKPSPGKLVDSIDSVLYSYLFFVNIYQLLREDVKIAKYDCINLKDIGEIYKIRIGHDNTGKNPRWYLEEVRLENIATYELFCLPVDSWIAENENDGDLWKEIPIMGPKKAPLPEWHRTHGYVPPDTS

SEQ ID NO: 932147 - protein, 165 aa, Homo sapiens
MTSKVTMQHMKSKKILDFAANVWLSRIQADGDVVLRYQVDVYTGQLKHAETESEVFLCLFGERGDSGLRQLYKSNMQVKFQRGQITLGRLFSTTIYEKVMCEGVLLILISIALTLGPESLWKCQCIFDITNQFYLGVKSPGYSFTTNPRMCSIFIYRGRCRGRMY

SEQ ID NO: 932148 - protein, 128 aa, Homo sapiens
MVHSFVSVLREVLDCGWFPSCCTALCQWTAESWKFTKGNTLQFYNKLTGGFVRLHPDGTVSGEATTELRVLYQPNRCALLESALVPGHTVVFDRHGKIADASSAGYANLSKEFVIFVKCAGYLFLPSE

SEQ ID NO: 932149 - protein, 177 aa, Homo sapiens
MGKHDLYITGIHYIESESGSNWKVFIITSDLPDAGTSSQIYIILYGQHRSSAPIYLYGTDGARFQVGHEDIFTIQLHNMNSGKQFYVPVQRWLARDQEDGEICREFPLLSKGQPVLPGRKDSTPVTIYEVNVATGELWNAGTVANVYISIHGEKGDTGSRQLFRSKSSFNFLRGQVV

SEQ ID NO: 932150 - protein, 144 aa, Homo sapiens
MGGVKATWKMADGTEDDEVEEKPENLRAPYIFPGASQIHMPPLSAGFGIKISELADRAAELALTLLQPRMGIHVSLDENTGMHSDLIKSDFEASLQSQYTITYPESTHLLDKKGKELSLLVTVNLLTAGKPNHKQRPDAASTFS

SEQ ID NO: 932151 - protein, 157 aa, Homo sapiens
MAEEEANTSFFTSLIQLKRHRAQRDCALGTILPNLDKMGGCPSTSLCSGRDFHRPYLGPGISSSDLTHPTFASGYWRPTITDIQGLQISKGLPFACTAHSSAQSTTKPQSNTDGPSRGRRPKVKGHCLPAACRDAWGPLCLLPTNAHRSRPIFWESV

SEQ ID NO: 932152 - protein, 140 aa, Homo sapiens
MSSLGALFHLQAEEQTEFLQSVWLHCSLATLPVLVEAELGSVPVKWCLCLHGSLPGAKSFYSTCLHFSAAPLSLCKREVSSVRGRCLLFASPSLCKLPGMLVPLVRAWPGVAQLIFAFFHRDGVSPRLECSDVITVRCNL

SEQ ID NO: 932153 - protein, 130 aa, Homo sapiens
MVQLLHVPELASFIFPRVDPKSFSMDNNLHLGIFFPETTSDSSVPLTGNRSILPKWQDELGLREEKKGREKRESKDVANKIPNALLPELWKESCSCPLANAGFKLIWVSAESASGSMEKLLLGVPRGLES

SEQ ID NO: 932154 - protein, 247 aa, Homo sapiens
MMFYKKEIQTIFLFKFKIGRKAVETTCNINNAFGPGTANEHTVQWWFKKFCKGDESREDEEHSGRPSEVDNNQLRVIIEADPLTSTQEVAEELNVNHSAVMRHLKQIEKVKKLDKWVPQELSENKKSHLSEVSSSRVAGNNNEPFLNWFVMGDEKWILYNNQQRLSQWLDPEEAPKHFSKPDLHQKRSWSLFGEALEPERLPSEWRKVIKTLLMKQDAVKNLAQTHQNQNGKENDLWSSSLLIIHLL

SEQ ID NO: 932155 - protein, 160 aa, Homo sapiens
MQTPAAVYRKPILGTTFKQQRDCSGIYVRDKHSENSRSVLESNLEDKYSDPRSSVLESYVRSKHSHNRSSVLESYVRDKHSELHNSVLKSNVRDKHSDCRSGVLESYVRDKPSEHSKSVLESYVRDKYSDPHSSVLESYVRDKHSDYRSSVLESYVRDKY

SEQ ID NO: 932156 - protein, 206 aa, Homo sapiens
MLENYGNLVSLGLVISKPDLITLLEQRALECEETEDSSQIPRYVFLAGPMLLSSAYMVVLLLSHQKKSWYLHSTCLSPRPSPEQSATQTILLLVSFFVVVYSVDFIISFSSASLWAYDPVVLGVQRLVCTIRQGVRCAPDPTRLPLPLPIVLKAAIVPAGLSAWVQGGATGTILEEGPGTPLSPPAYGGLRGCPVLSVAPGSYLTR

SEQ ID NO: 932157 - protein, 147 aa, Homo sapiens
MPVQSCPARAPGHGTVTAQGGDRTPGVLAVSSAAILWLKGTEGRAVPRTTLAKDFGADSGEAGVPPQPLQTGFPGGPGILAVDLPIPTGHRDTEAGPLGAEDTEQRRKDLELRLQPETKAAPNLESRPVHSSCVPDWMDPSPESLIG

SEQ ID NO: 932158 - protein, 208 aa, Homo sapiens
MYSRKAMYKRKYSAAKSKIEKKKEKVLATVTKPVGGDKNGGTQVVKLHKMPRYYPTEDVPRKLLSHSKKPFSQHVRKLQASITPGTILIILTGCHRGKRVVFLKQLARTHQKFVIATSTKIDISNVKIPKHLTDAYFKKQQLRKPRHQEGNIFDTEKEKYEITEQRKIDQKAVDSQILPKVKAISQLQGYLRSVFALTNGIYPHKLVF

SEQ ID NO: 932159 - protein, 155 aa, Homo sapiens
MTLCPFPPGPQAAFQQCVCASTHVGDGGTGVQGQEPPRRGDVVCGQQACILPGTCRLLLQGPPLMFTEEYQKSLPEQYHLGLDQKRRKYVVGELIGNSADFTTMQCKWQFGSWDNVPVLIFSGCLANSGHFDYKNIGNKGGKLAYSIALGFLDSG

SEQ ID NO: 932160 - protein, 181 aa, Homo sapiens
MRGRQQQSGPGTGWPWQSGGPGSEETCELRSRDSGQGPSEPLSSDPRYPKGYFVQNTDFDFFNYAGLQRSVLLYTTPTTYIDDITITTGVEHDSAGIASVFNPNEGIVHECRISLDEINMRMRISIERMFGYRIRGVEVLLVLSWLLEVYKNRNLILHNLYTRSFNTIDVKRKVLVMKYVV

SEQ ID NO: 932161 - protein, 174 aa, Homo sapiens
MVPTTTAVLFSWPGSFIFGIIRERDRGGWLKNAILYSEYRRTQFYIRNTEERNSIFGIQKNAILYSEYRRTQFYIRNTEERNSIFGIQKNAILYSEYRRTQFYIRNTEERNSIFGIQKNAILYSEYRRTQFYIRNTEERNSIFGIQKNAILYSEYRRTQFYIRNTEERNSIFGI

SEQ ID NO: 932162 - protein, 201 aa, Homo sapiens
MAGCSSQALPHGEAAKGRQEIERSAGGLALLGDPVHPPQLLAWVLSSSLPWPAGPVGRSKCGARQAHAHPELQLAHKQAQLRTEVLKRDTTTTLKASSKFFNGPIFDISYTKCHQAPEESTRRKSEIQANTNKEGDKEEECSPRKTGERGSSQELREPASWESRTKVQARVGACQPGRTLAQEHRSRALPRVTGPPFYRAP

SEQ ID NO: 932163 - protein, 316 aa, Homo sapiens
MPNSVDVVSYFSYSTLRLAQWTCGKGRSPSAAGLLEFAGGPLQTLFAWVSPAEAAEQQILQNSKYCCLILPLEASFQRDTCLYEVSVSPYWEGSPNCCASSEQGSASIGPSDSDMGYNLLVCHLLKPLEKQYLGGNVPFFQNCSGSWEVAYFYEIGTASKNGEAEFRETNLSTSLTHNEVSRDECPRSSTAMPILLTNSQYLYHRITVPQQVMALKEDNPERATLAALGAKNAIPGDFNHLQVLETATKRSTRCKLSVGLPFWGLEDSGPLLTAPLRSAPIGTLCGGSDPTFPFCIALAEVLHEGPASAANFCLRI

SEQ ID NO: 932164 - protein, 148 aa, Homo sapiens
MKHCVVLTVYSGMVEFNGIPESVRPVAAAARNTEWQSTAIIWTLQQGSGACDCSWQPKEHFPAYRALLQHRHLGDITALTAKVIFLRRDGTTSAVGTGNKGISGWSGSTSIWFHKEGYNICLQLGFGMLAHQTGVAHWQLSLINEGQQ

SEQ ID NO: 932165 - protein, 138 aa, Homo sapiens
MNDQDISTILLFSCPCPSHRVIFLGFLPRECGWILGSKTQEIVGALLYLHALLGNSQSQSSNSASNNLLKLAFKCTYYSTVPVVFVLSKRFSAVTFNICLWKLLSLPHLTRVIDFAFVQYFLVIRTQVTTSRIFTCQC

SEQ ID NO: 932166 - protein, 133 aa, Homo sapiens
MSKILHCLAISLCFTVPCMSGLFLHLALFHFLPNHNSITVFVGFSLYLSIFTILVRVLFYLIYNKPDTLLQKWKLPPDINFLFLPEINLTKAFLYPLFLFRQYNIFIYIFAWYILVISIDVKIFFILLHPIYM

SEQ ID NO: 932167 - protein, 138 aa, Homo sapiens
MPFFAFIDLCCASFRSCHKLWQGTGRDRGASLFVGVTAVMVAAWCGDTGGPTSNFMCTFAPAVLSAWERGPGGHGASTFCAHIHRGSSGHARSYGGCPQEAAQLDIRTCIASRCRQTGALGEARRQTCSQVGPAPSHG

SEQ ID NO: 932168 - protein, 204 aa, Homo sapiens
MFLGPPQPSRTKIEEEIILPNAFYKAIITLMPKPDKDKTKMENYGPMSLMNTDANICNNMRGSTKRKCGLEPPTHRFSTGELPSGAMRREPPSFRMQNGSSSNTLYHVRGKATVTQCQPVKAARRVAVPWKATGVKLPKTMGTHYLHQHELDARHRVKGDHFGALRFDCPTGFQICTGPVAPSFWPFFSFGMSVFMQYLYPPCI

SEQ ID NO: 932169 - protein, 139 aa, Homo sapiens
MSISFRIIIYRSLLIYKIRTIRVSTPRGCCECVECFDYCPAYEKQSSQSSLCPGWMTMTFWSSLHNIARMVFLEVCSCPLSHSCSLTQDLPLPLGGSHQVINYFHSEGRNEQEASRSQQETELLFQDVLQFFWGGWLLT

SEQ ID NO: 932170 - protein, 158 aa, Homo sapiens
MISPPPGLAYFFSQDCTAHGYNHSFENVLTSTPLSPLPPSTWLANLCSWEAVSSAQPTCGVEGCRGKCPVRLLPATSVTLGCSPPSSPFPFEIPLPRGHRCEVWWAFIPFPRSTLRLHGQSAVNCPSPVPTLRAPSFFLKGLEKVTPPNQLTLLALHF

SEQ ID NO: 932171 - protein, 156 aa, Homo sapiens
MVIPYDVLFGETYNLLANGSTQKMAQPYHLQTLMVHLPMPLALALDVPANWIIIISPLTHGTIFGFWVSVSAASFAGASSTCLSGLISDLADERLERRGLGCCHQQKSLSVPTMKMWEVPEELMMLELLANYAEILLTSPHGNKIAATIVNITPSI

SEQ ID NO: 932172 - protein, 184 aa, Homo sapiens
MGRLAGQGADPPISLPDGAAGLAGADSHLPPRRGGCRAEGLLTSQTGQLPGGGSPPFSDRAAGQRRSSPPRRGRGRAEALLTSQTGQWGKGSPHISEDARPGRDAPHFLDVMAAGKRRSSLPRWDGGRAETLLTFQTGQPGREAPHIPDDGRPGRDAPHFPDGSLPSSNHIQECWQNDHFNMQI

SEQ ID NO: 932173 - protein, 143 aa, Homo sapiens
MASVLKSPKYVSDAHLNTGWQRGHHPCQAYWQTNGACTVSSSRCQLRKGTLSAHGPYCRQKQHSRAPSCTSRARLSLQHFLSMQSKARLLLGTWCSQADESSVDFGSGLVTQSIRDDAESALARATAAIAAASGSQWQQTQLF

SEQ ID NO: 932174 - protein, 135 aa, Homo sapiens
MYEFSVNLNRSTTLPMVVIHLQGISEVQSKLEEVDIKEAFNIDNEPPVVHSLTNGEIAEIVLDQDDHNNSDDEDDVINTKEKVPIEDMASLKLMSSFLLTVFGEAPRLFQSNITQNLPQKQGTGVEKIVRFMLWG

SEQ ID NO: 932175 - protein, 158 aa, Homo sapiens
MHKDIEISRPVMGGAATKTSDMPRRHFPHWSSKLSHIFLSSSEPSKLFQPLPITQFQSCFHIFRYLFSSTPVYWYQLTLLVHFHAADKDIPETGQFTKERGLLDLEFQMAGDASQSWWKARRSKSHLKWMAAGKEKTCAGKVPFLKPSDLISIEKDFL

SEQ ID NO: 932176 - protein, 138 aa, Homo sapiens
MTEGPCFLTAVCWRPPSDPRGLLVPWTLSQHGSLLPQASEDNLFLQFAKMELSIMPPQALLASEAGPEHEEEKVQGKELLDLFWIKHLKESQKLSFNPKGCSNNNIRLLCQNFVDTGASKPEENHKLPTLTHQSCLPG

SEQ ID NO: 932177 - protein, 167 aa, Homo sapiens
MFIEPALHPRDEADLIVEDKLFDVLLDSSGSSAAGLLEFAGGPLQTLFAWVSPADAAEQQSLLPVPSSGSFIPEGHLQMPAIALLYEVSVSSYWEVSPSQDTQGDALPRVEESREEVWLQRPCLAAVGSPQFVLHGSFMYTVRGKPPTQALAVVDAPSPIKLKRPRT

SEQ ID NO: 932178 - protein, 158 aa, Homo sapiens
MPRYRENETADWDSALASYLGHVSVTHTRHLKMSNHQGSTYSLLFPPWLVHKVAWLLWCLLFSLYCLRCLLNNSLRFVYGLCQELGHPDRVGHLLPSRQESHSMQAQRSQKGPQVCEKHTFTHPNPKNRLRDVKNSGSETFNGSLPRSSVCMSDAEDG

SEQ ID NO: 932179 - protein, 136 aa, Homo sapiens
MAQGLISTPSPTITVQTLKRKEKSPYTCMTRLVVRHLKTLKLQAWPSGPATLVGPTLTQIKISLYFALKSQIRSTQNLGHLENLIKVMVYYGLNVYVPPNSYDESSTLSMTVFGDVASKEIIKGRGTPRKCGGAAP

SEQ ID NO: 932180 - protein, 250 aa, Homo sapiens
MNTLHFSYSFKLWTNACNCELPTLWLPVPRLHQPGLSNGITVSLHGSLPATDEKLISLDHILILLAYGTGAWDPLNVGTEKAVTSWPSALRWQRAAASCHSSSSGAELAPEPCAGAGQGADRAVNMPPFIGLQRAGQRMLINMLLHPLWSLSLRAPLPGHHHIPVIWMPESATGVTCDIPVPATSTAQGLLLCWHLEQWARHHIHSLACPLQPGAEYAVTVAAGSVLDCHQVQPGGPSGQGISSGKPRPK

SEQ ID NO: 932181 - protein, 149 aa, Homo sapiens
MRSLKCIQIGSVGLKSVGKSQANSLIAPWKLLLLIVRRKCSEGRNGAIGQQVSGTGNPRAQIRFKKAIREGDKRIVTWMMKMNELSEDLEDWASPFAWRSFSLLLPCEEVSSTMTAHGLSTWYGQNLKLWQSVIKSMLFTIILNYILHE

SEQ ID NO: 932182 - protein, 124 aa, Homo sapiens
MSIFVKAIQQVCRKFQTFPYFPVFFWALQTVPTSSCYPVTKLLPHFQNVSGNVIWELWPGMWTPQFCRMLHPTVAKQGDGTEWKEKQAKDGTVDNSHMCVAGRKCGRENIKLTNGGSSKELRES

SEQ ID NO: 932183 - protein, 148 aa, Homo sapiens
MNLLLIDVVLCFDSQFLLLSRWFSHIWNPWSIIFYTGTEYINSLLVSEVSDEKSTVNLIVDNLFVAGSKKEVELKECHSFSKTNKKREKNQIDAIKNDKGDITTDPTEIETTIREYYKHIYANKIENLEEMDKLLDTYHPPKTKPGRS

SEQ ID NO: 932184 - protein, 153 aa, Homo sapiens
MLSGGQGLEPNTLRIYVVFYSVVVVLATITRQSPPCSFLPLPLAKDSLPMATTSAGLKRVLLPMLIEGSRVFQSACGGCCQTWDSPFREVGSPLIQGKYRNDVQEARPGIRVQGLFSQQVLTLAKTESFPSIQQVLFWPSICQEMSSGSFDLG

SEQ ID NO: 932185 - protein, 193 aa, Homo sapiens
MSNGQQGRIEEKDGGSGNEETLCDLQAQECPDQARSCALSGSEDGQLAHYESQEGLRGLVLRLFWDSLFTNRMFVAFVFWASFAYSSFVISFIHLPEIVNLYNLLEQTKVFPLTSIIAIVHIVGKVILGVIADLPCIMTEDLVGIEHLANAYGIIICANGISALLGPPFAGNAGQKRVTYQMHTTQLVGRLDR

SEQ ID NO: 932186 - protein, 141 aa, Homo sapiens
MGRNQSRKAENSKNQSTSSPPKECSSLPATEQRWMENDFDKLTEVGFRQLVITNFSELKEDVRTHCKEAKNLEKRLDKWLTRINSVEKTLNDLMELKAMARELRDACTSFSSRFNQLEERVSVIEDQMKEMKMLSWKTSQT

SEQ ID NO: 932187 - protein, 256 aa, Homo sapiens
MVLDHKDALFYIPLPSDSQFLFAFEDPTDHTSQLTWMVLPQGFRDSPHLFGQALAQDLGHFSSPGTLVLPYSEIARPLYTLINETQKANIHLVEWEPEAKTAFKTLKQALVQGPALSLLTGQKFSLYITERTGIALGVLTQTRGTTPQPVAYLSKEIDVVAKGWPHCLWVVVAVAILVSEAIKIIQGKDLTVWTTHDVNGILGAKGSLWLSDNCLLRYRHYSLTDWCFKYVRVLPSTLPLFSQRMGNQSSMTAKKL

SEQ ID NO: 932188 - protein, 152 aa, Homo sapiens
MIEAGTTWREAGLFGNISSSGKILFCLIPFSTLMTKVQQGLSLPLFGNKKAAPPDDRVLPRFLQVIWFGYVPIQNLILNCNPHYPPRVPPVGEHLSIKFKVLNNDNSPLRGLRIQKIRAEPKEWLYKSFSKSNSYPLNPTKSIVILTDIKYE

SEQ ID NO: 932189 - protein, 196 aa, Homo sapiens
MFCGLEISSARYPKSSLSNSKSHKSLGQGSSKLSHIFLSSSEPSKLFQPLPITQYQSHFHIFRYLYSNVPLCWYQFTVLVRFCAADKDISKTEKKKRFNWIYSSTWLGRPQNHDERQTALFTWRWQEKMRKMQKWKPLIIPSDLMKLIHYHEDSMGETAPMIQIISHRSLRQYMEIMGVQAKVLVSQERMMYTIIY

SEQ ID NO: 932190 - protein, 143 aa, Homo sapiens
MARFQSSVQSSGYFIHFLSNTSSVKEEDKLASKVELTLSASYDRFYSLKSLLEPSLFIPVSKIAALAFYELISSVPEIIFHSMFHNCQKLKPSLFRGEMPASLLGLDSSRLSGERKGYFKYLDTSSILVFPKKIKHFFKTAVA

SEQ ID NO: 932191 - protein, 144 aa, Homo sapiens
MTPVPKLQDAPNDAKWNGVELPLLSPSIYVCMAIGTFNIKLHHAKGAAASSSITAVFVLAQCEARLGEEKAGKAQEAAKRIKRDAVQSPALCFYLLLLNVTVGQEFDKKQIPRSIPVTPQDHQGKNKNIQGLTLTRATCQAYHM

SEQ ID NO: 932192 - protein, 289 aa, Homo sapiens
MFVLIKQGPKMFGGSDNSGAKYWAPVGQLKATSAATGLKTRVSGFLGKDSLTTPDSSELGALVFENASVRANKSDFPRSSLWSKRKIKVFAAVSVNATIPISRVQGPFRVLGQEEFLLLHQKETSKEISKGPQKPLGYWLCPLQAVGGGEFGPTWVHVPFSLSDLKQIKAYLGKFSDDPDRYVDVLQGLGHTFDLTWREVMLLLDQTLAFHEKNAALVAAREFGDTWYLSQVNDRMTAEERDKFPSGQQAIPSMDPHWDLDSDHGDWSRKHLLTCVLEGLGRIRKKPMS

SEQ ID NO: 932193 - protein, 161 aa, Homo sapiens
MIEDDPGQHTFKRGGEVMGESLWDIDKDIAKDAREGSQPESPLLNRESTKGMSSFTEGWIDYKGDAGLSGRAWQKPKPICKGSSDARDCLTSSPSQIDDEVLGQFAMCRWLVEGVLGGRASDLQESPRVVFWLPIGLYSLVTLVHKVTATPACCSLWLESI

SEQ ID NO: 932194 - protein, 165 aa, Homo sapiens
MRPVRLSKYFVLRILPYTTSHTSSHGGEDREAQSGAITCTSPTGKWCRAGTNAGFLESSPHCIMGSAPGRGADGYGIAQEQRPHWSVALSQQQSDPHLEKQPTQRPLAPWVSPTHCSPASISHLCSCLWVQEGKTSNLDSILLNKMFKRKQNNQPSGCSKRDIRT

SEQ ID NO: 932195 - protein, 368 aa, Homo sapiens
MEENPRCWLVVASFYSLVVPSHVPFLSYRSAPLSILPAIGYFWNPADWCVLQSADWCILQSADWCILQSSCKTGKFLKSPLDPGSSAGLTSQDLLNDFDQNADSDMDNKVQTEMVSDGDEKLFGNWSTGHSCYAKRLAAFCLCPRDLWNLELERDDLGYLAEGISKQQSVQEEAEHKSLENLQPDDVIEKKNPSSGEKFKPAAEICISNEEQNINHQDNGENDLVSCVPAASAVAEGPKGQLRPRLQRVQAPNLGSFHMVLVLQVHRREELRCGNLSLDFRGCMETPGFPGRSLLQGWSPHGEPMLGQKGNTGSEPPHRVPTGASPSGAVRRRPLSSRTQNGRCTDSLHHVPRKAADTQCYLTGICCF

SEQ ID NO: 932196 - protein, 139 aa, Homo sapiens
MKIPRSWTTSSRSEPFQGFSLQSVANVPRAPRQITGVNPRVQKLKNLKSDIRGQEASSTGERWRPEDLAKNEGDFKELTHMNVGGVWQVQNLQDRSAGWRPKKELMLQSKSESSLLASSLHLSLSLSPPPQISRYHGVK

SEQ ID NO: 932197 - protein, 179 aa, Homo sapiens
MSLGSHGSSPLPSEGLRVLLGLLICSCRAPSSQMIARKKGTCFDPEGGTFIQLALAEPKLLQHECSLKQESIHKKVLCHANFKFRIHTTKTEQRRITCYEIALVLFEAGKFIEVLVPDQASPFTQFAFHAHRKLILSISLFRMIFKLHRTCSKAERKHGDHILEMVSITLHSEIIMKSP

SEQ ID NO: 932198 - protein, 253 aa, Homo sapiens
MTDVTLAVPKDALIGWPVSVSLINQSVLAILIYSSQLHEADYYQGVAKAMTSKLFSQIHQSKRSDPRFSATLVMAEQPDIGTWTIRESEPYSTLDCLHVLILMDLHLVHLHITDVPFEIPVLWLKDFVPVPHACVFMKIKSQGHLVQQRTFEPRSSQSSVCLSIKRVSLDNLPATSLVRGVLIAILSGLCLTLDKDGVASPRVCCYKKPFCSCCPEDRDLILSLIASWRDTLQGTSAGYIAEPIKDFLFWMNV

SEQ ID NO: 932199 - protein, 142 aa, Homo sapiens
MFFGPSAAGLLEFAGGSLQTLFSWVSAAVAPEQWILVNRKCCCLIVPLEVLSQRNTRPCEVSVCPYLGGASQLGYLGIRDPLEEAVCPFSDLKLCAGRNTTLFKAVRQGHLSLQRLLLPFVYLCPAPRGGAYRGRQASLSCE

SEQ ID NO: 932200 - protein, 147 aa, Homo sapiens
MTWILWLAAVSVQGCGAGGGRSGRLHAHQHYHITGGAAWGSYDVGPQEVTGLHQTLWALHLLEVCPYHFSNQLSSVCGGWEFPPARITEAYGESELLLACSTHLHCRSPGGPGMSPGAQLSHSGFPTSFTFSLCSVSSLYLLSIPSF

SEQ ID NO: 932201 - protein, 202 aa, Homo sapiens
MSCYRRAVMPFLIRHSDTYSHRSRNPIVNCACEGSRLPEPYENLMPDDMKWNSFIPNYSPTLSMEKSSSMKLVLGARKFGNCYFSHAQAQDIRPSPSEHTGLEHTGLMTMLGNSSKTCLGPRKERGASRSERGNPGGRQTRVLPGSTGHARPFCSHEELLSTKFYKKPRPSLLPGTQFCRYSSSRLSLTLDNFESPESFKGT

SEQ ID NO: 932202 - protein, 172 aa, Homo sapiens
MAERGQHTAQALASEGGGLKAWQLPHGVEPTGAQKSRIEVWKPPPRFQNMYGNAWIPRQKFALGWSCEKRVTILQNGRSTSSLHRAPGKAADTQHRPVKATRRETVPCKVTGVELPKTMGTHLFHQCDLDVRPEVKGDNFGAFKFDCPTGFWAYKSCSAHKSYLWYETQLQL

SEQ ID NO: 932203 - protein, 179 aa, Homo sapiens
MAGAPPPASLLPCSLNSDCYARKVRGSVGVGPSEPGAGYNLLWVLGLADFKNEAADPHGVKPQTFAVSVKALKGGASGVVCSSQWVRGLTDFRSEAADLRSECSAHKGSVVGTFFVWDVSFQYRRCKSSNGSQVYRGWIVTYSLFPQRGLTMDQGIIPLAHLTGFDYLSDDPEEIWPCT

SEQ ID NO: 932204 - protein, 143 aa, Homo sapiens
MCPEFFPSGGFLVSLTSRMKPWTLVAPLLQVCWSLLEVHSRPCLPRYHWQSLQNCKDCCLFLPLEASSQRDTCQMPARALLYEASVSPYWEVSPSQDTWGCHWGMKKKLLGLAQCLRKWPSSFVLETQGAGGAGTSGNLLVCS

SEQ ID NO: 932205 - protein, 269 aa, Homo sapiens
MKDLLASTLSSTMIASFLRVPPPAMLPVQAVELFRSYYLLPIMEEEEIKTHREKPGAVCKEGPPHEDIASAQPSVNAQAMAAASSCQRCSLHPHPFHLGAVRNEAVVISGRKLAQQIKQEVRQEVEEWVASDKDVDDFYVINVGQMCLDQYSTLPAAPWGVWEIIKQTGIPTLGKSVVVAGRSKNVEMPVAMLLHTDGAHEGPRGDATVTISHGYTPKEQLKKHTILADIVISAADIPNLITAHMIKEGAAIINVGINRVQDPVTANPS

SEQ ID NO: 932206 - protein, 204 aa, Homo sapiens
MFVVLHSCQLLQGCSWTRGTTSGFCCGHQCLDKGKVMAPKSLEMPGTAKPQKGYYSCRNPGLGSPDVWAPKRAEALLSFSSPATWGVEDVFQPCLGYSSFCPTIQHVLSSCPVSMENEPVGTGVSSWAPESTGIPGSGAEAGQLQLHPGVQGFCHTNSIGEEAPHQKPTVLVTSSQFSNFQNYNKYISAVYKPPSLIIYYCSLN

SEQ ID NO: 932207 - protein, 159 aa, Homo sapiens
MNAAGGCYSQRINAGTENQILHVLTYKRWVISAFPTEVLGSSHWDCGTVGAAHRGRAETGQGIPSPGKCKGSGDFPFLAMGICHRPYLEKQDTSAQILHFSQGSHSSPAMEQSCKENDELTEVGFRRLVITNFSELKEHVLTHHKEAKNLEKMLRRMAN

SEQ ID NO: 932208 - protein, 418 aa, Homo sapiens
MGRARGKAMQTKAKAAIDNFIKKPEENYNSECRLDLPPMKKNLVGEYTIETQLSGPKKGANSFGTDPISDVVRLRGEDPLDLDTGYHVANVRLGINLIGEFETNMVRKKNIRWYLHEKYNLRKAFRDDFSEWKMKDMPFPLDSINVTEKKSVGEIIARVKATDRDEDSSIIYSFKTQQKMFCLDPFTGTITLLQPLNLDNPSNSKIYSLETEATDNGNNTSSYTFTVFVENVDDPISCDPSFSTGAAIITVIVRVSRINELNPIGSASAFTFSVFENSPVDTLVGKVTFTDADWPFNNMEYTIVGGNLGTPPKFYIEPDTGVIKLLDSLNREIESQYKIAVKVTDLDNDAIPDPLRQRSGTAQVTISVLNDEKYSNTLTTPNAGEYVEQQEPLFIALGMQNNAATLEECSSFLHTLTV

SEQ ID NO: 932209 - protein, 140 aa, Homo sapiens
MTPPTISPGLQKTATTEVLNGDATLTNEFLIDLVSAVSVGPPVEHSLELPRSISGCCTSSEQGSVGMGPAEPSKGISWSAGCEAVGVAQYLRRSVLFLQLPFLLLVQGPGPQCLDSCASGHIYPECYPITQSPDPYSYLP

SEQ ID NO: 932210 - protein, 152 aa, Homo sapiens
MFIGDPSIAAQVSTRAHLTSAAATGYRNPCFGHMAEQESAGTEGSLTLGCCQLCSCQGLLYAGSELTFIPGNSKLHCGPPVKVGVYGDQNHPMVISPVPECIIGIDMLSSWQDPHIGSLTGPPEAMCIQLARPATYLHCPTSGVYQLSSFVS

SEQ ID NO: 932211 - protein, 183 aa, Homo sapiens
MQGWRFLPHPHSTFLSGLCRRQKTNGLWRMTVNYCSFNPVMTPIAAAIRDVVSLFKQINTTPGTWYIAVDVENGFFSNPVHKAHQKQFAFIWQGQQYTFTVLPQNYINYPSLCHNLVHWDLDHLSHPQDIILAHYIMLIGPSEHEVASTLDLLVRHFVCQRVENKSNQTSGPSSSMKFLWVQQ

SEQ ID NO: 932212 - protein, 158 aa, Homo sapiens
MELTSQVSWSHLTSSCFIGIQTKINFIPVASVLLSSLMGRQGPCGPRALAPAGTWGGTGRDLYLPCSIPRRNIFAFKAWPAFSGITHHVCLLNQHWCQRIRQRRAFQEKVKMGGDQPVNDIIICPDAHARNLGIPFGPSFLSHTASNQPQVLLMPTPK

SEQ ID NO: 932213 - protein, 139 aa, Homo sapiens
MGTPLGQNFKRKDQAAIFAVLQPPLVISRQTGPGVDLQQTPTDLQLRGHQYQRPKVDKTTKMGRNQSRKAENSKKQSTSSPKDHSYLPAREQNWTENEFDELTEVGFRRWVITNFSELKECVLTHRKEDKNLKKGKMNG

SEQ ID NO: 932214 - protein, 138 aa, Homo sapiens
MVVSLGIRVITNRKYKEQLAGPSKPLSRGDEIIPLLLVGPIPSFLPLNTVTMATKFQREFWRGRSNNSSEIKGRGPIMGWLHICRVCSHAFDCHNNNDDNDEKDLAGDGNLESISLLVAAEAVGVDEVTQGEYVAIEQ

SEQ ID NO: 932215 - protein, 144 aa, Homo sapiens
MSPAWCWLWDAVLSFMAFIHPTHIFVNSSLMELPQVCPVFPGRTLTCTVNQGPVSSTLFHSIIFMCMGIAGSPYSHPIEENPCDYTGPTWKIQHPLPISKPVDEDLHSVNFPFAMQLCAWLKCGEVLLPKGRRSRMDVRQQFPA

SEQ ID NO: 932216 - protein, 139 aa, Homo sapiens
MQSEKLEGKVLWVLSEEVAICHTKEELSLDTNPAITLNLVFQSPELQSGATIHNANFRKLLCLELQSSPASHPPDEFNSRTCGIERHRRTARPVGLKPHHLPDTEYKLPNKTNKSFPKLYHTSYKLFNPIQKTSIMPVR

SEQ ID NO: 932217 - protein, 143 aa, Homo sapiens
MIPQAEEEREDMEKVKLDNRRILFNLLPAHVAQHFLMSNPRNMDLYYQSYSQVGVMFASIPNFNDFYIELDGNNMGVECLRLLNEIIADFDELMEKDFYKDIEKIKTIGSTYMAAVGLAPTSGTKGKSAQKAPELPPAPALPC

SEQ ID NO: 932218 - protein, 180 aa, Homo sapiens
MLGPPLSCRGRARRHSLVCALLTGKEVQAQRGIRTRFEQPVLFPSAVDSVVRRPCPGEPVQQGSCLSGAVCDASGRSLVLGINVGPVVAGVIGARRPQYDIWGNTVNVASRMDSTGVQGRIQDEALKTKMEIVRGHTALQPPSLGTAGLQRPWREGLVPRHVTAAIHGGSLRDRCTVEWH

SEQ ID NO: 932219 - protein, 133 aa, Homo sapiens
MVSTFSSKFLGTPDQCQHVRNAPSRFCPERAKQESSSVCHIFVESCPFAVNLNSGKVKRLTFHCTANKPKTSEDWLYLQICGGGNGSLWIGTLFCQKANVCQNTDSGKICLGASNTFCVCWFLALGVGEDVSL

SEQ ID NO: 932220 - protein, 155 aa, Homo sapiens
MLHFPPRTQIVPYAAWVALPSPFLLLSKVEGKADKGDFYNHTKKSRPGLPYAPLTAGVLERRQALGELNVAIWLLGPVKEGPAVPTAVREPKELSDAPCSFPIDNFCTGDLPWGQGKGRREQRKEEVTCGMLRKVKTPLNKEEEQTMTYCLLGPV

SEQ ID NO: 932221 - protein, 155 aa, Homo sapiens
MSQTPVPLCPHFKTGAARFPLAPTKPLNSKKAECLTSLREYQASNPNCQTPRLCFHPSPHIEVHSVFYSLCLSWAALPLPNLTTPKSCHGPVCNSQPFITPFSHSSGPTSPVCVSPSDCSLSSRRQVQCSQTCASEQPANMTQTSTARASSMSVP

SEQ ID NO: 932222 - protein, 159 aa, Homo sapiens
MLPGRNLLVKFNLLALKKKRPFRKVHSRAAPQGKEAAHTRQQEEAPVLKFLSSHMRVTGFFCTEIRIRKGKTSQGLTVKASVADHTEGCGFSSDLDWAYLGITTAYDSGQWKATITAMENYNKSIQAGIWVRPFSNEGLGHPTEEEMNAHIILPCKDIY

SEQ ID NO: 932223 - protein, 924 aa, Homo sapiens
MEWFGMEWTQMEWTVTKWNGIGIRTECNGMEWNGLEWNRVEWNGVEWNVIKWNGIKWNGIELNSKEQNGMGCYRKISNGMEWSGMDLNGMDWNGMDSNGMDWNGNGHERNGLGWNLLENNGIEWNAIVWNDIEWNGLEWNGLEWNELEWNGNEWNAMEWNTMEWNWMERNGKEWLKWIRMEWTGVKWIRMEWTGVEWTRMERKRVEWNGMEWNGLKWIRNEKNVMESDGMELNVVESSRTELNGMASNGMETKGMELNGLKYSNVMDCYVIDSNGMESNGMQSNGMECNAMEWNRMECRGREWSGIKWNGMELNGIERNGMESNGMDWNGMDSNGIEWNNMEWYPMEWNGMEWNRMEWNGMEWTQMDGMESNGVKWNGMDLKGIDWNKMKSNVQWNLLEWNRMEWFGMEWTQMEWTVTKWNGIGIRTECNGMEWNGLEWNRVEWNGVEWNGIKWNGIKWNGIEFYIKEQNGMGCYRKISNGIEWSGMDLNGMDWNGMDSNGMDWNGYGMISNGMDSNGMDLSGMNSNGMETNGMQWNGIEWNTMEWNRMERNGKEWLKWIRMEWTGVKWIRMEWTGVEWTRMERKRVEWNGMEWNGLKWIRNEKNVMESDGMELNVVESSRTELNGMASNGMETKGMELNGLKCYGIKGMDSKCSGREWSGIKWNGMEWNGIERNGMESNGMDWNGMDSNGIEWNNMEWYPMEWNGMEWNRMEWNGMESNGVKPSGMESNGMELNGNEKSNGMASSGMDSNGMCSNGIESNGLISNGMEWKGMEWNGIEPNNGKQWNGTHWIRVQWNLLEWNRMEWFGMEWTQMEWTVTKWNGIGIRTECNGMEWNGLEWNRVEWNGVEWNVIKWNGIKWNGIELNSKEQNGMGCYRKISNGMEWSGMDLNGMDWNGMDSNEMDWNGVDSNGMETNGTEWNGLE

SEQ ID NO: 932224 - protein, 140 aa, Homo sapiens
MWLKPEGVPEKCSKDPCGLSDTSAGRGPGHARRIQRALTCLSLATTRLYQPQPLGRESKLGRSSIGKRGIWEDPEEAWKILRKLGRSSGEREEAGKMQKNSGGVGDPHNIIHLLSFLSVPPYGCNDALMDMNETGHSVTY

SEQ ID NO: 932225 - protein, 139 aa, Homo sapiens
MGIIIALISYICLLVEYFIIYIFLNNVRGLTLGDLLMRCTRTSRLQKETQRSISDCQRWDPTGTGTSGALIEKRQPKSERNLYWSASTLILVRLSDIFESKNDPQRPQNKYQQPTHFTLLKKERKEWQRLAKANRLWKA

SEQ ID NO: 932226 - protein, 124 aa, Homo sapiens
MFLTHSWTLQRITCYQELCHPEWPGKLHSLQKSVSSQWPTNTRAEKFGTLASRWELCGSTQAPELPHLSIILHNYSSSVNNSYYSHFQAANVIAAEHKVEKTCMQLAHGSQTSTLNDSFINLWM

SEQ ID NO: 932227 - protein, 165 aa, Homo sapiens
MFVVFLRFAYPFHAYLPFLSLQLGALIFLLGMKATSPVIFFSWRWAEMQENEWECAFNELDEVYLTLSIEGGDLLYSLLIQMLISSRNTITDIPRNLRKEIPIHFESEEEPNRYTFQVLYGYGALSEYLVLDEMTEGVHEFVVEKSKLNAVVQDDKNYGRTCTDF

SEQ ID NO: 932228 - protein, 138 aa, Homo sapiens
MIDRSTLPPPTRSLFHSVCLLEKFLEVDPGVSQEPFTKPFLQQNVAWHGALPPCFLSQSLRASESDMQGDPRGFISTFRAKSQGSMFFPISAHNQGIQAEMETCYVPGTMPGICIKFPGNQITEVRRNHAKQVRYSSV

SEQ ID NO: 932229 - protein, 159 aa, Homo sapiens
MIVNLAYQLWRNDVPFFSLKGGRTWQKQLQFWMTALQGHSAPALTSAAGKTEIQQVASCWLAQRVLLLAPATVQSRQRSLTSLWLSSTGLQCLHSRNPSLATLWPGLVDSEHWTSHVGMTTFQFLCLKKGQTPPDTDPTPPLIIRRCDLSFSRPQFSYL

SEQ ID NO: 932230 - protein, 136 aa, Homo sapiens
MLPGRPVVGARPPQMFLLLLLLAVGSERYIQRVMDPPRSLHFPTCLQGYLESISAEWMHASFWIQNVEPQALLGVQDTCCWQLENHGLKQFESIERELDGAKSKSNYHADQSQESPLTNDVSKWLTTSSLKKEKSS

SEQ ID NO: 932231 - protein, 120 aa, Homo sapiens
MTPCQSIYVNLQSQNSKSIKRKRFSYLPPRALILEAGKSRIKMPADSVSGQGGKGHWYPRAQASVEMGVCLQNMLALLQSSLWGPKLAQFLEETSPGALHGKNGVYPAWEQLPPGSSHSC

SEQ ID NO: 932232 - protein, 172 aa, Homo sapiens
MAFPTSRVPSPVVFMCKNVMACFLRLYRCSPLVLADSHLLPDWARPSQLLLLSPVVPPCFLVCSFTPEASETTNPPRGTNNSRRAALRAVTLTAKVCSFFPEPARPRTHQKEETPNTSEHQKEQTPDTPPLRTVTLTARKKGCYWELGSHPALTLILLQRDHHGLHRPQGQC

SEQ ID NO: 932233 - protein, 157 aa, Homo sapiens
MFQILRISNFAKLLVSRPGVAWQLSGTFRNPGFNVFAPLSLAFIPKVTSWSKMAAGAPVYMSLEGKRKGKVEKVEEGGRVAEKILGHTVLTQYLPTHSHIAGLPIALTPSGHNQEKGISGSIQTKSVLAWLCKLSKILERSIGIHQYKVPQAKPSQG

SEQ ID NO: 932234 - protein, 153 aa, Homo sapiens
MLVQGSPPKTAGSRHRAQEIQVGEKQQEISRRDFSMKNMHVDSLVEASRKYAKCRPKLPGRVSSPRYAFNYLICPWHYEEVTKGRNGTSNSHESTLVHGHWVYNNRDRAEEAEKTKIKSQKAQLLVAALSHLLPRGYSSQGSVARSVSGLPRR

SEQ ID NO: 932235 - protein, 147 aa, Homo sapiens
MGVGGCIKHPRSLNPQYFLWDWALVAHSRNLLMNICLIGFPCFTASSLATENHQHPSPYLKVSFEEPKTIEDNRKVVLDTFGNGGPEINGLLDLCNHNPSFKHLVYSHQFNVTIPYLYSGTLPTLLGLLDKFSAKKISLDRLVVNKV

SEQ ID NO: 932236 - protein, 139 aa, Homo sapiens
MANGVIQGVAFTELHFTDGWCAIYPCPPFCQVVHFLCRVIGLFEKNKTEQKNLRFKQKGPDPVGCGEEWLHAYRPNNWTPKLLTLMTDSPQSQKRDMDGRRKTEGRKASQEAFATVQVKDDNEPQKRSIMWIRKLRLSE

SEQ ID NO: 932237 - protein, 143 aa, Homo sapiens
MQLLFPSPLSSAELAHGPFSLLFLSTPKSQQIHRDSSAATWWKKIYKPKKEMTYRHRQRGTETAGLVPGAFCHFLFYGGKGPYSMASDDVKKSGITAQLDPCHVKDRMNLIQKTAPSGESADGMSVWLQLPLTRSSGEGISFL

SEQ ID NO: 932238 - protein, 165 aa, Homo sapiens [sequence omitted]

SEQ ID NO: 932239 - protein, 161 aa, Homo sapiens
MCPVRASRLSGIWLRGLNNEVAELKPFGQEALVGWTGCFKTCANELEGRRGQCGGRRTAFTGWGSIKRKHASMLYDFQSTMEMRVFKDFRLEAICGKAVWSRSQRCASHFGECCVLLDLPEIGCGSEVGDWLDFFSGHNPADQNRICFGQDKVKKLAETSR

SEQ ID NO: 932240 - protein, 145 aa, Homo sapiens
MRELPPGNDKHHFRYCFMVQSKSYLTSKSKEGRHAPQSIPGGWSDSDGELTTSPDSSIVRLHTELTASSYPVAVSVNTVPSAPGTSCRLKEILSMLNSSCVYVALVAPMGFWALAQGFSMLTTSVGHPLPKGFSGLSRLGTCQLL

SEQ ID NO: 932241 - protein, 165 aa, Homo sapiens
MRAVWDWLYDDGDILPLNMPITQVMKASQLVIRHGSYRCHSLLGTRKGSPEGCVMGHGYSYLAQNKSLQIFTEFNSFHGHGGAPVGDTASHPPDLLNQNLHFKKIPRQFAGMCTFMLTKRVQLCQIFEEIYSESNMSDQWPVTRPQETLRTCAQGDQAIAWLYTA

SEQ ID NO: 932242 - protein, 164 aa, Homo sapiens
MWSLGKMEEQKNTERKIYKIQKEPPLLEKKSPPTPPPAPTPQPLPPAPPPQPALPSPPPLVAPTSSSPPPPPLPPPPAMPSPPLPPPPAAAPPAAPPGEPAPHPPRTLSCRTPGLCTWPRSRRRRPCVERRTRRLTRDEFVIRAEDILSLKVCILKEWPRQGDV

SEQ ID NO: 932243 - protein, 137 aa, Homo sapiens
MSHELGWIFIFDEKEPKRYLMWDKEKGALTLTMALAPATFLRVNCWAGDHVWFFQDCQVYELGTLHAGSEPGGALPCSQAPLLQGCCSLLVVHSSSYLPGSLPSLELSPVEAADQQRCQAAPSSESSVLEGHWPDAS

SEQ ID NO: 932244 - protein, 128 aa, Homo sapiens
MEVKSRTAVTTDTQCRHLQSIGKRLAFCQNLTQIHTESTMKPWILLLVMFISGVVMLLPVLGSFWNKDPFLDMIRETEQCWVQPPYKYCEKRCTKIMTCVRPNHTCCWTYCGNICLDNEEPLKSMLNP

SEQ ID NO: 932245 - protein, 248 aa, Homo sapiens
MPVTKLGRLVKDMKIKSLEEIYLFSLPIKESEIIDFFLGTSLKDEVLKIMPVQKQTRAGQRTRFKVFVAIGDYNGHVGLGVKCSKEVATAIRGAIILAKLSIVPVCRGYWGNKIGKPHTVPCKVTGRCSSVLVRLIPAPRGTGIVSAPVPKKLLMMAGIDDCYTSARGCTATLGNFAKATFDAISKTYSYLPPDLWKETVFTKSLYEEFTDHLIKTHTRVSAQRTQAPADPTMMQHIQIHKCDNTTLI

SEQ ID NO: 932246 - protein, 222 aa, Homo sapiens
MLSNYLLSHLQLFRLTLFSFEQVLLFCLIIKVMLMHHTPHPSNKQDQGKPRDILENCVRIEVGCEWGEQVQEVAAEGAARIPGSLAGKSLKSNGSRGGIFSKCEDHGPLWGHGVGFEGSCACDVCMHVCTCGNVSVPVHFLFGVHKGSDTLGGSSLSTAGDLCVAVVCVFFISISIMFSTCRDMLCVYRCEHVCIVPTGANMSVGTTCACIMCWHAHAHAGT

SEQ ID NO: 932247 - protein, 179 aa, Homo sapiens
MRIKGNEECEEAGKDVKHTQLHLLHYDDGLLSVAVCGDLEHIAAAAALVLKVSSAFTRPTAVPMGADSWMLNWYISVGDTAMSRDEGSPFPSLCQQWGRGQGGPVSLNVTSSREPSQTSRLCSCAPLAPKLIPLLELLRFYSHFLFILSLGYELLEERDHISYSSGIPSAWQNARLSHK

SEQ ID NO: 932248 - protein, 152 aa, Homo sapiens
MVTLAPPERPQNRKRVGAQSGDGDREGLYSMASRRSPEGLLSQLPWGTSVMQVMASDADDPTYGSSARLVYSVLDGEHHFTVDPKTGEGQGGARGGAVGRGQGRGGTRTTPDVCSEPSVPEALRTAQGAPCAQQESPGSRRGRGSQAGRWTD

SEQ ID NO: 932249 - protein, 200 aa, Homo sapiens
MDFPLLEAAWEIWALEDKDLGVSDCKKTDVLLPPGPLCDPATEGFLPGPAGILLQYHCLGSAPTIHSDSDEGDGAIKYTISGEGAGTIFLIDELTGDIHAMERLDREQKTFYTLRAQARDRATNRLLEPESEFIIKVQDINDSEPRFLHGPYIGSVAELSPTGGLWALGVGDGIKVIPKWSLLGRGVADPLGRDRKDRAC

SEQ ID NO: 932250 - protein, 136 aa, Homo sapiens
MRNEEEKGFQEEVLSLAKSIQPQGLYPGCSLHLAALALATPTLQSENKSLSQGPLPKSPRLVRAPCQMLSLYLSFIVIIACFNEVRSGFPAADSLNDYGEVSVTAGLSFLICKMRVISCNYGNDSNIQLPWRAGIA

SEQ ID NO: 932251 - protein, 292 aa, Homo sapiens
MYTGEKPDECKENEKALKKLYHTQNERTHAGEKVYDCKKCGKFFHEKACLTQHQRTHTTGKPSKCNDSERVLKESCLTPNQRIKTRLKQERKTVKEVTTYTKPESSQKKRKPMTAINVEKASVRKQISDSIRAHTHGRKPYECNECEKSFFVKSNYAEHQRTHTGEKPYECNERGKSFCQKSALTVHRRTHMGEKLYKCNECEKTFCNSGEKSYRCPECGKTFYEKSALTKHERIHTGEKPYECNECRKTFSQRSALTKHQRKTHKKKTIINTLHVQKPASSRQICQTSAKS

SEQ ID NO: 932252 - protein, 149 aa, Homo sapiens
MCGICMEVVCEKASPSERGFGILSSCSHAYCLKYIHKWKGTKLFESKIIVSYPECRITSNFVIPSEYQAGERREAETHPESQGGNEQPGLIEERENNDPFDNNEEEVVTFELGEMLLMLLADGDDELTDFENEWDLFHDDLEDFYDLAQ

SEQ ID NO: 932253 - protein, 199 aa, Homo sapiens
MLFCNVILTLPLLVKRLIPRQLLQLQRQVPVLNHAQDRMKGQEVDARKSTFHVYLIVSAIGSEEPAGAGDKQEPCPLQVGAGAPQAQLQPPNLPLQTQAFCSMGRDIHAVLGVAAAIQTMTEDSGIHAFLGACHLDLRAKSAWYHEDSRKQMDSWEEEDRSLVMLHLQARQGLESGGQAASPVDQSGDLWCLFWPWHGH

SEQ ID NO: 932254 - protein, 525 aa, Homo sapiens
MGRPGGWRAKKVLQLEPEGYLLQSVLLLRKASCGQLLTQLLLCASLAAAAAGLVYHWLASLLLYPPGPSAMVATVCGLLVFLSLGLVPPVRCLFALSVPTLGMEQGRRLLLSYSTATLAIAVVPNVLANVGAAGQVLRCVTEGSLESLLNTTHQLHAASRALGPTGQAGSRGLTFEAQDNGSAFYLHMLRVTQQVLEDFSGLESLARAAALGTQRVVTGLFMLGLLVESAWYLHCYLTDLRFDNIYATQQLTQRLAQAQATHLLAPPPTWLLQAAQLRLSQEELLSCLLRLGLLALLLVATAVAVATDHVAFLLAQATVDWAQKLPTVPITLTVKYDVAYTVLGFIPFLFNQLAPESPFLSVHSSYQWELRLTSARCPLLPARRPRAAAPLAAGALQLLAGSTVLLEAYARRLRHAIAASFFTAQEARRVRHLHARLQRRHDRHQGQQLPLGDPSCVPTPRPACKPPAWIDYRLDALRTESSEGEGKELWSCRDLSCNLGPVPPPCVTLEETAGPRNVFCQQPSK

SEQ ID NO: 932255 - protein, 240 aa, Homo sapiens
MRTQVRVQQGLPGPVLRLSQLSPLRTCKEALGFKVLFAGSMKADMSSDLTSHSLSNPEMGGVPEEQIRKSYQLRGEWKWMASKQQMPASVTPPLTESLWDSLKCMSDTVRKRQENEKKTWMFSIFELMQAGDNSCQSCKAEHPEKWNRRIQAPVEGINESRGVWMGLFLSSVWLKLQTPGVTQWHLQRYAGEKAVPTLHRTPSQRDVGKPPKELALCLLDRLVPNPCLEMEPKGAGEEKK

SEQ ID NO: 932256 - protein, 239 aa, Homo sapiens
MAMSLAAALSWGSKVLTGFSSCCTEKRLPRQGQNQETNEKVTAVVQLGFEDCGPPRHFLEFRYGTLSAAIPAGTIAHALTSSPIYERKLAFHQTRRSALSCLSQSCRCKQQEAEGQETRILDLSPPHIVAQGKSQFLMGPGCSDLPNECDGTGTWNLAWLKKFGQVSIPSAISINGFPSPISINPKVFAMTSRAPNKPKRFCPLTLLSHPRSIHPTPVTSQTTFPNTRTVEGAAVGIGY

SEQ ID NO: 932257 - protein, 237 aa, Homo sapiens
MCTCVFATVRVCVHVCVSTCQRELHKLTRQSVSLALVTGSGESYGFSQANQANSGETMAFAFHTSKELPMATCFSSFSSGSDVTTSEKALLTTLSKMHFAPQTSKFSLYSFPPWHQHYLIIFLSVASGVLVDDLSTPTGGKRLYIRQATAASELYHSGTAQPLALRGQVVKAASLGAHGPCHPFFCSVGATCNLLLGVGTDQRWSMSCNAWTVSTLTNCFIQTANDSPIEKPIGGYS

SEQ ID NO: 932258 - protein, 118 aa, Homo sapiens
MYLSSFDNNQQNDPKQNLKVLSHTADSLWCSPQSCLPWSKTHFPHSSLPSKCPLKPEKHINFENYEPHNISNVCIFIVGYVYTYPTNTHVNSTNHAFFLNIFLSHLQRSPLQKKHSIF

SEQ ID NO: 932259 - protein, 116 aa, Homo sapiens
MQDRVYWQVTSVNGRNRDDDDFGHPVRSGFKHWGYNKILWSFQAGIAGHMNKFTGKITATGNSGKWFHSILYRTCASHSIFQHLLTLNGSPALPWPPVLVMSSPFPTQQLEGSFSC

SEQ ID NO: 932260 - protein, 301 aa, Homo sapiens
MKKKNWGELRKRLFSDHEQWSWVAGTKVGVLPLGQAPASQGLKGQEEEEACPRSPFVAALKCTFLAQAKGCAIVMMREPENTHWCACNTAHRPETVLSSQNLTAIPEVSFHQTCSLWSGQALSLLHDQHSHYQNILVFCSKTYSNMLVLDGIVLGIGRDEFSCQEMVAILPLCSHPKPRKVLIIVGRDGCLAQDHMGPAESLFKEAYCQQMKVKVALAEDSILCCQGEHQWLHLHLIRRCGSSASSRGGLHLLHGPHLPLQPDWLHAVRQNMITRDRELVQHLTQQQLWVTSGEPPIAPNR

SEQ ID NO: 932261 - protein, 260 aa, Homo sapiens
MPISTQATTFLCLCVFICKMGTEEGPARAKTLRFREAWSVQDQRRGQCGHDRVDTGFSPKNKMVSLTLLSDTRFPQQSSRPACKVLTTLLEFLRGEHEPLRFICAYRGHINYFMKCTPCGSAGRVLSSPAGCICGRPTARLMCAALGVVCSAISYYLGRGCIPHRWGERELMGHSLRYLLCPGGPSAHPPWLQDGAGPPTALTMGCGGQVPAECTCHDAECECLLNVTCHDAECECLLNAPAMMLSECECLLNVTCHDAI

SEQ ID NO: 932262 - protein, 136 aa, Homo sapiens
MPQVSSHPELGLPDPDGPESPDQTPEGQPNMLGMTIGAKRALGSWGRAVTSNVPLPGSSSFLRDPNLPAGHRSSHKACARCQREKQHWPEPLSQSVRAQLGTGNMDPVTVVLMVDCGPGWHRQLITVSPVAALWKV

SEQ ID NO: 932263 - protein, 140 aa, Homo sapiens
MQHCRGCLLSTCYLPGTVLDVGDLATNRIPAFMEHTFNRVKVFRHVQAPPLPGQAHVTYENNGTSQRKFQSMRMDSMQCGEQKDLDQTPGVLVTVRLLKGPKLSQKELPRNNGAESVRKDCLMASNRTQLGLYSQRRIDR

SEQ ID NO: 932264 - protein, 150 aa, Homo sapiens
MCTVFDIESGTGTDQLRAQALCRHGSSKPALLTPSVKSQPGRPMYLCQCLKCQYHKASRRGDPVELSKDDIKQATKLVCQGAGGFVCFLLRMAAQLTPHSISMLHLLALERVPWEPRTLASSTVGEPHADSSLLWINPDCLLYLEPPPRT

SEQ ID NO: 932265 - protein, 236 aa, Homo sapiens
MNVTQTEGKSPLYKEIDNNDAADGRGGDGDDEVDAAADGGGDNKVEGDIDDGGCVGSDGEGDGDIDGDCGNDESEGDMMVICGGGDDEGGIDGGCGGGDDESDGDMVDGGCGDDEGDGDIDDGYGGGDDESDCEMVVVVMKVMVMMKVMVILMVVVVLVVMMKVIVILMMMVVVMKVMVILMVVVVVVMMKVMVILMVVVVVVMKVMVILRMVVVEEVIGTWGQTSPFGVFVIELL

SEQ ID NO: 932266 - protein, 130 aa, Homo sapiens
MGKMTGMSLNLDNSQDSGVCMEIGKSGETLYRGWERKGGLDVAYKRKEEEKDGAQGLVLSTWKNGLAWAEMGKAAEEAGKLVNNRNFFLTILEAGKSKIKVSSDSVDDGGLLPGSVSTLSLYPRLVEGGE

SEQ ID NO: 932267 - protein, 142 aa, Homo sapiens
MQGNGNLSRHAEELCSDKLLLSYNHDKCFYETEEGDTDTEGKTCENEGWDSTEATTSREHLGLPKAERGWPCDFLRIVPGNTLKTPGLRDTDLSRRKHDPGGANDSVPPSQPHHPRKTRQMDCWVQRNQGLEWGPDYLSMEH

SEQ ID NO: 932268 - protein, 155 aa, Homo sapiens
MRCLSILLLMAAGVISRAQGLFPMPLRWTTWTLDNAKLSKGLASVSMAPSIMRGSSVFLLALGTVGTSHSCLVACPWPEAGPLSEEASAQQEPPKQSGDHSHLDMTPICPAGNDSRWQRETDPGAHVPAAPLGSSVISGDVSSLLSLILLDIECG

SEQ ID NO: 932269 - protein, 248 aa, Homo sapiens
MLDKKGLNQDCKDKLRAKMVISGKHYLQDLIKTIWQSRDSENQNKAGLGEYLVGGISPALEIVQVWKSKCRREWETIQNAPSYWTLIGSGRDIVSCGHYDKLPQTVQPTTKKFTSHSPKNPQGLFMADKAEVKFLLMAHKGLQDLPRHTGLGQLIFGPRTFAPAFLLGFLFSETSTGLISFKDKIQVCELAYSESPEKEKGDPTGRPRGKYPIGCIWEVWSLGAIRTVSWWHFGEGTGPTTSPSCERT

SEQ ID NO: 932270 - protein, 116 aa, Homo sapiens
MAGMDFLEIHCEQVVFAVGQVGEADGAEQTGRCRGREVSGLRCCLEDRQGLLMDLRWAVTMTISEFSPRSFYNYSQQKVEEKKFTLFFKDLNNTKRFIPHPPLTQASIMLRFFCIL

SEQ ID NO: 932271 - protein, 161 aa, Homo sapiens
MCLPPQGISGGQVGNWGSTQPGNNEALLLNPHPQCAVQPKSWESSLIYACCPLTTAVQSIHKCSQPDLCEDLLRGSGHDSDSQRPFSGMQVTHNRRHVSAPGAAGRRGSADLSWGPLGLLGSIGGLCFLLRGTGAGPRDQVPVHPAELSSASGRRLLRVLL

SEQ ID NO: 932272 - protein, 127 aa, Homo sapiens
MQTHEEGAIYESESRPSPDTKSDTALILAFSASRTVGNEFLLCIRREEYFSGLQKPREENSFYDLKGDEKHILAGHCKCVPCSSQKHLQYLHYLERCRRQNNECRICERFILIFKNATKLEKVLQGI

SEQ ID NO: 932273 - protein, 173 aa, Homo sapiens
MVFATEGRICRPREDKFSSPTASSWFEDRFSSPTASSWFEKSGQRIDSAWTGLDSRIQQIFAPSTCQALYFIKTPKGFWRRNNMNYNTPWLQAAPWEMEGPEAAKEEDDAEASKRCMVLQVEDWRHPALELGAKPWAESFPGQFELRDPGEVPPTSQTRFPALGEEATAASDP

SEQ ID NO: 932274 - protein, 119 aa, Homo sapiens
MPRKGYRNHGLAEMLKEQTNSLSWCCSGNKNYIDFVKAKPLISARLWVTAPRGLLGPHSPRFSETLDAASFEVLLLLSELLSVYPAHPGSGIGAQNIPGHTVRSGPGSPGPLPDLTVPS

SEQ ID NO: 932275 - protein, 132 aa, Homo sapiens
MRVTTPVQVSWNCSQMKAHPLGLTGESVVQWWSADSRHKCPGLNSGFASLLAMSLWQVKGPVYYLISRCPLGESLTEVQEGTQKRGQSVQGLMVYYYWEAENKTKMKGCKKQNTMDIGKSTDTESRFVVVRH

SEQ ID NO: 932276 - protein, 151 aa, Homo sapiens
MALWGWRPVFPWTQNHARDGEDEQGFYTRRQKGTSAKENENTRPGEAAGMRAVVVLRGRFERVRPLGSWSQAWEKLLHVRPGAVALATSTPPGNPPPRGLSLPRPGPGGAHGSRDLPNNPCRWLHKPQPVLQPGMPFPPGCLLLSLLSLDN

SEQ ID NO: 932277 - protein, 135 aa, Homo sapiens
MGTRRCWVPFSGRRPYLRSRLLGREWCQTQTRSCRQGTDFLVSENQSGSVAESVGRQGKVGEGLQTACRGHLGQAAGRRAQLAGTGPGSPYPQLADAQGCGSGDMDVNNTGQNLCHGGADTCLGRQPSDNGCGTG

SEQ ID NO: 932278 - protein, 145 aa, Homo sapiens
MASDRVQLTQDQIAARWMGPDGPVILTKGFYKTSVAPYWLKSRPFTLGRARGGLDFSPTRDWALHFVPLWNAGCCRGPPLMALCVFPSLSIHIRISVPGRQGLSQASECKQHGNSKSVTLCLGVLEVIDIRSITSFSDRQVILLA

SEQ ID NO: 932279 - protein, 150 aa, Homo sapiens
MEPGLPGRRGNFPGTSSPQFQLTVALLDPGPRIARSDLGTQCPRLTRRRETGSLVGVARRRSSPKPMQVKVSGPRPPVLAVCYWCHVLPSVKSSHTPQTWLPETKAGGCLQGRRPEKHSQVHLQPEDCSSAAPNALYRHRLTLPLFLTVV

SEQ ID NO: 932280 - protein, 139 aa, Homo sapiens
MSIAKDSSQASPSQGKTLLTPFFPAQDLVSSHSSRAHPLLDKGLAESDAGRCSSVVIPLSGVLQLKRDTPPISWDDKHLLLNVLVFSLDIASLLTLPGPCASQGRCPDAGSLGVSDPATVGDMKYWLWFNPFSFYPGGK

SEQ ID NO: 932281 - protein, 134 aa, Homo sapiens
MGVTREYVRGADCPLESSIDLCSFIPSMALKALTTIVNHTLLVISKKVIIKVFKHLKGRVVDHPKVHPSCFVNPSSESAILPAAVAHRVVIKFDESTIGLDVAKHPTVHKTVLHAKNYPTPNPNVNSAERESLL

SEQ ID NO: 932282 - protein, 148 aa, Homo sapiens
MEPGPGRGLWLLSLRAPVAWTAPAPFRTHTGLLHSPAFRVVMAAPSLPATSAGPLFPRIYWLLKDASKHPMMYRTVPHNQESPGPKMSMVPRLKDPVLELAQVIETSKYLDLEDVTGASSFFLNPREAIWVLHCGWENGTYVYTWKMK

SEQ ID NO: 932283 - protein, 134 aa, Homo sapiens
MWPSLRWVPIVKLVSAQPAECKCKSTTPGAASFAVIDSCLTVSSKNVVFEASPSMLGFLGPGGSGIPGSHFDLCIPNTNAGHFSLGDTLIKRGSPGAHGACILLGETGENQARDTLVPGVETPKTLFLLWKDTN

SEQ ID NO: 932284 - protein, 233 aa, Homo sapiens
MAEGEGEAGTSYMAGAGGRENGGRCYTLLKQAGLSHLLRTQWLVSCDGWKLEACKYQPGFSDESPPAAFSRTSAPPPVPLSPHRREFPGNLLLGAVLGNDGKIPLKGHILKVWLVDLPELYRCQKSIPCYNEVTSCPTLPGTADPQSMKLTILKSGKFQAVEDGLVTFAFQKAGWSLSLGPGTHTAPVVEGPSSELLKEDDGSQRHLILTHVFSAFWNLRNLIYQPPTWALDL

SEQ ID NO: 932285 - protein, 171 aa, Homo sapiens
MIISPYPKQSCLFMSLVVYWLSSSLKIICGFQGIRPLTLNCQIDCHNGYFMKYLTITADNSQGNQKQEKSEKQSQPGGAYGDMMTQCNVGTRMGAWNRKKISPGLQGQMGPQVHQEKGEDAHLHKEEVGGAEHDCQEESSCQGGLSPLPCRLPKIKASQKKKNAFLIPSEV

SEQ ID NO: 932286 - protein, 180 aa, Homo sapiens
MEVKWTSGYRWGAGDSFRKSRCRSGTSSSHFKNIIHQQCLEHYPESPPGQCSQVLISAKNIHLANVHASASLPECTVLPSCFQSLLKYFPTPSLTLSNLVVFILQTNRSFENVNVIDTVTFLPLKLLPSLAVLLWFSGCVSGCWDKVPQTGWLKITEMYCLRASEARSAKTKVLAWHCSH

SEQ ID NO: 932287 - protein, 145 aa, Homo sapiens
MHAVCHPCLCLLLILFFHLPSHLGAPVHVLSSTLLLCTTLPCPCQEPQVIYESSLSCRPQPICSSCIIFPQKLLSTPQPPPSYQPLPQPWPRKLKPGPLYPSIHPSVHPLITHPSINRLALSTHWVPAEHTGPKGRSSESRGVTE

SEQ ID NO: 932288 - protein, 163 aa, Homo sapiens
MLCLLSLSICRKSGKGTLGFTCFHSQPTHTPSLARDLSHIEPTMVLKRALHRPPSCQSPWSLFPPHFSWPIGVLIGVPILAWEATVSSFRTLGAPGFSPTHWAVSLFHPPLNTDASQSSVLHRFLPCPFPKGSFLHPQDICGHPLSFLDIELSPELGLAHPCT

SEQ ID NO: 932289 - protein, 135 aa, Homo sapiens
MGPGVCLSLQRYILGEPDTGDTAEDARSPGPHKALKLAEETDKKNQVVMRVRANMQDEGDRLEDDLSLRLQWVREGAKPFRRDIQGRPLGKGSFLSEISMTRGPDLMRTYENSTEGDGAKPFMRNRPMSPMPRAQ

SEQ ID NO: 932290 - protein, 136 aa, Homo sapiens
MADLADMLLDAFSENSVYTHAGSRGWGRQNYQGLRRQQDQEGSSLAGDHGCRGAMVMVIMVGAGIQGSAWLSSCPHLQYSSYHSLFASAMPYWLQSYHVVPVHASESLHLLFPLFAKPATAFLCFVNSYAWAVACF

SEQ ID NO: 932291 - protein, 126 aa, Homo sapiens
MGCHFHDWVAKDCDFRLASRLSLWPSQLAHFDERLPLLRRGRKEEEEGDKKKMFVKQPPKVKRKNFMSKGQVVGGHTWVKGRANPSIRKDAVCGYNTHYLHDSCTKSPDSTITLYNQVLHLDCLNV

SEQ ID NO: 932292 - protein, 157 aa, Homo sapiens
MPEVSSKLGCFSYKRGNGRCTSPEVRKGNVKTRRQADTEESSRRSPKDELRLDLRQDLVSPELNVGHRWESLEALQELLMSCRGTEPSAEKCDSEASVIPKYSLPSAHCEDPLPQGFQEHRLQRASHTFTEMNHRKPCLGTQTSNFKIGKDKCISAC

SEQ ID NO: 932293 - protein, 136 aa, Homo sapiens
MLERAFFFFAGQKFDRLCNLFNSSKDEIHRKVLPGLVQPLNSVFETQVLSDFLLCQTQSNRLLFMPHLSELDLTTPIRKPVPAKGSRIAVIGLGQESTNFFWKDPDSKYFRLCGPNGLCFTLQFCHCSVKAVKGKV

SEQ ID NO: 932294 - protein, 166 aa, Homo sapiens
MHVYHQDVGTECELDLHLIVKVRWHFKPKRELADQIPVLSGARKMVYMGKRASWVLDIVTGNVSLETEDVTRKKGQRCTREVQGIWKEERLCQVKTSPQTSLGETHAYLPHPDQGADDDGDGEWKISSSPHLPKLEQLLLGGHQMVGPCFLYCSESQQKTEFHSDV

SEQ ID NO: 932295 - protein, 158 aa, Homo sapiens
MKRVLKYTSLVPHILNFNTLFRLPITCLHVADALGSPSADAKLVPFSHPPPPLPCFLQTRHFFLSCLCLHYQQASRDYKANTDRHHAEAKENLLQAVLACAQNQLLFGFLLLASPSFLQSLTKFVHFTPSLSPGVSFLQPTDSAHQKRCTACCSPVFS

SEQ ID NO: 932296 - protein, 155 aa, Homo sapiens
MWGSLECPCKSLSSTNSALTMSTSEDFSPMLKSAQGCSYPAHAVKAGLSVKKCTELPKPAEQRPTSGIQTAGNVGSKKAIRLLFTADKGDLRRVWLLDAFSPSQTLSKNWDLEDFVQSNQISFATDGILAILAKGWLSYLSAKSIFQSGLLGKLA

SEQ ID NO: 932297 - protein, 159 aa, Homo sapiens
MLLARWFLSLASPSMLVCFHTAVKDIPETGQFTKEKGLIGLTVPHGWGGLTIMAEGKEEQVTSYMDGSRQREACAEKFPFLKPSELHAEKLGDMTKEPTNHNRWYWLSEGSNLETNLCTNVVKGGKLSLLGTIDQNVRCPDQTLPLRMSVREFLHEISL

SEQ ID NO: 932298 - protein, 152 aa, Homo sapiens
MHSYTSQLNIDEEGAWFPFTFRHGCCLQAEEQGSQSKSQNLVSREADSVAFSLWPKIREPLANRWYSKSFLRPHQKPSDAVAMLVVCRTITQINPVFINYPASGKKHMTQSWTIHSMVNDQPGTPVKESELKDIALVFKKAMLDNEERYSWP

SEQ ID NO: 932299 - protein, 145 aa, Homo sapiens
MDSFQIFNDVCFLASQQARIGYTLIQYDWCPYEKRKFGCRDRYAQRKDHVKPQGELHVKMKAQIGAMYLQAMDTKIADESPAGESSSKNGLIKLASEIGKWVLAKDYWFAAVDITIKSFRLFVLGCPCTEVGTLLFTFCLVHLQI

SEQ ID NO: 932300 - protein, 174 aa, Homo sapiens
MKQPVACSISCEQLSSGTPSGGFAEFALTGIDDCKSRWRHKEVVKNDSVSDFSNPTDEEIHPRLKTCSQKDLYTNIYSSFTHNSPNLEKSHVTINRRKNKAQPSRAMKRGPPSSRPQNGRSTDSLHCVPGKAAGSQCQPLRATMGSAPCRNSLFASVWPVCETWSQRLFWSFKM

SEQ ID NO: 932301 - protein, 153 aa, Homo sapiens
MLLLSIWMAFVCSSTLYAREQADCNSTSSLMIIDCFENIEPLCVRDSTCNIIIIFIMTPRQDLGDLEQPKTWAAQKAGTEGSIRDSRCKEPVAKDIMWLAGKRKGQPGERSFWKKYGPRGPEPTSQEGLLFGLKLLLLRYRANQHDLGHYSKL

SEQ ID NO: 932302 - protein, 152 aa, Homo sapiens
MKNRAAQQDRKVNDLCWVLLLTSHVTLEVSKIKRTNSRGSKLHRTYSLQGLSDHAIQGSHLEDVKSKHIDNIPFKALGNSKSSNVKETERKIASPGWIECEAAVKCKEVDGYRLYFGSRDDGISSLGKRVEEQRRIKDDSKVSYLNNRESQY

SEQ ID NO: 932303 - protein, 138 aa, Homo sapiens
MVGLKELEPRLESSQSQGCDSLFGALWFLESPSFQVLPHSLVPAGEAAALQTAGACAGTWSCPPLSNSQHVWLCTVAGPYTCSHTPCHSTPVSPVAGMGLRPVVKAEYYSLVYLHHTLLTWTSVDGHLDCFYHVDLPF

SEQ ID NO: 932304 - protein, 153 aa, Homo sapiens
MWQLLSQGCKCSVFVPSGMVSTSHYMKRVQFHSFTSGYSVFLTSFVDETILSLCILGTWSKISFCCASDNMKIKCAGDKNGITKTSQEAKAHRWSLWHADKWPLKDVQVLISGTCAYVVVKKPLQMKLKSTRRIDDPSIITSNKEPANLSAKS

SEQ ID NO: 932305 - protein, 185 aa, Homo sapiens
MSPKSLLGLSWNVGRERLSGERSICESLTAPEAWCSGPVKDPSSTSSSHFWDCLSFLGLLQHIVTNLAPTYSELGKAALAILGAVPIHTVSANSTQRTQYFKKPHNASASLNTFPMEYRNNSCLSGWAGSRESQTGLEILATVPHGILGAGKGENSPGLVDLQPESWADVDSQGMLGSCHQKTGG

SEQ ID NO: 932306 - protein, 170 aa, Homo sapiens
MPGPSVTVQLHHVRQSTMLPPPQLLTLAWAPGKYSCSLSSPGCGRSAAEPLWSHKIILMPLNPAEASGNTVRVLPKAAKLARKHLKLENRGSNYKVHCSMTGQSGYWDYLRQSHHLSSSIERGRKQELVKISKHPAMLIIPSCDSLLTSSSLPFISVFLRPLTQNLLFCS

SEQ ID NO: 932307 - protein, 125 aa, Homo sapiens
MLRGDQDECESKCGASTPKRRRESRIKPVRCSCTQRRDEGGREPSEETTFLILEHELEEMESARWIFGGAESRVKGMTVPRLAERQCYHDHSETQTDRAAIILNVASRQASGKRECGLGKSHGHP

SEQ ID NO: 932308 - protein, 151 aa, Homo sapiens
MSSPDRLVLDANENFASSQVFDLEEVIYPSLSLHFLTCKMGIKMKWDYLCKVLALVPSSQLVEAVLLLVASREQHAQGLHGGMIGAFEEYQGSHGRQNSRAGSRFSFSDYSTKQESRCCCEGFAVEMKVPSQLILGYENDPHGPNLIRGAL

SEQ ID NO: 932309 - protein, 156 aa, Homo sapiens
MLSLACACYPKALEKAAWGPHPRTPVSTPRSLPAGSCRALAPGKAGGTAAEKLRGGKEPGEFCVTAAWQGIQERLEAQQAGPGSARIKAPGVLAEDAVPSPIRGHCQPFASQMRHSRAVGHQPGATLGDSRTQARIQLLNVLPCPTPSRLNCGGGV

SEQ ID NO: 932310 - protein, 168 aa, Homo sapiens
MVAAPWDWLLLSESGTWHFWQPLGAIFKPHSWFSSWLLIGGQLLSGEMLSKKAICSCKKPTRTGSLLVNISFTLCFSDRNSKSQLSRIKVYQASGHTDCCLSVLQAIQVSSLFHSTTSSTYCVPGAVLSVEDRVVLKDNTVLAAKEPTVIMTATHTSSGLCPCNKYHT

SEQ ID NO: 932311 - protein, 146 aa, Homo sapiens
MPPQAKELQGSLCGTGPSRPDHPSPRQPLQPHPATLLLVHCPAATLATLLPPLPQGLCTAAEALPCDLCSGNSSIPSHSPAKTRLLGLLLRGSRTRGAWGGQACIPTPALSPWAVRARAGYLTSLCLGVLIYKMGTKRIYVAAGLL

SEQ ID NO: 932312 - protein, 145 aa, Homo sapiens
MSEYCQAASVSRSRCPGNVGPIPGIRLPEVYKQHCRYPVEMHIPGGTADGLGWDTAREVNPRAPEACWAAWLCTESWNVVPKSREAPASCPQGHPVFAGSQMGTPHNRAGTVNADSDPEGQGGPEMPPWYKVFIPLHSKPLLGAV

SEQ ID NO: 932313 - protein, 154 aa, Homo sapiens
MAGSMDVSVGRPRPLEEAEAALSGTPDPGEGSGQGRPSQAPYGPWFRTSLGPRGQRPSAGIPKDPLGPLGLLSTSVPPGEESPTKTGVTPEGATKSRQGEHGVQALPEPLPWAVSGELLWNFLSMQAQQATVCTTRLLPVNLQTLMARLFAYVF

SEQ ID NO: 932314 - protein, 137 aa, Homo sapiens
MTFLRGKGKKAACLVQRVFSILDTVYHTIPFISLPKDESTIKQNYCKHILNKAAFTLTFTSSPSFGTASLALPAGSLTLQDRGSQEHPAVLQASAHGHDLPGCSLLPHTCCMPAPGPLILSKSYPSFRKPSYENDIH

SEQ ID NO: 932315 - protein, 146 aa, Homo sapiens
MSCHQQLDVKLRPQGAKTCKSYLASSSRNLWNGSIHYNAKLLVWPEDSPFISEPVSPAGRVKIAPCTQWKLEELVKFSAKAKALKSSAVLLNLGIWGPETPWSTGPNPLAILQSAINQVLMAKTPANKELEQHKSRKQAVVKSLTD

SEQ ID NO: 932316 - protein, 184 aa, Homo sapiens
MSVLGAWGALSVEGHGVACTLKHAQQCGLCEAPQDDARVLIPEPGTWWPRCHHRGPSKRKEEVRGKDRGSEPLTLPPSGLCRHWPCWIASPAAGGIQLIVAKATVPRGGRGGQFHLPEWAALESCSGGCIMLRIHNCPRNPCFTGALAEEGFHGMQNPGPAGPSPSEVMWLPVGGCQSAVIRGS

SEQ ID NO: 932317 - protein, 146 aa, Homo sapiens
MAEAERHISHGSRQEKRACAAKLPFLKPSDLVRLIHYHKNSMGKTHPRDSISSHQIPPMTCSNCGRYNSRGDLASGPIMGRAAITIALVINIQLLITYANSVASLNLSSENGVFLYIALSGCKFSKLLCFVSLLKLNAFNSTQVTS

SEQ ID NO: 932318 - protein, 169 aa, Homo sapiens
MGPACKSPATLAASGLEAAAHPSVPVPPRSCPLRLLRKPEAMPCSGSSTCEGEDLGGAAGAVQEREGRNTWGACEGEEVCALIRADTPVKRQGHKSRGTTSIAKRAWRHLTWFVGHGRTIFQDEGACISHPADEPNLARGGKGWGECSRLQPQLGQDWEAEESQGVWEG

SEQ ID NO: 932319 - protein, 119 aa, Homo sapiens
MEMSSGRPDSEPVLITRAGTRARCCLRWPRITCQSELRGCAVPALTLTEGHMPPHAEGSWSNGGNYSLQVTANKIHYNLTYKCIQGGFQLLLQNIKTLEVVVLILTTRKKPNKLKINNS

SEQ ID NO: 932320 - protein, 150 aa, Homo sapiens
MPINERRPHLMAAMLIVPRLYKKHGTSIRFWGGHKLLLLMAEREGELMSDWFERDCVSSSKRWFLERWAFSRGSQNNEGDSGDTWTEQQGPGSLWEWAQHDQTRLVPGSFWLLWEHRLYGAGPELGDRGGHGAMGQGWVLPTTQQLPPGR

SEQ ID NO: 932321 - protein, 162 aa, Homo sapiens [sequence omitted]

SEQ ID NO: 932322 - protein, 215 aa, Homo sapiens
MLSSLLFYKWRNRGPGAQLPKCTQQWDIDTEEVNPERKQVVPVPVVVLSAGKDLTGKSSTEELRTPCDRNGVIVMPGILSKGPCCIQDCEGLESRLDFQVGLLATKAGAPQRRLLQGRGCAAQPGPPTLPWEQVAGADSQPGAWESCPGPQPGAWFPERPRFLGPTATAARRRPHCRSREPAINSSTQALFSVLPTELGLDGFNPRALAVSISLC

SEQ ID NO: 932323 - protein, 153 aa, Homo sapiens
MVSKGHVSAPPFTRSQVLVLYPGRMSPQNWQPSPKSSPGTHPFPPRRLSASTTINLPSTVPMVPKLLMQRGARRLALSCPKLPLGLPLAPNVQRGLRAAGGWEQGEARQWEQLPLTPWNVQPWLRLPYCSLRHGSSCSRRATSAITTMYGLFL

SEQ ID NO: 932324 - protein, 128 aa, Homo sapiens
MRFIMKIFKNTEALKESASTQTLPAEAALTVGCARCHSSIRLFSVPAASETTLAVGGGFPSTGRAFPPPLSGTFCLCIKASTILPEVVHALVAALSAPHTPCSVLTADLSPRYYYYSPHIPWAEIEPQ

SEQ ID NO: 932325 - protein, 162 aa, Homo sapiens
MTTSRGPQNWQPSPKSSPGTHPFPPRRLSASTTINLPSTVPMVPKLLMQRGARRLALSCPKLPLGLPLAPNVQRGLRAAGGWEQGEARQWEQLPLTPWNVQPWLRLPYCSLRHGSSCSRRATSAITTIAPSPDIANPSLYLQNPPWVLHFPLAPGQGQCPLF

SEQ ID NO: 932326 - protein, 140 aa, Homo sapiens
MRAMQGHVPQAPFKEGLPNCGSVLQKAPNSTSAAAFEEPDDDSTFSLSVQLRGTDINAGIKEGQSSVLSLIFPNLGAFRGPEAPAEYRRVEANADAVTIAPGAGVPQWLIRRIHQADGNWGSREGEGRRAVAFGALGSRV

SEQ ID NO: 932327 - protein, 143 aa, Homo sapiens
MLTSRAVGSRGTPGDDTGERERVRGEGWPHSHTTDPGSVSLGCHNKRSETRGLKTAQIDSHSLEAEVKSQGVSRATLLPKPPSGELVMSYEQSLAPERHCVNASADDMISSWGILTGVGQTALTTLCAAHSELCGLEQMALHL

SEQ ID NO: 932328 - protein, 123 aa, Homo sapiens
MGAKSHFTWWQAREACTWELPFIKPSDLVRLIHYHESSMGKIHPHDSITSHRVPPTTRGNYGSYNSSARGSDSFTCSSVRVIVCLRLEHPSEHPNGKKKMGKYDFDANANIDSEPRASGLAVN

SEQ ID NO: 932329 - protein, 160 aa, Homo sapiens
MAEGQASSLCHLGAVGINLGSEPPGSQGKWKHDGSLSCHHHLLMTSMCISPVGSGLTGWRKAHGGLLAQSSGEFTQGHMAEPVRCKPRSVLTPKPVSPPPHRQLFPSGDCKPSPTWGCQTRQRNWMSGPGRPEEARVCPTQSRDVPDHHAGPPPGSNKNA

SEQ ID NO: 932330 - protein, 130 aa, Homo sapiens
MNKAAVSRGRGRRFLNNGTGHKCFPEQPGDLLINTETSPGSHAPTTRTGPPSRAQATSPPPRSLQAAVNVSSFHQANGRGILAAVRKRRSGPDMGVDPRSGRQPSTETCKTAPKSINFENALEFLAEERC

SEQ ID NO: 932331 - protein, 134 aa, Homo sapiens
MKRKQATFLTGQQKEKCQAKGEKPLIKPSDHRRIHSVSQEQHGGTTPMIQLRAWCKLSMHLPFWGLENSGPLLTALLGSAPVGTLCGGSDFTFPLHTALAEVLHESSIPAANLCLDAQMERLSGELEDESILYY

SEQ ID NO: 932332 - protein, 170 aa, Homo sapiens
MLPASSQQWEDDGVPTRAQYCQGGLWDELELGGLFQFRHFLNLEGKSHPGRKSTIGMHVAQTQGPRMYSRIPTSSLLGKENSRTKLRIHLWPSAEKGVFQLKYENGFQKVFQKQNRPHFRCGIEGPSNYLGPSGHVTLICLTKVSWSTNRFLTSLSGHNIWSRETYFSVI

SEQ ID NO: 932333 - protein, 171 aa, Homo sapiens
MSLQKKLFQSCCKTSAGPGRSHFQRFQATARRCHENADASHARVAWIWRRSLDVRADGPGPWRVSSSHLHLVLAPAAECVVGEGNENKECPPGDAVRVAQHLLCTGPMSLLCQVCELAQPCGEQTLGHVLGDMAFDTRRPLLSSAHWPWAVHSARLVPLNLTTFPWGRDGR

SEQ ID NO: 932334 - protein, 195 aa, Homo sapiens
MAGGDVCVSPKRAYRLVRDAPTCSESCWLAQNGRWMLQMQLSTQMSVINACLPWKRGSGVASAFQPQTRYAFSPELTVGKLARTQRMESRLCEHSKQRYLRPWRQLGPGSRSLGYTWLLAATKFAVLATQAWSSCGPCGLLSRAGLGMRPQRGHWSREVERQGSDDIQQPDPDVKPSLSSGTFRLHEPTDLPASS

SEQ ID NO: 932335 - protein, 246 aa, Homo sapiens
MGPAEWEEQQGAFESRPSSERGLLCTSILRTFSKSTSRARYCCEGFACIHLWNPREHLSSPHTHLSTWAETILLNAREIPCKKAACTAHGVGTSWFPELNDLGELSKAAVRENPTLPIRYRTRSEASRCWSSHDRARDLFQEGGMAPRSPAGRLAASQNEIESLPATQFTCSLGKCSSAILSCFVEGTRMIQKLLDLVCKAVTQGIKLLSVSRFPDPWHLLPFEFSGDLIDPTSSGNALRPLEVAV

SEQ ID NO: 932336 - protein, 160 aa, Homo sapiens
MPADYLTGLPLAGLESTSACNFPSLEHVNQLLQICWLNFRPPAQSTMAGLRCQMPKEGQGLREPGVDITLICHADDMILIRPEKQKVVADMLRPLESHTRTRFRGLEINLMNIQGPVTSLKLLRVRKNAHVQVEMISVFMCVCEYVPVPVCARACVSVVW

SEQ ID NO: 932337 - protein, 234 aa, Homo sapiens
MTWEVLVVWGDRCAPLLTHQPGQLQGHQAFGGDCRLRIQHAGRGGLLWMMMAASGVGGLLSSCTDPDLLLHPHSSPVSRGAQEGTELPHQGAALGGSVTERSLGAMCEGTVFSFVSALREREMMKTSPWLHCVLAKPQGCPHTRFSTWGDSAPLGDNWQRLETFLVITQGGRAPGIYRVEMGCCETPCSARGDPHHRGSPAHPGNIVEAEELFLWLLKRPHIGCLKAAEKYSPF

SEQ ID NO: 932338 - protein, 159 aa, Homo sapiens [sequence omitted]

SEQ ID NO: 932339 - protein, 149 aa, Homo sapiens
MRVLRSALFVFIFKQPRYVPRGRTAGGYGNSISGYFEDASFFIAMAPFYVPTNSAQGFQFLHVLISTYFVLSCFYDSHPNGCELLLEMLVPPQHPGVCDGQVLSGSCGGSCPWTAAQVLEPFQYFCEHLSPCSNSHSVQNWDMVSISCK

SEQ ID NO: 932340 - protein, 292 aa, Homo sapiens
MIIITIITTITTTITITIVIITITAMIIIVITTITTTITITIVIITVTTMIIITVTTTITTIITITMIIITTIITITTIIITTIIITTIITITTIITIITIITITIIITITTIITTIITIITITTTTIITITTIITITTIIITIITIIITTTITIIITIITTIIITIIITIIITIIITIITTIIITTTITTIITIIIITIIITIIITTIIITTIITIITTIIITTIIITIIITIITTIIITIIITTIIITINITIITTIITTMIITIIMAAHIYMEITMWWALALFQDFKHN

SEQ ID NO: 932341 - protein, 306 aa, Homo sapiens
MAGTTPRPHPALQAWDPAPGTLRQGHRSPPQHQSQQNPWSQLLKTYVLAASSHTPGQATLFQASSMKSADPSLRGQLSTPTGSPHLTTVHRPLPPSRVIEELHRALATKHRQDSFQGRESKGSPKKRLDVRLSRTSSVERGKEREEAWSFDGALENKRTAAKESEENKENLIINSELKDDLLLYQDEEALNDSIISVPVAPPHVACLPLPARLSLGPSPWASLMVLTPQPQPLRLLLSLEVCKAPPRLKHRSVQEATWPLCGNTWPLLLTQPYFPYGSVPDANTIGFAHAASLPAHGLRETKSSPL

SEQ ID NO: 932342 - protein, 122 aa, Homo sapiens
MKSFSHCWAWTLVFRLHPVRRQNEDQRPLGDLYTAVSLHAVISGFATGWMVHDIKELKLFTNLLSQNCSNGSKENWNLQNAFPSCSWTKYKAQRALTVALKLLSECLEMVEDTRKSAESFPD

SEQ ID NO: 932343 - protein, 126 aa, Homo sapiens
MKPFVKVSLSDSGSVQDIVQFPWCINQCMWVCMASVWKGHRHGSTIQDPPKQMIFLLTCGQKVNSSLTVTHNAYTTHLTSSHHLGASSSHISTRRRQQYCPRGIQQGLDKFWVVATEGRKVGVSGI

SEQ ID NO: 932344 - protein, 164 aa, Homo sapiens
MSWLFLKLTRLTRLFHPSDSRCHPGAVEGTGHSKQLEEKHFYNKEAFEREKPFESQFPLCLGSTVIWRGPNSYCDHMGAFGRQGAGRGGCAQAHMPQPQPLYPALQRQLPKPSSPFWLLPHVYCVYQCGHFENVTETESSTVTLSQALVASPCSTTAGSWLVSN

SEQ ID NO: 932345 - protein, 140 aa, Homo sapiens
MMQGASLHSPFCTQVEVIETRRQFPQCCSRDKITQFGAVLYSSVRIDLYGEVATDANNNWLQMSAWSCLGLDVKTKKPIAFTNIMTSKMVQCEDSSLSLLSTKVLITHISQLNLSKLLVFPQLLISVIVCKELFRSIKQC

SEQ ID NO: 932346 - protein, 161 aa, Homo sapiens
MASQVRTWPRPCQCRKQPPFLPTHQIMRKRQCTLMKIILTQESVEVLPPLWDPMFHVRQNWVQISAKPTKTYIEYLLSAQHYRVRLKGTRSCGCCLQNFTLFGEAEVTNRLQMTPSLSRSPWVLNHGLLCIFSVSNIPTGHTEQWDLRLFWKISGLPFAQS

SEQ ID NO: 932347 - protein, 163 aa, Homo sapiens
MGTCGSHLTQHVSESYPRLTEKTLRLVNNARTSIKGRDKGSEGTSAPEFMSETPVRTLRTMKGSWRSKVLGVCEVPMILCKAGCEFIPSKPSLKAFCALCLPAKTRELKPRGGMGGLLAMAEPVVISAMVFIIVFEAVVHVTNSTSDTLVFCKMLGLESPTPG

SEQ ID NO: 932348 - protein, 185 aa, Homo sapiens
MAPMWPLTTNNLPLSVFLKGKGWKGKNPRTYYIPFLPLNIHEDFYLKEFGIEGRYSTQNVCMNAHNNTIHKTQKEITSHKIGDRDHIHMEGAFWICIHLGRATHGLCDTFSSMVNISTRTTLQTWTHNGKLAYMQNSKTEENGFNCGSMVEIIHKAVPAPKLLEILVAWMTIPKENGKCIAHGSG

SEQ ID NO: 932349 - protein, 151 aa, Homo sapiens
MQTQHVMRMGLESGQGTRVAETRFESELAQEQPCWRSSHTNHIRPWTSGALDTTTHSSPELQPKDAETALPGDTDSGQGKRVLQLLVSGQKTRFCGQARSSILVDKVHQDYVEWAGVISANTKQGAVTIKNKQTNNNNNNNKNRQQSKLNR

SEQ ID NO: 932350 - protein, 146 aa, Homo sapiens
MKALRLQRLWLWLSIVLAPWLQFRAIKSLQLAHWNIHILDKKMENPECDLPGAPGFNQFLAVPAGPVIRRNIMASMAALEMNFIEREFTLRFMIAAMKRVHILSFETQEVLGFFGLSCSSSLYNLDSNSSSDRWLTNIFSQSVTCL

SEQ ID NO: 932351 - protein, 132 aa, Homo sapiens
MATEVLTTVQKKPEVKNVFTLLIVILVCDGHKRRGNRGRFPFSPLSRQLVSLMCTQNNPSFVHLFTPPSVSLLWKYYGTQGSIPDFFRHTKVTQDCTETLFSGRSHSSEEEENICLNKHRARGVPLEVCPPT

SEQ ID NO: 932352 - protein, 140 aa, Homo sapiens
MSRWHPGHTVSYWVGGVCPVASLLESFYLFISELTDACPGHAQATDEPTKGILSLCYSGFDSLHLRFYSVFEFFVVFISVGARGVKFLKCPQFCLYWWLGLPFGLVLRKNLHLAALSAVILLYRMPGTCRKLRSILKSYD

SEQ ID NO: 932353 - protein, 149 aa, Homo sapiens
MGCSQELICSREELCLRCCASNLCIVKELRFLDSKTQELDSCPCEAISGNRGQNDTFIDQCFGFAGQKITLSCPASALIVDSPSRLSSQPTHLPFSQGPAVSYTLHPCQDALTALFSHSSHPSSGLGSPLHHHPPILVPRGLTLLKIVM

SEQ ID NO: 932354 - protein, 141 aa, Homo sapiens
MPISGLCQQKNKAMCAGALLPAPLYDMIIADKRNDDAAGSGDDVNCDDDKNGDDDGDDNNGNEDDGDDEVNGDDDEEANNDEDGDVTGGGGDDDNGDDDSVMMIMRVITVMVIVDTCAECAGLLHRYTCAMVVCCTYQPVI

SEQ ID NO: 932355 - protein, 156 aa, Homo sapiens
MSVFTCAYVSFIPKVHTIPTIWNVSWELPTPASHFIFKSVIEFPRAHHSTDSSSPFQTSSSALFSVFPPSTVLLGAPLVDCCPYKALQGAVISKDLCGQASGMHLGQGFCWTSRSWGLESVTTKKKACNNWESLCRGETPYVKSTCDSIEEALALS

SEQ ID NO: 932356 - protein, 185 aa, Homo sapiens
MICKREPLLSDDCELGLGSFSDFGTEVSVLLGSRADLLLDWSENIHCPASQLADCGKLDFHPAALGGGCWKLHRQSRHGWGEGTCLGGTPGSGFHMEEPIRLCGSLKVPQGHLEALPKYRLLGLTPSVSDLADLGRGLRAGPSNKPLGDADTAGLRMLILLVCGCCYCWSEDADTAGLRMLTLLV

SEQ ID NO: 932357 - protein, 122 aa, Homo sapiens
MQQQEDLLIGEKEEPKALDFGYHFLALQPSKFENVFSLNELVCHLSCRAWKLLKANETTYVKHLEQLTEAPNLTFHSCAPPEPTEKSPKVSCAHLTGLSGALSSRCRDIYFHSRRNHFVADI

SEQ ID NO: 932358 - protein, 321 aa, Homo sapiens
MAGAPAAILDYEKDGNLSLVSVPATLNEKSVVHNILRHVYSFIHLLTSCFLEMYFVAAMVPGLEIQTCSCPPGVDSNTLFNDHSVSENAREADSRVSVDLYSPGCREKCGHRCVKGLCQANLYLPDRLSDPGPMRGCKTGVFTCGDIPGDPSAADPGGGHLQMTGVFPCGDTPGDPSAADPGGGHLQMTGVFPCGDTPGDPSAADPGGGHLQMTGVFTCGDIPGDPSAADPGGGHLQMCMFPQVLLRTVVSLTRKGIPTTVTKCSSFHWSPSDLGCNSCTIYTSHALLKGLERIMEGPMQGKLQGNRSRGRETEGADAGGT

SEQ ID NO: 932359 - protein, 140 aa, Homo sapiens
MIFPDVEFQLIRQRVLWGKALAMTGLGRSEKSRTSKDGKADCQKHFNSQGLAARVKILLESGFLIWEEFREPGIIHIRKLVWSIIIQFKEKPPTSKPAVMKYNIFSTEEMGVPADPSCFPYICGSIWWTILNTPHLQHRL

SEQ ID NO: 932360 - protein, 155 aa, Homo sapiens
MPDLLSALASHMDRVCCFALALCACEREDVLAMGETMGSTDLGLSCNPNMGSYQGWKPSCRCKGQVWPAESCTTQRWQPQKSPHLCDGAVAADRRLVSISIGPCLAPAAPATVCSSGAELGLCSPEEGSAPMAACPNYASTLKMPGATTLLSYQK

SEQ ID NO: 932361 - protein, 335 aa, Homo sapiens
MGSCWSPDSFWWGMVCGPQHLAPLWNSLLLDFYGWALPVSTLHLSGVDADVDIGADAGADVDAGVGACTGAGTGVGTGIGANVDVDVNVDGGVGTGTGLVAGADADVDVDAGVNTGAGVGVDAGAGVGAGVGADAGAGVGAGAGVGAGVGAGAGVGAGAGVDAGAGVGAGVGAGVGAGVDAGVGAGVGAGVDVDVEASACVGAGVDVDVGAGVDVDAGAGVDVDVGAGLGTSVCTGVDAGTGVDVGAGIDVGTGVGTSVHTGVDAGVGTGTGVDSGVDVGVGAGTGVDSGVDVGVGAGTGGDAAVDVDLDAGVGAGTDVGVQFQVQVQVWMQIQS

SEQ ID NO: 932362 - protein, 120 aa, Homo sapiens
MWRGFTLIFQRPGSFIIIEIKQCFESDVKVLEAEKSKTEVPASMVPGHRATLMTSSNLDFLPKPPSLNTVMLGAWLTRRKEEHIPKGKETLRESQTNRLRENCGEKEIYLQKNGEGQIKY

SEQ ID NO: 932363 - protein, 256 aa, Homo sapiens
MGLIWWHSAKEWSGLEALENFRLMPDRLYSSSGAQTKWPKRPQCELHSFSELESKWYILNLVNGYVLKLVNGYVLKLVNGDVLKLVNGDILKLVNGYVLKLVNGYVLKLVNGYVLKLVNGDVLKLVNGDVLKLVNGDVLKLVNGDVLKLVNGDVLKLVNGDVLKLVNGDVLKLVNGDVLKLVNGDVLKLVNGDVLKLVNGAVLKLVNGAVLKLVNGDVLKLVNGDVLKLVNGDVLKLVNGYVLKLVNGYVLKLVNG

SEQ ID NO: 932364 - protein, 488 aa, Homo sapiens
MLKKMVLEHHCHVQTGSDPDVQGHSHKTSSDQAHSGSFIQSYTYLSGSFIQSYTYLSGSFIQSYTYLSGSFIQSYTYLSGSFIQSYTYPSGSFIQSYTYPSGSFIQSYTYLSGSFIRSYTYPSGSFIQSYTYLSGSFIQSYTYSGSFIQSYTYLSGSFIQSYTYLSGSFIQSYTYLSGSFIQSYTYPSGSFIHGSFIQSYTYPSGSFIQSYTYPSGFFIQSYTYPSGSFIQSYTYLSGSFIQSYTYPSGSFIQSYTYLSGSFIQSYTYPSGSFIQSYTYPSGSFIQSYTCLSGSFIQSYTYSGSFIHGSFIQSYTYPSGSFIQSYTYLSGSFIQSYTYPSGSFIQSYTYLSGSFIQSYTYLSGSFIQSYTYLIGSFIQSYTDFSGSFIQSYTDLSGSFIQSYTYLSGSFIQSYTDLSGSFTQSYTDLSGSFIQSYMDLSGSFFQPYMDLNGSFIQSYTYLAILHRPQYEVPDFRFQEGPRRNAGCSPR

SEQ ID NO: 932365 - protein, 184 aa, Homo sapiens
MQFGGVPCAVWGNTVCSLGEHHAQLGGAPCAVWGSTVRSLGEYRAQFGGSTVKQFGGVLCAVWGVPCTVWGSIGGVPCAVWGSTVHSLGEYHVQFGVLCAVWGSTMHSLGEYPAQFGGVPCAVWGSTMRSLGEYHAQFGGVPCAVWESTMRSLGGVPCAVWGSTVRSLGAYHVQFGVLCAVRDT

SEQ ID NO: 932366 - protein, 154 aa, Homo sapiens
MPETPTVLDKGHFWEAFFPCEFVGVQPASKGEFARVSSRDIVFGRHHVASSPLGTWVPDVCADTFHVDVRHQFGNQSTFWMLGFLGWGHRDCGYAGTLKGALPGEEGPLILPSGGQNSDVKVSESHAPSGSTHSHACRGPGSYPLQLGDAGRVP

SEQ ID NO: 932367 - protein, 132 aa, Homo sapiens
MGSDDLIKGSPLHMLFCLPPCKMCLSSSFAFHHECKTFQAMWNCESIKPLSFINDPVSAEVEETNVPCRTRKAHPAKCYETKKASWRFANTSPRQLILPDKHIHLPTKLNNGLPEGKVNLTGSESTFPCLIR

SEQ ID NO: 932368 - protein, 454 aa, Homo sapiens
MVTSSFSARNSTSATSMAARVASSGLTVSLGPSVSRRSSGPSSGRMDQLPQKNLLRLHPAGSAGCSTGVESSSMDGFWMEVEQIQQRDELREEDSGGNEGQLPEEGEAESQWLQDTGLSGLLGGLGLDGDHQELLSTLTQTQVAAVCRRLDIYARSVRRQHKTPVRDVRDVFGVFNSGKMSSENGDSGMKGAQLSSGASKFPPAAEPGGLQEQAGREEAFNMDSAYSEQAAVLLQRSRPSRGGTSAWGKCSLPKFTVPKGRLGVTRIGDLSLQDMRKVPSLALIELTALCDILGLDLKRSKAGKWKAAETRLFGVPLDSLLEADHKVLPSTQVPLVLQALLSCLEKRGLDMEGILRVPGSQARVKGLEQKLERDFYAGLFSWDEVHHNDASDLLKRFIRKLPTPLLTAEYLPAFAVVPNIPNLKQRLQVLHLLILILPEPNRNALKDFSKPLVY

SEQ ID NO: 932369 - protein, 142 aa, Homo sapiens
MVLEDSRDLQGGWGWRWAEVLLTFVFYKGPFGFWEAETETGVQRTKEDEVTAVVQVGENVGVLNGVVQVPLVLGEPLLSSSTCQDDYFVTRARIYKRPGVTSIRQGAGSFHPGSKSLGKSCHLSEPYFSHEIENLTRLLRIT

SEQ ID NO: 932370 - protein, 258 aa, Homo sapiens
MQEQWRASSPIRSSVFTLLNLATAHSFCDFARGYITLSGVQRGANSDPDQKVWGTPLPPTGPECKKWDYFNCVNCSQTPQCPHQNNSQWQNFQDISLVQNASSKVMEDDTLIIRIQGSCEPLPNDWEPYLHLSKCFGAQMIAMVLVMVVTVMMVTVMMILFADELCGLRLAKSCQLYGSTTHSYNCQRQLATVRSRDRELQRQKSVHSNSLNPQIQSQAFSCALPFPPPAPQRELAVEYSHYNNHKIIAITYWACSTC

SEQ ID NO: 932371 - protein, 151 aa, Homo sapiens [sequence omitted]

SEQ ID NO: 932372 - protein, 160 aa, Homo sapiens
MPLVQGPHFVNHCPPLAEDKRDALSWVLKCPQRQSYLLDLAPFTFCQCQEMAWLEPPTSGSLIFFDPQDVLGVDARRAPPIDDSGNNSTDPFNIIEVYYVPGSELLTGSNLFRAHKAGSSSKQASNQSRFPGPAKKLQSIKKQVVSLQGHPNLREVELIV

SEQ ID NO: 932373 - protein, 134 aa, Homo sapiens
MGLEGEELEIFEKKTHNIHSDEYSNILQYWALGTSTYEFWGNGIHPMQDSRPTSRHLKLSGNRGELKGLSKEPSVSFHKDIMCFPSQGFCCLCHVSALPPLSERAGAWCLSTFLSVHGCWRWAADEYLSKSEEI

SEQ ID NO: 932374 - protein, 151 aa, Homo sapiens [sequence omitted]

SEQ ID NO: 932375 - protein, 134 aa, Homo sapiens
MCSQTNSFNNPFHNLLLDLQQTTHLVVHGSYVPPLLKFGMTFFSHLLPLSPLLHQFCQFDKSNPRDEKGELLDMTPHTWKVPGPSACKTLQLQDGKSCGKDGPGSWVCGDRLGAKVHRGELSLLDRPGVCVHKA

SEQ ID NO: 932376 - protein, 137 aa, Homo sapiens
MLISLHIIYGCFHTPPPGLSSCSRKCIPPVRQKVRYLLSGPLQEVCRLLAWGTAEGLWGYSSGSDLSRGGTLDIMDNGALGSEELAAGWAQDDDDDNRVLRARASITASSFRSRMLSSLFNLTPIGAAPPYQKCRQS

SEQ ID NO: 932377 - protein, 138 aa, Homo sapiens
MAQIKAVLWIPIGHKPVVHQPKDSSRKSPKYLRAHPNLRGPHELQNIADWVSHSLFCCCFSVLHKRECQYLWVETGPLTRPLNSSLLLHLPSWYSSRSTQSGPQNSLQQILEENKRRPMDRKLREMVHTLFSSEEQKW

SEQ ID NO: 932378 - protein, 130 aa, Homo sapiens
MGGLQVQRTELAMGGLQAQQTESVMGGLQAQQTESVMGGLQEQRTEPVMGGLQAQQTESVMGGLWAQVAEPITGGLQAQRTEPVMGGLHAQQTELVMGGLQAQGAVCTNTQRQKEVHVVKPVPQHIACTW

SEQ ID NO: 932379 - protein, 152 aa, Homo sapiens
MSQMPRKRFREDPEYSPVAAMSRLMLRRTPTVTNNTCQTQPLIWGQIKKLPQMAEENLRKVGQPVTTSNLMVAMIAVITAAAKLKEICINGLNFINENWKHLIAKEEDMKMRESLELLRDSLNDCDQNAESDMDSGVQADEVSDGNEELTGD

SEQ ID NO: 932380 - protein, 206 aa, Homo sapiens
MGPEHRCGNPWVLIPEHLVSAVKLQQVGVIPQIPLSCPNSGWHNPQEPERASLAYALRTVIPAVLASCCSSDHGEEAPLKLSTLSKFAQEEREEENAKVTRGVECSLALLGLSTPVETKGSPTGDDAAQVPSKGNEKNSQNNAAHVTLMPASPREGVELKLSSPSRCQDRVSGAMVDIVGRDRMDVLCHEWTTITKMDSCCTKKEP

SEQ ID NO: 932381 - protein, 183 aa, Homo sapiens
MGTDGLCSQDILVLLSGEVKVLDFLNDCSGIQECIFPEIGSDSCWSLAAWASNLEYITSAASCWLQPPSNLPRLQEKEHTLGVRTWLVLSLMPTKKAWETGKPRVTDVIYTRRVKPLEEQLPSFLCYTRSSWELQEAPVTTASIRRDPSSGMQALTLHLQWQSLLYSQHLACRPWRNPEADKR

SEQ ID NO: 932382 - protein, 230 aa, Homo sapiens
MPHFWTKLMSFFKWGGGDECGGHADCDGWIVVIMVIMVEVLVMVLVVVLVVVVIALVVMVWFIDGSVIVLVVVMMVWFVDGSVMVLVVVMMVALVVVIALVVVIALVVMFVDGSVMVLVVVMMVVLVVVIALVVMLWFVDGSVMVLVVVMVWFVDGSVMLLVLVVVMVWFVDGSVMVLVLVMMVVLVVVIALVVMSTSRFSFQTTVVSLTLSEEREPDPQKEHPFQNQKS

SEQ ID NO: 932383 - protein, 470 aa, Homo sapiens
MQGAFTAPACAHKKLMASLDIGKTQMYLSHFQTAPWGGATPMRATVLDSEILEDAVYGPYMSSAAWDQASMKEPNMHAEIQLPKQVKFGGDCDVSDSGRDDDNGGDSDGGQVTVIGGGGKDGDSSDDGDADGHHGDGTMVMIMMVLTVLALVVVMSYHGDGHDVDDSADAGGGGDGYGHDGDNSVDTGGGGDGDGMTDTSGGDGHGHDGDGSADTVVVIVVMSYHGDGHDVDDSADGGGGGDGYGHDVDDSADAGGGGDGYGHDVDDSADGGGSDGYGHDVDDSADAGGGGDGDGMTDTSGGDGHGHEGEGSADAVVVMVVMVCADTGSGGGADGMVMVTMVMTVLTLVVVMIMEVMIVMMVIMIWIVIMVMVMTGDSSGIGGGDDGDNGNDSDGDSHDGDGCSGGDEDGDVVAVVTMVTVVGRPLSLGCPVDSILLPSKPPVSRAITRENLLKTRFLIQDLVAFVETLI

SEQ ID NO: 932384 - protein, 460 aa, Homo sapiens
MNWHAVLHFDDFGKGLGFFKIEVSTPVPLRDVTFPIVKASLRRRLQLAHQGPPSSVDPSMHRAHSLCQGGVGSRRCTAEEDPAQAPKGNPSQGESSTVLCQTRPSTICEKDNAFSIELPLSFAKDQLTVVICVDVDAGGIDVLAADVSSVDVADVGAIALDVDADVMVLIVDVGGIDVDGIDVGVVNIIDAGGTDVADTVSGADVGGADVSGVSIVDVGGVDVGGVNIVDGGVDVGGIDVADGGVNIVDGVDGGGVDVGGVDIVNVGGVDIADVVGVDIVDIGGVDIVDIGGVDIVDIGGVDVADADGGVSIVDVGGVDVGVDVGGVDIVDVCDVDVDGGGVDVSGVNIVDVSGVDGGGIDVADADVGGVNIVDVGDVDVLDADVGGVIVDVDGGTDVPDADDSDVGVGWPLCKRRRIQACVSAVAHTRCGPFRSSIVCEPVFLDGNAGQSHDKLSLPTL

SEQ ID NO: 932385 - protein, 134 aa, Homo sapiens
MTNTDLHGPKGGDLPSQKAADGELVQSSRPQAPTETSVQELLPATLIRAGACACHWYTNGQARGTSSSQLCPTIPTEQEAQYIRHPHCPALHLKQLRAPNSKKRSDLYPSVYGTAGCYLQILQRFSHFIFKCAC

SEQ ID NO: 932386 - protein, 172 aa, Homo sapiens [sequence omitted]

SEQ ID NO: 932387 - protein, 193 aa, Homo sapiens
MEPEQVVQCTDPLVRQSPPRLTKSWTEGKKDRGTWRGGEKNAGVYHALTMLDARVPDVTPREFTNLGADTSYKNNSSFWRKCGFLKWIHCKPELLAAIFATKRERFSENEADRKAGMTDGETARVLMLLYGHLLDPAVKSVTLNTYRIQFKVMYRIYLFRSILDITTTRGFLPLTRPQSFSCGFARGWLYLGG

SEQ ID NO: 932388 - protein, 138 aa, Homo sapiens
MILSLYPQRRRLQWKMLLLLGGVSHHSQPSICVSKSTLRYNLHTIKCTYFKCYRAMHFEKCTQPCNYDHKQNTEHFHHPTSALVPLFSRALFPTLVLITSSESAKHFQLPLAMSKQRKNQNPLSQIKASSDSSGNKGA

SEQ ID NO: 932389 - protein, 155 aa, Homo sapiens
MEFCMNSKEESSHKCIRSTLMGLSLRQAPGSHAWRYPGRGGEGVLALAAPSVSVALSCDFSGLGKFKVTSGVEEVETSHQGWQRPTGKLGPIPAPHGSHHKGPSAPKAQARPVPLFMGRVSNLLLAGRLAGCAMRGLLTPQLWSGLCRLRGRAGE

SEQ ID NO: 932390 - protein, 260 aa, Homo sapiens
MGFLSPVCLLITSQSRIKKSRLLPARWKQQYRWTVLPQGFTDSPKLFGQILEEVLEKVVIPEQICLLQYLDDILISGEDLEKEKPNRLLWTSEEVDQIERLEERLITAPVLGLPSLEKPFHLFANVDSRVPSGVLTQEHRGRQQPVAFPSKVLDPVTCGWPQRIQSIAAMAILGEESRKLTFGGKLTLNTPHQVRTILNQRAVRWLTDLRILKCEAILLEKDDLTLTTDNSLNPAGFLTGNPHLRREHTCLDLIDYHTKV

SEQ ID NO: 932391 - protein, 149 aa, Homo sapiens
MRSCHVLGQIVLGLLEWGCGEEAVGRGGWSARRLTLDLAPRQLATRPRVGSCASLGLHTLICKLGKPYLLQEECVVGKQGHSGRTTCQFGVLKYLDPKEEDCPQSESPTLGRGSLLGCSHNPALLPAPPLATPCISTPWMIIEGCTWGS

SEQ ID NO: 932392 - protein, 205 aa, Homo sapiens
MSEPYIKLRHRCIALHRVAGPPSVQPTASDGHLGCSQIPPNRASGKVLLSASLCAWHISLRQVSGHETDGQHVLLTFGGPVNPLLSRRLWPEGRDSSHSRAIDACLSVGQLWLGSVFIFMSVDTITGTRKNQRSTGKRFGCMEECFAVRALEPCALIQILAVSPAGCVTSDKLLDVSEHKLGHQKSQAILLGENRNTTPFQKCAP

SEQ ID NO: 932393 - protein, 144 aa, Homo sapiens
MPKYPGGQSCRHLPYWRMPSRRMNRKSLCWQVEQPFSSEQMIQPVQLPPRPRNSPLCKVLMKHILAPSPWNRNQKSSGPPLSWQQLSDEYCYFPSPHLLFLRFDSEQITVEQRCFGADEEPGAPPIQPDHPGAPGDTEVPGSTL

SEQ ID NO: 932394 - protein, 204 aa, Homo sapiens
MVTLWSCAVPKRPNGPLLDKQPREKFYGNHHRSQRAHERAKESQRAWDIFSLAPKSREEVESRAGVRPILDLGGWVGAEIREAPGAWQLLPLPSPSQHGRRGRCHPHCWAEMYLALADPTRTLGRGTSDKIHLVARQQGLYVSHPQAAGCGSGRDSHWAKGNSLEKREGPCDPTGTAAADAPYPAKGSGRGTHSVHFSPLSVYC

SEQ ID NO: 932395 - protein, 143 aa, Homo sapiens
MPLYCLPFPHPSFPTQDGVAVVETPLTVQGPFDHHCKATGCGIRRTGASLVGVTLSSGVPMSSWHLLDGRHCANHTFTHYLIKSQKDPEKEPHAFQGNHFSSNNKQPERADSKTQIRQLGHRKRWGKSLLGNCQTSPSYNGPQ

SEQ ID NO: 932396 - protein, 158 aa, Homo sapiens
MARIKQAEEVGKTDLLSLPAFIPLLCWMLPALKHQTPTSSAFGLWDLCQWLCYIVTAALASKFAFPAKYDPSPKYDLSPKYDLSPKYDLSPKYDLPPNNWQILPDPQNPHSLLLSVNLSLAQWCLMGNANLLLCIISGDSEFQASRRDPLRHNPSLKK

SEQ ID NO: 932397 - protein, 167 aa, Homo sapiens
MSIRSRRRSAACIPDTQQLAALTTCISRLWFLDVTNNPHFFYIIQLGCIHRLFLNFSSKQKARDSFQEGEYRIWLGDTELSGKQGVTLRTGELHECGHCGCWGSPIPSPSLIPHAVPRTPATIPTGSREVSSQRAQTVEAAKPHLCTRSIQSAVKGSPFHTSRLPDG

SEQ ID NO: 932398 - protein, 344 aa, Homo sapiens
MLVSLNNSYVEILTPEEEVQSTVERGMDSAGKSLCQVAEPTQVENAGRGHFLVVVAAGHRVLKCQFARDRGNFQDTGFSVLNWESMLPHGNITDFPTGHEPMPLFHLLCSPDSNCKCYAGNSHAWMTPIGDWKPSFGTSLVHNKCPTICVAEIATPAPVIPPLKGGVEKGVFRLAGEKRPPPGVGVKGDSESFREKKKIKITGFSLDSAVCESGQWAGLVVTHLEGLGPLRSSDPLCGASPDLRLGGLRKELYPEWKHGDLLCHGRYEVGTLGDPKDLYTKLLNIITNQWPCVSIIYFWGAYCVPWVSERINVSECELPKMDSVVKIREAPLKADRPGLVHTIY

SEQ ID NO: 932399 - protein, 115 aa, Homo sapiens
MPWTALRHAENNGALESLGPASSGQSSSSPDVFAEVTLLSWKGVGSCALGETAWKDWVPAAERRARRPNAGCGCLQPILPPAPRVIFRNASLIVESTFLTPFSALLFVTPLLYKR

SEQ ID NO: 932400 - protein, 150 aa, Homo sapiens
MCHGDLLHRSSAICLLEVRGRVWGWGKEDRSPVVSQVIATSKYFTKHLVGFDKPMTILNLYLDLVSKFQNLGPSTHLKPPRDASQTGNIAVPLHQRCFSSSPISLSQSLAVRVIPSSLSFSILNLSPHVVGFSCNHLLSLPLSLHIHCYP

SEQ ID NO: 932401 - protein, 387 aa, Homo sapiens
MLKAHQLPSRLSPKHSESDVPPDTVHLFCGGHPVGSEVKVSTGLAPPLGGTPVQQHHLLEVLHGVVLDRHEAHGVDHAVAHGDALDHVEGSEVVLFLHEHSGEEVTNDGETVEGCPAQHIGRENAHEHQDRLPAAAQPLANLLRLEPRDCLEPELPGDPGIAQGHGDHRAHELDTKDEEEVGLVVELLIHRPDLATEDLLLALDNKEDRFCCKVSRWDGNENGHHPDQGDQEGGRLIIHPWFQGVNDGEISGENKSRMPPAGKQAPQNLAINWRQRNNGTSVGSARLTPAQFLQFKTWWADEASIQAACNAQAHPQINITADQLLGVGDWAGLDAQVVMQDDAIEQLRGVCIRAWGKITSCGEQYPSFSAIKQGPKEPYVDFIAQLQ

SEQ ID NO: 932402 - protein, 141 aa, Homo sapiens
MLPVYGERPKKKKQIDCQTFIFVPYHCPDGVATCSESIHSVGGTPMFKRLTAKDVQPIHIPGHMGIESPLASFDIVPSAKASHMAKFRVHVRTHCQRTRGTGGLNKLDSLLQTACQGEAIALAEGSNFAFPRLWNMASCGL

SEQ ID NO: 932403 - protein, 188 aa, Homo sapiens
MDKSKSISNSEKHPGIIKNDMVVPGVATLDRLGPGKENSVRRATPSGSGGPNLLTALAPAEMSFQPLPYSTATDSSRPVSLQQWQQKNPNGPTHFTSHLHQQQGAQSARISGNSETHAGQVIYCSTPGDSRSYKKNQMEITELKHAATKFKNSPGGLSGSVEMTKDKVTDLEDNSTEFIQFDQQREDG

SEQ ID NO: 932404 - protein, 176 aa, Homo sapiens
MLAALAAAEAEDMQVGEELWLKGEPQSQSAGADGPHAAVSYCADRHGVWSAGLWGSGQPPGRQGLHGPHCASKHGHMEIIKLLLAQLGCNVHLQDNDGSTMLSIALEVGHKGITVLLYAHISFAKAQSPGTPRLGMKPQKELAMYLPLEKYSVVLCIYGFLYTVSHLLWSYMYLNI

SEQ ID NO: 932405 - protein, 127 aa, Homo sapiens
MNPETMQSPFIQKEPPGGDSLDFQLALVPVLFKEPSASQNNDAKEVALGATGQDSGPNWTQKEKQTLPSLTSNVDVPSGGGARQHSVFLFLLSYRDARRMETESSVVREAPAREPLGQGSNPKSGIC

SEQ ID NO: 932406 - protein, 163 aa, Homo sapiens
MNVAGYTGQHSTTYALTEDMFTTYRRQRGGQQASPGQWEGEPAGNHTLNQRDAENSLTNLFCEVDPPERWTKDILLFASSLHRIESVPTPVSEACDTGARRPEWEEFSSLIWDEALAKSFVPGEAVQGMDTFPGPEAEKLEAKIGMERCSAQKKSPLSSPGVE

SEQ ID NO: 932407 - protein, 139 aa, Homo sapiens
MSRCSGAPLKDLHSRLPVYSPSSITEVFAWPTVPAVLPVDQALPHLWESCLLHSSLLSLRAVFPRLLCSWFQAGLNQWKLQLPSHRPAMFSGSTRSPQPWALETPPPLEVPAVLGVEVAFCCSQCLGVPLALFGFLTHL

SEQ ID NO: 932408 - protein, 136 aa, Homo sapiens
MKLGCWIVTLRLIMKGRRNKGPWLATGSYRTGRIAVWQRVGISEDLQGVKEHDVYHLFSNGLQKIPFREKGENKWETISVSPNLDVDKKYLGGVDTPVDDDFQLEEQQPRCLLTAELAGIDLAAIEALPFSFKKST

SEQ ID NO: 932409 - protein, 170 aa, Homo sapiens
MATQFLLTLRRWFLCSVFDQKMTKPRWKLQMGGVFALCLCQRNIKSYQKLEDTRKNPFPTGFIGNMALSTPCSGTSSLQSYETIHIYCLSHSVVLCYGSPSKLLLYAKAANSWIMPAIALIKRHICYVMDKDCGWWIHDLPLETHCQSSCPQLFKGSLVMQRHMECSGCC

SEQ ID NO: 932410 - protein, 138 aa, Homo sapiens
MARTDKVETYSYMVLLHCLISFLRAIVDKTKQKKLEAGRTAELQLSAGSIVPVPLFPHQRTVDHNSYMERKMKKSKIKVLARSVPSQRCKGELIPYLFPGFWLFAGNLWHSFACGCQGPLPSSSYGILFGCMSFFVSK

SEQ ID NO: 932411 - protein, 185 aa, Homo sapiens
MKSSSLWHPLLAQPNRELAATQKYEYKRRESEAPQNRTKSGAVTLKDLRSICVAATCISFQGIPQTAFPKWAFPLEQPTSLSWPLGPAVPSLPEKPMPQFQSDSTGILSPGNYASFLTVMPHQCSNPIYGSSSCLPSSDLDLTFSNEGEQYDVVERTVRPGFLNLSTTDILGQIILLMWTLSYAL

SEQ ID NO: 932412 - protein, 157 aa, Homo sapiens
MISLEYAPGVPYNQRASFPGLLLEILGKRCSVLSRLDVPAVCKPNIPGDHLCHHIKGSPLRTTTIQRKIELRDEMQLDPIYNPFSHLFELKSQIVVLSRLNVHGSQHLSSHFRSYWVTGLQEGKPHHAFEPQGGERENRLTPKTSDITVVWREIVLL

SEQ ID NO: 932413 - protein, 135 aa, Homo sapiens
MDRCDKPAQEKEVQLSTHTHILSFQFLLSFCHLAIPPKKTRVQELWLKRDEGEVSAIPEQLRYARISFCAISNNAEMNIVCMFFISATILTVFTNQPSSPTMGLMIWLCNMKEEGAMKLKCMDRKNSHPIYAVLI

SEQ ID NO: 932414 - protein, 138 aa, Homo sapiens
MVALSMGLGSGSCSVSQQEELSGNNECQRTQLLSRVPVCDVPLPVSKCSHCSIPTYEEDFHPNPKVAKMGLWDSGISGAATSEESQPVSSVPMSHVVAPGMSGTFTEATPITDFEGLGGKNDFVGQAQGSLTVCSLGT

SEQ ID NO: 932415 - protein, 139 aa, Homo sapiens
MFNVRWLCLPGTSNNVLPEGRHFINIKHWTKQASKPHSDIRQDLNITDGYAKGYEGKSGQHAITTRLLEIPNNSTIICPLIFAFKDVGSKGNQLRKKKRKEKKKQVKITTKRWEKGTALRLCTYQVVNSARPVSFTSRR

SEQ ID NO: 932416 - protein, 130 aa, Homo sapiens
MARVIASWATRFLILPEFLPLHLLRTATYDVSSCQTLHSHSLHQPLHPDPSIASPSPEAAALCVPDDNLGIGTNQYQEWVCWERALETLVNAYKERFVSTVCNNRIQNNIAASPSVNRQVSYFIYTVEAK

SEQ ID NO: 932417 - protein, 138 aa, Homo sapiens
MPCCKNPKTGGGFALALLAIVPAEILTVSNNYQPSASRNEVSKGARENESNESAKRERATGSKDQLPELTLHGEVEEEVKKIGQVCVCVCVCARVCKFLPGRDLQISLGALSSDGSYILYEIIFGHFLHVCCALIVIT

SEQ ID NO: 932418 - protein, 169 aa, Homo sapiens
MARDWRATLPTALARDPLGEASWFPESTGDSENFYLKDCKCTNQHSVSSSRFGNAPISTLCLAQDHEPTGKKEQLWRGGTMNSRRAALRAVTLTTKVCSFTPEASKTMNPPEGRNSEHVRTAEETNFGHTICKNCNTHRTWMKLEIIILSKLSQEQKTKHSIFSLIGGN

SEQ ID NO: 932419 - protein, 162 aa, Homo sapiens
MIYNNDIKLDHTKAPHPLAAITTGLWGVHLHYPCCLFNAQGLFSPLVVNAAWPRTHPSAQWVPLWLMAGPEMPSKSQVLELKTPRACLVLYPPVAKLVSKTQDKIPICLSQVEEVLLIAITVGKVSHLTGSQQASESLQRPLIWYFGIAAGYSGPKDTSVSM

SEQ ID NO: 932420 - protein, 147 aa, Homo sapiens
MTQVLPGCPRGRLPSPQQTQSRAHVWGCTKASLWEEEGASLETHPPSASVPRTFQPLAVPPHPLCNLRVPNTAVRRSPGAPGDPPDPSPVHCPMEQKGTGEITIEKKSESCFLGCFTYDKVFTLVMREDTGKQRSAARQSWVEIHFQ

SEQ ID NO: 932421 - protein, 153 aa, Homo sapiens
MFVFLCLAYFTYHCSLLRGSTMLITYKLCLFQAFVIKSILNKGEHRWLKGTADCLRPLPNINVLNLLQLSSEIKNDHLWHMCVVRRTVIYCRPAQQDTKDIVIVTRWENSLKHQDSSVNLVDTGIGPLCRYLLSETMHDIYEIFINNSFNIPL

SEQ ID NO: 932422 - protein, 153 aa, Homo sapiens
MPSVPCLQPSDLIASVSTGLLSAADNEIEKLRNSPEACISGSRNDVINHHMIAKKKQVQEEWRSQFTLGSGGEGPQAKNVNHQDSAAFWKGGNVFSISKGRLTQTHSYGDARGPRKKVEIPKCFFKACLSQATGSRKESVQGSTITVYSCQEV

SEQ ID NO: 932423 - protein, 140 aa, Homo sapiens
MITGYTVLNFCWAARFLTGHRPEDLYHNFVQNKKVYYVFGANSAQCQAKGFARGASQRTLGPLTEYPHAVRNLTYFVQCTGEQDTKLGKGYPEVQTARIRPVCVLPTFQRYMSLIKVNWANAPVVISVFQSTACKKLGEN

SEQ ID NO: 932424 - protein, 157 aa, Homo sapiens
MDATHLLPYSLLCIPVHNIQSRTHQGIQSKPYHDMRNQYTVYHIGIHLFYKYLLSTTCLHSTVQGAREGTKEDSRQALKKLQIHVEKRASPQRSPFLLSKKWTLATELKLDPLISQLSLSIITKNVFSTWCTLGVCLSRMARRGRHTLRSVDILPFI

SEQ ID NO: 932425 - protein, 142 aa, Homo sapiens
MRTTLSKFFKWSHKLLREPLADSQQETEAHSLAAGKELNAANNHVNLEEDLADTDGKEVLSKVFFLMKSSPQIFFFSNKEQFVKLSCRHKNASWKLVWVNAGSCANKERLPGARRIQNGGSTFPFPCKPHNMAPGHAKTPFA

SEQ ID NO: 932426 - protein, 140 aa, Homo sapiens
MGEHCPPSRIFVSCIFHLPMTASPERTLTAASYRLQARGTLLSCTWIPDPEDGLRYSPYSFSLFLASKVASTCIKMQLISSFVSISKTEKYHFPCWVDRYQVVKVFKKKFMCENTNTEGSDSDKWEKRPTCTEDVNLMME

SEQ ID NO: 932427 - protein, 136 aa, Homo sapiens
MAVKIAELFNLFPGRNFLRNFVVVLQEDSVSMHIGEHYFIPELSVKRWCLLDKVEMTIAGGSNRPPPALLCPPDRDLAGPPLTSSAEHYWSSAWSNPNPGATAYFIFKVQQSLTFCCVPHFVFLFCSSTVEMIIFY

SEQ ID NO: 932428 - protein, 145 aa, Homo sapiens
MEGVDFGRAPLKNKLALELKLYIHNICVQNILQESGSAVRPLFCSTAEVCWESTPDLICLSPFLTWRYHQWRLENSKDGSLLLLLGALSQRHTDLLPARTPLYENAKFNVSCCLGVRRCCYTLTEDKDDSQGAITTSHSYHFSSN

SEQ ID NO: 932429 - protein, 180 aa, Homo sapiens
MVLGFSSLPDIYAAQLLSCSGQGLELIVKNHFGMLLGKSVWDDGHKMRSKTELHLNKNLASVLILSSPPKHLLLGYDNHFKFHKARKLRSKQALLQDLVLGVLNKELEKCATKHRKNEATKERKQGFIENESTLHSVGTSLSSGSKARIQNLLGSKYPLATSCSPHVNEVVACNQRSCEE

SEQ ID NO: 932430 - protein, 147 aa, Homo sapiens
METSVETCGSSLPCDLNSLIELIDFSLTCYVLLGQSDDFQVPYIQLTEPDFAGPVWAPHMTALWYKLAGAGKPKIISTIYGIFGAHCELGCYYSPLCDLSLYVMTHTSGLYLASFSSSLKLALTVCWPVRCTIFNWCLAPEKSALTY

SEQ ID NO: 932431 - protein, 137 aa, Homo sapiens
MLSNSFSVDNALQIWGHSVTFSGVGRGGGTRLESGILALEEEQLRLCKVTWAAQVTVLPAELSGAFPGFLASSVSSFWICGWETFSLSVQTLSQMPCALHSWSFLLLDHLHRCKNHLKSLSNPDTWVTLPAIQVLHV

SEQ ID NO: 932432 - protein, 139 aa, Homo sapiens
MGDGVQGKVLKFKGSSSESLIHKTKTLRRPAHGIFSPVPCLNGPADTCSSIPEGFLLAQEVRSLKVLRSQHLQEQPSANNGWKLEDKYTSFIPAKPVPVRSLELQLHWLLDKSISVDLHLRTTSRHLLKITEVRILQIR

SEQ ID NO: 932433 - protein, 414 aa, Homo sapiens
MLGKVQQQEQTIAKDLVVTKYKMCGGTTSPTGYFGRWWKHLAQKGDAMIMEETGKIFKKEKEMKKRIAFPTSISVNNCGCHFSPLKRGQDYILKEGDLVKIDLGVHVDGFIANVTHTFVVDVAQGTQVTGRKGDVIKAAQLCVEAALCLVKPGNQNIQVREAWSKVALSFNCMPIEGMLSHQLKQHVIDGEKNIIQNPTDQQKKDHEKAEFEKRDSSKQYGLKRKTSRAFFSEVERHFDAMPFTLRAFEDEKKAPMDVVECTKHRLLQPFNVLYEKEGEFVAQFKFTILLMPNGPMQKTSGPFKPDLYRTRSRAGVSLSPPSQFPNPLPSNNNQLQLTLVLGEQFGEPGDLLKSSKYQLNGVCGCVAMFCQVVLKRAFQGLNQPYHQNQSKCQLFFSYPNSGPDWEHLLGILFI

SEQ ID NO: 932434 - protein, 143 aa, Homo sapiens
MISWESALRRKAESRIGQEKKLSQDVVQLRFYLSLILQEAIENEGHRRPSPSPFAFCHDCKLPEALTRSPADVGTVLVQPSEHNSSQNNGYLVEVLSVRQYEESFYAAGNILHLDLCDDCGKKKEERVKGLVYAIKDPETFIL

SEQ ID NO: 932435 - protein, 136 aa, Homo sapiens
MPSKSQVHRDDLEPGIVVAGQMTRTSVGSFTLGWAWSFSLWGLTWHWSRLKVSGHWGQLGTATSPGPGASGMAWWILLGVGTGLEAQSSGTGLESGSMKVCTVLGFTGVGSVIGPQTKSNVHFPLFFHMKIYLSVM

SEQ ID NO: 932436 - protein, 184 aa, Homo sapiens
MSVLEALHPRICRYMAGSASPGIAAFLTRTAHQFEPLYNWKHGYDTSGCPQPEFIVIPQQKSDINGTWQWIQRNIPTPNTNVIPDKMLFQTSIIPFVTSSQFLSDFNHSCAGQVHSSLKLPEATFIWEFLCSSVLEPPSKRQKPLNTQPRSIEEVKSMRDGNVPQPLVCHEDNSEMFTPQNLYW

SEQ ID NO: 932437 - protein, 141 aa, Homo sapiens [sequence omitted]

SEQ ID NO: 932438 - protein, 181 aa, Homo sapiens
MLKPKPCQVYLMFSLKQNCLLSPAKATPDTDLQTWEMLVVVRHPVLRWLIIQHYYGNSQLMHGIDKTSFIKSACSVDLNSMWWRCVWNWWVLGLADFKNEAADPRGMKLQTFPVSITALKGSTSRVVRSTRSSQWSRGLADFRSEAADLCGYICELPPHQESECYQQTRNLLKSLKIYETL

SEQ ID NO: 932439 - protein, 289 aa, Homo sapiens
MNHVLLSYPKLIPVTNFVIKKPYQTENYGRSEGRRYTFGKTEWELCPKSRRHIIRLNTEQTGINIGFQCFSNGRLQGIHSALSLPVSAPPSGRTISRRSMKLGTKLSSTTYQSQRVEEGTNVSCSRCPGEAPDTWAWGTFICTALRNCELLEMPASLAVCCGEHECVPDPEQGRHGPDFTVLGNQSVTMVTVSFWEFPEEGIIIIRNDNSVSIIAPEDLPAGQNEEVKDSDIGDSDPVKIAKISGFGTRPLGYGFQLYPLQFVCPWARYFRPVGHTFRVCEIGTTLVHK

SEQ ID NO: 932440 - protein, 143 aa, Homo sapiens [sequence omitted]

SEQ ID NO: 932441 - protein, 167 aa, Homo sapiens
MLSNRNGVCLPGTVRPNIYIEVCSGRKEGVYLQGTKQGESRQLVLKTQSPRWFSAEKECQPWLVDVTFSRIIQNETLQMGSKKAEDDKEKREITKGIEEEILGNLLLEGRKSGGIAEKCIYGAGDSVPMCSNGCSMLRWTQQEGQKEHSLEEIRHENWEKVVCIALV

SEQ ID NO: 932442 - protein, 424 aa, Homo sapiens
MPNHAQRWRRRRRRRRRRRRSQISGEEEEEEEEEKEEEEEEEEEERRRTRRRRSQISGEEEEEEEEEEEEEEEEGEGEGEGEGEGEGEEEEEEEEEEEEEEEEEEEEENTNIWSRDLSLALDIWSFERGLSVKSPGQPPFPRSGKPVHKRLPDGPCHFVPKSCSLETFRDSGPVQDKLTLKNRISRSKCVVSSFMTAKSTDQSCPPFKHALASSMNKNKPSLYPVVSPSSSCPISLFPFTLNLFKSVFYTHCLQSFTSHGLFNPLQTGFCPLAREAAILKVVDDLHAAKSIATSLASSYPTSEQHWSDGPHLPKHCPTPYDLQVMPHLPSAQDPCIRFLKALYLAGLEHSDSSRGWLLVILRSANATSLLEAMLPNVQVSNWEQELIRMVPRKEAQGSLKKQEVQWSSKEKPIPSLILPKAAFL

SEQ ID NO: 932443 - protein, 141 aa, Homo sapiens
MAYAADPKPRTWNELEEQGHLRQPQPPKIVQNRCSCWATVENASDPLTGCDLLDDVVCCCPGSSSDMKDLVGILRLLLVPQIKAAVIWGFFPNCHLKNITLGLQPDVPLSRFRERGLLPYPNNAKDVCLDIILITFRLMVA

SEQ ID NO: 932444 - protein, 148 aa, Homo sapiens
MSSFSLLSVSLSLSHFLSLFLQLLYPHFCCYVVLTVPNTSSSAGRISVPSWHKRPKKKGGHWASLIRELWFHFPSKLTFWALHDPSLAKDSYNWIAAVIFCTPKFPNSKASAIFSIAFKFPMSAALAKRLLWRLNEIIHGKCLALCVV

SEQ ID NO: 932445 - protein, 160 aa, Homo sapiens
MGHGSLLFPASTGSAEHTALSVLPLLQLAFLQAILYPPIINSINLPAAVTCTASTPDTNYFRHMFTGMCKMDLRLDMLTTELLIFLNSKPVPFLTSPRPVNGSFIHQMLRTKILSSPSASFSHTQYPSYLELYQQNLMYYTVPRNSDYFGGYEPGKKKGT

SEQ ID NO: 932446 - protein, 203 aa, Homo sapiens
MGRKAAKTTCHINNTFGPGTANERTVQWWFKKFCIGEDKSLEDEEHSGRPSEIDNDQLRAVIKADPVKTTWEVAKELNVDHSMVVRHLKQIGKMKKLDKWVPHELNEDLKNHHFNEEAPKHFPKPNLHPKMVMVTVWWSAAGLIHYSFLNPSETMTSEKYAQQIEEMHRKLQRLSQHWSTERAQFFSRTRPDRSSYNQSFKRN

SEQ ID NO: 932447 - protein, 153 aa, Homo sapiens
MVYRASEAIRQCQSSAAKPRRSGKESVREPWARVPGGSGSGCQVSWTVQFSVGSHRDGTRLTRNPRLQAFLGPMARFPALVASSWGRRFWRNAWLLRFRRLEVLVCWRCGWGLSHSGGKELQLRNILLLGCLYSIIVHLEGSRAVKHLRVAAK

SEQ ID NO: 932448 - protein, 232 aa, Homo sapiens
MGISGELVKNGDISACIFTRSPGKSQSSPQPLLQLGSRSSGTWPLDSAQCKALSQIPVRPGCGEYQEAPSPQQFPQCQGTSDTRLLAVRAPAGICSCPVLQAACGEVHDSPVWCMTAPGSQKPCTSGEASCAPANDKHSLKVEEMNEFEETLSQLPPSQLCCHGLSRLNLHTWRQLPCKDTAPGGGLASSHSGCHSALSLHSLDPITGQISVEAGTTIRQFATVWQRPPQDC

SEQ ID NO: 932449 - protein, 146 aa, Homo sapiens [sequence omitted]

SEQ ID NO: 932450 - protein, 160 aa, Homo sapiens
MAPGSAGFMHLGRVTSSTAQSPVLALQEQRPCRIRSLVPEDCKLNGQRYINRRRSTTFIDAKILRAWELLRKEMKTRTRGTNVVCLEPSIQELLGPKPGLLQNLETCPSFSQLQTLNSPAFPLGCADLEIDECTGPQEAAQSSGLLEDINLAPPFPFSGN

SEQ ID NO: 932451 - protein, 161 aa, Homo sapiens
MSLKRQNYSGNLVSVSPRNMGSSSTYLLVTFWNDSQATNASLFANDRDLISGDDRIDVAAAVPLDLEDALFSLLSPGNIAPDAAVNINDPHSSCGHNLDSFREMSGDKANFSSNLAHKISEKLLFQGLCGADTIGISCLYPVTLTIPMPAEGILLQHRYST

SEQ ID NO: 932452 - protein, 136 aa, Homo sapiens
MNSNGFGSYYVQELIVARRWKLNDHLNEIHNKPTEIVNMEDLQALRGYELFDFVSRQNSKEYLPYILGVIMAIDWYHIPKTFHLEQANKVFLKYSQNSRRKKRRREVNKKSWRAYYIFICRPGLSLQCWCNLLSCR

SEQ ID NO: 932453 - protein, 146 aa, Homo sapiens
MAASGTQLCLPPCTFPTAAAGDSGDREPGSGAAEAPGLVADPTWLCEGDGGVVSCLGDARHRGPIASTAAPAAAPAATAHTSLLQPPEQNTDTDFQGHRKEATGLASEWHLRSDRCSSTWKRRNLSEKDAVPMNIAELQFQMGHEL

SEQ ID NO: 932454 - protein, 156 aa, Homo sapiens
MVPFKLLLLIDNACGHPRALPKMYKEINTVFMPANTTSILQPMDQELILTFKPYLRNTFNKAIAAIDSNSSDGSGQTTPGFNNHSPYQPVVINTEARPFISKEIMEIMKAQMIFLSSKLFLIESENMRSKPETDTSLESSPAQPIDLRLIHGPINK

SEQ ID NO: 932455 - protein, 139 aa, Homo sapiens
MAGKEGKMELPCLIWLAPGPCPLTKFVTVLPSKNKTSPGKAILPDLVRLIHYQENSMRKTTPMIQLSPTRSLLQHVGIMGTTIQDENWEVAGDTGCEALPGTEEQGWGPTLKSSLATFSQRSCARGSTLAYDCLGLSKV

SEQ ID NO: 932456 - protein, 156 aa, Homo sapiens
MKALTTVEKRLNSLREDVVKIPLKGTKTSMGKAQDLGMHSPNLMRLSVVHFGSSALFSGLAIALRIVPGISEPNSNMSTTHLTHFRHHPKRIFEKKYFDIELLNIQIFLCLQKQWNHSQIMQPLTNGPLKFTEAAGGVKNMERFTNLHVILAQGPC

SEQ ID NO: 932457 - protein, 159 aa, Homo sapiens
MRSCVHKIGGEQISAIGRGICVLLGISLEDTQKELEHMVRKILNLRVFEDESGKHWSKSVMDKQYEILCVSQFTLQCVLKGNKPDFHLAMPTEQAEGFYNSFLEQLRKTYRPELIKAMNESSCGSPFLLIFGVVIVLDFGHSNRYVEVPHFNLHLPDDI

SEQ ID NO: 932458 - protein, 170 aa, Homo sapiens
MSALTWFFVAQTPAQGLLVTATGPGQHTLFPFLLDNARSGTSLELKSHESVTFGFSLFLPATYRPGGRGSPPQTLPEPTVSPSPEVTCSLHGQLTCKSTASYLSTCPFLLKDTLWPQAGTRPEYRAGQKCPEVKDSRSGPQSLRNETWGAKNPTLLLPTEPTEICPTQSP

SEQ ID NO: 932459 - protein, 134 aa, Homo sapiens
MQLCQCGVMKAHDVDSGVVVSTGHGVAQTWGRILALLLTCCMASGQFIQLFSLLCFCSLICPKKEVLATWSMVINRCITSIPIEPSFLLPMLPILAEIRPYCFHSILINSTILSKNISSAQCVICEFILSSNDH

SEQ ID NO: 932460 - protein, 160 aa, Homo sapiens
MHQIINNAISFVRCTLVAKLLESGKHHMSESTSGLNLSYILQPPGEVLKILVPRLHPKPVKFRYSVTLEQYLRAKPALQTLHHFWWYSRENGIWSRGLVFLFWAKHRDRLCLLCGIINGVEPKEIVGGGCSVCEVGNFMPQSSALPEPGLASVLCKLLEA

SEQ ID NO: 932461 - protein, 134 aa, Homo sapiens
MKEGTFHRGCMGKPWVPRQKPDAGAEPLQRTSTRSGLRVNVGLETPHRVPTRELHNGAMGRGPPSSRLKNGRATGNLHPVPGKDTGAQLQSMRAVMGAAPCKTTGVELPNALGAHHLHSVTWMWDIESRIMLEL

SEQ ID NO: 932462 - protein, 149 aa, Homo sapiens
MNFTKVHGSPEISGPSAAGLLELAGGPLQTLFAWVSPVEDEEQQRLLPIPSSGSFVPEGPLPAELKRPAGRFAALFRAGRQEHLSLLKLPLQLFLPPCFLSQRDGGFMYKPLTGAAAFLSEMPCPERKNLGKQSGFSGFAALWWVPHPV

SEQ ID NO: 932463 - protein, 167 aa, Homo sapiens
MPENNNNKNKDKTKTRQQQQQQRQNQNQTTTTTTKTKPKPDNNNNNKDKTKTRQHNHLPPNQPTKIKNQENRNNNNYNKKPATIPPFLPSSLLQCKQLTLLLISLTRKVFGGRGTVDRNMDVKVSPCVGVVKHPIQECSYWHQVGAPRGQRSQRMEQAPIFAILQPS

SEQ ID NO: 932464 - protein, 151 aa, Homo sapiens
MCTCILVASPAHLLHSGDVVPVSFLMSSCLSKSPEPWVTVFLPVKLEVGLNYLGMDGPQTVDKRRLHIAYFLGFPSNVCLKKRFCEKKIHSEIRSVVAWEQGVEARASRRGNSIKISCTFILPVYLLTSFHTHTRARTHTDTHTPENKVLF

SEQ ID NO: 932465 - protein, 134 aa, Homo sapiens
MRGRKWTGLQLSLSSALISQPENAFCKVTELGLAAPSVDSKVEGTQIQFCYMLTRPGLVSEWHVAVSCCPWWAQLYGDSFTDCKKGQWSWNEGPHHSTQTPPFSSRLSQPPVHTGLVVSPHHPGAAPPKGLSFT

SEQ ID NO: 932466 - protein, 152 aa, Homo sapiens
MSPLSVWTLPKLRTFQIRTWIQDISLKIICLLSKTTQKMEVRLFQDFLHAETPIPCGCTLKSKEEFLIFTSTYLCFCLNFGMGGYPPAPPGSKNRGWRIQADPAHPNCRKRSLDGRLLAASLALAVLTVAMETMKPQCDGYSLMAAESYFVQ

SEQ ID NO: 932467 - protein, 125 aa, Homo sapiens
MEGHGGLPSYGHPEETKQIMSPLSVWTLPKLRTFQIRTWIQESMMWEEGESKCCNNKIPGRITIWATQTKVRGCRKMSTRSMHSKEKTGEGGNKSEKERRSKNKIIKTKQGKEERSCDWARSPAP

SEQ ID NO: 932468 - protein, 144 aa, Homo sapiens
MPGRIFLFYSLLFLLRPFKRARALVPNRKGPQTGKEWIRDPFVNKPGELTLSVTEEGELLVIANDGGLKSMFEKTSNLHTFLIKVKAKYPEMATKALKTLLPFPTSYLWESGFSSVNADTLGVTVSITPRWDCLVAGKQAQGSR

SEQ ID NO: 932469 - protein, 179 aa, Homo sapiens
MWQTSAAGPVCSVNALTCPDLLRPYTLPWPLFDPSYCFWIFQISSHSLRFYIAGYEYANELPFIFFALLRKETQVSGYLGPDSKEFEWNTIEGVKYSVVSLTVELDCRRATDGKERARFSPILPAVVRKGLDMGIHQDLPSDLPGLLPDLPSSSSHHYHPNLTHLLRPGHFLLPLRIFL

SEQ ID NO: 932470 - protein, 142 aa, Homo sapiens
MGRYRESAHLEQKLLEPQMGRPHTFMDLHLRAQSGSIQKNEGRSPDGFSRRKGKKLKGNGEAQRQQEKQKLKYQTNLKPLTPAEWIKKQNPNNNVYQKPSFNIKIQHPCQKLIHHKSINLFLDFQLYCIDLCVYCYIHTTQY

SEQ ID NO: 932471 - protein, 162 aa, Homo sapiens [sequence omitted]

SEQ ID NO: 932472 - protein, 153 aa, Homo sapiens
MLFFLSTSLLQGLELVTGSAKNGTYFRIHINKYKMVETITCLSREPFPASNYIRLFGQHEQLLNNLCARYDENLITDLYRMMSVAVVRLFSLLCGIPSYNGHDSVMAFPVDCIYTGSSSGPLQSDVVNTVDFYNQLVKIHENPIGFDRKCIKS

SEQ ID NO: 932473 - protein, 164 aa, Homo sapiens
MGTILYVASVIFLLDITGLDRKVKKVSLLTASCEHHFKCKDECAVGPASRGALTARDDGHVKRTTIRRCVQRHGEDLLKHWRRSRCLQGKPGPGKRGGTKQAGPAGNDRWFDCSNVQSDASYLSKRSSTETSLHNHSWRFRMDSDWREEQCLKARGEITFSRIG

SEQ ID NO: 932474 - protein, 142 aa, Homo sapiens
MITCQNSSIQYELKILYNFSKVIVFGPGGWEGTELVFNGDSVSADEDEKVLEMDSEQLAHQIEDEEINPTEKPRQYLKRVFEESIYKTLVERSTLDYLHYNRYHLPMKAYMTFGKEEAVFLFQIADEEHKVTEKLGAQGVHT

SEQ ID NO: 932475 - protein, 145 aa, Homo sapiens
MGLAQGVVNAPISTLSKWTNQFSVKRTNQLSVKWINQLSVKRTNQQDVEEMTQASLPEDRKQLPGSVLSHVIETRIPLFLKWVIETRTPFPQGKPQKLERTLSDTPPLKVGHKTLFQEGSCLDLGGRNAVYTEANNMNKHFKNLK

SEQ ID NO: 932476 - protein, 158 aa, Homo sapiens
MKKAPVKVTPLTTQGWPAAVYNPPALRVTGQGCPRRVVNSQALLVPVPAGKYCSPSNLSYPCGQFRAGEPEVIKLPCGDTKNGGEEGFGLVNPESRACDKDLDAGRSFGRRSQGAGVRDRKMEGKKPIKDVSSLWTTRLSLTWGPQGNCVEHASEMPL

SEQ ID NO: 932477 - protein, 191 aa, Homo sapiens
MKKTENECPQKQKKQENRGCVQLAAGLGRKVQAVSIHSWPFNAAACGSLSHAVSLSVVILIFLPMRRETIVTSAEEFCIRVKMRPSGRSSRELAKAQATAQVTAGSLGQKFSRPLEDVDVPLPPAVGAWDCQVSCSCLCLSISHQSISPRRAHQKLLSEALPPLIPMSSGHEGGFQNMNCATTKLRSGGWD

SEQ ID NO: 932478 - protein, 151 aa, Homo sapiens [sequence omitted]

SEQ ID NO: 932479 - protein, 139 aa, Homo sapiens
MMIHFIKCVRLTFLRITLDQDMSIPVFVLLFIFPGQDQLPLMLLKSGANAGDSCHPGSMRMFEDKMELCIRKSTVTMCQALCCDLHSPSWDKDCHVQAADKAQMPTAHTRIQTNLCFSKGFGLKHYSVLLRSKKRKDHD

SEQ ID NO: 932480 - protein, 181 aa, Homo sapiens
MAGQARPKLGLSPGRFLSLLRKEFKSEPVVEENSCIEMAIFMRVRVKRPPNRLCVSNMAVYFTWVQITTCPLIDPDKSTGSKCYKLVSYNFQTINTHESRRKITSEKSTEMKEEMKVLYTFYDLEQELFPNTVTLRGTGTWALTYEFWENTNQPTTAECLQTTNILTQDVLAGRLTTGLTT

SEQ ID NO: 932481 - protein, 157 aa, Homo sapiens
MTVLPGLQMDLGWPGAAFCLAFHRLLGKFPHPLDSNGPGYTLVDQWPWTLVSLKDLVSNLSQRSWMGPKERNPELKQSLHSRLERFKVEGAQTVPWGKAKKLLCRLNKIVCALILSGSEEILTVTSEHKRWKKLEILPEAQQMLMPCFFYSQQNRVK

SEQ ID NO: 932482 - protein, 151 aa, Homo sapiens
MFPFTQWVFLSSGRRKTYQWFLNMIGKTTCRERVGPLLSASGACFPESKEGYKYSILQVMQQNSSHGRWNSKGAPEVPALLCTHRYEPFPSANMTGYHFCDWVTYQLTLRPNGREPEHRFEGEMSPWPETCVLQPQGNGFHQQLVSLVLRT

SEQ ID NO: 932483 - protein, 164 aa, Homo sapiens
MIMVSLLIFGSKRRWCVPRASRFCFSDGPMVGGDIWECLETWVIKTEKGAFGIEWVEDGDTAQHPTVHRTAPTATSYPAQTVNGAGACCTESQLLRQQVLPRKKALIGCCSQGNLSLKSVSLTNYNWGIYIIGSIPNFNVSDNKQLISSDHYYFVSLTRSPMST

SEQ ID NO: 932484 - protein, 216 aa, Homo sapiens
MPLGLLPPSDQFMELIMVIDSDADGLAWEVMDGTGKVALPGRQPHAPWRCRGRSPSTTLRAACGLQSATGMLPLQQQQLDLLDLSHGHLGIIACCTVEATGAETWNARRWGCWYKLWDCMLLSRACLNGSRTSSPSDRRSPLRPTLLINKMPMLVLCPGPVTLWTISVFICGRVDQANRNHQCGMKFDLNWSHMENAASGLGVDGEALSTMREKPI

SEQ ID NO: 932485 - protein, 135 aa, Homo sapiens
MRVCPAAPLSQTFDVGSAVLDPQFPQLPSTSSFSFSKSWAAWVQLYGICTRYLLSVNCVIKFDGGLWLQILCMAVYFTEANDSPKVLEICELQNSTALPNHFFVFIPPRVFDYFRLAFKCQVLTMFLKNTFECNY

SEQ ID NO: 932486 - protein, 179 aa, Homo sapiens
MAPRGRLFLGDAEAVASQHSQSHMDDPWQLDPRSHASPSGVASMAASSSQWLINNCQKQGSSITVIYFSLSVCSGRKLLAREKSGNGPDASCPFRSAVDSSVVSGKLFSHMCLKCLFGQSRKHKESFWDSDGQTDSLVCCFFGVALSNPIKEIACRQFSGRTWPGAIEEKDFEKTIFGA

SEQ ID NO: 932487 - protein, 150 aa, Homo sapiens
MLEAKGPGNNPVTSWELAALNSLSFLIVRPLQAEKSQTCLSVPQTDERPTWVRWNSIVVVFTHNDKRPEKREAGPCAPPDMSLLCERAGLGDRITREFQVLSLFLTYRNHSIPFGNAKCESCYTAFQKWVSWIKVYQVKSLPICHPHKNA

SEQ ID NO: 932488 - protein, 161 aa, Homo sapiens
MHQTVASAQSRLGGRWLKGYPENSRKQPDLEKAGTEEPSETKADTDFMSVNQDNACKHLRTVPGTQSGLSGCQIIRFREAAVHFHMPQRKIPLPAITTSTVGCCSMSKSMSKPHVTSCLPMAAPKESKSALPVAGPQHSHCPTHLSILRQLGDFPNHAYHR

SEQ ID NO: 932489 - protein, 139 aa, Homo sapiens
MIAYVQYSIQDIQGHLYNTWFFVCYGFTEFRIKGRPRFRGSKSYMIWRRGETKSEADNLQYPSGSFLLPKGKQKCRDSTFHEAFHRKYSSPPSLSRFRGSTIHVAGNPWDDTARVSEVKAERHYSWYQKYFADYLNDLL

SEQ ID NO: 932490 - protein, 136 aa, Homo sapiens
MDCFENKRAAIFAKTFKRLLRSRKRSAQGTDHLLHDANRLVTVRTQVRQSERGQWGMSDCARNRLQKSIFNPTRMLGNSEDRLEVSPLPALENQLGARGPPPCFLWKKHTVRVHRSPGISCHTRAVRSPISKPSDA

SEQ ID NO: 932491 - protein, 136 aa, Homo sapiens
MVLENYKHDSAATVGRNCHCWVEAALLERCWEEEEVLRRNGRAPLPPDLRPHSSVPLPGASGQAQLQFAESQCWHHKAGYRKVGLEPRENHLIMALLPAPAGISPYLIKAITQSSSEINSTRHATFSLDIGISVGQ

SEQ ID NO: 932492 - protein, 228 aa, Homo sapiens
MECTCTNLDGRTCYTPRLCGISLLLLDYTLGQHVAVPNTVGSCNTTVFFEKEFSSQVNLREGGLIEVKHYFTAGLFRAFNLLNACDIPSGAVSEDCLRKFHTRHCKKCWGLGGKTSLGLRGIACCYSFGTQPGPWAVAWASLLEDERPWGAEMSQSSGPPRNVCLGDGTDEEMKASGCRFSGPDRRSRDLCFLLGIRKPHSPCLQRRCRSPLWGRGEEAKKVSFSSSP

SEQ ID NO: 932493 - protein, 163 aa, Homo sapiens
MGLGCGVLTLCVVFFTSSMVVEETCNHESCWDPFATLHDADHTERRREKQNPEALTFLLGPRLVQSWESDSKEEAWGHCPMCRKPPCLPQHATPEERRRTHVERNLIQGTEENPHKNQSFPESSQQSSEFALSHFGQDCVTNHYSPLVWHILSEIKDLPSRPE

SEQ ID NO: 932494 - protein, 178 aa, Homo sapiens
MGPSVISRVCGNIPTQSPQIQTRSALFPWPMLPFFVLPTGVVWTAHKCGGQFWSLYPSTGMRNEGLELFFQSIFSDPLSDFNLTSLTRKFMGDLYDYSHVGRTFRKCVAKSMEAKATKKSLESMAAFAKTVALLSFGHPQAALQHSPEALRSPEYHLISSLGSQTNTAFLVKEIMSPL

SEQ ID NO: 932495 - protein, 175 aa, Homo sapiens
MIIDKVDQTAPLCEYSLDRMSGYLRSEAGSEDRGPFAHLFLAQSLGSFYQQWDEEQATCTVGDAELIGAGVCTSPFSFRMSYKLYLVKPWGPALPTALVDAVNQVPAVQITYVFVTRTLVKIWKVKAILMRTQMELRNKVLETEVKENPCCKVAKALAELYTGPRVLCNAKLKEY

SEQ ID NO: 932496 - protein, 139 aa, Homo sapiens
MIESKVNCSEGGARGAKGECMWGSLSPRSLCPPSQAQWEHRERLPCAGAKIMDEAMRNRKKRLAHPGFSPPPSSQSPASASHWLNLPGSESARPPGKCGASLLLCRLINYTSPLFLVSGASIWESDPLASEDQGERGQT

SEQ ID NO: 932497 - protein, 338 aa, Homo sapiens
MSQNFGVIGLRHHFAIHYLVGGGLLDGLHGAAAVQGITNIEVLAIFQQAAVGGDLSLQLDLDVQQGLLLLGLALSLCPELVIWACRPFISSLWFFFMKSSSSLRALICLQLQPSDIRVINDLAEPMEVALYRLEHGQLCLILDSKVISSKMGIVNLQNDVGIVHSICKDLSPQVLYGLEVMPPVSDLGSLLLQLLTDFALQPLVLGLQAPHSVQVGDQVVIQALPGLLLVLDAFHSCQTLSHPHSQSSGHHAAPEAGGVGHGDQGTRGPSTFIDAGLAADQPGTIAWHLDRAQGPVVGGEGGASGEAHAVRGGEREDRTQALLTILILRLYGKAKDRE

SEQ ID NO: 932498 - protein, 148 aa, Homo sapiens
MALPGKVSRTKASGTAEGRRISRGKSLQGSSSSNSRELASRTLELLSSSLRMASDRDTQVLATACANTREPMCMKVTRSFMFLSNGDPSSSDVGAGFSKEGQRGKEEGQEGAEQEQVRAAVWLYPDPWGSFGTNCTTVSPCEGLAFVP

SEQ ID NO: 932499 - protein, 136 aa, Homo sapiens
MRRLTEHVLGASTSFHSSCDFIPHSETEQESLENSCNLPEAELAREAIIEEAELSTMESPQQQTLPQCCGRFSCDGCQSTCSLPPAVTPETSPDAAQGPLEGKTTLRENCFRLWLSKECTSGENPNCKTHSVISLK

SEQ ID NO: 932500 - protein, 153 aa, Homo sapiens
MEDCACGKPRESGSWNGCSFVVKSLNCGFRFQHKHRHGQLEDSEEAAGGDGKVQGLWGTDDNVALHHQGAGWASSYGKPGQPLDEELTGENERVLTCIPTTDSRIVYTWTMSTLLNVTREETVLRVEMRFLGPLLMNKVSMDLEMMPLSLDYR

SEQ ID NO: 932501 - protein, 141 aa, Homo sapiens
MSRLKAILQSRGMNDLQPTVEISDRMESFYGFLLGLSWQVGGTKKGLTEERDASKVGCRHIELSEDMSLFLQVNLGGCGPGSHGGVRATIHSHIGQGRLEPGLLGSVNKSSFLTGHLEAAFNNSDQMSEHILTHVPYFPSQ

SEQ ID NO: 932502 - protein, 163 aa, Homo sapiens
MRWQRAHWQSDILKVIMQEYLDIRPVTSSSPQQQELNFLRRLTCASHVPSHACSPSPGGQWNPQWDIHRDIARAAALEEVKRPASLVQGKSGIKETEGRGFLRCAGEELSVQLYACELGTVVSTGSSLMGTKMLQKAASGASFCGKHSLRWNCPGTVQGLGTS

SEQ ID NO: 932503 - protein, 171 aa, Homo sapiens
MALILESELDEKRGSDLRSCHSSWEGRAPKCAHRSTNLAPGEQKQKLVLQHYFYETTLNTLPPTKVVGYSILLAAQPASPQTSGVAAHRRPRQIGIMEPLHQDPSAPSLSPSTLRESFTLLECPCIFKGVSMKNKAIDIDKEAVMSTDLMGKAKLSAVFVQKYRNFQEDLL

SEQ ID NO: 932504 - protein, 137 aa, Homo sapiens
MDLKIPVEYLLRSPDKSKTNCLTFHFQAGALSRQVLPVGFPLKLYTVIGACILTGDVLQKNAEVIVGGLHRCLLGVGDASKVVNGLPAQTSSLEPPDGSRGTVSKHCAVQKDSVSSGPQHQFLGLDDPQVWFRVPSS

SEQ ID NO: 932505 - protein, 145 aa, Homo sapiens
MASSPQALGMSRGAIWEPRTRGVLPDYRQCSFKAQGLFSQLVVNAAWPGTHPSGQWASLWPRIGLEMLFTSKVLELGTPKNHLMLHPTVAVLVPNVQDKDLEIGARSLRLAPWIYLPPQVLCSPAPLGVGFLSITLVVYPGQGQP

SEQ ID NO: 932506 - protein, 179 aa, Homo sapiens
MPLVLSLQPWRHRALRGAVEDSLRKEGCLTPREKRGNYKWSLTYNGSISKFLLSDGVQVIHSAKTMLPVPIQPFFYFQWFKGTETGQELIYSSKGGHFPKIACISDITKRNNTDFSMCITSITRANTGTYNCVKFWKGGPDMELKSGPGTELSVHSEYSVGLLRPPVCDNKSIVTPSIH

SEQ ID NO: 932507 - protein, 218 aa, Homo sapiens
MAACAQTPSFIQPDNIIEHLLCAMCLLRAENRKLTRTYPQEAHSLLRKTINTGTKQQLRVTRKTINIGTKQQLRVTRKTVNTGTKQQRRVTRKTVNTGTKQQRRVTRKTINIGTKQQLRVTRKIVNTGTKQQRRVTRKTINIGTKQQLRVTRKTINIGTKQQLRVTRKTINIGTKQQLRVTRKTINTGTKQQLRVTRKTINIGTKQQLRVTRWRNRLG

SEQ ID NO: 932508 - protein, 144 aa, Homo sapiens
MGKSLYLSGPISLSMKIPQDRKPFSQTGECQLISCAETNHRSEGDGAWVIDCIKFSLLEHRAGQREAHMDTGEGKALFHRYSYSYFTDVEIGAEKLENLLKITQVPLRLVAPDNRRVSAAESILAQGFNLPMVARIRRLTDIGA

SEQ ID NO: 932509 - protein, 163 aa, Homo sapiens
MLRFGIQLSPSSRRTCNRNTLSIFDEARRTSLALQHCKGRQKLCWGMVNNLAEWKKVNPAAFEGASIEEHPIHPRMPESLRNWQNQTLRRWRESRMLKTRGLTESLCGGILTLCSHARLSPEATGDLISGKFESGSRFSSHKESIDSGCDIGERWEGAEQHRG

SEQ ID NO: 932510 - protein, 128 aa, Homo sapiens
MAKSQPDLRASGRLCDTWTLWDTSGKMTIQEAVSCREIANRPGHHLYPLPSSGGDVVRLWVPRNRPGRQKAEEKSEAQASENPNQATCSGLNMGQNPTPRGRAGLGLHCLLQCTVGVKNEGSGARTGN

SEQ ID NO: 932511 - protein, 168 aa, Homo sapiens
MSMCRYPFASVSLENIDDYTAGDSPAERGEWWYMGGGVIAIFRKRTATQRGEVLIKPSQRTKSLHHCFRARGKDSSLFLLQQYPDFTSSVLVVVVVSGLLSLPLSVQNFSLMSNMKRGQSGSQYSQTDKSRSYLPFGLSPQMSLIHFGASDRELTYPTGPIYLCYREV

SEQ ID NO: 932512 - protein, 145 aa, Homo sapiens
MPYSASGGESLSEEELAQILEQVEEKKKLIATMRSKPWPMAKKLTELRGLLQRGQHSGSPMRAKAAVLFASTTGPRGGAMEDSEDSRPPNTTDKTTAPIANPGSKGKWGSLDTHLCQAKARCPNTPNQGVPEEAEWEAGIFIPSR

SEQ ID NO: 932513 - protein, 163 aa, Homo sapiens
MWTLQWYLNWTVCFLFAFPESPRMKAPSTESLHLAPGKARGTQQKPMREASGPKPCKATGVALPKALRAHPSYQCALDVGHGVKGDYFGALRFNDCPSGFQTCMGTVAHFFCPISPFWKGIIYPMPVPPQYLGNNTIDFQQGYQDNSMGKKIVCSTNGAETSE

SEQ ID NO: 932514 - protein, 148 aa, Homo sapiens
MITECRGRRHSVKAYSETRNPLQGVYLGAIISVSIFYGWPKTILLPMWPRKAKKSDTPDLHVLLLRCPAKDSPSVGHNDGLTQRKTHDPNIATAFWSIDMDSGKKQSIKDEKNLGPLEGSMRDCSENEANKHSSRQAPNGGSEISPSG

SEQ ID NO: 932515 - protein, 166 aa, Homo sapiens
MVVKAVSSEGFTSSDVGPRAELGLSEDSPQPRTGPSRIAKTPQSSNCCICTRSFLAGHHFDKFCQQQQCHSWHLYGSRLNRHTPCSPAGWTFMSREVSSNKSTDASSTCLFASPPLPATCQATGNRDPVTGGQCGGRTAVSQSPCTKPTAPWQDKEADIQMWRNNA

SEQ ID NO: 932516 - protein, 139 aa, Homo sapiens
MRFGDKRPNYSRDDTFTQITAPLAVRSWSPLCCVGPCLVLEEQEVEWKTMLDVKGGILVHLSWTTDAFLFSTRAMAMATGNPGLQRHWSIDTLGVDMPSVDALQCYPGKQMIWAIWWPHWYCAALCLAGHVLWAGHETK

SEQ ID NO: 932517 - protein, 172 aa, Homo sapiens
MSRLPVGAETWVWGDSSAGPYREGWGSKHPLPVGSLQASPTQQPGVRQPQVALQVTEVESGVGQMLDRAVHGELYGPLNVSVLGPRPGSGIHRNPSTTNRALSTLARAEVVQDRGQFCQWKPPAAVGPRADLLLVLLLVLPRAPPSWFAQRPPGTLGWWERQHKHERLTGRT

SEQ ID NO: 932518 - protein, 144 aa, Homo sapiens
MPDDAGSEASRVKTGLCAGNTEAGPKQEIPTRFAENNTREGAAGSALLFLTSPSPWRSLSACWLHLVLHHGQLWAEENKHTKRATGREQGRMKHVISNGDSVLSSVGKLVLKLGHCGERNEWSRRYSTSQDYHVFTSKERELQG

SEQ ID NO: 932519 - protein, 197 aa, Homo sapiens
MESLLENPVRAVLCLKELTAIVQKQQSLIHTQRERIDELERRLDELSTENRSLWEHQQLLQAQPPPGLVPPSSAPLPAAPATAPAAAARAQEPLQDQGQRSAAAPHPAPDRPPRQHHGQLLEQPQRGPGSRAHTPQSPQKHLGTQGAVTDKEKERPPSCCAAAGALLQHKSPSALGKGSRRGAREHPIKPMEDSGMA

SEQ ID NO: 932520 - protein, 194 aa, Homo sapiens
MVISQVWGLVLLCGPQLLEATGAPISGRCVVQRFQTSLDNIGKLCSIDPILKKIKHDTAVYALIPVTYSFKDKKFAHNPECTWSCTCLRFFERLTLRGQLDGFDSSSAIERGCKPVRRQMESMKCRLDSEGKGCPPAAPWQLQTPAETTVYGGGDFPPLYPTWGGLWVFAGRAVQSILYALPAAASAATLNFPS

SEQ ID NO: 932521 - protein, 144 aa, Homo sapiens
MVGLVLLGLGLALAVIVLAVVLSRHQAPFDPQAFAHAAVAADSKVCSNIVGSWEWKRAWGWPQLLLRNRGHWMLGPWPGWLEASGRGLLQHHPGQDSSLQRTLATLPQGLLGPPEAHVPASISPLSPGFTLGILLQLEPLGASS

SEQ ID NO: 932522 - protein, 168 aa, Homo sapiens
MKGVINLASSSCGPGGLWLGAWMAVSLSCHSGGSAGRASSQEMSLEYGGDSGSGSLKSQTEKHSGCLSEEKSYQCQNSTGFLTFLKLYNNTSINLFAVQGVRKSIAGSILERVEEGAAAGIGHYTVVIERKTKALCTDSHTGSTRPLKNGSGKFTWAAVWKEKQIPVH

SEQ ID NO: 932523 - protein, 142 aa, Homo sapiens
MLAFPNFLIMALLSHPGWSAVKTRERFHLGPSSRDGPAAMRPFIIGSVMRRNNALRAFHKLFFRVVAAEVISQGTLNPDSSNVFASREDCRDSHTGSLWESGGLQVTLTPEQTWNSVECSRRCFHFLVFHLNRCFIYPLLLT

SEQ ID NO: 932524 - protein, 151 aa, Homo sapiens
MSLEYGGDSGSGSLKSQTEKHSGCLSEEKSYQCQNSTGFLTFLKLYNNTSINLFAVQGVRKSIAGSILERVEEGAAAGIGHYTVVIERKTKALCTDSHTEQNIRRNCHDIRFGSYFLDMTPKPRQQRKIDKLDLFKIKDFCASKYTTKKAI

SEQ ID NO: 932525 - protein, 239 aa, Homo sapiens
MCPVCHWEAWVEIRFQAHLWDIPQGQAFAAWAPSTTPFMDVEKCSLSWQLQVVSLPLFIPLPHSPALASLIPALNFPSQFCLRSVFSLGHCGLTMFQDQAQDEIESPLTSAHEHIYTYMSQDKKKSLSQPLNLGIPVAAFDEWTVGDNELGRLLSPSIGYSPHLHSLATLRPQCCGESWISVLEDERLLGHTEPVWPWAGWAGEEALAEVQVITDKGLNWDGGGNGRRGPRRGCVEQDC

SEQ ID NO: 932526 - protein, 155 aa, Homo sapiens
MVISQTGAQDPGTGSFHSLFLGPLALGALNCHVRSLATLLIRPHRETPRQPEEGEEASCVYLPTSPPKCQINWELWDTNGIQGLLHLKQEAEPLCPRISQSWSQEDSGGVRNSRGHFQAQGNAQGQIQKTPSCVWTLASAECVRLLGKLCCFQAV

SEQ ID NO: 932527 - protein, 200 aa, Homo sapiens
MHCCFNKSWYSWTGLTSWHRPSSGDRLCHQQLFGHRLRKAKLSFMELQNALSTIMIFHTTLLLIKELTSQPMKCGQGPTLMEIAILKQLCYRTLKSSFEDWLPCQLGGNTFQGWNKVLQEAVYALNWHSIKGAVSSIAKIHRSRNSGVGVEEVPFTIIPSDPPAKCLLPVPTTLFSAGPGGLVPRRRIFPLGDTMVFPLN

SEQ ID NO: 932528 - protein, 152 aa, Homo sapiens
MSCKGHELILFYGCIVFRGAYVTRDFYFPLQCLLAASSGEKEPCVLREGRRAGKPDTVMVPLPFTREEPSQPCHHLLKALPFNLITWAMKFQHLNFGRNAFKPQQTHYPISKEPGIRQVHRTGMDKRPEPWGQGKSKLCDLEQLPCSSSFMS

SEQ ID NO: 932529 - protein, 137 aa, Homo sapiens
MQSRTELYIFERDPSTFNSWGFLRKARFSQYRSMVLPLFFPRSAKLLEVLLSPLLCASRVARQKQRKIIQSTEKKEKKSFFQKNKIQEEKKTNHKRAFKYRRQRPRENTVTWLQDQVHKDINKMETSSRFFVCFRDL

SEQ ID NO: 932530 - protein, 152 aa, Homo sapiens
MFTKQGDYGIPKAQVCVLQKQRVGRAFLSPVAGLLHPGGHENCEVHKEAAVAKCIIMRGNGLDKGIIESSASPRPRLGEWDGVDCRPEPLHDANIAKVARGQGGQVAHGAGGVAESGGSSALIPDSHDKHRLHRSGKHADPAAPPFKGAQLL

SEQ ID NO: 932531 - protein, 346 aa, Homo sapiens
MSFFTLRYYYAASWKHGPNPEVLMECAVGDPGAWAHAGSLSSVLMKWGWEVPQRLQEMEEKVARAGPTAELGLLVGVEGGFMWLRLRAGWTSTERSHSKGLLSMGSAARPGADLLVSAPTVSTKNCPAETMGVVLSNTNRDRQGRAYSITRWQIHTEVNLSGLRHYRGTAAEPAQMCGVCSSSCGCGQGMWGCDLAVPVCMLGAMDYTAGDGEAQAITRPGSDSLASVACFLAVPLLLGWKATSENLDPGVVPASTMGTKFSVFQPGLLITPITARGDPPPNLLNSEWLWSGHEVRDGDHSSSSVFEKPAQRAPSHLSVSSQHKLVAVEQGCALYTQETWAPVEVS

SEQ ID NO: 932532 - protein, 148 aa, Homo sapiens
MARGTAQALCSPWRICLRAFPALWGRPHKHPLADYKWELEGVQQTPPGESTTGGQALCRTNIGGRGNTTLLVEAPRPLSCPLTSLEPLITPWTQAAWTEGALQQGPWVCCTSILSRCLSPASSSDPQDNTVGPEETPTKNLGKQKEER

SEQ ID NO: 932533 - protein, 136 aa, Homo sapiens
MLGFNCCFQITPMPSAFWRLCFQVRGLSPVSFCCSHTIWLGAPVATLGVESESLDPEFNGALNKRNLGGWGVARAGMGKALSQTVEYALANAPGEEAWREVPGDADFLSPGRGLTSCISNKFSDNVNVSGGLRAMR

SEQ ID NO: 932534 - protein, 143 aa, Homo sapiens
MPFKKTKPVKHYVKLHMAGVSGWRQSRGALLIPRSRQAAATVVRAALPSSSGRPHAPAVSRPSYPDPGGQSGSLGAFLKVQPDLLAVPSAPRHSHASGPLDVRFAWSTLHPVICLANVLGTFSLAHPTLQSLPSPAHTQDPCI

SEQ ID NO: 932535 - protein, 251 aa, Homo sapiens
MRLLAASSLLPSTYACHTSGSLQDLVSTEDMEGQGALEKVLREPVSHLTLSSTVFPSLEPSLTTEASLTAPKPPSEALEPLPVHHVTLPSSAGHYPVPCCTPTPHTVLLQGRGMEGKYPCECGEWIFNGILSSCELPHRRPLQKLGKGIPGFYKEEPGILCLPSLQEASSNTSESHWPAEASALRHRGVRLGCLSGYLAPDQDTFESRNTAISHSAGAAGTNKDCPEKLVLSEPGALEKPSTARKLSPPFL

SEQ ID NO: 932536 - protein, 154 aa, Homo sapiens
MLHLEKLTNSIIYTFYAPKLNNLKFMLVNILKRKAQKNSHVKRAASGTQKPTQQVHVARELETHTLRFSGSRSAAPCFPWLWRGFVEPCLSCLQIGNPWAPRYWHHAGHGTGNKAGNPEQQAFMSDWGCLHGFQPPPCKPTGDPSCNPDQLCSA

SEQ ID NO: 932537 - protein, 129 aa, Homo sapiens
MWAEPNKGIKAGHPSQQCETTNPPEGTNNFGCSTFKSYNTHCEGRECGGTGKSPLFVGHCGNPNRKVISLLFVKEWTIVTSAASLISSCFVPWNMDKGFSAQGCRASLAPCGGSVSFILRLKVQSKDKA

SEQ ID NO: 932538 - protein, 130 aa, Homo sapiens
MTHAQPVPAWSAVHDFSTAVQGPQGVTALPLDQPCSGQSPPQLQYCHCVKADPTAGGPGWPFCCAHSFWPLATAAGNESGAATLEKSLAVPQEVKPIQQSTPTYTSKRIENVHLHKTLYMNVHSSIVHNI

SEQ ID NO: 932539 - protein, 266 aa, Homo sapiens
MVTGKSGHSDQFPYIDTWLQLVLDPPQWLKGQAAAVLVAKGQIAKEGSRSTCQGKSTPEVLFNPTSEDPLQEMAPVIPVVPSPYQRKRLPTLEPTVLAPPQNKHILRPPRVNKRGVEASGETPPLAAHLRPKTGIQMLLREQQYTGIDEDGHVVERHVFAYQPFTSADLLNWKNNTPSYTEKPQALTDLLQTIIQTHNPTWADCHQLLMFLFNTDVRWRVLQAATKWLEERALADYQNPQEYVRTQLPGTEPQWDPNEREDMQRLN

SEQ ID NO: 932540 - protein, 152 aa, Homo sapiens
MELTGSKDAATSLDLSTGKKKRFNWTYRSTWLRRPENHGRRRKALLTWQQQEKIRKMQKQKPLIKPSDLMRLIHYHENSIGETTPVIQIISHQVPPTTHGNYGNTIQDYEVENFQTIERGMRKETTEKNIKHDYRPLQKDRRYRKQVSQESG

SEQ ID NO: 932541 - protein, 285 aa, Homo sapiens
MDRVDREIAKVEQQILKLKKKQLQYMGLLALSTFLLSHDGPQFNETFCGSIMVSRGIIWSMYQRYPKYLYFNMLPPLLFLQDFHNCGCDDDDDGDGESGDNDSDSHVEDDGEDSDSDNVGDGEESDSEGGGDDSDSYAEDDDDDGENVEGEHGDGDDKDGDGDDEVIMMVMRMVMVKVVIMIVIVMLRMMMIMVRMVKVSMVMVMVRMVMVKMVVVIMKMMVMVRMVMVKVVIDTDSYGEDAAADAGENGEGETDDNEDGDGEYGDGDGAPLDLAIRHLRIVHFF

SEQ ID NO: 932542 - protein, 191 aa, Homo sapiens
MSLEKLRALNISPCKQPRGHLVRIMPNLLYPCSINGFTIVDATKNIHDSPEEVKITALIGVWKKFIPTLINDFEGFKTLAEEVTTVVVKIAREVVLQVEPEDDFPRGSGKLSRTVHLKHEPRAFAHLSHTAIDLGKRTTALNPALEKVPLCLGTQAPGQMCLTLHGLFPGSISKCKLCLSKWCPRLCCLKG

SEQ ID NO: 932543 - protein, 188 aa, Homo sapiens
MVSCALCLQEEMHCVLTWQKVEGQNRGSPLHPVLVDLLNDFDKNADSVLNNKVQAEVVSDGDEELVVNWSKEPLYRVLTGELPSGAVRRGPLSSRPQNGRFTDSLHHEPGKAMDTQHQSMKTATRWTIPYKATGAELHKAVGAHLLYQHDHDVKQGVKGDHFGALKFDYLAGFWTCMGPSKCLIFFNG

SEQ ID NO: 932544 - protein, 147 aa, Homo sapiens
MSNCQIKGCTITIPIFTITILIIIISLTLTILTSISSSILTLTISIYHHLHYHHPHHHHHLHYHHHHPDHHHHYHLIITILTITITTLTFTFLTILIIILSITITIIITTFTITFLIITIIITLASPSLSSPSPCSPSPFSPSSSSA

SEQ ID NO: 932545 - protein, 164 aa, Homo sapiens
MADVGIKEPTRMHGQGLVHRAAGINKWKPPSHLICVAPGALLPHIQSALSQQEGFHRSYPEINPPPLQPCPYLRNLAYPCVGDSLGPMQAPSTILTPSDSRALGTIWTSTVFTLKWTQGRGHAGSELCVGRGTVSGGPERHLLKLRIQGGGPLAKIDGYDSFVQ

SEQ ID NO: 932546 - protein, 172 aa, Homo sapiens
MHNCLGMQPKNQACYKQQPSGTELTCYDLLQEPRSSQICELPWLKLVRGVLKGVQFYSQRPLGWVVPSPASRGQHKPVNRQSPLRGRVLAGPEHWDEGHHLDLAHGEAAGHSEAQMQSLTLRPIPATEIWGCSYLRLLANPSQPISPGLFSSFLICLLESPAHCISLLETLR

SEQ ID NO: 932547 - protein, 135 aa, Homo sapiens
MNTFPRGNIVDNWSFLFELKHEWEEGTSHKKIRKNIARKGNSKHKCPEDLILTNNFQKVWIWIWISMIKYIKSWALDLVGCPLPADLNDKGRGVQSECEGCTRGQLRECEPQARHSPSPISSAVASDLQLHFGLP

SEQ ID NO: 932548 - protein, 132 aa, Homo sapiens
MVVATVGEGENGEIFVTGYQVSVMQRKEEEGEGEGRRKKKKEQEGKGRGRGRRREEGEEGQEGEEEGEKEKKERRRREEGEKKESRRRAEGEEEGEKERRRRRRERRRRRERRRREEEGEKKERRRRGGGAG

SEQ ID NO: 932549 - protein, 691 aa, Homo sapiens
MLSKAQFSFLMVVENTSGKSQRPTQGPQHSTWVSLLVIQHPRALQLAGSESFQDWVFSFKAVGSLVAQGVSRNVILELGPEKGASRLSLAPYPAVAELISKMQDKVLPTFPSSLLKEKECVSFRATSCAAWGSGVHVQICHLGEFRVMGVWCTDCFITQISGLKWKWRKDGGPSAHAHRHPDQQAARLACGQKWMKEWQEIIALYEKDNTYLVELSSLLVWNVNYEIPSLKKQIAKCQQLQQEYSCKEEECQAGAAEMGEQFYHSCKQYGIMGENTRGELLALVKDLPSQLAETGAAAQQSLGEAIEVYQASVGFVCDSPTEQVLPMLWFVQKRGNSTVYEWRTGTEPSVVERPHLEELPEQVAEDAIDWGDFGVEAGDDAVALQITVVEAGIQAPEGVARGPDALTLLEYTETQNQFLDELMELEIFLAQRAVELSEKADVLSVSQFQLAPVILQGQTKEKMVIMVSVLEDLIGKLTSLQLQHLFMNLASPRYVDRVTEFLQQNLKQSQLLALKKELMVQKQQEALEEQEALEPKLDLLLEKTKELQKLIEADISKRRMGVPCHAPLQILLHQTLWAPHRLKFCLYHFSKQLSLPAQVSVVVEGSPAGIPEACGERLLAYRSLWIQAQGLPSDRSAPAAPDSRTVPGFRPTLSKIGPHTPRLWAHPGAGLETLASGTRPVNMDTVLRPAE

SEQ ID NO: 932550 - protein, 135 aa, Homo sapiens
MSLSQYTGCVGPSVPWGVGCCVVSDAGSVVVPLGLASTMMLQPFEWVWVDIGKLWLHESLLTLNLSCGLLVVLVALVFDEWHPWSGHVAEACSTVMVASFPKQFSSSASWRKEGCAAASLKGSPVGMTIVNLCGK

SEQ ID NO: 932551 - protein, 154 aa, Homo sapiens
MGTIWKMAALLGSILGVKWCLTPRDPELKELALRMAHYQVGMVQWRLNLRDGGMQMLLTPRVGSTLAVVLASRWHKEFVPFKSIPLQSIPFDSIPFESIPLGCIPFKSIPFESILFESIPLEYIPFQAILLESISFQCIAFNSIPFESIPFHSI

SEQ ID NO: 932552 - protein, 154 aa, Homo sapiens
MLLNGGISGTERSVWSNDRNCPRGYGEDEEGVESLCDACPPWKLDIAVITVVTRNDPHFTDEKTEACSHRDFPIVIHQMLPDFPEQQMNESSQLTNGCRKGGRMKLHSGKLAFACAVTIRSVDQVAALLAELPGDWLCQRRIVLEQAKWENETL

SEQ ID NO: 932553 - protein, 483 aa, Homo sapiens
MHGLHFGPCGTMEASLSLCARARASADRPPYPETSWTSSCTKRNAISSSCSSTGGLPGLKRRRGPASSHSQLTLSSSKTVGEDRLQAVSSGHTQCEKAADIAPGQTLTLRNDSSISEASRPSIHKFPLLPCRRGEPLMLPPPLELGYRVTVEDLDREKEAAFQRINSALQVEDKAISDCRLSRPSHTLSSLATGTSGLPAVSKAPSMDAQQERHKSQDCLGLLAPLAPAAEVPSTAPMSGKKHRPPGPLFSSSDPLPATSSHSQDSAQVTSLIPAPFPAASMDAGMRRTSPGTSAPAAAAAPPPSTLNPTLGSLLEWIEALHISGPQPQLQQVPRGQNQRSQTSRTSSCPKRKAISSSYSSTGGLPERKRRRGPASSHCQLTLSSSNTLGELLKPRREAADNTHGPCGGGGKAGLSSNTKSRTRQKPPKTEGLMPERWPQAFACIAEGEPGPPPGERCVPQPHTGFATTQAFEAGGGDFRTHS

SEQ ID NO: 932554 - protein, 260 aa, Homo sapiens
MASEGASLQPCQLPCGVEPTRAQKSITGFGNLHLDFRGCMEMPGCPSRRLLQGQHLMVNAVQKGNMVSEPPHRVLTGAPPSEAVRRGPPSSRPQNDRSTYSLHHVLGKATDTQHQPVNAAGREAVPCKATGMELPNMMGTHLLCQHDLDVRHGVKGYHFGALRFDCLAGFWTCMGPEAQEERKGSRRGRAAEEESEALPWLPSCLLRLNNGCTSLKPQLLRSSLLPELQPALLFLAFPGPGLTVAPHSVAWKCFITLGSP

SEQ ID NO: 932555 - protein, 135 aa, Homo sapiens
MTNTKGKRRGTRYMFSRPFRKHGVVPLATYMQIYKKGDIVDIKGMGTVRKGMPRKCYHGKTGGVYSVTQHAVGIVSRDSFLKRMKENDQKKKEAKEKGTWVQLKHQPAPPREAHFVRTNGKEPELLEPTPYEFMP

SEQ ID NO: 932556 - protein, 281 aa, Homo sapiens
MNKGGSLDIECGSENSLTLEAVKRLIAEGNKEELRKCFGARMEFGTAGLRAAMGPGISRMNDLTIIQTTQSMQSARMWLSLSAELRKFLHFGLTALLLVDTTFRDMLTLSIKTLSFALADKTKARIVLANDPDADRLAVAEKQDRYGYHITKASYFICHDQETIKKLFENLRNYDGKNNYPKACGKFEISAIRDLTTGYDDSQPDKKAVLPTSKSSQMITFTFANGGVATMRTSGTEPKIKYYAELCAPPGNSDPEQLKKELNELCRNPFLGFLFLLSVFE

SEQ ID NO: 932557 - protein, 138 aa, Homo sapiens
MCQLRVRVIMKTWVPFWENGGRKPGVLKDGKSTLFLLKLKCNGGHDGDEEAIAKAQEKTDDDKAPEVPAQGNHHGHQAQEQEGKDLEKQGPEAQGFSSSSHKQANLAKNTWKEWGSRLFGALKIFYVVAGSEFFRLIS

SEQ ID NO: 932558 - protein, 143 aa, Homo sapiens [sequence omitted]

SEQ ID NO: 932559 - protein, 200 aa, Homo sapiens
MLPALLEESSETHTRLLLDRKLLFLATVLWFRHRHRPFHTVLSRGLLRGGPPRPLPCRDGRADQKLRALCLRALPARFAAATRAAANPLERGGPGRSAGRGGAGAGGAQLLGRGIREPRVDRSRLIAARELPRSRLPGLVPAPVRGCPGVQRRRTACRQVSPAPASAREPTSEARPGEAEAEAGWLQPWYRTAATLGLPS

SEQ ID NO: 932560 - protein, 168 aa, Homo sapiens
MWISQQKKFENSKNQNAAYPTKDRNSSPAREQNWTENKFDELTEVGFRRRVITNSSELKEHVLTQCKEAKNLEKRLDELLTRITSVEKNINDLMELKNTVRELPEAFTSFNSQIDQVEERISVIKDQLNEIKRAGKIREKKNKKEQTKPPRNMGLCEKTKSMFDGRPI

SEQ ID NO: 932561 - protein, 182 aa, Homo sapiens
MQVTEFLLPTSHSPSMPGAYHPSKLFSKSFQLASFITTLAVVSIYVLMYSGPFLEPSSESIGPYNQSVFLVVSHEFQMLARSLNSYFLDTNPVPQNIGENNHSRSILTSKNLICTPDPMKSLEVFKLCFVFLFMTPILRPDLEISAADFVTHKSMNIAGKGAQKAFLGQVLLCCEVGERTAS

SEQ ID NO: 932562 - protein, 290 aa, Homo sapiens
MKHPGLTIPERIHTKERPYKCEECDKSFKQSSRLNKHKKIYTGDTTYKCEEKKPYKCEECGKAFYYSSGLTQHNIVHTGDKPYKCKDCGKIFKWSSNLTIHQRIHSGEKPYKCEECGKAFKQSSKLNEHMRAHTGEKFYKCEECGKAFKHPSGLTLHKRIHTGENPYKFEECDKAFYWVLSFTKHMIIHRGEKPYKYQECGKAFKWSSNLTIHKRIHTGEKPCKCEECGKACKQSLGLTIQKRIHTEEKPYKCEECGKAFYWSLSFTKHDSSYWREALQDMDEIGNHHSR

SEQ ID NO: 932563 - protein, 1698 aa, Homo sapiens
MRHFWVSLLKTDTESIEEKNSSQDKHSDPRSSVPESYVRDKNSEPSSSVLEFCVSDKHSELRSSVLEFYVRDKHSKPSSSVLESNVRYKHSEPSSSVLESYVREKQSELSSRSSVLEPYVRDKHSEPSSSVLESYVMDKHPEPIHCLLESYLRDKHSDTRRSVLESYVRNKHSATRSSALKSFQCSGILCVGHSDPHSSVLETNVSAKHSEPSSSVLEYLVRNKHSDNLPSGSVLESYVRDKHSEQSSSVLESSVKDKHSDPSSSVLIPYVRDKHSEPSHCALKSYLKDKHSEPRRIVLESYVRDKHSETYSSVLGSFVMDKQTEPSSSVLESYLTDKHSELRSSVLESFVRDKHSEPSSSVLELYVRDKHSEPSSSVLESYGQTFRPSKQCSGILCEGQTLRSSSSVLKSFVMDKNSDRRSRFLESKVRDKHSEPSSSVLESYVRDKHSEPSSSVLEYSVREKHSDPRSNVLESYMRGTHSEPRNSVLESFVREKHSDPRSSVLESYVRDKHSEPSSSVLESCVSVKHSEPSSIVLESYLSDKHSELRTCVLECYVRDKHRTEQQCSGILCEGETLGTQQQCSGILWTNIQTLSSVLESYVRGKHSDRRSIVVEFYIWDKHSEPSSSALESYVREKHPEPSRIVLECYVWDKHSEPSSRGLESYVSYTQNTAAVFWNPYEKHSEPCSSFVDSTVRYKHSDPRRSVLESYVREKLSETCSSALESLVRDKQTQLSSSVLESFERQKYSDPRSSVLESYVRDKHSEPSSSILESYVGDKHNPAADSSVLESYVWDKHSEPSSSVLESFVRVKHSDSQSSVLESYVRDKHSDPHSTILECSVRNKYSDPHSSVLESYVRDKHSDNHSSVLETNVRTKHSEPSSSVLEYLVRDEHSDNLSSVLESKVTEKHSETSCSVLEFYVRDKHSEPSSSVLESLVNDKRSEPRSSVLDWFVRYKHSDPQSSVVESYLRDKHSSHSHCVLESYLKDKYSEPLRSVLESYVRDKHSETSSSALESFVRDKQTEPSSCVLESDLMDKHSEPSSSVLESFHSDPDSPVLQCSVRVKHSEPHSSVLKYYVRYKASELSSSVLESYVSDKHSETSSNVLESFVRDKHLDSRSSVLLSYVRDTQIQQHCSRIFCDGQTLRSSSSALESFVRDKQTETSSSVLEVFVREEHSDPRSSVLESYVRDNHSEASSTVLESYVKDKYSEPRINGFLKSHSSTLESYMRYKHEKPSSSVLESYVRDKHSEPSNSDLESYMRDKHSDPRSSVLESFVRDKQSGTSSFVLESYGIDEHSEPSISVLESFVRDKQSGHSSSVLESYVRDKRSDPRISVLESYGRDLQTEPSDSVLQSFVREKHSDPQPSSSVLESFGRDKHSDPLSSVLESYVRDKHSEPSSSVLESYLKENIRNLLEVFWNPMDKHSDPHSSVPESYVRDKLSEPSSSVLESLVRKKLSDPLSSVLESYVWDKHSEPSSCVLQSYVRDKHSEPTSGALDSLDNPSDPSSSFLETYVRNKHSEPSSSVLESNVRDKHSETSSSVLESYLCSGILYVEQTLRAQKQWSGILCEGQTLRPSKQCSGILCEGQTFRSSSIVLESFVMDKPSDAHSSFLESLVRDKHSEPSSSVLESSVSDKHSETSSSVPASFVRDKHSDPRSSVLESYVRDQHSEPSHCVLESYLRDKYSNHRRSVLESYVQNKH

SEQ ID NO: 932564 - protein, 162 aa, Homo sapiens
MVNTLYGHIILNMHNLINDGKYFLPDADVENLMIMLTSLLKVLNVTENNHFTENIPNGAAGEVGCVGKGHILPHLYIDTGAVKCHCSWGITVLQFSEAFPPQQTSCHSASAPCAYQHAAPDLDLLSPTWWPPLVGFIVKDLPFLLCTPEPISCQNCKFYSDT

SEQ ID NO: 932565 - protein, 165 aa, Homo sapiens
MTPHNCPSYLLTSFLTSLLLYLFSLYPGILELDPDSGPLPGTFYSLIALELEYKESICVAMMVTSADATIEHWLYCLNDILKWTNGQKLLHTEQIYLWRSPKCPSGILNLQFNEIIVVSPGSSIPPSEIKRSRPAECNVMVTGSKKFASGPLGVMASDATSTSTP

SEQ ID NO: 932566 - protein, 462 aa, Homo sapiens
MLQISFKYENFSSKIITEKSIGFNLQVLQCLFGKPTTENSQSTKVEEDFNRTTKEAATKTVTGQRERDIGIIERAPQDQTSNDNFIFYTKIIEVATYQKEIKTTNGKIEDSTTLSKILDAVPSCERGRELKKDHCEQITAKMEQTKNKFCVLQKELSEAKEIKSQLENQKAKWEQELCSVSHTHESENDLFHENCMLKKEIAMLKLEVATLKRQHQVKENKYFEDIKILQEKNAELQMTLKLKQKTLTKRASQYREQLKVLTAENTMLTSKLKEKQDKEILETEIESHHPRLASALQDHDQSVTSRKNQELAFHSAGDAHLQGIMNVDVSNTIYNNEVLHQPLYEAQRKSKSPKINLNYAGDDLRENALVSEHAQRDRCETQCQMKKAEHMYQNEQDNVDKHTEQQESLEQKLFKLESKNRWLRQQLVYAHKKVNKSKVTINIQFPETKMQRHLKEKNEENV

SEQ ID NO: 932567 - protein, 254 aa, Homo sapiens
METPLTLPAANSSEDSTAGSLARAGTCRSAYSGQLHRAQRLKPRALGSGQGRDQPCRPLLRTQLQLPPVQRRRSSRATGHFACTTKSQDTRDNAASAPNSGSQPRSCSRAETFALGPVPLAAQFPVPATRNSGSRQRKSGLQAGTVVHSMTLRLSGKPLPAHGARSSLGGNPRPCSYTSQADPRARPRPAANSGGQAPAAGGREQAAQPFPGCCPVPSACTPRYGYYRLLVTDKYGRNCRSSCDRQIDLAEEEE

SEQ ID NO: 932568 - protein, 143 aa, Homo sapiens
MRPPQAKIDLCSTKKDPRTWGAEGSTERVGATGVHRQLEEDADGKLPFVTPGACLGPEDHQIPKASGASEAEERQGQWLPVSRDLAATTEAYLLVPQPTGGHTPGLWALPRTCVWASLPSRNHLRTLCIPWICFVSEGIIKEC

SEQ ID NO: 932569 - protein, 188 aa, Homo sapiens
MRYLVHHHWHWLDSGCSPQRDRSSSPATEQNWTENDFDELTEVGFRRSVITNFSELKEHVLTHWKEAKTLENRPNLHLIGVPESDRENGTKLENILQDIIQENFPNLARQANMQIQEIQRIQQRYSTRRATPRHIIVRFTKVEMKEKMLRAAREKGRVTHKEKTIRLTADVSAETLQARRVGANIQHS

SEQ ID NO: 932570 - protein, 372 aa, Homo sapiens
MEALELLGSTYVDKKRDLLGALKHWRRAMELRHQGGEYLPKLEPPQLVLAYDYSREVNTTEELEALITDADEMRMQALLIRERILSPSHPDTSYCIRYRGAVYADSGNIECYIRLWKYALDMQQSNLEPLSPMSASSFLSFAELFSYVLQDPAAKGSLGTQIGFADLMGVLTKGVREVEWALQLLREPRDSAQFNKALAIILHLLYLLEKVECTPSQEHLKHQTIYRLLKCAPRGKNGFTPLHMAVDKDTTNVGRYPVGRFPSLHVVKVLFDCGADRDSRDFDNNTPLHIAAQNNCPAIVNALTEAGAHMDATNAFKKTAYELLEEKLLARGTMQPFNYVTLQCLAAQALDKNKIPYKGFIPEDLEAFIELH

SEQ ID NO: 932571 - protein, 137 aa, Homo sapiens
MTKMPSVLSTLRKNRLLHPLALEGCPLPGACASYSRYQTNMPIKACVLSPRQTGFRPVWNLGNGALPMATIGNLVLAGALPFIDKNPLELGFPMDENNLQCGLILACFGYHSRSLALLSSSFPLHFPASATTLSPVV

SEQ ID NO: 932572 - protein, 154 aa, Homo sapiens
MYYLLLIYCLLIHQLAQHSQAELPAAIIPSLRGLEAIELLYLTLLLLSQAGELRHLQSLPLGSLKVLPGTKPSGVTPVPPYAPRAQTVAKLAISWILVATPGFTVWDTAEPRNAKIWSDYYTVLLVHKTLRLRPCLHCCSKYLHLESSCCGSCL

SEQ ID NO: 932573 - protein, 190 aa, Homo sapiens
MPYGLFVLLLFFWHAWEKPGVEVSYDHMGLNKRQNKDNSVPQIFLLPLMLLVLNHLGKKLKRDREEKNKNKDILIHREKTLENALLPEDGSFFRPEEFHLGYHITWFSLHHRKLLLDVTALGELPRWWWAASKMVASLVFSDLGFLASRIPRNRILGHADEPGHLAVQEQWQAFSLIRSGNGFLAGSISM

SEQ ID NO: 932574 - protein, 143 aa, Homo sapiens
MLDLRSRLTDQTLYFCRRVQHKSRNGKSRLAESSDLHLSPVLDASCPQTLDSKFFSFWTLGSTPVVRPGRSGFQPQTEACTVGFPTFEVLELRLTSLLLSLQMAYCGTSRSDIEEAEKRRNKCMERDGNQIVSISYYVHVKNL

SEQ ID NO: 932575 - protein, 139 aa, Homo sapiens
MAAATQGGSSLPSELESMQSALWVPGLLTAPQAFLGLQDLMPCVPATPAVTKRGQGTVLAAGSEDGSHKPWQLPHDVEPTEKQMLRKLIATRPALQELLKEALNMERKDHYQPLQKTHLSTQTSDTIKQAHKQVGMTNT

SEQ ID NO: 932576 - protein, 352 aa, Homo sapiens
MTSSVVGPRRSSKALPKAELAPEKGHGHCWVGKCFHNQQDAENAFQEFIKSQSTDFYATGINKLISHWQKWVDCKEFSDSLHNNFDQVWKNKEHNEAGWLLLSSGDKVMKENDQLRDSVSGLQKQILSLKSPKIALSESLIFCREIAEIVEKETQALTTRVADLQQKVHTQPRQVSTVKVRTLIEKERDPATWNGNTWEDPDETRDTEFVNSDEPFLPEGTASPSPVVATSPPQPMVPSPFPPLSEEESAPMPLFASRPITRLKSLWAPRGDFWAFTRVTVHWRKGNDQTFPGLLDTGCKLTLIPRDPKHHCGPPTKLGAYGGQVINGVLAQGHLQWVQWVPRLILWSFPQC

SEQ ID NO: 932577 - protein, 124 aa, Homo sapiens
MVRTVKCKPFWMSVKRNLTQNDCFNKGLRTMVIEQKDFCNRNRGLLQYEDPSVGDNLQLYHMALKRGFLFQGVVNKARNNLVSKSWIRGSTKGPLIRRYFFLRMGKQINRKRIKKINAMVEFLT

SEQ ID NO: 932578 - protein, 151 aa, Homo sapiens
MARTVSGIYSFWWVLGLTDFKNEAPDPREFVKRLQTAVRNQSWRDSDFYVYLNVTVFWLLCKKEKGINSQAAIGSLLEQQLMLQLGDRNPNETEENTGPPVHCGALRKNQRTSPLVSSQQKAKETSYIIAGKRENDSRVKEKTPCKTIGSL

SEQ ID NO: 932579 - protein, 263 aa, Homo sapiens
MAGVLAGMGGIQNAETMQSLNNWLASYLDRVRSLETENWKLESKIREPLEKKGPQVRDWDHYFKTIEDLSAHIFANTVDSSCIVLQIDNARIAANDFRVTYESELAMHQSVESNIHGLHKIADDTNVTQLQLETEMEALKEELLFMKKNHEVEVKGLQAQIASSGLTLGEQPEGGGGPLCPANGAAQGDPDAPGVRVATDLGRGAAPGPGVGGAAEHKVKLEAEIATYHPLLEDGEDFNLAFEGFEKRRYTISSAYERDDPAD

SEQ ID NO: 932580 - protein, 143 aa, Homo sapiens
MRKNLHKKAENSENQNTLSPPKDHNSSPAREQNWTENEFDELTQVGFRRKTHLEKNINDMMELKNTARELREAYMNINSQIDQAEERISQIEEQLNEIKHEDNDREKRMKRNEQSLQEIWDYMKRSTLCLIGVPESEGENGTK

SEQ ID NO: 932581 - protein, 154 aa, Homo sapiens
MASKGGSPKPWQFPHSVESVGAQKSRIDVWEPPPRFERMYGNVWMSRQKSAAEAGSSLRTSAKAVQKENVGLEPSHRVPTGHYLMELRQVNQFGNQKFLIYVPALSAEDMTHGERSTAQFIKRGRLCKQWKYIQIKLSQEQKTKHRIFSLIGGN

SEQ ID NO: 932582 - protein, 148 aa, Homo sapiens
MNKGSSNISDHSNPAQHWITPQACGKYCLATTDIHSRSKSDLVVNDVRPGSFNLMQQPPLWPKVDPEMLMRGQGLKLVSLGEPTRCSITLSSSLYSSCFVLMQLCSMPPSLSPNYNFWALATKCRLSLLQPPPLLLHNLQRVNVDNLH

SEQ ID NO: 932583 - protein, 142 aa, Homo sapiens
MKPAEDTLFHVLSEIYEAAHPELFTPPGGFVVSLISGLNLLRFTVSVTAHKGHSDPKSQQQQDLLRRAKQGGFHSMEADPTRLPLLAWVAPFYSLIWPHPHSADWSILQSTDWSVLQRADCILSSPSGAGALQAVPELYELL

SEQ ID NO: 932584 - protein, 138 aa, Homo sapiens
MRVQQEGLLQTLNARALILDLPDSRTVCDLIKILLKTSLTAVGIREWQEWKQIDLHYCMAPCSNQPEIRSSSMCSFMKGLNGKKYRFTQSLLEQRGAKSSLMFSVCNNNMVALVVLRNYSIHISHYIISITSFLFQSR

SEQ ID NO: 932585 - protein, 176 aa, Homo sapiens
MTKEEIIGEFDFAGLEDGGKGREPRNTDRKNLKLVISSFQIRSQELGKWVHICTRRGKMAMFNRYMTFQRVSLSTSKGKNASSEHVYNSGEHTVHTPLPSASRPSCVQTTHPEGRTRGEGRQDPGSRPTYKNPKSKGQTPRLPTGKTEPEWKGSKKTDTGENFYAEDLALNTIKEK

SEQ ID NO: 932586 - protein, 229 aa, Homo sapiens
MAEVKEEQVTSYMYGGRQNKRACAGELLFVKPSDLIEILEINDTMTELKKPTETFSSRLGQVEERMSGPEDKMFEIIHSDEQKKILKRKRITYIMRVPQLEERTTLGSVISDSNENMRHDSSEKSDHLAKDVQTCPEFLPSDAFIVSLTSEVKLQTFTLTSGVKLQTFAVTVTALKGKKLFRSPQWVHGPAGFRSEAADLYRGKKTQGIAATGSGSLLLFPYLAPPISC

SEQ ID NO: 932587 - protein, 135 aa, Homo sapiens
MQVWKVTGIDKTDIPICFLELVTWVQGMGRYEDTAAVKSNRNRDRRWLGSIFSVGKAQNVAESSTAEPELSQQRISDVSVNPLDKTVLGGHSVSEGGLQHFKRLHCHRQIFVPFGLQKMLPRMGLLPNTWKPILW

SEQ ID NO: 932588 - protein, 148 aa, Homo sapiens
MAWCCLCNSENSGIQKALCPCDKAGSLTELPSTSCLQKAKMKQHIVTHGHWDFSCKRSTPRHCCGVRAPQPAHLHAPARSLSSRALKKQQATLPLHALRREQGNFSSFTIALGCLFTLLTVSFPVQKLFNFNKFHLSFLFLLHLLLRF

SEQ ID NO: 932589 - protein, 140 aa, Homo sapiens
MLFIFFFFLTFSFIAFYGFIFKFMIIFSAVREENLGNTIQNIGMSKDFMTKTTKAMATKANIDKWDLIKLKSFCISKETIIRVNRQPTEWENIFAIYPSDKGEIPNVDNGLVGAANQHGTGVPTKQTCTSCTCILELKVL

SEQ ID NO: 932590 - protein, 129 aa, Homo sapiens
MNADSKEKKLPGFAHTKWHTKKWQSMTFWIHFTRKREKSLRWACVPLPKHTVCAQFPRVRRAPCKWKAHSKGRIMGKEKIAEDAKLVDRRKGLRCSQLQNGRTKNKSMYILKQKAHVYKMLTFGIFAFM

SEQ ID NO: 932591 - protein, 237 aa, Homo sapiens
MLIKSGLSYCLTQDIISEILLAIFSSDLICCTCSFADGNGHGNTKSCSENVDEAGNHHSQRTSTGTENQTLPILTLSLNGFDQNADNDMDNKIQVEVVSDGYKELVGNWKEKFKLAEEIYVSNKEPNVNHQDNGGNILGTHPLYQCDLDIRHGVKEDYFGTLRFDCPAGFWTFMGPVSPSFWPISLIWNGCIYPMPVPQLYLGTMEIKKTNTVCKPAYPREKCDVKLFNMNENQYQY

SEQ ID NO: 932592 - protein, 208 aa, Homo sapiens
MKIPENVEATLELGNGLSLEQFGGIRRRQEDEGKFATSRDLLNGCDQIADSDTNSEVQAEVVSYGNKKLIGNWKFVWKYLNVKAEVCYRRKAIMKNLYLGSKKGKYGTVAPTQSPTRALPSGAVQRGPPYCRLQNGRSTDSLHHTPGKTTDTQCQPLRAAMVAVPYRAAGAGLPKVLGAHLFHPSIIVACIINMSFSNHRFLDTYLIP

SEQ ID NO: 932593 - protein, 170 aa, Homo sapiens
MLRRQWENGHKGTVELTSVTAPITGPECQGLTEGNMSKERFQCSQELGTYCPGPTQVSVPYILVQGSSAAPATSQDCQDQLHAAENQSHPLLQKEEEDEEEEEEEEEEEEEGEEQEEEEEEEEEEKGEEEKEEEGEDEKKKRKKKRRRRRRGGRRRRKRGRRRRRRRRRI

SEQ ID NO: 932594 - protein, 136 aa, Homo sapiens
MVNAGDFIADENPSRQTQVAGHREEHISERRHKWLVNESTPAEEHADRHQQVNESMPAEEHADRRQQASRPPTGGTMWRCRKTDRRQKTVKVKIMNFWQRCCGIRSHSSCEQIVPPDSFANLVANWSFAPLEKQNL

SEQ ID NO: 932595 - protein, 163 aa, Homo sapiens
MGVNFDCSKDSWRLIAKEESEKGRPKTQKTKMGDEKPDQIWRVIRYQRSGILSKLRRTLAKTGLCTSGKDGRLRSRPTLFVVLLASGVKLQTFVGSATAHKGSADPNTEQQQDLLRRGKEQNFHSVEGPICGIHVLRHKPFEKVVKDVGHKNLRDTRVDKLSK

SEQ ID NO: 932596 - protein, 183 aa, Homo sapiens
MGLFFSTAWSGCKFSKLLCCASLLNTSSSFRSFCSCIRKVTFATVSNTFLISKPSSTRTSLSISLAAFSSQQFNKPLGSSKFSLISLSSSDPSKLFQPLPINQVQSCFRIFSPESITIGHYIDDTMLIKPDKPELFVEFQMQELKEASGKQPERHQSSWYHNLQNLELSQQPHELRRGPQGLR

SEQ ID NO: 932597 - protein, 139 aa, Homo sapiens
MTQTNGNTSHAQGSSHFHNLYCENDHTAKGNLQIQCNSHPNTKIIVQRTRKNNPKIHMKPLKSLHSQSKTSKESKSGGVALPDFKLYCKAIVIKAAWYWYKNRHMDQWNRIENPEGAEDCTGSMAACAPGEDIGSCYSW

SEQ ID NO: 932598 - protein, 166 aa, Homo sapiens
MHQDCLVLRQPSSLLLSDVIPGVLCPTSKNIKESRDKSESSPVYVVDIFASMSTKCLSPTSKTPTPYLFGVVVFSNIYFQDWTHSSTWLVKPHSHSRRQRRSKGMFYMVADKRACAGELPFIKPSDLMRLIHYHENSTGKTHPHDSTTSHQVPPMKRGAYGSYNST

SEQ ID NO: 932599 - protein, 147 aa, Homo sapiens
MLFLLMCSHHATPSCRGWKSMEGSEEDRKKRENLELPRELLNFCDQNANSDTNNEVQAEDVSNGNEELIGNWSKGHICYTLAKTLVGLFPCPRDLWNFDLESDDLGKAAFIHDSKHFNLHFLSTASSQDPAKVSNDISIAKPREIFL

SEQ ID NO: 932600 - protein, 166 aa, Homo sapiens
MKYEDAIIIFRNPCSFHGKAICHIIRFIEYLVMDCPGSIEGLTYPLFLTNKQNKIFINHKVGADDHGTRNNNRTKHHQHLMKGITVRSERISDNDDDDDDDNNKNNNDDAYAGIEILKLIKQKEVWSSVAQWFPTLDAEKPQIIIQSVKDNLAKNKTRTRIQSFTH

SEQ ID NO: 932601 - protein, 156 aa, Homo sapiens
MTELYGKSQGNYSKRLFLEIHRNKKELLARFTKGSICLYQLSLFYCSLLSTGIHKALSRQIHKDSNNNDAAVEKAKGKEEVALVIAVKAIPEQHQPGGHKTCEWSQPRSRELKSHLASQRHWVKIQSKNTETMLDVSKRRDLIRDISKIDAGRLEA

SEQ ID NO: 932602 - protein, 157 aa, Homo sapiens
MKLKPGTVVAHLICGSNDNALLCADNFRGCMEMLGCSGRFAAGVRLSWKISARVVQKENVGSEPPHGVPTGALPSGAVRRGPLSSRPQNGRSTNSLHCVPRKAVDTQCWPMKAARREAVHCQAIEWSCPKPWELTSCISMIWIFQVIYSLSPNTHHY

SEQ ID NO: 932603 - protein, 211 aa, Homo sapiens
MSRLPFLPLPTETSTSLRVGVSLSKDLLGEEYEFMLKREADHKSLANLQPIHVVEKKNPLSGEKFNPAAGFSISSKRLSVKSQDNGENVSRASQRSSQQLLPLQAQRRGGKNDCMGQAQGPAALCSLGTCGAITRGPPSSRPQKGRSTDSLLRAPGKATGTQHQPVKAAVGVVSCRATGVELPKVLGAHFLYQHALDLFEKPPYCFPQWLR

SEQ ID NO: 932604 - protein, 162 aa, Homo sapiens
MQVSLASGDKHLNYINLSKNGYLQEEEAGICKALRKQITTQLLEAINTVQYCQDLDSAHHMSEQFSILTHKSKALSNVEEDVIPKITTLTHSDTLTRKGQEKEGKEDGSILEQLEITCLHFKNNLPETLPVTLALPPNGDGSNGGTNQEGEICGLNSLCLIL

SEQ ID NO: 932605 - protein, 161 aa, Homo sapiens
MTALHKQDQSPSWDWIPENNDGIDFNVCGKRLDSRGTVIFLALLDGAAQPTGALAAAYMCKYWKNRITCGLGGWVQGFIEWSVFLSTSRHLCVRPLGSQRFYGHRMEDVMGQSGLGKCNIWVQKQECLSLLRSLGTGLRVKPSPGTLPFSIQHFPISLLYH

SEQ ID NO: 932606 - protein, 228 aa, Homo sapiens
MQGYRKPWESPVGSVGPQGHSCLALPGFFRKVARGAGKMPQGEGNLQLHFEEEKSKSLENIFVGIIKENFSSFARDLDIQIQEAQRTPGKFIAKRSSCRHIVVRLSKVKMKERILRDVRQKHQVTHKGKPIRLTANFSAETLQATGHWDPIFSLFKQNNYQPRILYPVKLSIMYEGKIQSFSNKQMLREFATTKLLLHELLKGALNLETNPGNTSKQNLFNAYISQDL

SEQ ID NO: 932607 - protein, 148 aa, Homo sapiens
MAKSVPALMHRQYSVILKNKSTDIKKYSLTCGRFSDMNPMFDGNSIESINYFGLYGHFYNIDSTHPSNTNIIVIATITIISTMNFTANNIGFIGTTTDNEKLITKSNKYLINIKNEDLHVRCALFYWGIFASGHLRCKGTSLPSHSLI

SEQ ID NO: 932608 - protein, 150 aa, Homo sapiens
MAPWLLTHLIVELLILLQNATQPSCDKMKQLVSLSIEKKRSFFHSRLHSNSWDSVFSVPVETSAPGLRSLFPLGNVAVSPTAQGPLRHCILRGPLSCWEADIQMSSRILSLPSGPSAPYEWCFPLVLDEKHPFPFQRDCFCGPHPEFSPG

SEQ ID NO: 932609 - protein, 295 aa, Homo sapiens
MLQGVDLLLTAVAITMGPKGKTVITEQNWGSPKVTKDGVTVARSIDLKDKYKNIAAKLVQDVANNTNEEAGDGTTTATVAKEVFKKFSKGANPVEIKRSVMLAVDAVIAELKKQSKPVTTPEEIAQVATISANGDKEIGNLISDAMKKKISSVQSIVPDLEIANAHRKLLVIIAENVDGETLSTLILNRRKLGLQVVAVKAPGFGDNRKNHLKGMTIATGGAVFGEEELTSNLEDVQPHDLGEVGEVTVIKDDAMLLKGKEIIEQLDVTTSEYEKEKLNEQLAKLSDGVAVLKSR

SEQ ID NO: 932610 - protein, 316 aa, Homo sapiens
MWQLHTYPLVWVLGLQLGLGLTLVVSQTLKTWPADGELQGTEEFDGSQPVVLQVLGSQLGDLQYLLCAEVRIMHPPKRVTFQYWEICECYVTRQKGTVQKLLVSQSRARWTTRAEHMGQRLATTEQRPQRSEAAGHNVKTLRTIGQATRGLASRSEEVLGLATLGQAELGAIGIGHTVSYGLVTIEQRPQWTTAAGHIPLWSTGYWKAGTGEERSRKKTASLARPGHVVSSGRTARGFKIAGLTVDRLAAGWFTAGLLAVVCDPGFLAVVQELDSAIAVPGLAEDISEGHMKKGAIRGDDSPMAITPEGMTAVVFT

SEQ ID NO: 932611 - protein, 163 aa, Homo sapiens
MPGESPHTLGLMTLPMEMDVQGKDPRERQLLDPKPRDPEAVQKGTVGCELPHRVPTGALSGGAMRRPPSSRPQKCRSTNSLHCVCGKATDTQCQPVKVAMRTITCRATGEKLPKALGAHPLHQRVLDVGHEFKGNYFGALIFNGCATWGLYPFCSGQFLPLGM

SEQ ID NO: 932612 - protein, 193 aa, Homo sapiens
MWHANSESSQCNSAELTSPINMSYNCCSGNFSSRSCGGYLHYPASSCGFSYPSNQVYSTDLCSPSTCQLGSSLYRGCQQTCWEPTSCQTSYVESSPCQTSCYRPRTSLLCSPCQTTYSGSLGFGSSSCRSLGYGSRSCYSVGCGSSGFRSLGYGGCGFPSLGYGVGFCRPTYLASRSCQSSCYRPTCGSGFYY

SEQ ID NO: 932613 - protein, 155 aa, Homo sapiens
MGVQLSVPKKILSFNAVEETLSQSWPSIVFQEFLYPTVLSLCLGAAQRKQAFPKNAVLTFRTQQCDVACGSVIDGSYHFEGVRLQRMLAPWEQRPRWAGPDLAVLPTGPLMTGTSISLEGEFCRQTPNTQRRVRYGGVKAPQSQDLCKDFGPGNF

SEQ ID NO: 932614 - protein, 148 aa, Homo sapiens
MWNCESIKPLSFVNNTVLVDGLCKVNHDLILQEIPRESSGHQNSCLPGQENIDIENVKDEEEEEDKGEGDKEKKIKERKGMEREEEGLRDRKNDEEEEGEEIIHVFYKIYSHKSQHYYSVVVKLLWNNQTIKRKLHEDNYSHVGILVV

SEQ ID NO: 932615 - protein, 136 aa, Homo sapiens
MCGSYYRNYNGGHGYGCCGYGGLGCGYGGCGYGCCGYGGLGFGYGGLDCGYGGLGCGYGSFCGCGYRGLDCGYGCGYGYVSHSFCGCGYSFDNNYHGGQGYAKGGLGCSYGCGLSGYGYACYCPWCYERSWFSGCF

SEQ ID NO: 932616 - protein, 146 aa, Homo sapiens
MGRTVAVAEYGRCRHGCHSSYSARFSIPEEDSHFLEDNKAHPNASIRNKSPNTFAHCILVTELPRETQQHQAQDGAMLLLTSEETSNYYGGLRYGYGVLGGGYGCGCGYGHGYGGLGCGYGRGYGGYGYGCCRPSCYGRYWSCGFY

SEQ ID NO: 932617 - protein, 137 aa, Homo sapiens
MLRCLCPSLRPLDFSISICFTVILKAHLVSQLLVARMLQASCPLKAGLRLLLSAAWKLFLQVSVRSTPFSPSFCSMKLIQRKYFKRNVYGFCDTWVLNDHGIFGDLVVVMPPTVVTVASIFLDKQLRSRVHNHSLPP

SEQ ID NO: 932618 - protein, 286 aa, Homo sapiens
MVDSPSSQSCIYSRRESRIHIQSHIHSHSQRQSHIHSHSHSQFHIQSHIDSRSHIYSQSHIHNHSHSQFHIHSHSQSQSHIHNHSQSQSHIHNHSHSQFHIHSHSQSQSHIHSHSQSQSHIHNHSHSQIHIQSRIDSQSHIHSHSQSQSHIHSHSQSHIHSHSQSQSHIHSHSHSQIHIQSRIDSQSHIQSQSQSHSHSHSQSHSHSQSQSHIHSHSHSQSHIHSHSHSHSHIHNHSQSHIHNHIQNHNHIHRQNPRQSHICICPLRSAFAASQRFVSTSWDPFNN

SEQ ID NO: 932619 - protein, 285 aa, Homo sapiens
MCRFATGVYCVMLRFGKHLLETHLNSLLLTTCVATTTATPVAMAPAVAVAMALALAVAVAMELAMAVGMAVGLAPIMAVVMELAMAVDMALALATVATGHFALEDAILPAKTSLYDGVTKKSSRGKLKSECGKRRLDKCQKLLPKNDRNRAIKDEVDLKYPPTPQLKSNLLKSCVATTTETAVGAVDMALAGVPAVDMVVAMAVDTALAVDMALAMELAVAMAVDTALAVDMAVDTALAAVATDHFATEDAIPLATNHHYSLLQVLKMVRKDQGSFMFPLPTLSV

SEQ ID NO: 932620 - protein, 157 aa, Homo sapiens
MSAQLLLSCYPGHAAYKVALLHKEQYLCFCTETFGRKLSCSKLHGYAAVSETEEMEKQLYLVIHSAEDQLSAFFSLWLVVLPSDKLTKNRACETQRKNNVYMPQNEKFVYSKRETTAATKLQPDPRPTVPRIQDSAAEKNEQLLKKKNSSKALVKAE

SEQ ID NO: 932621 - protein, 129 aa, Homo sapiens
MLEREGNITFLDSIMLLKDKLKSAFKILINSQASVQKLQVVNMPVVCATQCTMQDWALVSFIWSSVQIRTRNYADARLWYYNEVFSFQGLSILAILLTQLECWSISSDHLLLKCQDYQQCLQFYTMDIL

SEQ ID NO: 932622 - protein, 157 aa, Homo sapiens
MLSRSPLDVFSATILVRMEEVVQRDDVFVLTANECVLMYSCVLHFSWFYVYNEKGAPSPSCNLASLFNERVQKSIFYFMEEFLSREVSLQIGSTNVSALFVEEYSSGRKNVFNRISRKQDKNENKKNCCGAMGLFMHWCNERLGPETAEVPSFLSDF

SEQ ID NO: 932623 - protein, 154 aa, Homo sapiens
MNPDGMLALLDYQEDDKVPLGNHEGLLGLRSNAMPSTVENFTLFIKELLVCCCWTTVEMKQLDMGHQVTICTSRAQWLLGSSCRRLAWCHHPYTIMLQCHNHTKLSNSFLSHMDRSRVEMKLRIAIAAHPGGQPSSGTESASTFVLDFSVSIIT

SEQ ID NO: 932624 - protein, 132 aa, Homo sapiens
MITAYFLAARDDFAMPEDVFDYHFQGVGMLLASNRKVFTGLTHTQDWGIGKTHRLEMNINKSSACGVEMKPGQHMTWPKTMGCPCVGNSTLEESFESFGFLLRTITHSKIVIWLLVLESWVSRSPGLKIKNF

SEQ ID NO: 932625 - protein, 173 aa, Homo sapiens
MFKASSLPAPVWRESSKGAEGRSGPPRPKEASAQSTQHWLAPDSSVAALRPALCGKRQPKGPDSRPAWTRELTVPVSQTFYVFDDLDRFEECWSVYAADPPDPEPKMLQLETLALLSLEIRYGCCCPREYSSLCLLRFVTTFQFKVWGGCLALVEPKSYAFALAAGGGWECIC

SEQ ID NO: 932626 - protein, 173 aa, Homo sapiens
MPTYKYSHNRGLASIYKFGEEKQSIIGYFVPKNATATPTPHGMKGSVTNEKKALDREDKERTQLEVMFKIFNHFYGMDLTNQNLTGFKASEKSRIPGDQEKVIRNSAEKAGNTPDTKVMVGVCSGEEKLVFLDAVGSLQPTPTPRPLWLSKVHVSPRPSSLGEDVGILWVQSF

SEQ ID NO: 932627 - protein, 147 aa, Homo sapiens
MDNGPERGCFISLDPKEDNMKQGYTFQANEKFQPTETKQMWLYPHIQSQALGRAGDKEHVIWGNLALSEIITVNSLLAVSEFRLILILVFNEHPEVFLMSPLHSDEIAFSVLGGRVVQSMGVELRDVHSTPGFTLKSSVTWPSRASL

SEQ ID NO: 932628 - protein, 140 aa, Homo sapiens
MSPTSWSHLVAGCTCSLTFLLKAPTCPPTPVLQGKLVNDFISSPLTLLNYLHLPSSSHHYVTCEKVAWVLNQLWLPLEFLPTPLPSQRALKDDQVILPASKLSKASPTLPVKLCLPYAPSLPTFPTALPTPGMGSPWPLP

SEQ ID NO: 932629 - protein, 119 aa, Homo sapiens
MVPGISGVMYQMGPHERGHLNSEFGLEDLVTTVDGGTTGFPGAEGKTRSGQPGKGIGQYQENCRANARLLVLSWGCLWEQRGLHWNSEWGASGHRSLLSPERGYKLNSISTMIDGIRTW

SEQ ID NO: 932630 - protein, 333 aa, Homo sapiens
MVSYSMNPVDLFETNDLFESGNVRQVQVSLLALARKAKTKGLQSEVDIGEEYSEKQEGNFDDATMKAGQCIIRLQITNKRASQSGTTPPDGYKQVCQPGGHGGSWDPVAHLRHEAGNHKYDNSSTTLKMGYTLGTNQSSQVFSLGRQIYDPKYCLGAQWPTGLPQVQATARGQWRPLNISLTTKRRPATEAPSTLSPHMVSLSGCLGLSHRAVGEGIKAISRCVSGEGPRWRVQAVGLAVLGRRDLGMEGTGPRRFPVASPLPPFVSRSVCGFCTRKSFKKLLSGWISLGPSDQQTSDPQTYAGARSTAVSPPTTRPAKYCTGPPTQGPRIMR

SEQ ID NO: 932631 - protein, 137 aa, Homo sapiens
MSKRKVHIGGSFLRATPQPPKLTSKVTTVRWAAEGEQHWCLGVASEPLLPEHQHRHISQRKQFALRQFHCEWKRQGCIVHQTMPELAISWRIYVSVQTEKNCWLEKGRTGLFSIFISVINKFLSKVIASVYTPISKV

SEQ ID NO: 932632 - protein, 142 aa, Homo sapiens
MVKSATKAALALTRFIYPKELRTSTQNDTCAQMFKAELFTRAKSGNNPSVHQRMKKMQYYPTIKKEGNYDTCYNMDESGKHANEKGALKCCPLPWEHLESPVLKAEFTTQAAPSEENHECRKLHRDKDPPCRRPLPARLVPT

SEQ ID NO: 932633 - protein, 134 aa, Homo sapiens
MLLLGAPTLRKVHHSLILKGINNRCPTETGLCRLKLWTVSKCLKDLSFWKLPAPFGLRLSSIFKASHPIISTSVAGVIKYAALPACPPGKLKQPSGESNVPAAGPPRLVRAEGIQGFCGAPTASLHAAHSAHEI

SEQ ID NO: 932634 - protein, 115 aa, Homo sapiens
MFPITSLLNSSILCYVIYLKYDYLLAILVLVCGGSEYQMPLMSHPKAPLLSLKFMVKDVDLMKQICGHGFEKWLSTRGDFALHGSSGNVWAHVLVSMIGGCYWRLVGRGQEIGKL

SEQ ID NO: 932635 - protein, 116 aa, Homo sapiens
MASKLTCLRGAGLGMWIQRTSRWAHPPPGKHTFTAAMSTLYGARDFLNVSFNPHLLLLHIDDMMLLVQGLHFENPNHAWIVVNYESQDFQGFVCCLPCKPCHPLRPNLSHSWHISP

SEQ ID NO: 932636 - protein, 145 aa, Homo sapiens
MARVSSRLEEKLEMEPSPPNPGSEQAEQLLPAEGRESCQGGLWSPDASPVGSIQVPRPLGPAPGFLEADGHHRSSGTRFVSIVPDLACALAAPSCGTQTPGESELAGSLEGHSHSCTRHSFPSQARYFSNPCCLSFPYGSQKSNH

SEQ ID NO: 932637 - protein, 192 aa, Homo sapiens [sequence omitted]

SEQ ID NO: 932638 - protein, 153 aa, Homo sapiens
MLYCTGSSFVRNSTEDTGEKYFQAKNGWMHQGCVPVQGPCSLLLYFSREFFEKVTKMSEEKQIKFKCQLLWGVANLGWRHWLLSRGKVRAFAYESQLKAWETLFWETTEGGMALAFSGVTDGTVLDPRQQAGGKLLAKRENSYSTEGIDLDNS

SEQ ID NO: 932639 - protein, 136 aa, Homo sapiens
MPWMDAHGFCQMPGLQRSQPCFLIYQKQQIGLKTSTDIINMTRNKLCQHETCLRRCLGTFTWAWEPRKEAHPKLLLIQVNSSGQEEEKRNYNIIILLLEAADYGPLTVMCQMHCVTTKTLHIWGALQDSSRRQLLA

SEQ ID NO: 932640 - protein, 134 aa, Homo sapiens
MLHKNDEQVLSVIGDASVLPRGLCLLPWICHVAGKSPTNRRLVFGHVTVLGESAGHQCGPVHAVIQGFRLLKAQPCLLGFQGHPEVSFMPASWKEKVYVLKNLGRLTHGVVLNLDLADWALMLQVNMLLGFLTS

SEQ ID NO: 932641 - protein, 150 aa, Homo sapiens
MYSASSQDSHQPENLRAKPAQANTLCIWPGEAGPVPCPYCLKCGINHTQLCGRRNAQYCSPEPPAATDTCPTSAAAPPAQACLQSCQVKGANFARAVAGGTGLPRPGGPHPGLLWGEAVTTNPLSGSRPVLSSPLIGGDGGWQAKFRNPI

SEQ ID NO: 932642 - protein, 146 aa, Homo sapiens
MDFPKIISPHFCSDGDVYSQHSTVVSEGISVYTRNTFPRSRSCPEQLRSSAKAHKALFGSQSYHHPPTLGKCCLFCSVPCIHVLGLYELTNIIIIMFRNCKFWSLKDHQAGFGVTASGCAPQRTPAQDKVNLQPTREDMPLALFFR

SEQ ID NO: 932643 - protein, 160 aa, Homo sapiens
MSCKSGCFRRDCTAETWALCLDLPLIPRVTLSKPSAFLGSCGLTCEKRQLDLATNESDLSNYNFEASRNESLSLKADGHMHHWWTSLLTFLPAGTATFVQNKSILGCEWETKRWVGGWRGEKQIMDHKWCQHEWPSPLNCQGHRNKETVIANKNLRETGG

SEQ ID NO: 932644 - protein, 214 aa, Homo sapiens
MCASLRWVRTSSLSSEKFVITDRLKPSSLNSSKSFSIQLCSVAGPSAAGLLEFAGGPLQTLFTWVSEAEAAEQRILLNSKCCCLIVPLEVSSQRGTRPSRSCPQRWSLQRQAALLELRWAPPSSSFSAALFTYSNLSKGGHPSSSLAATLHLWKALAGHGGSRQLTQSSAIACAKLCKASTYINWEDNAVIFLLVQSMVVDLTGQSACRCGSYD

SEQ ID NO: 932645 - protein, 403 aa, Homo sapiens
MVLTLTIPKTDEWRLHESSCQEYGRRYSVAEREKLFTDLLLKLSGVWAEDSPPGLVVNQAPVIVELLQGTYLVQISLWKAGYKVSKEKAQICGQGVQYLGFYISQGQHELGWEQKETVCSIPQPDTRRQVREFLGAAGFSRIWIPNYSLLAKPLYEAMKGQGKEPLLWGKEQDMAFKEIKKALIQAPALGLPDMTKAFYLYVHERKEMATVVLVQMLGSWYWPVAYLSKQLDFVAKGWPPCFKELAATALLAEDANKLTFGQKLIIQVPHTVVTLTEQRGHHWLSNPKMLRYQGLLCENTYITLETVNTLNPATLLPIEYVEHGKPPLCAPGYHCCVETVDEVFSSQKDLKDQPLKDPDVEYFTDGSSFISKGVKKARFAIVTLSSVAKARPLAVGTSAQKAE

SEQ ID NO: 932646 - protein, 260 aa, Homo sapiens
MDQKKSSFLMKRVLFMLLKCLHNNLCQKYSAHAFQFSPRNVLWLLVVCLRSDNKRPCLEFSQLSVKDSFRDLFIPRIETILMMYTRNNLNCAEPLFEQNNSLNVNFNTQKKTVWLIHGYRPVGSIPLWLQNFVRILLNEEDMNVIVVDWSRGATTFIYNRAVKNTRKVAVSLSVHIKNLLKHGASLDNFHFIGVSLGAHISGFVGKIFHGQLGRITGLDPAGPRFSRKPPYSRLDYTDAKFVDVIHSDSNEFEIICFDSR

SEQ ID NO: 932647 - protein, 145 aa, Homo sapiens
MFGTVPIYYFGGSNKSTLDPEFADIRNKEVSRSNCQCDLLCYLQKDPLGWFSSAHLLWDPPVGSSTKALELQVDLQEHHPPGAVSQLSSHRIWFKMCGTYPLSLCFSCSGGVRSVCFPFAFLHDSSAFSVSKQNDLSNRHPHSHF

SEQ ID NO: 932648 - protein, 169 aa, Homo sapiens
MSQVLQLLYWSAQGPYHFFKKLLSNMNINSRQGIIQEVDVGPTVDSSGQAYSMLLAPTYIHSLKMEQKKNKTRGNVYRSQSTCSYIQMLFYGMDRQQPKMNAPTFLYLRLSSPSPISFPSITNLHKLEDISTFSEVLTRLPPLLTLLDPALAKGDIRPLGFEKGQTRGD

SEQ ID NO: 932649 - protein, 160 aa, Homo sapiens
MPAPLCLPPGSRCCYASWFTLIQYDCCLHKAGSLDTGMHREDDVKTQKEEPSPTKEKGLKHILPSQLSERNNPGGKHLVWATPLPSLDYLRGKRYFLLHGKGEKEDPSRPHYYHRHQQCSPMDTPAVFTSPEPNTGSCLESMLLHLPMRKSQDCAFCPMS

SEQ ID NO: 932650 - protein, 137 aa, Homo sapiens
MNYKDKRWQSVPVGDLKTGMPYTSQCKPKIKFQAPQPTDWNPLSTKEIPKKPEKLVQAVIGSEVYNCNCPTGSPCPRPRESPFIKTGDLQLRKSNSRRGGCVGDWSFIITQIGLPEKSDTEGFKDNLVSRGSRSGEC

SEQ ID NO: 932651 - protein, 156 aa, Homo sapiens
MENQIIQTAGRTRQESGAAHRRDDATSTLQHLGSPAKGSENCQGEGVSDEALAAMELAVCVQHRSESSRFASVSVDGMAHFILRPFSSVVLPRVFEKPILGSERRISNAIVCVMNPLGNLLSMSFPGTPRSKVAQGWSRASPIGWARTHTNRLNQN

SEQ ID NO: 932652 - protein, 197 aa, Homo sapiens
METEPVPVSTKTQGEAMETWNSSFPPGYFRGGKKVALCKPQRQPSSGTKLADTHALKEEIMDVSFRPRPLRAGASSSGFSPTVTVDAFSPKKGSSRRPEGPQCGRKVTRYIPGPSSVVSRDSILVPSTPKSVQGNSVESFASNGVFLADLFHAAPQPTPHFTRHAEDAASPGQGYICLEAVQVLRTLAVSGKPTTTS

SEQ ID NO: 932653 - protein, 136 aa, Homo sapiens
MTLPTSVFSSTFATFHFQSKKSGEENEESCYPITASSRGAGMSTPLSCEAAHKQCQGLLRTLLCRVPLQLEELAPFEAYLPQRVTKLLSGARIAATLSHHSPPSTICTKSCRSWYHGASYSANSPGPERFCNPRWR

SEQ ID NO: 932654 - protein, 131 aa, Homo sapiens
MLTAGLPRCLAVDPKSSLHNYTRSNFYNKSFFLITLTVTLLPCSRGTWLTQALRLPQPHVPTTSRAQPGALCLQLPPELSSSMPNSFMLLVFLQTTHASKLALFRILKSGDNTFHLRESSPFCNNEKSVCD

SEQ ID NO: 932655 - protein, 148 aa, Homo sapiens
MFANHLQSAYCVSRLLHSHFWRHWVLNINVLERRTCNVQGTMLMGSGKLCPVTALVIRDKRGRMAVQNWKDVLSQHCAKALKQDMEEKKGHRHKGKRTATYVMMQTETRGMSLQAKECKDGWQHQTLKRDKKGSFPTVFRRSKALLTC

SEQ ID NO: 932656 - protein, 148 aa, Homo sapiens
MTHYILICPLKHPKHNPTGKNLLKIIETLPWKRLSLLVICLMPLDLNGSISALTDGTTSTSWQQQFSNELPDNISLDLCDQPMDNVFCSTALRTACVCFYVSCERPLGKFQILYNLSEVRYPHLSCVKSGNVKLSEVLENQVIKHVRG

SEQ ID NO: 932657 - protein, 128 aa, Homo sapiens
MYAIGKAAVMKSQRGDFYQEESCLPGTLIYRTGSDLDLSVGSLASHRAYGWSQFQLHHTLPDEIDNIRPNTNCMWFNLRVFYIEGQSYRFQSKRPKFTSDHLLTGYVILGKFLGFSDHSWSSSVKQFN

SEQ ID NO: 932658 - protein, 154 aa, Homo sapiens
MAVHSQCTTVIHSQCTMAIHSQCTTVIHSQCTMAIHHQCTTVIHSQCTMAIHSQCTTVIHSQCTMAIHRQKPGKGGKKRNTLGQNLSSQVETLSHMHVFVWVEIYFLWVRWIIITPKVFQKTSDKVTTAIKLSAICKRLGLRFTEVKHVLKRKN

SEQ ID NO: 932659 - protein, 202 aa, Homo sapiens
MKPRYCALSSQWRKSGSWEAVPFSSEHHLLPNDCSPMDLNADPFHKTVLKAKKEVPAPPKAKAKAKALKAKKAVLKGVHNHKKKKIHTSPTFRRPKTLQLRRQPKYPWKSTPRRNKLDHYAIIKFPLTTESAMKKTGDNNTRVFMVDVKANKHQIKQAVKRLYDIDMIKVNTLIWPDGEKKAYVPLAPDYDALDVANKIGII

SEQ ID NO: 932660 - protein, 148 aa, Homo sapiens
MPCGLAWWVLLGNANWCFPFCPLTFHLGRVWLSQGRDGTAERESTGVRSRLSISRAVRKNSCAQTLGGEADVRDPLPAHAETVQDCGGLQWGSGGASPGSMAMRSPQRGRHGYQPPRLTSAPPQGKNEASPLNLSCSSASGLSFSLCH

SEQ ID NO: 932661 - protein, 195 aa, Homo sapiens
MLSRLAATWWPKKQVLVINIKAPHLTQWRHPCSEYLQGKTNMCELRVQQWPMAPQKALEVPKLHLPMDPTAGQLWLSPWGLSLTDRAGHAACPFWGPCQAQYLLKLEAFWGQREKSNISRGEPRNQPGLPELPGLPEGRGFSWYNLRVELRAMLYEGSHSVLKLMQQETRSGRRLLNSDKGDECPESQVRSSQKL

SEQ ID NO: 932662 - protein, 143 aa, Homo sapiens
MLIGQGGNHKASELSSGAESVPEWEPQDKVSHPGHTDAKGERCKLPVDLPFQGLEDGGPLLTAPLGSAPVGTLCGGSDPTFLFCTALADVLHEGPAPAANFCLSIQVHSWSSGTWHQIPRLHTAWGPWRQPTKPLFPPGPLGL

SEQ ID NO: 932663 - protein, 131 aa, Homo sapiens
MDCMPTDTHTGLTSACFCHQCLIYGQGSPWKSTVAGWAEGPVTFQVAGTSPLFVVTRRDCRVHLSFGGSRVQTFWSQGHTRPSQLCNRKELRALGFFGETEHYPSSMKKISPTLAGAVTNPAQGESECRPA

SEQ ID NO: 932664 - protein, 333 aa, Homo sapiens
MHVEARYPGRPCWSNKSYRAGASHTTLRKHRLTVDMCNDKPNKVRSFVEGVKTPKCGHGLYWDINQQGLKEQNLHVCIKCPLTYQVQRADLVTLLASWHIFSVASCKDSHLFGSLISFYNSNSNYPTLPMSLSDQMLYQGLYVHSLFAPHLQVLRWIPPRPPAGGAWWFLIASFRIPTVSEYPQYLLHFSFLPKPLGLSTVPSRKHSAGPGGCGADALQFADCNLLCAPRSCRFNRMGLEKNTTAPTGPTYTNDRYHQVGTRTRLQVCSAVYCRRTGFSILLGEDAKRFSSSWIPTILSFFLSQLLMAVDTNYTHMTHTFASPLHFPPGLQTP

SEQ ID NO: 932665 - protein, 170 aa, Homo sapiens
MRLPAQEMGQSLFLPPPGRNGGCISGILYSGFPKECLLNTEVHPAPINTAALVPCWRSSSSQYSPVPGTHWVLVKMHTLGPPPGLLDQNCENSTDMYSIVSKGGCSLISRSLPTTVHLELLVPRVPAPPALLQSTEKSLRCSRWCHDECQVKGLDTKDSTVHLASYQGHS

SEQ ID NO: 932666 - protein, 181 aa, Homo sapiens
MLAVKRHPSLNTHCILSHRWALGRHLLPFILVGQYYPNKTSYQIKNAKDYLDLFIAYPGTRTVNEQSFNLFLCFNVPHHSTFLRLAKHSYVTNGVLNQKLRTWILDVRNHFLYDLGEVVPLLSEVTLPKGTSQQERKEEYGRHTGTAQLNAQACPADEDWLPGLQSLRVTSAAPLFDEKAS

SEQ ID NO: 932667 - protein, 135 aa, Homo sapiens
MEPITHLDPVHRASLTSEASCRYSEMWLDFQRLVKARDMKLEISSTCLSKIMNPEDIPREVGRLKGEFGRPHAVHRPMGRGQQTEEEAPTPESCKQRWTTGILTPAGLQGLVSGYEPAGVMPGGPMVSRHVWRNM

SEQ ID NO: 932668 - protein, 146 aa, Homo sapiens
MSFGADVGLQGQGQSKPEVLRLLNIQRIGLGAEAGTGENNRFPKHLGQVLHKGMIRNPNAYKRSEGVLHSFRSSGTCPALLSIPSPGHWSWQQVFQELLEYSPMAGPCAFLHPGMESGARHMLSVQYTFPIPDSLGSLDKPFLLFL

SEQ ID NO: 932669 - protein, 136 aa, Homo sapiens
MTLPNHLGSPLDHHGRRASAYPSCLRAAAAAALILLEALKITNYAQLTLYSSHNFQNLFSSSYLTHILSASRLLQLYSLFVESPTITIVPGVDFNLASHIIPDTTHDPHDCISLIHLIFTPFPHISFFPVPHPDHA

SEQ ID NO: 932670 - protein, 144 aa, Homo sapiens
MAPAAPHSKQHQVSTPGLRHQATICKHQFQACQVPGQSLQAHAPADPGSKYDPVEPSAGLALMDSSSRTAPVSPSTKFSSVPGWPLQTQAEGLPQSQVSPVDPGSRLVPANNSSRPIILDSINWSTTADLGSRRDSRAPGTRPP

SEQ ID NO: 932671 - protein, 162 aa, Homo sapiens
MTMLCLLCLQAFISRKKPFLRRACALQQSQLQASPDALEPCCHGATGSEMLFLLFEAYCLHVTDNSLQPQGCQGRSHHRFSVDEHVFRFRLLKNSFSVANEYPLAKYEESYDNILSVQKKSLGSLYTLSLKQQLRCQVTGLCFINFHIQQLVRLEERIFLWR

SEQ ID NO: 932672 - protein, 151 aa, Homo sapiens
MLSRDQQGNLPLLAWSRDPEISAAAFRVKFSDKSVVSHLYSLYLNSGICEPREIFAFFLPPSFWSYSQRGKGYNVYCLSDKHKLNHLMGSDLKKRNRLPKRKESYCFSPRTKWLVLYSLGILLHLKRQSAVEICLVIVLKGKLHKERPMHK

SEQ ID NO: 932673 - protein, 128 aa, Homo sapiens
MQSDALAAHSGQPGLQTWPPNSVSVTPGRTRELTLPTPPPASRSQNLATCSSDGYLMSLKDTVIPMFVFLDVILCSHHSLHMAPLANCCLFNYVYSFTEGPANPPIGTACLGENDFRFPWLWRLALYQ

SEQ ID NO: 932674 - protein, 144 aa, Homo sapiens
MSYPWNHIVRGLFDWLLSLNAMHLYCNREGKDEYPEMKKNEHGETPTSWERQWKDPLAPEDKGEGESQRKRSCLLRATFNKTPSSRLEKAKKDDLQKSFPELCALQAAAVKTTMTAVTVRCRYLHSYEGNSVIAFPPSVPMSTQ

SEQ ID NO: 932675 - protein, 136 aa, Homo sapiens
MKFPFARVARAVAERLSVAPEGSVQGVGEFAAGSIALAGGGWRPRPGGPAWEVQSCYQWLARIARQWVLSCEVLSKWGLPGVPTQAPGFSLFPRDYSKIYMEIRGTLNSQNNFENKKESWENPTSHFQILLQGYIH

SEQ ID NO: 932676 - protein, 158 aa, Homo sapiens
MLLSMMVSTECQLDWIEGCKVLILGVSAPGSGSDGDHTPAPNPGELSSLRQQAAEVMATAYAPGSSVILVPNVIMFSLMDHSTNRLFGPVEIRLFGPLPVISWQTIPTSINPLPTQDLLLTPDHWIMPPLFFDEFLLIVPFPLSSEITLCHLQNIRYG

SEQ ID NO: 932677 - protein, 175 aa, Homo sapiens
MVGSFFLFFWKHLLLSLDWLIKLQCLSRLLAATTDYYRQSNLQKLEAYLTHSSGGWKVQDPGATSGKTSYQVVNSPMEEPHNMAVKSGDNLEHLRAAKVTQNYSKWHTVEKGGMHKTGPGVYGLFEWTMVQALDSLTQMPTRTKVVPENTDRIFDVSKKTHPWNKNDLRWCAVKN

SEQ ID NO: 932678 - protein, 153 aa, Homo sapiens
MRVESDDYVSWERFWCLAGIPSQWVLPCEVPWKWALQAVATQPPGFSLYLESMYGGLPSCFGEVATSLAGKHGKPEYLKLLGLFTCLSGCSVETPCSSACFVRLEVTAIEEMLQALVNTTKDNEQKSPFDVKSDFKSIVSKQESRGYREPSGR

SEQ ID NO: 932679 - protein, 256 aa, Homo sapiens
MGSAEDRKMWESLELPRDLLNAFDQNADSDMDNEVQAGVVSDGDEELIGNWSKCHCCCALAKRLVAFCPCPGDLWSFELERTELGYLVEEISKHPGIQDVAWLLLTSYSHMYLQRDYQKLELMFKREAEYKSLENLQPDHAVEKKIQALRPRMKKWFHVHGPGPCCSVQPQDMAPCVPAAPAPTMAKRGQGTAQAIASEGKSSKPWQLPHGVVLASVQKTRTELQCQISVLVTDYGPQSINYVLSVPSQKQIGLPL

SEQ ID NO: 932680 - protein, 148 aa, Homo sapiens
MNVGVEWLPGADGKVEPAHLWPPPLGLHCGRTEASTIMGLAHSLQEPLPGYWLCLVKARGFCNLQVAKPIRLVGFPSRWRVTPSSSRGVSHHGHHCPRAMDKYCLATGNVHSRPKGSSVSFGECFQDWDSPFRTPGSPLAPGRSRNAI

SEQ ID NO: 932681 - protein, 125 aa, Homo sapiens
MGPLSLLNSVDKELRITFLYCMRNFTLSTSDITSENADGFETVCCSIYLLRAQAFWLEPEPDQASSVLECNCCAPKTQTSFIIFSDFHDSEIVKFPEAFPATWNCESIKSLSFINNPVSGHRWIY

SEQ ID NO: 932682 - protein, 214 aa, Homo sapiens [sequence omitted]

SEQ ID NO: 932683 - protein, 170 aa, Homo sapiens
MRGLNPPSSSVTQWPSFVPPKVWLSQTVTTTNLSASFWKLLLLGHGSGYGYGYFDLLGCQSYFFVISVKLSWTVLILGMVKGWSYTVCMSVGRRIHFKLTTIEESYNFLVFNKHERNHWLIEMKYVRSNITFKNKVTRTYSEEWKYQLMDTVICEGRETKPFHITLKKAQ

SEQ ID NO: 932684 - protein, 163 aa, Homo sapiens
MPKALGGHPLHQYNLNLTPVTKQGPQSCRLKALDSTNTGNSQDSSDLQTTELLWMEDQTSHNIPLCQSLIQSKPLTLFNSTKAERDAIRNIRNSQEKGKISTLIEVWKKPIPTIMNDFEGFKNSVEEVTADGVEIARELELEVDPEDVAELLEDATNIVEMTT

SEQ ID NO: 932685 - protein, 141 aa, Homo sapiens
MSTFSTEAGVMEDCISETWPATGPIPGNSGVFLCSSEYSQIGPLVFAYNAVYRSSPLPYLQGAMKIGDKYICLENWSPNSQKDRANIICLSIQSILDGFRFYLGNLIKQPGRINHQRKEETGSHHHVPNRIFIYPSEDSSK

SEQ ID NO: 932686 - protein, 139 aa, Homo sapiens
MAGTRGERGTGHLWALAAGVAEAGSEDALCPCSEPAGSVLAAITRAHRLGAHKQQKPVSHCSGSLLWSWTPAVKAPPDSVSVCFLVHRWHLLAVSTCGRRSKGTLWGPFHKGANPIRKGSTSPEPHLLTPAHWGRDFNI

SEQ ID NO: 932687 - protein, 418 aa, Homo sapiens
MLGDSVDLEASQAGKDSSPLHSDFCEELKAGRDLKPGAMGIGKAAAVALLCRGPGQPCAVRRRPSFYRLGAWLPSHEGSEACSSYVTARVCTRLAVCGRVPGARAQEQGLRAEQELGEEQGAVPLPHSTAHDPALEPGARGESRVLEQEGLLHRRACPATPQPPDSGLLDLFSNLHSRARPGLESSGQRGFGPALQECRGLLTVTHVAVAIPELLWDFLGFRQPPLDPGAAQGHEPGDTCLMFRSDCCMLESDVAGQARRMLGATVSFLSHSALAGRVFGTALQMGVNDKSSIWSGVKSHLLPPWFLPEKALRRLRSMAGVLIKRGQVDRDRHRGAPMRTRGEDGHLKAKGRSSEELALPRLDLGFRPPEQEKIRVCCWSLRLGSFVVATPVNSHRTCELTQDTQKFPQCLLWNFLVF

SEQ ID NO: 932688 - protein, 398 aa, Homo sapiens
MTITITITITTITITTTNTTTNPTTTTITITTTTTITITTIITTTITTISITTITITTITTITTTNTTTITTITTTTITTTTTTTITTTITTTNTATITITTITIMTITITTTITITTTNTTTTITTTTTTITTTTTITITTTITITTIITTTITTIITTIITTITTTITTTTTTITIITITITTITTTITTTTITTTITNTNTTITTTITITISSIITTIITTINITTITISIIITTTTITTTTNTTTITITTITIMTITITTTITITTTNTTTTITTTNTTTTTITITTTTTTTTITITIIITTTITTIITTITTTTTITTNTTITTTITITISSIITTIITTITITTITISSIITTIITTITITTITTTTITITTTTINITTTITTTTITITTTT

SEQ ID NO: 932689 - protein, 149 aa, Homo sapiens
MLLHFEGRDRKAPSGDGVPTRGPSKRRVFLIQPAQADYEFSLCQKCQNPSSWQAVVTLLTRDLEFLDGVCRGGTRTDEALQGQWLPLPKQPGQAGLPSTDAHFKLPLPLGALWNEGMQGEAWQEAAWSLGQVKNMSSAGGGGGGASAGP

SEQ ID NO: 932690 - protein, 180 aa, Homo sapiens
MERKVNFAHQENLVSQQLWSCCDTDCWLPWLQLWADSDVILQHSSPQHSSQSSPSCASGPEIGASSPQLLQQTATNGVIYNSRNVSRLRLEARRLRSRDLTLGHCLVFRSGGEAQLGSPGQQPGAGDFAACRDFWAPKPQANAAWLRQHGVPSRATLIGNSPQDSRVGPENNGLCRRKRL

SEQ ID NO: 932691 - protein, 190 aa, Homo sapiens
MTFSSSRAGGFSRSAGVTARGRGGGATVTEWGSHLPEALGPGQEVFWQLVGTELPPPPNSWWDFLWSLQGPLKWKAVESEASLPLGKKAFSEQRQAMGPGGKSVCPCQPCTSPSGQAIGPGGRQGLERQKSAQKEGDRRMAQEERMVLEKLLCGREEPCGPRPEDDGAPGSWHLTGISPWIHLTGTSDLH

SEQ ID NO: 932692 - protein, 174 aa, Homo sapiens
MLGFQAPIATHQWLFSVRNDKNTLDTPRSAGCDGAHRPRQEPAPDGPIVLLCLEPMPAPGSYPGGAPVSGHRQVHPQQWQVQHLGQSGGIRTGLGANCGKSHDSAYKKGGDVCFPGEMVPVVHQILKGVQHPNKCRGHWGTLVQQKQPWTGSRGPTADQLHPKNSSLTLVFPSR

SEQ ID NO: 932693 - protein, 151 aa, Homo sapiens
MRRAASLSRTRQLRLLLDNEPPLNSEVSNNTCLGGSGSQLVSADGHLARRLNASLNCPLLHFHFFHIFPRDPNRHAGPPVGPGLTLDPNRHAGPPAGPGLTLDPNGHAGHPARSGLTLDPNRHTGPPAGPGLTLDPNGHGPPSWTWSHSRS

SEQ ID NO: 932694 - protein, 179 aa, Homo sapiens
MAGPGTREWTSWSAPGSPRWPAPGLGSGQAGAPLALHDGRPRDSGVDKLERPWLSTMAGPGTREWTSWSAPGSPRWPAPGLGSGQAGAPLALHDGRPRDSGVDKQTPPPPPVLSVFKWGPATGGKGETSADGARDANRCESHVCAFPGGPIIWMSGREEGNLPWQPTCWVHPVLWVWDF

SEQ ID NO: 932695 - protein, 145 aa, Homo sapiens [sequence omitted]

SEQ ID NO: 932696 - protein, 288 aa, Homo sapiens
MVSESPGVGRSSGPRPSHCLKVQGLATHSAHHAVTPGSYSGPLGKPLALTHGPAQTSSPLKGVALAFSWLSAMCGMMLAFSRLSGVFGVSMSSVSVLGTPSPAAMAVGTTGQHTFAACEDRTGGLGSAGHTVCSVRGLDLVLEGSCRPRVKEGVRLCSGETWIVDMGSQRGLQTPGLEPSPRGTLVSEKPEEGVPGTWGMTMDLCCHLVAGLTYLSHVLFSRFRNILVGGAFSSLQQTGSSVGHTIWAVCPAFSRGPQDPAGYSLERTEPQTLKATAVIAHLCLRSAF

SEQ ID NO: 932697 - protein, 187 aa, Homo sapiens
MSSVSVLGTPSPAAMAVGTTGQHTFAACQDRTGGLGSAGHTVCSVRGLDLVLEGSCRPRVKEGVRLCSGETWIVDMGSQRGLQTPGLGGTPSPVQPLPNPGFRRGSKTLRVASDSWVTLAQHTLSSSLMSSPGGTGTGTVILGAIGVLSPHCSLSLSSGRTVHFFSSSFAFSGAFSGVLRSFKCFMD

SEQ ID NO: 932698 - protein, 129 aa, Homo sapiens
MLGSGEEAAGPSQSTSCMGTPPLDSHSTCCALEMDILANHKFRTRHCQEKKLPAGLQALCGIFLRGLLGLALLGVWALDNFHVDPDSWAPWTHNIHAILRGGDKHSTSAVGWNQTVFVNKLPGANVGKF

SEQ ID NO: 932699 - protein, 191 aa, Homo sapiens
MRQHTSAPAAMVSEEAGENEIKEDLDMIITSHHMARFQLQVLTHAKNQEDSSSADKRQSTDTNTNTQMTWAPKLPNRAFKKDIIKMLQALDGPHVVGAFRFSEIQSSLERGHFAGEKTPPEEQSSEGQVAVNAVQLATPEASIMRRAVVSLNVKRRPARLWTAGSLGEQGGVRPLTREPCCGGCVRMLSTA

SEQ ID NO: 932700 - protein, 151 aa, Homo sapiens
MLRLGIQHALSELERGVDEDEGSPGLLQWSSLLSVQAPEPALGLRSQCPCHCVAVGMVQLACGFGAWRAVARAVCAWRVVEAGIAGSQHAPTINLPGWHRVAFLGDTGERGGSSGVMCSPTLPGAIFVGLCLYLWGLWGVCCDFLLPLPPG

SEQ ID NO: 932701 - protein, 190 aa, Homo sapiens
MEASHGPPALLWNSGRNTQPGPGHEKRPHKPNLRCILQNKWLKRLKNVKVRKGQIKGDKEVSAENNDHGGPDASYLGCDPGLGLLAPPAPHSLRARLRLPPSPCSQGKPLPAGLEGSLFQLLPHWPPAGSGQRGGGKSTDPSGSLARVSQAPVDPGIWGQRGGHGKGTVLALGPSGDRPALVPMGSRGRP

SEQ ID NO: 932702 - protein, 152 aa, Homo sapiens
MVDVQTSHQRSCPHSAAAPTCHLAGSVVRRLVTAQLGPVLGSQRHQRAISPALWSDAWSRLSWGLCWGLSGTNVPSRLLCGQTPGHGSAGACAGVSAAPTCHLAGSVVRRLVTAQLGPVLGSQRHQRAISPALCIKNALKRPNIICLKYECV

SEQ ID NO: 932703 - protein, 256 aa, Homo sapiens
MGRQRIHFRRWLNQDIEACEVTACNTVHTGVGDAITPDSPEEGADADDSKLGPTTCSVESSTPPAVDPVLRLDPGPVPQLPHGSSESRHSLSGQPLGTTQPQLCKPPPAGPGPQGNKRGSGSPGSEGGVSGDAEATEFTAGWSRTDGSSQNPTLEGLRALGPVAGFESSSCSRVNAEVLFIFREAGLGDIVTLQVLPIRVLQKGREEAHLPHGRNVRAQLRVALILRHVVFEQSVLFGFCSFQITDEQMEALTAEI

SEQ ID NO: 932704 - protein, 192 aa, Homo sapiens
MGCFCVCFCVSVSSPLLTWTPAIRLGPPNPIELQDTGRPGSWSIDCSALVATSLPADDQEVAVSISRGWRSTFSECQEDVSLDWQLQPGPGPGGTAVSKLTRLTANLFPVPGSFGTVSSGDCGQAQPSPLATVPQPLTGVPRCFQPYNFSSGPTRGPPPELRHRRPALQKTWVSDHYQSLTNSPNSFLINVP

SEQ ID NO: 932705 - protein, 219 aa, Homo sapiens
MGGKRGPSRAGGWRRWRGWGPPCSPGRAPPPAPARCCSDFASRARPPVAPAPFPGRPGWGCVRLRGPGCWGPRPARRADGGPGTRPLVAAALGGAGFPPSAPRPLPYPVSCVRLAQASRERPRVRSSCRNCRSWGLRVGSREGRDSRAWARRLGQSLGMRRATPATPFPLETTELAEGPLLPLEASTSSVLEDAPGASPTRAAGALTGGCSTLSLGCQQ

SEQ ID NO: 932706 - protein, 324 aa, Homo sapiens
MFGAHEDLELPSGRIVTRGRNKQEGGCHFQRLHGRACAIAGHSLDGRRQQGSCERGPATPCLRVCGVCTCFAPTGRFLQDSHEHLQCPRSKEGMLPGAEVATMTLGQQMAAEAWAAGFHGSLGSDPCTEETRAFLAPQFGFLVPLRSADGRAAPGVGLSTPAPEVALPSLPQVQDLVQNCEGSLKLPTAAHMLPDEEAGDQTKDTDHAQAGDQTKDTDHAQARDQTKDTDHAQAVQLVQSQVEITRAGAQRATSQWLQILVSDSWVLGELPFIHRALRLSSELDLDFDGWKEWVMLIFSIISTLGYCHGFYRTEQRGTNAEMKT

SEQ ID NO: 932707 - protein, 204 aa, Homo sapiens
MGSACSHFAIHRDRSPWAGRAPDPGQEEPPTPRRSLCSEGPQEPSTLAAAHGPWHQKGRHRTLGPLLAQPSTCSSSRPQRSLTSQPLIAGLLPGSQSLFPAMEEPSLCPAGLPSGLTPVSLQGPLAIPGSQRTRPSPLGLGAAALPGGSTFPRDLAGFLPASAQGLPWSRSGHTHCMDKRNNMAPSASPPGQRQGEQAPDVLMG

SEQ ID NO: 932708 - protein, 160 aa, Homo sapiens
MSSVKAIFTSFVILQLLPTIWMYTCSLPTPGLEQGFRLREQTCFFSSLESTESSAFWKYTAELFLKCERTAMDATPGPGSDLPQESEPSAAPAGGEVLGVPKFASGMWCGAQSLQGGPGSAPESYQEAEPSHAAQLLQMPEPQKPGDSDVYCPPNPDEIN

SEQ ID NO: 932709 - protein, 147 aa, Homo sapiens
MLGWGRRELGAGGGVRNDRKARKARMTSYQRVCYRHARRSKINIQGTYLNVIKAIYDKPTANITLNGEKLKALPLRTAKIQEKEIKGIQIGTEEVKLSLFADDMIVHLENPKDSYKKLLELIKEFSKVSRCKINVHKSVALLYTNSD

SEQ ID NO: 932710 - protein, 333 aa, Homo sapiens
MGRQRRETQEAVRQQLGWQEEAEAPQEGTGTQQVDLHTGWQRRDTEEEDLQQEAVQQAGWQLDCWQHDVEAPEQTGTQQACWQGEEVQQAGWQLDCWQHEEESSEQVGTQHTGTQQTGTQQACWQGEEVQQVGWQLDCWQHEGVQELVQPDWQGLGSQTAWQQGLDTQLTQLDCWQHEEEIPEQTGLQQTGTQQACWQGEEVQQADWQLDCWQHEESPQQTDTQHTGLQQTVLQQTGTQQACWQGEEAQQASWQLDCWQHEGVQELVQPDWQGLGSQVTGQQGLDTRLTGVQTRLRQGAGAQQGGSQQLSGQSSTCQESEQESQEPGRQTRLP

SEQ ID NO: 932711 - protein, 384 aa, Homo sapiens
MAWEHPLALLGSLPTCCWGSRAGVKNPGVQVAVSTQALDDLKEITQQLDFWVEVGPQQAGREHAGRQRRDTQEAGRQQLAWQEEVGAQQEGTGTQQAGLHTGRQRRDTEEEGLQQEVVQQAGWQLDCWQHEVEAPEQTGTQHTGLQQTGTQQPCWLWEEVQQAGWQHEPESSEQVGTQQTGLQQTGTQQACWQGEEVQQAGLQLDCWQHEGVQELMQPDWQGLGSQTAWQQGLDTQLTQLDCWQHEEEIPEQTGLQQMGTQQACWQGEEVQQADWQLDCWQHEESPLQTGTQYTGLQQTVLQQTGTQQACWQGEEAQQASWQLDCWQHEGVQELVQPDWQGLGSQLRSLEQTDIVDAAMLGIELEEMGNTSSAKSTATLNSTAV

SEQ ID NO: 932712 - protein, 344 aa, Homo sapiens
MAGGDQCQLKTVCPPRRTTGKENQVTKESLLGRPEPAGPGGRAHQQLDSWPEQRPQQARREHAGRQRKDRQEAGWQQLGWQEEAGTQQEGTGTQQAGRHTGRQRRDTEEEGLQQEVVQQAGWQLDFWQHREEAPEQTGTQQMGLQQMGTQQACWHGEKVQQADWQLDCWQHGEEAPEQMDTQHTGLQQLDLQHTGTQQACWQGEEVQQAGWQLDCWQHEGVQESVQPDWQGLGSQLTGAQTRARQGAGAQQLGVQQLEAQERGSQQLSWQLSTCQEEPVQVLGEETRLTRPTSLEQTDMVDAAITYVLVQQASAMVGAGLGGVSAGVRCVDYFGEDVEHYQSPK

SEQ ID NO: 932713 - protein, 287 aa, Homo sapiens
MSIRSSAYSDSWQVDDCPESCCEPPCCATSCCAPAPCLTLVCTPVSRVSSPCCQVTCEPSPCQSGCTSSCTPSCCQQSSCQPAYCTSSPCQQACCVPVCCKPVCCVPVCCGASSCCQQSSYQPACCASSSCQPACCVPVCCKPVCCAPTCSEDSYSCCQQSSCQPACCTSSPCQQSYCVPVCCKPVCCKPICCVPVCSGASSLCCQQSGCQPACCTTSCCRPSSSVSLLCRPVCRPACCVPVSSCCAPTSSRQPSYCRQASCVSLLCRPVCSRPACYSFSSGQKSSC

SEQ ID NO: 932714 - protein, 193 aa, Homo sapiens
MWSLCLALFTQHVFKSLQFSQRMPLPTECDWKAPHQGLQELPFLNPELVSITVSVCTTAPEALGHSPYHSGSLCKMLLTPATALWPPLSLHPSLCGLSLPAQLPGLRSIPTFPFWKRAVPPAVGPVWGSFVPTGYGRGPQTRLCSPKARRVGGIAAPGHQCGGCGNYPQEASFLLSGLDTFPHCPGTPLSSPP

SEQ ID NO: 932715 - protein, 240 aa, Homo sapiens
MRDTVLSAFNKTARRELAGRQRRDTQEAGQQQLDWQEEVGAQQEETGTQQVDLHTGWQRRDTEEEGLQQEEEEVQQAGWQLDCWQHEEESSEQVDTQHTGLQQTGTQQAGWQEEEAQQAGWQLDCRQHEEAAPQQTGTQHTGLQQTVLQQTGTQQACWQGEEVQQAGWQLDCWQHDGVQELVQPDWQALGSQAAWQQGLDTQLTGVQTRLREGAGAQQLGALQGGSQQLSGQSSTCQESE

SEQ ID NO: 932716 - protein, 164 aa, Homo sapiens
MDENISHKKLTSRPKLFMVEHDAGKYTRENKMLGNTVETTTRKTTVVFLCYPDDRTQLLPSLPANLLHTQPLPGILLCARELPVLRVHARELHAHCVRGSLLPALRVRARELQAHHICDSLLPIFGVLPAPLHHCPLQTHLLQHPFLLLTSCSWYTGVHTCIPP

SEQ ID NO: 932717 - protein, 285 aa, Homo sapiens
MLHRLTGSSSSVHCDHAADTLLQAALWLTTGNIAGAGLLFFGGGIGGTILYAKWASHFRERVEKTIPYSDKLFEVVLGSAPYNVPLPKKSTQSGPLKISSVSEVTKEFKQPASQLQKQKGDTPASATAGDTVLVPGVQHEESLKTDHPAIDEGKPTPALSEEASSSSIRERPCEEIAACLAQEEKQEQVKTESLAKSFEDALRQTANVTLQAIAAQNTVVQAVNAHSNILKAAMDNSEIEGKKKSAKCHTVQETKQIMEILTAYASAVGTRTTQVQPEDSNYIHK

SEQ ID NO: 932718 - protein, 189 aa, Homo sapiens
MNSLRGAGGLLLSSPLPMRTPRAGPSGVCALSGSRDVASPGPVSADPKGSREPGRGQTRASPSCFRRWGSTGRAGSPSHAIAPEPGFLLRPDSAGTGRERCARLPSLVLGDSHQTGGVFVPPWLFAPTRAFPCSSEAARREQAHQKASPTERRLPFPNELRKLGRMLAPMQMLVEICMVVSGPGEKQNI

SEQ ID NO: 932719 - protein, 141 aa, Homo sapiens [sequence omitted]

SEQ ID NO: 932720 - protein, 280 aa, Homo sapiens
MVTPQDVHTVTLEPVNVAYLEIGFLQRHLQKPEEAGGPSTGPCDPQTDGPSAGPCDPQTDGPSAGRCDPQTDGHSSGRCDPQTDGPSAGRCDPQTDGHSAGRCDPQTDGPSSGPCDPQTDGPSAGRCDPQTDGHSAGRCDPQTDGHSAGRCDPQTDGPSAGRCDPQTDGHSAGRCDPQTDGPSSGPCDPQTDGPSAGRCDPQTDGHSAGRCDPQTDGRCDPQTDGPSAGRCDPQTDGPSAGPCDPQTDGPSSGPCDPQTDGPSAGRCDPQTDGGKDPPQR

SEQ ID NO: 932721 - protein, 174 aa, Homo sapiens
MPVPDLGLRGPSGALQELPAGATSRCPQERLWEHPSQENPTECPPIIPQEHPPLMAFPVQSPASPRDPPGPQDTAPSTPRATGLLHEVDHPGAQKVPSQSPRPHEPFRGTGTPGGFPQPLITTDPLPTRQILSVFPGELCARVSSLFSWVLALGIWRFPASLTGTSGGLCSKDP

SEQ ID NO: 932722 - protein, 131 aa, Homo sapiens
MSILAIFLTVITFCVKQIPTILRTTLDMFILVTKFKRSFSEFDAVLFSYLLSPIFTQSPTEEYLACFQVLATINKAAINVSVDIRVQLIWVNAKECDCWILCSNDERSCCSTPWPAFGGVGGRVLAILIGV

SEQ ID NO: 932723 - protein, 234 aa, Homo sapiens
MEWNGMEWNGMEWNLPEWNGIEWNLMEWNGMEWNGIKWNAMEWKKNRVEWNGIEWNNRRGMEWNGVEWNGIEWNGMEWNGMEWNGMERNGMETTRVEWNGMEWKGMEWNGMEWNGMEWNGINPSGMEWIGMEWNGMEYNGMQWNHPEWNGMVWNAMEWNGTERNEMQWNRLNASGFEWNGMDWNGMEWIAVEWNRIITNGMERNGMEWNGMEWQGTEWNQPERNGMEWNGMEST

SEQ ID NO: 932724 - protein, 139 aa, Homo sapiens
MKAVWKRAIRSAGALDSHSSANPIVNCACKEFRLCTPYESLILDDVKCNSFIPKPAPQDPPPLHPPARSLEKLSSMKLVPGPKKKVLAHVKVPEEFLDFCMEAIQERLMRGMERSCKGPDVWSLTNFLVAEWTWKERIL

SEQ ID NO: 932725 - protein, 155 aa, Homo sapiens
MGAVREAFHVFLELLGKHTPLHKSAHLNSNAHTVQIQMSFLSFLNAETSLFSHLKEKDEELLLVNEQRKWFLEMESTPGKDAVNTVEMTAKDSKYYINSVEKAVAGFERIDSSFVRSSTVEVVTTTPTFSNHHPDQSAAISIEARPSTSKMTMTH

SEQ ID NO: 932726 - protein, 192 aa, Homo sapiens
MGPQHQPIVTVGSQAHLSRAGKGTRHTPRMSGQVLRKVTMNTVGKGLTLYGNEKDNETAPLIKCCKVMNDSRHTGAVGIMARTPELDWRNGWDPEGLPGGRGMKEQFEFGMWISFVHVELEIPVSLLSSDVQKQLNLWIWSSGAEPKGDEDMGIIRLWLVIEISGMSDAPKKNVCCEKIADLGITLQSTVNV

SEQ ID NO: 932727 - protein, 162 aa, Homo sapiens
MPKRSSLPFIRACPADFRLVQPTPQLCKPVICNKSKGAQKYSVVIEKRNPGFHRSSIYGVGDDLKRANLALKAGPGADKFKSLGVRRAPGFPVPFLEFVSFRTSNQVATITLLNPGESGHLASHTPLSTGSLKDTTSGPMSRAGEDKIYNIVVQRAKINLHQ

SEQ ID NO: 932728 - protein, 221 aa, Homo sapiens
MTGQRKMARGFVTVPATPAVAERLQRTAQTVASEGGSSKPWQLPRGVEPIGAQKSRIEVWEPPPRFQKMYGNAWMPRQKFAAGTGPSWRTSARAVQKGNVGSEPPHRVHTGSLPSGAVRRLLPSSRPQNGRSTDSLHCAPGKAADTQYQPVKAAGREAVPCKATGMQLPKTMGTHLLHQSDLDMRPGVKGDNSGALKFDCPTRIQTCMGPVTPLFWPISPI

SEQ ID NO: 932729 - protein, 153 aa, Homo sapiens
MTLWKPTHHVSASEGRQGGVCLSGTSVCSQQQRATVQKALLHYPLASRISVEKPNAIKISSHGETSFNILPEQGQGMGINLTISVLEANRQMKNKWSVLSSFNIQIFTSFSFFHRGISRCASNLILGFSDFRDVRNKFLSFKPPNLWQFVTTA

SEQ ID NO: 932730 - protein, 147 aa, Homo sapiens
MAHVYICSEAMMTSLELTGHIAHGRMVSSKESVEIRGWSCSKVIAHRSLSELPGCESPEDIKRNKTPKSDSLVVDFQNLLLEDKAKLLRAVEDSTQGRVQTIDTAGVEEENNECWCAMEKLEPLCTVGRNVRWCSCYGKQYGGSSKN

SEQ ID NO: 932731 - protein, 138 aa, Homo sapiens
MASADPHPVYPRCSLTSMASAAPPPESHRCSLTSTASADPPPESPGCSLTSVASADPPPEPSRCFLTSTASADPHPEIPGVSSPPQPLQILIQSHQGHPLHSWKCNMWKEQGLIKCAGQEHGLYSLTELDSNPTSFTY

SEQ ID NO: 932732 - protein, 169 aa, Homo sapiens
MEPLGIGEEQVLRLRWTAVFFLIARSTPLEELLLTPFSYNCLNTYFSVFTADQPASGDPDMIAFKLNAWSRMTHQSSGNTGNSEDLQGKETQEPEQQGGAPPPTLFPSVQHKEETFSRNDEDGPEPFPPPREKPLPSFPPPLRRPSFIGPESKKSICENGVHSSFTRDG

SEQ ID NO: 932733 - protein, 133 aa, Homo sapiens
MRTPGCPGRGGLQWQSPHGKPLLGQCRSLQATQKQMADQIWFPDHGLPTCACDLLSSKGESSRLREALKRIQFPAIVGLKFLFPSWPMAWDYSLLLNAASFLDLWTFAFKASGDIGAKEDFKDPESNGKNHAT

SEQ ID NO: 932734 - protein, 158 aa, Homo sapiens
MALQARLWYWCGSYRGMTQATDSPRQADSPPRYPGPPQWKEGFELGAGVPGENVAPETETSVQTNGVPRENADSGNVLAVWGGPEPTPRPHSFFSSSDTFWGSVLLRPLWHLAGSGWTMSELGGRTAHLYNGFPGERTRDPLLQASAPLWNEFNSKVR

SEQ ID NO: 932735 - protein, 217 aa, Homo sapiens
MGGGHPCPGLTVRKRFIDHSSRPTRATPPPPDACRAPQHLLEAAQGPLRPLGPPSHWPRVGGGVRISTKAPKPAASAGKELCWGLRCWRGAPVPMCPMRAPVPGECGVTREFTAWARTRERTQGIPVPSAGRDGATLKGIYTHQPQFRSQPHSCPCCGVLGQPLNLSKPAIGCLKKKSDSNADQHRRLLWGGLSGGWGGPKPSQQPAVPTQHPYLDS

SEQ ID NO: 932736 - protein, 187 aa, Homo sapiens
MFFMCFSLFFSACFGSAVTKLLPSGNSAYLTVLSLLNNSHPIQVCTPSGYLWSCGHLFNQHINSLSLIWDHELNGYQHIDNIWFRGQCTTPYNVQLYTITYLRAKWAIRLILAGVEAAIGLPTPWGKFAYYEATLQNFTSSFYALSHKTGDTLETLKLSLDSFADIIIDDRLAREYYTYWLNKEYAL

SEQ ID NO: 932737 - protein, 147 aa, Homo sapiens
MWNSHFFMENFLLQHLWPLKAPSALFYPGSQGSLSSQGWLPALEDLRTKPGPKLDMRSFTTQVPRGAQALTRRTGIPGWAQEWGLDKQEKPPPEAAPGAVLWGSRWSRKQEEGTGPHTQVSEDPKNILDWQLSLWVFMGSAAAWVGR

SEQ ID NO: 932738 - protein, 140 aa, Homo sapiens
MTSGPKRQILCGDVQTLLAGPPECLLAPPPPCKTLAMGSGTSMLTACKAAPATEWAQTPTRQGGTTPFLREERLSLSTLFEIASSPPSWNPKLFSSCFIFLQSIYHHLARRGTLICEAEDCANDSCTGLDDSLQEDMFMS

SEQ ID NO: 932739 - protein, 125 aa, Homo sapiens
MNWGRTKVSKAWAVPGPWEALGVTVLLLELLPDKSSGGTLVHWDTTDAGWKAELPAVGEGWQGAMVRVSEADSKPEGWEKNISLETCSQTFLETRRIQDPVQIVGWDFQFLDEEKLRDWASLLCS

SEQ ID NO: 932740 - protein, 283 aa, Homo sapiens
MAYQGSNLPSLELLICRCLFHLPIALLLKLRGDPLLGPPDIRGWACFCALLNVLSIGCAYSAVQVVPAGNAATVRKGSSTVCSAVLTLCLESQGLGGYEWCGLLGSILGLIIILGPGLWTLQEGTTGVYTTLGYVQAFLGGLALSLGLLVYRSLHFPSCLPTVAFLSGLVGLLGCVPGLFVLQTPVLPSDLLSWSCVGAEGILALVSFTCVGYAVTKAHPALVCAVLHSEVVVALILQYYMLHETVALSDIMGAGVVLGSIAIITARNLSCERTGKVEELWTY

SEQ ID NO: 932741 - protein, 134 aa, Homo sapiens
MYVAESTRKTLLYHMEFSELTSRYIKIINGQVTQGEIDPGLVRLSIILPDMLRQKAGFNLWWDFKFRDTFAVMCHYYCHIPCRNSSPFGECPTLSWAARVSQQLQVILAPCPTEERALLKTVSALPPENVIESE

SEQ ID NO: 932742 - protein, 148 aa, Homo sapiens
MHHAYAVLKGKSPQEAYAATSSHNAGKPGKNVYVYKSMDQGVGNGEDLQVNGQDQLCISSRCFFHVLFHETLTKHPASTIGMPLSSISVSLGSPLLFAYDVTYWPPSGRGAHSSGPDMGIFLHLDPAITKNSPSYFNYSLNVTLELAS

SEQ ID NO: 932743 - protein, 153 aa, Homo sapiens
MLDPILGARRYWGACGPAEGIHGQAYTLQVEGVGPLGPRKAPRHQERKKQNPPELGVLRLKERVEELRLGAVCVLMHHAYAVLKGKSPQEAYAATSSHNAGKPGKNVYVYKSMDQGVGNGEDLQVNGQDQLCISSRCFFHVLFHETLTKHPAR

SEQ ID NO: 932744 - protein, 214 aa, Homo sapiens
MFILELSTAHPWFLLLTILRLQQEATGKAPDSPSLHVSGADMHAREYMGNSSSVKKAEVVEGLSDENPFSGDLKAVRKCTKRLHDNLCMQRVSGYPVTSGLDPMPNTRCIRKVNDTFALKKFTIERELQKRLGTNVREMVIDSQGEIRCKVLFESWRSTDFLSFFLPGLIFIFFFISTVVIWNLPFCVRLRLESGMTASCAYDAIVNGHDERES

SEQ ID NO: 932745 - protein, 151 aa, Homo sapiens
MSVYLRSKVEFGPMDYLATWPAQFQIWQLNYLHSHFQVWVSRASHICVFYPGKIGHGVDTRLVIDPHVGAKDASTILFQEVLAALKRVLGFRCDTATVKAKGCVFEWAVCQISEKTCQTTVNYKLDEVGELVQKSLNQTETKHSPNDMSFL

SEQ ID NO: 932746 - protein, 138 aa, Homo sapiens
MASRPKKDPWENLELTLLSAGNLAPCTALVCIWAPRTQIGLRGIPSPVPERQFSALSSAPNCQMDAQSWAWGSDVAKCLRSRFLPSWPKAELLASQQLQKAQVSCCCLTGKFQLSDSGSDVRSDFCWKQSPPLDSLQN

SEQ ID NO: 932747 - protein, 233 aa, Homo sapiens
MPSSIAANHLALKNSRIVNRRAQEPGLNAASPLGGGTRVPERGVGNSGDSVRGGRSEQPKARQRRKPRVLFSQAQVLALERRFKQQRYLSAPEREHLASALQLTSTQVKIWFQNRRYKCKRQRQDKSLELAGHPLTPRRVAVPVLVRDGKPCLGPGPGAPAFPSPYSAAVSPYSCYGGYSGAPYGAGYGTCYAGAPSGPAPHTPLASAGFGHGGQNATPQGHLAATLQGVRAW

SEQ ID NO: 932748 - protein, 154 aa, Homo sapiens
MGIGRNLQMEAKEATVLRKFLSRKVQWAQLWPILSVIIPSLRAAPFLMAVWPKHWVMLSGMPPSRSMPSLEVWELDRLLPCDIRDGAFITMPFHCYAQNRGEGFRHRSTLPNWLPKGLATSAMASKARNQKATYKVTVRGSGGCHLSLLHPLIP

SEQ ID NO: 932749 - protein, 157 aa, Homo sapiens
MHSKHFYGVVLGTSDTSRRRKTQSMPTEVADQCGKKQATKSSPGKDENISEREMSPCKALRKELAECIQERADSKEGKATFRKEDEDAGDWDEFQRAQWMDFRSWGGVRDDVKLKEVWSHMEMRVQARRNDLGPSLPEVTDINRDFVFDDLRSFKKY

SEQ ID NO: 932750 - protein, 168 aa, Homo sapiens
MSASGHSQEPCWSSLGFWKPLEMPLFCLSLETWAIMDEDADRGQRGWAWVSDCCVALGKFPNLSEVRCSAFDIQNQLRKKPRHQIGIKILPQLLVKLNWRKLFGLESRLIFKYFPLNHMDLPTQLQGGEALLSGYFHLHIRAERRIQMFCGQVDPKEERPHGNKSFGP

SEQ ID NO: 932751 - protein, 168 aa, Homo sapiens
MWAADKENLLGGYKSIKWRLIRTSEQRYFGFMAEESLFHIELWSWGPGEARLRLWEDRLSWFFWAVERLPARGEETDMFRQLENLVNTEEEANCFLSSCTVTLLHIQRFFMELFYSESGGHGHSSGSCGALTESQAGLGVNSGLATCKLCGLVPSRTPNQAQVIWSST

SEQ ID NO: 932752 - protein, 219 aa, Homo sapiens
MGIIYSEESPLETSTEDTSCCGNCTCGKTTFLEMFSDGITSIHILIPLELLLHLIQVEIRIFDAFPLREGMRRFCSRSLPVALSLGTMFTRDVVAGYNGSQKILFNWSSTSLPGKRGHPALASSAKMQPADHKSMDVEYSLAPKKTSGGWYHSVLVTEFENQSQLLVAVQEVMKPDDVLVLQLLECGSISEFSVLFHYSMCVSLYQYHTVWITIALYKS

SEQ ID NO: 932753 - protein, 137 aa, Homo sapiens [sequence omitted]

SEQ ID NO: 932754 - protein, 136 aa, Homo sapiens
MGMWSLGARALGAAALALLLANTDMFLSKPQKAALEYLEDIDLKMLEKEPRTLKAKQLWEKKMDLGSCGSVLPKTHVDELGVPLYAVVKEHIRNEVKDFQPYFKRETFLDEKKKFYGPQRQKMMFMGFICLGVWYF

SEQ ID NO: 932755 - protein, 191 aa, Homo sapiens
MVRVPAGHTNSSSPMMPHLGLRLTSLDRRSNQLQHSLKPKPNPEQGPTLFNSMRAERGEETAEEKCEASRGCLFMKFKERNHLHSIKVQGEAASDDGEVAAGYPEDLAKIIDEGGYTKQQIFSVDETTICCEKMPSRTFIATNEKVMSEMEQQSLDDSACLLHGLVNILSSLLRPTPQEKNRDFFQNITAY

SEQ ID NO: 932756 - protein, 167 aa, Homo sapiens
MAGIFTKHVLAQAIARTHIHPPAPCLPPVEFLEMSTLKAHQFKHQDVFSVCPGAPEAFGEGREADIYEEEMLNINITNHQENRNQNHNESISHLLRWLLSERQEITSVGKNVEEGEPCRPLVEVQIGTAIMKTLQIELQIELPYDPAIPLPGSYALLRILSGSRMMH

SEQ ID NO: 932757 - protein, 138 aa, Homo sapiens
MVGLVLWPCGPETDLSRLNRLLDLELVFHQKFSFLSSLSGFAKTVLPEDEEAELISRAVGLQEGFPVSQTISADDAHQEDGVMRSSGNWPDGSGQPTPGGRLGKQGAEDELTEALSAAGSISLSLHIHAKLISYRKLQ

SEQ ID NO: 932758 - protein, 139 aa, Homo sapiens
MAQPFICVSHVACQKSEILDPLDSSVRREWETSHFLSEEAQKGDDFHEVRRQRWIQSLNLRLLPQSPSRVYHMLPETRNSMKSVRDRKRRHNFLENYWLRNVGLAHSCSALLFITKICLSICSSGYPTGISNPSCPNLF

SEQ ID NO: 932759 - protein, 260 aa, Homo sapiens
MPFPNSSSLLLTAHARAKADAADQAALAARQECDIARAVARELSPDFYQPGPDYVKQRFQEGVDAKENPEEKVPEKPPTPKESPHFYRKGTTPPRSPEASPKHSHSPASSPKPLKKQNPSSGARLNQDKRSVADEQVTAIVNKPLINGELHSQYHGYYVKLNAPQHPPVEVEDGDGSSHSSSALVHKPSANKWSPSKSVTKPVAKESKAEPKAKKSELAIPKNPASNDSCPALEKEANSGTPLHPKGEGKPQQLRSYPEL

SEQ ID NO: 932760 - protein, 142 aa, Homo sapiens
MKAARREAVPCKATGVELSKTMGTYLLQLDMRPGVKGDHFGALRFDCPTGFQTGMEFPRVVGGIQRELNHEGRGGFFLTRRNLGLAIRPEGTRGAAADHYCTGPFLHEGTQASFSSFLLFQLPVQLSLLLNSEINLKTNHKV

SEQ ID NO: 932761 - protein, 302 aa, Homo sapiens
MKQIKELQRLLGKKTMENELLKEAVEYGRAKKWIAHAPLLPGDGDRHTDDTDVLLRIHHVIGELPTYGYRRVWALLPRQAELDGMPAINAKRVYRIMRQNALLLERKPAVPPSKRAHTGRVAVKESNQRWCSDGFEFCCDNGERLRVTFALDCCDREALHWAVTTGGFNSETVQDVMLGAVERRFGNDLPSSPVEWLTDNGSCYRANETRQFARMLGLEPKNTAVRSPESNGIAESFVKTIKRDYISIMPKPDGLTAAKNLAEAFEHYNEWHPHSALGYRSPREYLRQRACNGLSDNRCLEI

SEQ ID NO: 932762 - protein, 442 aa, Homo sapiens
MTLIVSREEEWRLFFIELDQEIRPALAKRWPRVRAEDNPPGLAVNQAPVLIEVKPGAQPVSRVRQGNRCPTPAPGGLWVEGVQEESSDLPTAVQEAHKLTLGQNLNIKASRVVVTLMNTKGRHWVTNARLTKYQTLLRENLRITIEVCNTLNPATLLPVSESPVDGSSFFNPQRERGAGYAVVTLDTVVKARSLPQGTSAQKAELIVLIWALELSEALVKTVPQWCVTCRQHNARQGPAVPSGIQAYGAAPFEDLQVDFTEVPKCGDLIPTFGLPLRIGSDNGPAFVADLVQKTAKVLGITRKLHAASWPQSSGKVEQCVYVCRDIQWNVILCLPGYDEQYHGGCTTSEILGVISISPFWKLGTTSQGNNITGLHKPPSILEVISSSFPVDIRKSITGLCKPPAVLGVILSSLPLDIREIFTRNYFDIGSNIILYFPGYWAQ

SEQ ID NO: 932763 - protein, 187 aa, Homo sapiens
MKYSGPCAAGLLEFAGGPLQTLFAWVSPVEAAKQQRLMPVPSSESFVPDSHSPDDSQSSPGCCLSFGDALPREEESREAVWLQQLCQAVVGSTQFKLPCSFVYTVRGKQSIQASVVVDAPPTTKLDSPRSSSGCCAGSENGKPVDLSLLGSVGMGSAELDHLTPWLQPPFQGSEWFCLTGIPRATRV

SEQ ID NO: 932764 - protein, 142 aa, Homo sapiens
MFGAIPDGVPSGFFCLDRNLSQFWSLAAGTHSAFLVYILRCTKNSQVMCHGLVFQEAGSGMKFREQRVYWEVPWRIAPVEENRLGQKEKMSCNACLPASADLTRALTLEWPIRVALCWAQMAWPLFSFPASLVTGCGLPGRV

SEQ ID NO: 932765 - protein, 129 aa, Homo sapiens [sequence omitted]

SEQ ID NO: 932766 - protein, 158 aa, Homo sapiens
MTGHVEKGLCSMCSSAQSFQGLHILTNIYFPFFDTSLPNECEKKESADLQLPGASLLIRKRRGEMNEALSLSQMGSWNQGAYIKSALSKYCSLLRAKTRNKSTPTERQQRDRASRKLLCGFLKHHYPVLFEYGVLSSRKSNNLQGTFREIVGYPPSEQ

SEQ ID NO: 932767 - protein, 147 aa, Homo sapiens
MFNHAVNLRQPPTLKEPYVASMDLSTFSKTLPLKLTRFPDLPAGLVLGSTLEERMTELLLQKINCEASNLFCSALSLASPLVKVDKPLRFLDTDTKLWHRRKGRNLSLDVNFLTYPSTNPLVIQQIIYTPWESWQNVSNYLKETVSG

SEQ ID NO: 932768 - protein, 134 aa, Homo sapiens
MDGDLPMGAWEQVISAFPPWRSAAAVLCLQIPILCPGLMTTLVACVEMHHGILSHPGEHVSKIQRSISLIDVCATCTAKSDLLTCVLFSPLPGDKSHYLMGTTCVPSNDCATAGNKAFPACAAILRSKVNAMKY

SEQ ID NO: 932769 - protein, 338 aa, Homo sapiens
MLVDLAAMSRTLKKEVSKEISKGPQNPPGYRLCPLQAVGGGEFRLTPVHVPFSLSDLKQMKADLGKFSVDLDRYIDVLQGLGQTFNIIWRDVMLLLGQTLAFNEKNEALAAAREFGDTWYLSQVNDRMTAEERDKFPTGQQAIPIMDPHWDLDSDHGDWSCKHLLTCVLEGLRRIRKKTMNYSMMSTITQGKEENPSAFLEQLLEALRKYTPLSHDSLKGQLILKDKFITQSAADNRRKLQKRALGPEQNLEALLNQATSVFYNRDQQEQAQKEKQDQRKATALVMALRQTNLGGSEGTENGAGQSPSKACYQCGLQGHLKKDCLMRNKLPPLPCPLC

SEQ ID NO: 932770 - protein, 139 aa, Homo sapiens
MGEERDKLKELLHKQKLELEDLKNSRAVHVAIDEKLHSGKKNQECCCLIKRLQVCDLWIQSAISAEARNRDGVVPAKMLFWTEGNEDETVKEDYLTSGILQNDPVEIFGSEHVFDNFTYFILKLADFFFCLLNFATEHL

SEQ ID NO: 932771 - protein, 139 aa, Homo sapiens
MREFSTYQFCDLGQLTQPFSVLQFPLLKKGDRDTSYFRDVMRCEFIHTQGLGHRLTHERDPCTCMKKVNCETASGRSSRQYPEEGIAITEMTAPCLLLPLKTFQWDRMWWWKTVILMILTLCWPMIMDLNMLAKLVSKS

SEQ ID NO: 932772 - protein, 135 aa, Homo sapiens
MVPNSGGKLEGMLPRYLNLELWASESSMGPGPPGSWRPVCRSRCQDHRALSHTALLLLPIFSGLAPGPALVRYPPKRPSLEATTWEPQLPPALRKQGTVGPCDSSSLTSLDVPHHLCSPLPPGALGLLALPEQRS

SEQ ID NO: 932773 - protein, 137 aa, Homo sapiens
MVNSTVLSNILGHAFFELFADRVPKTAENFHALSTGEKGFGYKGSCFYRIIPGFMCQGGDFTCHNGTGGKSIYREKFDDKNYILKHAGPVLFMANAEPNTNGFQFFICTAKADSGDNVSKKALSPGPVEFPLRQEKA

SEQ ID NO: 932774 - protein, 138 aa, Homo sapiens
MGNEAFSGQRLTKPSLSSCHQGSTHALGRICSQPVQVHKGSCLKLQACRQPKYTCELDWACWPHVWDSRRLVGTHHHQFPSPLSYRIRHGLHPQTQGAQTEKQGRHQILKFVLIGEFLLCSIPTNIIIVIIFIFNFIL

SEQ ID NO: 932775 - protein, 144 aa, Homo sapiens
MARLAEGSDYSHSCNTTTYSGNGGSDGGGYYLLNTWTLAFGARGQSIMMMTIVVPIIIATIENISKVLAVKDALVTTYARPQFISECPPTQACVREDLLSTYSLPGTGGSHASSEQRSYVCVQPTKITQHTQLRATFELHTRHM

SEQ ID NO: 932776 - protein, 328 aa, Homo sapiens
MHVSYQGMSSMQWTSEKHYGNEALMEKCELEPSEAASCRKERQRILGSGYGHAAPGTDAGKAFCMFYAVLGIPLTLVMFQSLGERMNTFVRYLLKRIKKCCGMRNTDVSMENMVTVGFFSCMGTLCIGAAAFSQCEEWSFFHAYYYCFITLTTIGFGDYVALQTKGALQKKPLYVAFSFMYILVGLTVIGAFLNLVVLRFLTMNSEDERRDAEERASLAGNRNSMVIHIPEEPRPSRPRYKADVPDLQSVCSCTCYRSQDYGGRSVAPQNSFSAKLAPHYFHSISYKIEEISPSTLKNSLFPSPISSISPGLHSFTDHQRLMKRRKSV

SEQ ID NO: 932777 - protein, 141 aa, Homo sapiens
MAANRPFVGSLPMSGPLKAGSLGWVNTQCLSPHLGVSGILPGHTIFPLASITYSSLVGPPGLLSLKGLVVHMHLVILSPLRAVPWLVLIAPAEAALGTPVPHGFIWYLCSCSLFLSAPLVELLNFNWASSNTCYLSLLGVS

SEQ ID NO: 932778 - protein, 140 aa, Homo sapiens
MKDEEETEKEGAFLRGEILIFMQGLWLHLTPFPPSWTGNEIGTDTELKECFPSTVVQRKGTPGGAALRTQCGESVCGCQHSAQCFSESPRKRVPCGRVHTPPQVQLTAHDSSTRGPNPVTLLDVTYEVETVTTLFFLLSL

SEQ ID NO: 932779 - protein, 133 aa, Homo sapiens
MVNVEQQLFRRELFVAFANVYKANVPTMDKFKLLKAVVTEYGSLEEMHPMALSETVSPARRGFHSSIPLILHSLNVFKSLSFSWQRCTYWPLDSNPIMGTDMEKAHSSLLIELYQRRHSGGKSLVEVEAVFTL

SEQ ID NO: 932780 - protein, 157 aa, Homo sapiens
MQILVLEMRFWRGQGSVSLTSPKWCPHLSVPQPGFVLGISSSDCMKDQDGGFYCSRELLRDCGLPEASPEAEAYVIIFDSRRTVHKGLDDTPLLPMFQGYLLYSVHQNKWESLPETPSQTYPEIMFNQISGHPVTQSSLSIKLTIIDANPVFLPNIQ

SEQ ID NO: 932781 - protein, 220 aa, Homo sapiens
MEQMCWGSKLGGRGGMGPDDKQKMRAPSTAQVPYGKGARLFSKKVPAPATPPWLQSIDLGSQPPHPHLITWAGRSSVLPEMELPEVGGRTTIFAAPQPQPLLPSDSGGSKDIKNEHGPQAQCSCLMEEQPECFPHESLPLLLLTGQSLLTWANTTTLPPPYTFASGSSAIFWEGNPRDNPQPLFHGNCGGTALTAFELGKEYRAWLHYWHLQRAAATIWR

SEQ ID NO: 932782 - protein, 135 aa, Homo sapiens
MPVICPRLLGLRQQTEGCAVGFPTFEILGLGLAFLLLSLQTAYFGTSLVIVENITVCLQGASFKGNDHKNFLKDILMNIIKTTISIKNVIQLESYKMQPIQTNFFQGEIIEFSTMFLEFPESIVWCPEINSGTFL

SEQ ID NO: 932783 - protein, 244 aa, Homo sapiens
MHFLPSEAHKNPRLSQTGADEGMTCLQRGAVHCGSLFAERWADNGTTCLWRGATHCRSLLSCSTAQESTSSPSSTSTCLCTSFFLDAGQQLGTHRMMGSPDLGAPQARVVTPSLGISGSGDSKLPVPPCSLMPVMEAACSMPGPAAALQGASACAGTWSCLPHHSQQAWLCAVAGPHTCSLTYSSLLCAWLALGRHGTQVSSTSQVQPARPSGQNELSGPDRNLGKGTTSHRGFQPENNTPTIL

SEQ ID NO: 932784 - protein, 150 aa, Homo sapiens
MTVCSREKAVGTAWSEARSYVCFRVFLLLLLSFKKSKDTWYDFNLKFVRLVLKPILRSIMENVLCAIEKIVYSPAIGWNVPCMLARPIWSICFSSPLFPYQSSIWMFYLWGISDGGYPVSNGVLKSLSIIVLLFNSSFRFASVCFISLAD

SEQ ID NO: 932785 - protein, 205 aa, Homo sapiens
MATVPGSEDRYAGSCEIEIVHPCKKRNKNYKQTILKSYNVSIAIVFRVCSFRWVRGLADFKNEAADPPNRIKATWLFMETELRTEVICLTCPGRPTPDGKYKNGKELSELYQTSYKQNNQVTDVTDSFVFFNINCLDYTHYWGNINETSFQNVHLFSAQDFFVNTITLSLASKIEEEGGEEEEEKGERGDEEEDRVLDLLYIIVC

SEQ ID NO: 932786 - protein, 149 aa, Homo sapiens
MGRNQSRKAENSKNQSASSPKECSSLPATEQRWMENDFDKSREEGFRQSVITNFSKLKEDVRTHRKDAKNLEKRVDEWLTGITSVEKSLNDLMELKTMARELLDACTSFSSPFDQMEERVSVMDDQMNEMKKYRERQKDTPREEQLQDT

SEQ ID NO: 932787 - protein, 139 aa, Homo sapiens
MHPVKTLNRWMLFNSDFQLISVIKASRMKRTKCNEKDEEVLAQGKVVEAKVTDMEAENMSGIGRPLSSLVQLLEAGRDIPAPDLNKELLLQERSEEEHSFFLDGSNSGGSCMAKFLEVNNPLDFKTHNMYDVCNHHLPT

SEQ ID NO: 932788 - protein, 155 aa, Homo sapiens
MASASLPSSKFLRGSTFSQLNMDEVGNHHSQQANTGTEKQTPYVLTHKWELNNENTWTQEGEHHIPGPFVKALKILRWKVRAKVRVSNFYVISYELLEEDGQWLWEFSLIEKTEPSIEFGNLDHDSPLQLQKKPQKSSILRRRVRWKDKNKKLIN

SEQ ID NO: 932789 - protein, 721 aa, Homo sapiens
MLRATAPCWFPPGYPEAKKVAEEAALEASRHLGGEQSQAGAPEGSKMLRATAPCWFPPGYPEAKKVAKEAAPEASRHLGAEQSPAGAPEGSKMLRATAPCWFPPGYPEAKKVVEEAALEAPEFPLPSHQPAQSFGLWVPQMHKQASAFVDIQAEPQNRGPAVPPAWPKMVTESCYFPAQRGSACRLPAAPRLTERPSGVRISAPRKRKTIAHSSSPCLVTGYTDAKRTRVASSSQRSRGSKVGRQPGKTRNRSGMACKTTATTSSKRIVRQCLKFCASKQEAEEKALNEEKVAYDCSPNKNRYLNVVLNTLKRLKGLTPSSMPGLSRAALYSRLQEFLLTQDQLKENGYPFPHPERPGGAVLFTGQGKGPGDSSCRVCCRCGTEYLVSSSGRCVRDQLCYYHWGRLRSSQVAGGRVSQYTCCAAAPGSVGCQVAKQHVRDGRKESLDGFVETFKKELSRDAYPGIYALDCEMCYTTHGLELTRVTVVDADMRVVYDTFVKPDNEIVDYNTRFSGVTEADVAKTSITLPQVQAILLSFFSAQTILIGHSLESDLLALKLIHSTVVDTAVLFPHYLGFPYKRSLRNLAADYLAQIIQDSQDGHNSSEDANACLQLVMWKPQASSKTAISPESSPCPPRRKAKETGAAGGRRGQKAKSNPNPPLPVPRNPCRGPSGLSTSLCPSQTSVLPPIASRSPEPPLPVPRVPAARPRAYNVFALLPFGL

SEQ ID NO: 932790 - protein, 176 aa, Homo sapiens
MTGSRQDCEEAMASANLQGPSRTTELFHPTLASISSPMLEGAELYFNVDHGYLEGLVRGCKASLLTQQDYINLVQCETLEGQDRTGQDWHHKTSARQTPPFQKKEEEEEEEEEEEEEKEKEGKGEGEGEGGKKKEYTNGGKVDMAGERQTAERTENTGPTTTVVGLLMPHVSKISV

SEQ ID NO: 932791 - protein, 156 aa, Homo sapiens
MGSGTNHCTYTFKDECGFFKHTCTVHIKLRSMSERSFDKNPTGQDESADEWTERIVQRSHNDKAAIPKDRQMKTLSLLTLGNATLFGKLKKKMLKVKIISLRHVSQEIQSENWVFDISEIQTEIEKLPMVDHSVIIIGQRRNFQPPPCEDDKDEDL

SEQ ID NO: 932792 - protein, 125 aa, Homo sapiens
MLNFRTEQSFALPGLTYISMMISDVEYLHGIAGQNYNERSPCTCRPLLKKERERRREITSVAVWTSSSSQYSWKDSQGQSGLRLKCGFDISSTPLHRPQCRPDRAPESCPLSLFRFILRDNAGDL

SEQ ID NO: 932793 - protein, 140 aa, Homo sapiens
MTRSTRPDPTFPMSSPQPAGEATVIATWSQGRGWLRAHPREERRFQDFRSYKDRRRQMGALPMSSCCSSFYPAISFLKYLGVIPNAAVKCLRMEQEDPDLLPDKECSNSHSAPRSSCYKKEAANMRKTDKVIENLKVISV

SEQ ID NO: 932794 - protein, 138 aa, Homo sapiens
MGHEEGTQFEISSEVIGEATLVKEFCRSVGVCWRSTPDPVCLGISSGGCRTANIGEQQMFLPDPSSGSFISEGYPAMRGVSLPLLGGASQLGYSGVRDPLEEAVCLFSDLKLRAGRTTTLFQAVRQGHLSLQRFLLPF

SEQ ID NO: 932795 - protein, 161 aa, Homo sapiens
MKERTILENQCRSHYSEVHTSVESSRKHIESLREIYDKLLSVKVHTRCSIFFGNRSREHQSAYLISNSVDLLSVATVTRVGKHFLTTLFFGHPGVGMQKIKHQRQKHSMKGGIQTQMRLPPVQRGASILSKAFSSREYRAFDPDPDAFQWLEMTILPPPQP

SEQ ID NO: 932796 - protein, 135 aa, Homo sapiens
MCTPHGAVTVPKISPDFALTSEQVLTAGRSQAVGTGISEPARAGGPSRAPKTGGLGLQLRFGQLQQSCQLYGVGGLGQQLCLERLRLHLGSSCSTNLEGVGLPLVASSTECAAPAVPPCYSWHDGKERMPDVAHL

SEQ ID NO: 932797 - protein, 154 aa, Homo sapiens
MFVDTIWNQQLGFQALNCLWLEVNCFKSALQGIISEHESVDKYEIWIQIPLESQWFYVSTLASLSSNLLTNKLILIPSSQSILEILEYIKASLWSCSILSPKHCVSEPGGEPPLPASFSSDPSSAGHSALHLFATCLPLMKGRNFSRKCEEYNQ

SEQ ID NO: 932798 - protein, 124 aa, Homo sapiens
MPAGEEALLTPTQPCMKLHMHQLRPPPSPAGLPVLQGSWAAEPSPNGPAGTQNPSADAPFCEDTHRKSVLCLPPSLGALQSCLSFTNHSWSPCQVPGTNWALSLLSHSTATASGSQEARCRAQS

SEQ ID NO: 932799 - protein, 127 aa, Homo sapiens
MKLPEEGSDSNICCSTIFAVLQPLLVMPRQTVSGVDLQQIPTDLQLREGKLTNRKDIHTKTPSVRHHHQRPKVDKTTKMGRNQSRKAEHSKIQSASSPPKEHSSSPAMEQSWMENDFDELREKGFRQ

SEQ ID NO: 932800 - protein, 196 aa, Homo sapiens
MFSILHSLKASSEEKEPKTDSLPQFWITLNLYPIPRHVERKEDQPNEKNKDNLFFTCCSKGVSYLHLHLGRLIAGRGVEKLHSGKREGSSPDHFGSTATEVIVEFPELSLERAVWPPASLIYGRLAAWVVIDQKVGFLEVAADCGSQFCFICNMTIVHLYLQSLTTNRNSNFPKGNNTQNDDKSNIVIEMDKKRIL

SEQ ID NO: 932801 - protein, 159 aa, Homo sapiens
MYLYSTYLKITHTKTLGKADHFLLAMTRCPRKDPGGSGAHEDVNGQPSNLNGPGETTRKNYTGGHAGSWSFKNISVGRGCSTESNEESGNVKWLYFRQLVSRTENLPWAISLPGEKASKLTASWLSHGACSSNPPPSKHLWILLFFLLCSYGSSWSKSL

SEQ ID NO: 932802 - protein, 198 aa, Homo sapiens
MELHGTLKHCLEKSHTREPLELHLPVMQARKALLQQWVPRLGLFVAAGSSCVFQSPVAKVLHTDETTDSADVTEPTDASWSHKELTHQRMRSLSAPISKDAGKVHSLHLFSLVVLSHRPFYTTVSMLSALHSSTSAEKFPLPPPPPASPRAAADHWVTCHPKGLGGIVPAGHSTYSPPPANTQGMQDPLCQGCHIPSL

SEQ ID NO: 932803 - protein, 137 aa, Homo sapiens
MHEAVKDNRPVLKPTNEWRHSLACRRALIVLCGPFSTRTMCSQLAVLSLLGTLVNMHVPNHRHSLRARNSRPYPPPAQPHPDSIQPPLEDEKHLPNQSRLRLLLIASLAWWEDREKGEQEFSRALKRGDGNGRRTGL

SEQ ID NO: 932804 - protein, 125 aa, Homo sapiens
MPSVTQAEGKDFPAASMLEEWGALWTAQGEGAGGMLDGGRWLFSRSSQQQMKEVCGDHSPQRPFISLQLKEQWVLEGEEKERKCSAPSQHWEEHRAAHEWARGHAGAICEDFDLELDSSDGFTVS

SEQ ID NO: 932805 - protein, 140 aa, Homo sapiens
MVTNKPGPEEAPADSKNMAADSKDKKIHQRSWLSVLQAEPQLENLCKFFVHRVLVECARAEKGFESCRNGFPDTPGHSSLIGCLGFYKEEREARNTTTTRVSFAAEEKLLQPQQPVSPASPCDFRRTPSDRDQRSCEHSG

SEQ ID NO: 932806 - protein, 195 aa, Homo sapiens
MSMSPNGKDKKANGHNDPEVLEIPNLPVAIARLRPKVFLVPKSMEEADPNYLIHSESCVLSSVTAATGQILDFWKSFTILNTRGRKESCHKDWCWPPGPGTKRPAEKYPQKGHSGSSLQPLEAGQKDEKPVFAFGGKMKKGRGEDWLLTVSQAECGSFIRQSHIIGKNFLTYALSPLFDEWNFTESGGKSDSKEL

SEQ ID NO: 932807 - protein, 164 aa, Homo sapiens
MELNFLNFLLAVAAKPTICYSLLSTCNNQAHAPLHIPGAHAPLHIPWSPCTTAHPWSPCTAANPWSPCTSAHSWSPCTSAHHWSPCISELHLSPCTSELHLSPCTAWLRSNFTVESSDSLPLQLELLFPSLCFYSGLFILIFAMLRHFVSPLLDSRLPQYKDAS

SEQ ID NO: 932808 - protein, 162 aa, Homo sapiens
MFLSFASFLNESCHKDWCWPPGPGTKRPAEKYPQKGHSGSSLQPLEAGQKDEKPVFAFGGKMKKGRGEDWLLTVSQAECGSFIRQSHIIGKNFLTYALSPLFDEWNFTESGGRDNFPKHIIIHVDMEPFGTLSKVFTSSCNCTFQAEHQYKLNWSGMMWLGS

SEQ ID NO: 932809 - protein, 141 aa, Homo sapiens
MGITSTSWSLWRPLLAEPNGASGKAETTWSAEFQSCSPSIFNIDMKMYSPKMTQLADRDLIYKLLSPEPGLVMTVPHGISGEKTMMNTYLNQGKSFTKIVIKNLKCVLIKCARMNISSKLSINSLSATTGTLSAMSVLIPC

SEQ ID NO: 932810 - protein, 165 aa, Homo sapiens
MDNFPYIPPNSSLGCILNNWNQFNPDNLRRKHLIFYCDDASPGPQEVTLSPVERVPLSPINVIGEETIPNSLFIDIWRSGKCPGGNLNFQFNGIIVSPGGSIPPSGTNTSRPAETNAMGTGIKNFASGNCRGEYVVLDICVFLEKYKNMCTRILEEIKCNKYTLF

SEQ ID NO: 932811 - protein, 139 aa, Homo sapiens
MDLEEEDHRGSLTSRNTFSEDQLVLLISSNGVRYKMPSGRGIKPLSSHFFNRNPKLQILTSKLMTTSRCSPAQYRHLLSHTAKALLPWAASSCPNLPEGNYNLRPSTSFLFIPLTPVENTYAEYFESFNKHSAYEFLHM

SEQ ID NO: 932812 - protein, 145 aa, Homo sapiens
MQHHLLPKAPSPLPSDLNSDWICNCASFELCQVFRSTSLSWVPLGFRDGNLKHAIIVIGGPLSPVREMKKYIGGPQVQVINWVNGGAIHGAREYVKRIRFGGKDELNFEHNGLRCLGNIKWRCLTAPTTKNYLVPNVNGAEVEKP

SEQ ID NO: 932813 - protein, 141 aa, Homo sapiens
MNQGKLSRLQAPVCIGEKATACGRKKVVEAQPGAKALSLGVQPGGSETCSRALQPLRQCFSSVPVTIWKSHGYPGAVVGQLWEENEIFFACDRASVSACGVPSVVPGSTEHLLLSCLHRPRQEPAQGQWGAGSKREKRRDH

SEQ ID NO: 932814 - protein, 163 aa, Homo sapiens
MAPRRLHSAHGVVTFAAVMGMAGPGAKSLTLRSMLLSTASCPNSHTNATWNFGERKGKFEIHIPVWQPVLALAARGTRADGAAGRAAATICASPDLLCGCSQEMWCPRLHHGCRKERRKARAFQEEEPHVHLHRAGKQYDQAVMSRFNAFNDLEKVAAYPCQR

SEQ ID NO: 932815 - protein, 140 aa, Homo sapiens
MTLGVTSTHYKACKNLCLFPTPLKSSVICQASPLPACLHHPLELLCSFLHFMFTLHPRFCSGKFMLSCNYYQVQLGASFTLWPLPNSASCLPFPKDLCELPKSHPSTNQAGSCLAFEIKQDQALSGWYGYRLSSLNPFQV

SEQ ID NO: 932816 - protein, 206 aa, Homo sapiens [sequence omitted]

SEQ ID NO: 932817 - protein, 137 aa, Homo sapiens
MWVEPDKGIKAGCLSQQKNEQAQTGGSSNSRHVALRAVTLTAKVCNFTLEASETTNPPEGRNSEHVRTSEGTNSGHTTFKTCNTHREGSLALSPRLKCSGDLSLLQAPPPGFTPFSCLSLPSSWDYRRRPPRPANFV

SEQ ID NO: 932818 - protein, 149 aa, Homo sapiens
MDGSPGSPYDPKFLHAIIWHDDPLVSYLAFSDSSLKVSLGASVYPGESESHLLTWPLLVLLEEGILHLEMLLPLGWKIEKLWRTDTAEPQRASNTKPLYKTPVKEKTLITTTRITKLSSSVMALIQSCKCLFTGSCTETVTENLEELSY

SEQ ID NO: 932819 - protein, 125 aa, Homo sapiens
MLSNLSSLLILYACLNKLPQIEWLKKYIFSYFWRPEVQNQGVGKAMLPLKALGRNFHEDGFETELASSLLQHQIKAFSLGNTCHLSDWLSVRKRIIISDFSIFMRSKTECAIKSLNAACVAAAKF

SEQ ID NO: 932820 - protein, 135 aa, Homo sapiens
MFGALEVLPAQWPSPHWTKVQCHLPINSACQVKMALRERSVPQGPRRGPLLHLKLCYAQASQLVIFHVALWDEDVEEPQRFQMTTRDSKAEYDPDHKKTQGTFYIRCFSEVSYGAFSLHGLLPCGDLLVSPGGLC

SEQ ID NO: 932821 - protein, 137 aa, Homo sapiens
MQPVGLQSVCSVLEPNMLLHSFCDGEEGSGLVLGPFSGRGTLLSPLKPLFVFWQPTQAYPVEAWHRLSTGHQKGHSSSGHLSESNKTPSVNRPQSDPTWVRLNPLSFTCKDRSQGQILILSTYLWLPTFGCLWLRSC

SEQ ID NO: 932822 - protein, 139 aa, Homo sapiens
MRTSSRCFCTHKSLTLSFLLLCLARGLPSSFPLHLTQLSIGVSRDLGTMFLPLESSDPQKDRAVHFLGPDLQLPGHGAGAHAVGPPHTLRPPLCEGVSRDDTKNRSSDAGPVLIHLLTNPATTVALCYLICRMGITSAT

SEQ ID NO: 932823 - protein, 135 aa, Homo sapiens
MNLLTEACFLLHQKDVPGTSLRTLRRLAAPLASHPLDASSTSPASGDHQKLSPDIVKCFLRPNVLEVSRKASSRTQALRGPGMNEANLIMVGKFFNLLLDSVCQYFFEHFHIDVHQGYWPEVFFLLLCLLPVLVS

SEQ ID NO: 932824 - protein, 156 aa, Homo sapiens
MWKNMVGLTMADSLGLLVVAAAAAKPRVTFSIMFWICKYRNNVHNMVCYMGVMCDVDVWSMNDPVTHIVNIIPNVSSGFCCRHELPIRSSPLGAAHEEIMMPIMSVPISAGSRESEVTKDWSSPPAQHRSSMEKQSDCFFTQVLDPVSIHWVESPD

SEQ ID NO: 932825 - protein, 215 aa, Homo sapiens
MVLDNHLALEYLLAAQGGVCSLQGTSCMWINTGQVQQLLKEIKIDLTAMHNVIQVFKNIHTNSPGNCRSVLYRANDSAQDSKPQYHPHTDTLLPSLCLGVTCEGAFLTQCHVLYHGPLTQMPSRPPGPRHCTGCCPCPLPVGCTPTSLEFQHLQDASALHADSHTVLHCSTFCSSHLGPDALLSMDTLLTLLGSSTWCLATVACFLLHPLLVPTL

SEQ ID NO: 932826 - protein, 141 aa, Homo sapiens [sequence omitted]

SEQ ID NO: 932827 - protein, 141 aa, Homo sapiens
MKKLLSYEAGTPEEMEDALSEVDFQLKVDLHFTDSEQQLRDVAGAPMVSSRTLGLHFHPRNGLHHQVPVMFDYFHLSVISVTVHAALVALQQPLISVPVGTLCGGSDPIFPFCTALAEILHEGSAPAANFCLDIQEFPYSL

SEQ ID NO: 932828 - protein, 134 aa, Homo sapiens
MNYDGAFRNPGCRDVLDTAESCASGRTAVLPDDDKGVLAAPNPSRDDEPGLASRDHKLDMRNSDGGAVPTAGWTGWGRNGSSSSLYLWWNLAVNPSGPGLFLVGEWHVQRCGNVEGHDAFAHQQHSIPGTKADA

SEQ ID NO: 932829 - protein, 153 aa, Homo sapiens
MAGLAQTQVPLTGMDDLPPTRTGLNVLSATNRVLHCIAFHCYTIAELRGNIINQPLCEHRCEGGNIQSRNDRRCEGGNIQSRNEHRCEGGNIQSRNEHRCEGGNIQSRNEHRCEGGNIQSRNEHRCEGGNIQSREGAPFRSLLPHYASQDHLR

SEQ ID NO: 932830 - protein, 147 aa, Homo sapiens
MGTCFGPEIYGKHRLAEEAIRHVFVSGEQWDDLLSCEDKLSVYIARVKFHRTVFGVKILRLTRNSLWANCEGGLNSFYTQYRLKNEWIFRRHLKAHLTLNFIVKYQPGEIFTATSYENTDTTNSSLVSMWRVYMVVTDGTKVDWGVR

SEQ ID NO: 932831 - protein, 161 aa, Homo sapiens
MGFRDPLEETVCPLAEFECCARRSTALFRAGRQERLSLLKLRPQPPLPPGALSQGDGSFICKPLTGTAAFLSEMPCPERRNLERESGYSSFAELQWALPIVHSQQFYLHCEGKTTYSSLSNGGRPSFHQAGASTSDCCAGSKNFKPVDLSLLGCVQGDPLS

SEQ ID NO: 932832 - protein, 151 aa, Homo sapiens
MYVFGYWYIFSLVPYVFYEEWDLVCYVYCCHKIDIRTSSLNRKVNKVLVSWAPNISFLILFLVLGRGLEQSSHSFPMQLLDDFPQISSYSLLRLCLIISIQIEWTIHEVSGGLQLMSCSLKRALRHGDLYERSLVGHSLQSNRSEEMKETC

SEQ ID NO: 932833 - protein, 132 aa, Homo sapiens
MENDFDKLTEVGFRRSVITNFSELKEDIRTYRKEAKNFEKRLAEWITRINSVEKTINDLMELKTMAQELRNSGTSFNSQFNQMEEMISVIENQINEIKQEDKKPYKPEESGGQYSTFLKKRIFNPEFHIQPN

SEQ ID NO: 932834 - protein, 149 aa, Homo sapiens
MSKIFISVHVLSGIFHVGSLQTCRIHSTEDRFCIRLNSKKFELPVFISKHWEFEMTGLFANLLMSDFEKVKGSKYKIKPGELDCVFKLPTFCPFVTFNCKVYSQLIKHIKIFTATGSAMYSIKIPKKTTVFTGKNKVLVTQPGRDTKTL

SEQ ID NO: 932835 - protein, 171 aa, Homo sapiens
MRTESFPGYNEDSGPFAAGLLQFAGGPLQNLFTWVSLVEAAEQQRLLPAPSSESFIPEGTSLMPARALLYEVSVDPCCEVSSSQEPQGSIIPGPLQTAVLAARISNQCFLACWAAWEWDPLSEATWLPGFSPLSRGVNSSVSLGFQVPLGYEEKTPAASLVSAQTAAQFCA

SEQ ID NO: 932836 - protein, 136 aa, Homo sapiens
MIDLTFCLPLYPLCRAFSAFVLTLRHIRLRTSLTKIKSSRLKRGGSRRNVGPDKGDKGRYSKRASGLSQRALAEAGRGFVEVDSEGLRSRKLEHNYSHECSFLYVVLKSTLFFFLYMTLSFKFNYGYSEIPADNML

SEQ ID NO: 932837 - protein, 155 aa, Homo sapiens
MHWLTFSFSQTYQRKVGIEESCAMTGEGNAGVKVYNTWVTGGAGGIAVRDNTYMKGNFKFFRFQTVMVNIECQLDRIEGCKVLFQDASTLPALKHHTPTSSAFGLLDLHQWFATGLLGLWPQTESCAGGFPTSEVLGLGLITTGFLAPQLADSLL

SEQ ID NO: 932838 - protein, 190 aa, Homo sapiens
MGKKQSRKTGNSKKQSASPPPKERMMEDEMNEMKREEKFREKRIKRNEQSLQEIWDYVKRPNLHLIGVPESDGENGTKLENTLQDIIQENFPHPARQANIQIQEIQRTPQRYSLRRATPRHIIVRFTKVEMKEKMLRATREKGRVTHKGKPIRLRADLSAETLQDRREWGPYSTFLKKRIFNPEFHIQAN

SEQ ID NO: 932839 - protein, 247 aa, Homo sapiens
MRNCAFHPSSYTFPKVFSTRRPGDSLGCLYHQGPGFQAQNWAAIWADTELAAGPLRVRQTASGVDLQQIPPDLQQRGLTVRRKTNKQKGIASTSTKRMSTQKPHSKVTNIKDQSTDSYSLEAECLTANVVTLAELERCAGRSAVVFRAGRQECLSLLKLRPQPPQQPPPQPPLPPASSSAPGRLQTAVLAARISTQSILACWAPSGWDLLSWTTWLPGFSPLSRAVNGSVSLAFQEPLGIEYVTSPT

SEQ ID NO: 932840 - protein, 159 aa, Homo sapiens
MRDMSFLHRMGRSQFKQSTSRKTLDIVNQDPEEERKMWESLELHRDLLNGFDQNADSDMDNEIQPEVVSDRDEELVENWSKGHFSCALAKRLEAFCPCPGDLAVWKGNVLSEPPHRVPTKALAGGAVRRGPPTLSPRMVDSLPAYTVHLKKLQTVNGSP

SEQ ID NO: 932841 - protein, 117 aa, Homo sapiens
MIGKLPETPSVNILIMTTANRTEACLTCKQWRCSAPSGAPSLGDQSATWWQVDYTGPSKHGRGRTYAITGIDTYPGYRIASPVLNDSANNTIHAFRNASFTIKEFHMKLLLMKSFVP

SEQ ID NO: 932842 - protein, 142 aa, Homo sapiens
MSSSLKWEWSYLTLEVVVTVTDVVTIITTTTTTTITITTNTTTTITTTTTATITITTTTTITTTTTTTITTTTTTTITITTTATTITITTTIITTTTTTIITITTITTTTTTIITTIIITTTTTTIITTIIITTTTTIIIVN

SEQ ID NO: 932843 - protein, 141 aa, Homo sapiens
MIVSFLRSPQKLSRSTHASFMLTSLVLMLLLRPLSGPLSPGTTTGLAPHILKVTPQPSLHLEKTFLTTLHTAISPTVTFPFGFPLLHGSHGQAVSPHTMYLQYIYLLSAPRWESMSHGSRRKNKNLSKRTQAKLEKLQASW

SEQ ID NO: 932844 - protein, 158 aa, Homo sapiens
MLGFEQVQTESFIPQGKTLSHVMPLPTPHIKKEAFHECWQHQRPTISKMTKPVGIYGSVQQNPSFQHLKSIAEIVIMLKSITEIVIMPEQYKGITIYIAGLLGMNEINRNVPAPLLPGRMKFNDTYSTDELKSCTFQRNIWSLTSSWGIPCKSLEYPA

SEQ ID NO: 932845 - protein, 140 aa, Homo sapiens
MPLLDITGLDLEPTGERLLVLPLSVLSEHRPSAPFCRLSGTDQGRPSAGTPGDRSAAGSVGWTDQGRPSAGTPGDRCAGIKAGAWLSSHRRECEPGSQAQSLSSKPYHCSIPETAITHAFKTPDAVLAPAEIELLERKCA

SEQ ID NO: 932846 - protein, 143 aa, Homo sapiens
MRKSSPARSSLGWSISRLFLSLIRLPELPGPLLLSFDQNCFSVSVYLPKIDKDGHLQWPEIQLSHRELPGYSRAADHWGARSHEGKRAVELMGHKDSQLILQVQKFENIKDISADGFLVRKEGEEKMKKCGRGGRDSCFWGLD

SEQ ID NO: 932847 - protein, 193 aa, Homo sapiens
MVERAGWMVENAGQMVERAGWMVESAGRMVERAGRMVERAGQMVERAGQMVESAGPMVESTGWMVENTGQMVERAGQMVERAGQMLESAGRMVGKAGRMVGKAGRMVESAGPLVESTGRMVESTGQMVESTGQMVESTGQMVESAGGMVESAGGMVEKAGQMVERAGQVAESAGILESRQWRTCMLHPSANTE

SEQ ID NO: 932848 - protein, 145 aa, Homo sapiens
MRFLTVWIPCHCSHLSSKYKQILDLQESFGYSFQKAPIIDPTLYTTGERTASPFTVIPEAKPRTLGLELILFSHPCESFLNRPTIPWRHPDTPGDMVWLCPHPNLIWNCSSHNPHVSWEGPGERYEISRRSLTVSLYISNLELKV

SEQ ID NO: 932849 - protein, 441 aa, Homo sapiens
MLGRRVSGSLTDYLMSQGTGCVPEDGLTTQQLFARADSLTYNEFLILPGFIDFIADEADLTSALTWKITLKTPLISSSMDTVTEGNMAITMALVGGIGFIHHNCTPEFQAKEVRKVKKFEHGFITDPMVLSPSHPVGDVLEATMRHGFSGIPITETGTMGSKPVGIVTSRDIDFLAEKDHTTLLSEVMMPRIELVVAPAGVMLKEANEILQQSKKVKLPIVNDDDELVAIIALTDLKNRDYPVASKDSHEQLLCGAAVGTCEDDKYRLDLLTQAGVDVIVIGGNVVTAAQAKNLIDAGVDGLCVGIGCGSLCITQEVMACGCPQGTVCTRWLNGVRLKKYWGTGLLDAMEKSSSSQARYFSEEDKIPFLGIHEAKNPRSENRRLATILEAACHHLGNFVNKDPWKFQLHNPYYAPIQQEAVRAVVGEPPQQHLGFPDERAD

SEQ ID NO: 932850 - protein, 143 aa, Homo sapiens
MPSLHPFPILATPHIPRGINSGAPPNPRRPPPTSKAHDDKVHRVEQVISGNCMSARADIECWVPAGEWDTVGLRTGQFFAVWDCPMQCRIFLIPRLGSSSHSTTHYGHSNTPTHITSCPIGGQHHDFENQNPRDVKSRCSPVD

SEQ ID NO: 932851 - protein, 152 aa, Homo sapiens
MSRFVILVNCVSWGFGVQIICHTVAQGRLWWEEGASGLMLMGRGPSAGALRQEQSASEGAMMRARGSTLFRQAPGPAAGAPGDRVALRLDWLHLTGKTALLCTDPTRPIEDIRHDKCQKTVKLLGQIHNSQMFYSPSAYFKEIKDYVSRTPA

SEQ ID NO: 932852 - protein, 142 aa, Homo sapiens
MMLLPISQGYKYTMCSIYFLYSSLPQNNATCINYIYIISLSRSTSVSISVSVFICICIYIGTCPLQYKVKFLKHFTFDHPLLSSRIFEYHILCIPCIYSLQIKHLITFLYSEYYYRFTLKLYLLLVQTSFWNLPQKFLFEDY

SEQ ID NO: 932853 - protein, 135 aa, Homo sapiens
MPEPLHILGCRVARASPTGATPFSAVSSLIHCPRAEECEHTAQDWQAALPASPVQDPLGSAASLLKPARPQTHQKEETPNTSERQKEQTPDTPPLRTVTPRVSTASFLKSVRPRTHKFGTQKHKNNCYMSQVEDH

SEQ ID NO: 932854 - protein, 130 aa, Homo sapiens
MEFGLSWVFLVAILKGDSWINRDVECVQCEVQLVESGGVVVQPGGSLRLSCAASGFTFDDYAMHWVRQAPGKGLEWVSLISWDGGSTYYADSVKGRFTISRDNSKNSLYLQMNSLRAEDTALYYCAKDTQ

SEQ ID NO: 932855 - protein, 141 aa, Homo sapiens
MQPLLPAPVEPSPQMGAGLRVLLDGHMDRGPGKPPAPTCILPVTLVTQTLFTQALQQALGWMASGLFGALVACLPNSAASPRQEHFLPRLLKLVRGFPTSQKSFIGPPLETSDRSHRRLASGICPHPRGQVRDQRPAKPSP

SEQ ID NO: 932856 - protein, 342 aa, Homo sapiens
MASRGQPPQTQLEPLSLWKLQYRFGETGFEQNIASKELSKLSCLHFTPSSCFSFSHLKTETGRVTLLGQALHEPLPRSHSGSSLWLLAALRKPPAFHAQRPIPMRLPQAQYAPAGLLTCPPGKRLGPPTATRATGSMRLVPGDVDMTGPRRLLTGPPYLAPLPFCVLRERTSREAGGGDLPEHVRAARSRSSRTTRICQPPGKGDKAGPPQRQPRPPPAPAPPRPQRQPRPAPSGQPRPRARPPPQRRSSQGWAYTLRCSGEGTSQAQMAPYLIPYKQQHFQDTETGRSTCCPAHSSPSEVVPLDKGHRKSCEIIPANQPLTPKETRDQAQLEPPSCAQSPA

SEQ ID NO: 932857 - protein, 147 aa, Homo sapiens
MDLELERDNAPSGRQKLADEGRVAAHRCQDCLLCSAGIYPVSKVVSDGHTLQKSFLRADHGHCATPDCAELFSGLAACLGSKLELKPLSKPLSIMLGGMFSQESVSSHSYTLDSINAFRGGAVLLYSPQPLALLGPEKSFNKSVLMD

SEQ ID NO: 932858 - protein, 139 aa, Homo sapiens
MDEAGNHHSQQTITRTGNHTLHVLPHRTPNSPALDSGTWTSKHLDFQLLGLGLSHTISFPDSQDFRLGLSSTSFPGSPACRCHTEQSHLNPYRRRETFPTLQGSNLLQEAPSYNPIQFVFNFSVSQKYLLFFIGGFIVF

SEQ ID NO: 932859 - protein, 226 aa, Homo sapiens
MLKFYNGLSEVEAVGLPAGTEPLDPTDLNGVHFDPEVYLDKLPRECPLAQLMDSETDMVQQIRALDSNMQTLTSQCQVYKCVQNWWVLGLTDFKNEAVDPPGGARGLAGSGVKLQIFTWVHGLAGFRREAADLLGRQLRPSEKSSTAAAGPGAKPLTARAGKASRQLLVQGRQAHAHPELQPAGKQHTRGLKGSSSAAKVGAQAEEVPRVNEGCEGCQHAVTSHKE

SEQ ID NO: 932860 - protein, 272 aa, Homo sapiens
MGTKLHCALFRALFKEKVTFEDVAIDFTQEEWDMMDTSKRKLYRDVMLENISHLVSLDRESALKKKHMISMHPIIRKDTSTSMTMDPFEYNDSGEDCTHSSTITQCLLTHSGKKPCVSKQCGKSLRNLLSPKPRKQIHTKGKSYQCNLCEKAYTNCFYLRRHKMTHTGERPYACHLCGKAFTQCSHLRRHEKTHTGERPYKCHQCGKAFIQSFNLRRHERTHLGQKCYECDKSGKAFSQSSGFRGNKIIHIGEKPHACLLCGKAFSLSSDLR

SEQ ID NO: 932861 - protein, 140 aa, Homo sapiens
MAALPGTSWEPLNLLWFLEWGSLGLHLEIYSVKAKKSGSTENYSEPHESMGKSGDTCAMWKYITNGLWQREIPLPARCLHELLKAAECLAAVPVSVLCAVGPGCFIHCTLNVSNTFRPKLKLRVVRPLNLNVDLVPCGTD

SEQ ID NO: 932862 - protein, 136 aa, Homo sapiens
MFESAPGTACSWQGAVCMSDTAGKRSRSRYFPYSGAQPPPQQVSCYSEEASPWEQAVLPQAPNHRRSRRGSQLRVVTSQGEKSAGFQQRLHLAEKIESSNDELSGRISPYITHPHQRRTPHPLISDGKRRSRKCAF

SEQ ID NO: 932863 - protein, 165 aa, Homo sapiens
MWNFTGSIAAWVHKQLQSLPPRRKNSTEGHTVEKETERTGRRGKFSWKRPEQMPEGPRKKREEPLTLILRWVFLFPVIRPLGRKKVTFEDVAIDFTQEEWAMMDTSKRKLYRDVMLENISHLVSLRYQISKAYIILQLEQGKELWREGRVFLQDQNPSKQQGPVL

SEQ ID NO: 932864 - protein, 142 aa, Homo sapiens
MEQAHEQSGYEGGQGGQAQAQGHEGHMLELAALSTGALERPRHISTGKEDGNGPGWEVAAAAAGVLSPGVKGGSLCGRSTDTSVPVHSQSALHFHFALSLGNFAAGPAVAIFIQVISFNPQKQTCQGVITQVYRGRSWGLER

SEQ ID NO: 932865 - protein, 514 aa, Homo sapiens
MEDDSLYLGDAAFAEIQRTSLPEKSPLSSEARVDLCDDLAPVARQLAPRKKLPLSSRRPAAVGAGLQNMGNTCYENASLQCLTYTPPLANYMLSREHSQTCQRPKCCMLCTMQAHITWALHSPGHVIQPSQALAAGFHRGKQEDAHEFLMFTVDAMKKACLPGHKQVDHHSKDTTLIHQIFGGCWRSQIKCLHCHGISDTFDPYLDIALDIQAAQSVKQALEQLVKPEELNGENAYHCGLCLQRAPASKTLTLHTSAKVLILVLKRFSDVTGNKLAKNVQYPECLDMQPYMSQQNTGPLVYVLYAVLVHAGWSCHDGHYFSYVKAQEGQWYKMDDAKVTACSITSVLSQQAYVLFYIQKSEWERHSESVSRGREPRALGAEDTDRRATQGELKRDHPCLQAPELDERLVERATQESTLDHWRFPQEQNKTKPEFNVRKVEGTLPPNVLVIHQSKYKCGMKNHHPEQQSSLLNLSSTTRTDQESVNTGTLASLQGRTRRSKGKNKHSKRALLVCQ

SEQ ID NO: 932866 - protein, 136 aa, Homo sapiens
MALQTPRASQILSLSASLLFGRTSKERNSASHTFSETSAEQQDKAYSEAPTDQEGPLCAENGPPKEPLPSARLGRTPGKQKVVVGTFSMFMEWKQPETLTDADAQTWTFSDTSIVSQINMFLYLNYPVSGLPSEQY

SEQ ID NO: 932867 - protein, 149 aa, Homo sapiens
MGGRGPSLGSHLLSALFEDCSPDIQVKYLRMAVMATVPLLPFWVTHDSGGEVYVQTSEEIQKPAGGRRSGAEPSQPTGPSQVPRFERELNQDHQNHLDCHHQPQMRKCALLSPVQINTSRAVSKNPCLLHYTSEEELTDQAHGSQLLFQ

SEQ ID NO: 932868 - protein, 163 aa, Homo sapiens
MPLQNSSIPVSASREMQCLFKTLIHSSVCIQKNAMPLQNSSIPVSASREMQCLFKTLIHSSVCIQKLPLVTPLTLHMPILLVVLPQGRVACFCSLPSPWSPSSPTLFLLQCHGLQLQLRSVGSQIYSFIPELSAEFSIHVSKQQMEQLHMGKFKDPQTHFAQN

SEQ ID NO: 932869 - protein, 419 aa, Homo sapiens
MAALKIPSRLHRFLELFTSKSDNRLSRLHDLWCGTTLFLLFLGVGYPIKEAVLMLLEGSEEDKKMWESLELTRDLLNGFAHNADSDMDIKVRAEVVSDGDEKLVGNWSKGDSSMAERGQCTAWDVASEGGSPSPWQLPHSIEPAGAQKSRIEVWEPLPRFQKMYGNTWMSRQKFAAGAGPSWRTSAKAVRKGNVGSEPPHRVPTGALPSGAMRRGPPSSRPQNGRSTDSLHCDPGKAADTQCQSMKAARKKAVPCKATGAELPNTMGTHLLHQRDVDLRPGVKGEHFGALKFDYPAGFWTCMGPGPGEELYGLATSPPKSQLELYPPEFPLVVGRTQEEVFPVTFLWNSSVLSCMIYLKGDYSLFQFFFIEEVIGVQVVFGYVRLPVPLLLVTAHGRWGGLADGKNEKGSLARRESDQP

SEQ ID NO: 932870 - protein, 136 aa, Homo sapiens
MGSTPTEEWLWQKETHRLQELRRLLKLPPGGGLREVEADVPREELSVDFVQVPQEESQEAWQCHRRQGADIREVSPGLLAKISLQLPNNGPQLGPCASLQAPWQAQTTTWYRKGQMAPERNPLETITPPYGSLMEC

SEQ ID NO: 932871 - protein, 169 aa, Homo sapiens
MWCCLAQSFLAPPISPFAILALLAEMRLQRGRNFSERYKIGPGQMDLGVVNIWISNIKIKYTEASKEAENQCGRKEQEPEHNGCKGKINAGQTKGTIVYEIQSLSSTFPRYISKAVVLNVQSLSQQHMLLPERWLECLFSNPTLDPLNQKHLQNFSRIRKCCWHELHCQ

SEQ ID NO: 932872 - protein, 137 aa, Homo sapiens
MLQFSGGLLQALLASDFLVPGSITSEGCKTAKMAACPFSWKLPPREKQSGHIVVEQLCHARVSLPPGQLGLSKAHRLEQLNCTNSPKSNNGGPFHPRYFSTFYLTLTLPITYSSDAVVYYKYALRSSERCGNSALIY

SEQ ID NO: 932873 - protein, 271 aa, Homo sapiens
MDQCDILWKQKAIKVSLNKIMTQSWRVDIPLRQDSKGILLALPAEGKLLLVGLMDRNGEKGICQVSGCISEDYNDILGPLESTSAQSQCPVVPKKPNYFPFQNAQKEKDGLVKDKLRLANGDPKKPKGKMSAYAFYVQTCREEHRKKNPEVPVNFAEFSKKCSERWKTMSGKDKSKFDEITKADKMRYDQEMKDYGPAKGAKKKKDPNASKRPLSGFFLFCSELGPKIKSTNPTISIRDMAKKLGEMWNNLNDSEKQPYITKAAKLKEKGR

SEQ ID NO: 932874 - protein, 142 aa, Homo sapiens
MIYIPLGIYPSGPSAAGLLEFAGGPLQTLFAWVSAAAEAAEQRILLNSKCCCLIIPLEVSSQRGIQPCEVSVPSATALLGYEGEFPDPLHFLDEVMPGPASAHAQCAAPTVLNPLSNKPQEEVEQDGGIKGSTDHLLHKNTN

SEQ ID NO: 932875 - protein, 138 aa, Homo sapiens
MENLYLRVVWRGNVGLEPSHRVPTGALPSGTVRIGSPSSRPWNGRAANSLHYAPGKAAGTECQAMRVAIGAEPCKVKGAELSKALAAHPLPQHPLDEIIERNVFVKYQRVQQKGRSASVTHRGARLCLFSINLISYCG

SEQ ID NO: 932876 - protein, 291 aa, Homo sapiens
MREQEPKRKKFCKGEKSLEDKEHSCRPLEVDNDQLRAIIEVDPLTAMREVAEELNVNRSTVFQHLKQIGKVKKLNRSVPQELSKNFKNCRFKVSSSLILHDNKKSFLDWIPNLHQKKVMVTVWWSAAGLIHYSFLIPSETSPSEKYAQQINEMHQKLQHLQLALINRKGPILHNTRPHMAQPMLQKWNKLGYKVLPHPPYSPDLSPTDYHFFQHLDNSCRENTSTTSRMQKMLSKSLVGGRKGGKGCGTQTFRPWHFAPGPRKSISFSHVKYMHSIPVTNVLVCSSINSKV

SEQ ID NO: 932877 - protein, 126 aa, Homo sapiens
MLGAVDWSCSYSAVLAPSPKFLHILANNCHSLFFSIVAILMVARYYLIVVLIFISLKIIDVKHLFMHLLAICMATNRAGVCRRGPLRFREGKLTLKSQRPVQRRTIGRGMGLKAKANFDGQQRLGT

SEQ ID NO: 932878 - protein, 134 aa, Homo sapiens
MKSPHSFFLFETLVVPLGIPHPQGLLLMMNNQSERDLNPKADTEEDLGHEIGAAGWRTSQARASVTHPTHFLKRQSRERVRHRGPLLHIESEKKCLCECLGRELETATCGSLHLQPGAGIRRMYLFCATRAMPL

SEQ ID NO: 932879 - protein, 356 aa, Homo sapiens
MLPTFLLMNLLSLAGDVALQQLVHLEQAVSGELCQRRVLREEQEHKTKDPKEKNTSFETTMEEELGLVGAADDTEAELIRGFCKMELLDGKQTLAAFVPLLLKVYNNSGLYSNPDLSAAASPTLGKFCMISTTFCNSQPHLLFTMLEKSPLPIVRSNLIVATGDLAIHFPNLVDPWTPHLYAHLQDPAQPVWKTVGLVMTPPDPQGHGEDIISHLSDPELGVEEVPFHTIMKQFFSYIITKDKQTKPVMGKLQHGAKPEGKAIIDEFEQKLQACHARGLDGIEELEINQAGSQRAPTAKKPSTVCRHQPLASAASDNDFVTPEPRRTTHRHPNTQQRASEKKPKVVFSSDDLTELH

SEQ ID NO: 932880 - protein, 178 aa, Homo sapiens
MESAIEKDHCGAATLDLKEPPRASVSFSVNRDTVSPYIVNVKITKGSLNRSQHIAWPKPQANFMMQVLHQPPGLGPQRQPASLQHSQDSMKGERLRIVSTSSLDEGHGHMGTDIWGGVVEGLRRCFPKGPAGYRLGAVFLLLVLGLHCESPTLLGCDAAATAGRLMAFQAAEPICHEE

SEQ ID NO: 932881 - protein, 140 aa, Homo sapiens
MADMWTGHRRQLWLGFWFQFQEIKMYLCRNDAYNQIFFPPCLSSFSLYLLFFSLPLFLPLFLFLLSSLLLFLHPSISLSSSLPPFLPPSFPLPPFHSFSPSFLLSPFLPPCLHFFFLLTYQHLMMFTMYKTLGEVLGIQR

SEQ ID NO: 932882 - protein, 158 aa, Homo sapiens
MESLKYNIIMGVTSFYLCYILLVGSKSQVRPTHRCSSRGEGYTGMNTGGGGPGATLHPVHHCDLHISNFPTGVLVAKNSQKLPPQSVCCKASPFDLESSSVLSTFLPDLNPSPTAHVSTFEKGEVGRDSVLMEDRSRARRFSIYFAQTHQRNHNLRQL

SEQ ID NO: 932883 - protein, 181 aa, Homo sapiens
MNISSNEHLGKRHREATDCGERENPILSTVPIPNTTLTNPECEWGQSLPCPSRSSKSLCMFQPQEQHVPERRPFVQPGSQNEDTRENAARKKGSAGPGLGEGNELNAFQAYKQFPRIYRQKSFSPSPPPPRVTNFSALMHLMAPSLSGLREDMEHGQLSMVEYVPSADENVYSVVVGWRIL

SEQ ID NO: 932884 - protein, 134 aa, Homo sapiens
MASIECGAPTPQPPKSSVGRGNRTCKGTEAGENTEKSANKSQWLEYGVQSTDGSRDSTRSKDQFARGKGPEKHSEKFGFDSGSKKEVARILHSERFREKRWHNKVCNFFLHRHKPPGVPQSHVLTVRPPPQGLP

SEQ ID NO: 932885 - protein, 146 aa, Homo sapiens
MLNNLSCFYQRAVKDVEDQYNFFFIMSVIFQLSQDSWIGHLLLLLYHLPTIPSIGLHGPAMLLTRTTSTHPYSSHWGGHVTRAGQVQLSHPLDPMIGSETGAGLTQANQNHSVDFRASQFPLGYRGCKSRPGFKFQSSPISWGQLV

SEQ ID NO: 932886 - protein, 181 aa, Homo sapiens
MPISIPLFLIVLATQLCVWHKCTVLIKSAVVHSNVLGCTFTHHSFTDSPGANSSSATSIHHKCPLQVCNFFLSFMPCFYCTFSMFRCTHTYHCVTIGYSIQYSNVVQVCSLGAIGYTIQPRCVVGSTIQVSVNALYDVHSMMKSSYDTFLRTFYLAVSVLPLIWLHKNAGIQGFSVDSSAR

SEQ ID NO: 932887 - protein, 160 aa, Homo sapiens
MVSGKKKYGFRRGLGNRNWHLNTNCVSDTKLGMFTFLSFLLTAALKERCHSHFIADKEEKLGEAGRPATVTQVASHRTGGGASEPGPSHDDHQALPGGSQAALTTATGSMVSAPVAQGMTGGLSCSGSCVPFLDPLSLPGLVIQCERCWVQFRLEMKRWI

SEQ ID NO: 932888 - protein, 137 aa, Homo sapiens
MSVHVHNMQLLIETNSCCLFMTEHTQDLKDVTNNVHYENYGIRKLAAVTYHGVDNKKNKGQFAKHLMITLNIRDRSPLAQMEEERREQVAKIKKMEMEMEQVFEMKVKEKVQKLKDSEAEVISPIFQLLADIVFLFK

SEQ ID NO: 932889 - protein, 136 aa, Homo sapiens
MSCLLLNCQGQLNDLTGVMQMEGTGFEPIANPAGPVRHSWSRTTDGINSLMATEGEDTGLSSEHQPGHWKWSTGLRVPSDLIMSLMDVGPLWRKAVWESWGHNSQWAPGGSAAPASGPSHRGALASAAAEAVNSWG

SEQ ID NO: 932890 - protein, 138 aa, Homo sapiens
MFACQREKTQRVLGLCACSSRSSFNSSEMPKLLLAGTNYFLPGLKFVSVPVPPAQFALTQSDSAFRPHPWVFSWNQTLAGHLLDHPLPWHSLLCWNTLRSGLAPPERPPSHCPVQCLCSRRVQAKRQWDHLARCFLYY

SEQ ID NO: 932891 - protein, 150 aa, Homo sapiens [sequence omitted]

SEQ ID NO: 932892 - protein, 153 aa, Homo sapiens
MPKRLELGLELTPSALLILRPLDSVWNSTISSPDSQAFGLISSSSKSSSSSSSSAASFTFFCGTLLPPPGANHFPYILKSFTSSCSSSSASESSSTVTKCCPLICTGPEPHFNHQVSGSLMLRAGKKPLLPDIPPVGRQPSGLPPGVALFIAV

SEQ ID NO: 932893 - protein, 155 aa, Homo sapiens
MTRRAALATGDPGEEEMDCQVDMPVVYLQCVVALPLQEMRGYLEPLHFNPNLAFNADEMQGSGVFYGSSPTGNLTNQQVILLHLYGRKHSPSVQGESRQEKQSHPHVVMGEQLSIRLCDPEYASLARKTPAGLVEAPIVVLSSYSFFLSRNSALN

SEQ ID NO: 932894 - protein, 143 aa, Homo sapiens
MNRKSHCEVKNRYTAHCLCPQDLSWVGAKTDMGKNSFNAGPMETNPAESLSQVEFASGELCLPFTMEFHTGKFFLPLLHVDRINTTSLLCLTQLYCSVQRHVVVMRSIINSQIRLSVWDFLSRKVVYVLINCSMQLLPTYVSL

SEQ ID NO: 932895 - protein, 181 aa, Homo sapiens
MQNYSSYRGKPHFLLGALGEVHLTGCPALNSGGFIRVRGQPCQFAGGRDNCFQYPCPSSSLSRTASSTPVPPVVYSVSRCQSQDTSLGSLNPETEHGATKLCTGRIQVGENDCYFQSVVSLLPTTNAIVSPPELKGPPSRVRLLERLSFCHPAMCRLVQTHTDSPPLTYFGAACSDTFPKR

SEQ ID NO: 932896 - protein, 147 aa, Homo sapiens
MNMSQFYVLGFVSRIGEFLGLADFMNKAADPHGVKLQTFAVSVTTLKAAHLELFIPPVGFVVSPASGVKLQTFAVSITTHKGNADPKSEQQQDLLQRAKEQSFHSVEVEVGCCYWLGWPASIPLFGHTHILLIGPFYRALIGPFTEC

SEQ ID NO: 932897 - protein, 180 aa, Homo sapiens
MELNGGKEKPHPPEPDQSRLATRSALSCLLLGYTAPKTGCHCWKHLPSPPGLLSCFGLGLSKVEQFQLSISTEVKKSIDIPCKISSTRFETDVIHWYRQKPNQALEHLIYIVSTKSAARRSMGKTSNKVEARKNSQTLTSILTIKSVEKEDMAREIIIPLPLNAGEKCEGSNGRKRLEQC

SEQ ID NO: 932898 - protein, 175 aa, Homo sapiens
MLLALALLLAFLPPASQKSSNLEGRTKSVTRPTGSSAVITCDLPVENAVYTHWYLHQEGKAPQRLLYYDSYNSRVVLESGISREKYHTYASTGKSLKFILENLIERDSGVYYCATWDRHSDSDLRIHSMSPLDIRLIIWIRSQHGPLRNTTALLRDKKDYPLKEFTPPGRHGERA

SEQ ID NO: 932899 - protein, 412 aa, Homo sapiens
MSIRVTQKSYKVSTSGLRAFSSCSHMSGPGAHLSSLSFSRVGSTSFRAGLGRGYGGASSMGGITAVMVNQNLLSPLNLEVDPNIQAMRTQEKEQIKTLNKKFPSFIDKIRFLEQQNKMLETKGSLLQQQKMAWSNVDMFESYINNFMQRLETLSQEKPKLEAELGNMQRLAENFKKKYEDEINKHVGEAYMNKISDTSVVLSMDNSCSLDMDSIIAEVKAQYKVIANRSLTEAESTDQMKYEELQMLAGKRWDDLGRTKAEISEMNRNISWLQAEIEGLKGQRASLEAAVTDAEQPGELAMKGAKAKLSELETALQLAKQDMAQQLRRGELAGVWDAEHEYPYEDHLWLCRWSELSYGRLTSPGLSYGLGSSFGSGAGSSSFSHTSSTRAVAVKIKTRDGKLASESSDILPK

SEQ ID NO: 932900 - protein, 151 aa, Homo sapiens
MPEQEEEGIGGNEQEGRLSEAHQECRKVTLGDGGVVLRAESCFSPPNQTAMQKLGLLSKETLTDLCKQREGCSSSKTAQVLHPRRLCIGGADDSPSKDPSRQPASTTTHESDSQNHQQGAGRSGVQIQTLCSAQVWPAAVVMEGADPEAFR

SEQ ID NO: 932901 - protein, 132 aa, Homo sapiens
MRRLVGLRSGWAWVLEKWPMARSSRPFFGHCKDVEFNSNHERKPLEGFGQGMTRSDVPSKRLLCGEAKAEVWRQKQKCGGRCLGPLIREFSPASATPETAKLASTLPPPPQPTQSEEDKDEYVYDNPPVLNK

SEQ ID NO: 932902 - protein, 144 aa, Homo sapiens
MGRSVERFPQDPMIAGQVSKPLLSVRSEMNAELRGEDKAATSDSELNEPLLAPVESNDSEDTPSKLFVFPYTWARIQVPVSSSMLLFTEHGRQEDSSGFAQFNSENGFLLGNLKVSNSKDVSSSPKLHKNRNSAYLVHYCILIA

SEQ ID NO: 932903 - protein, 197 aa, Homo sapiens
MKENLNLSISDLPTGICLICASGDLNTKYLDLSTVLFLPQNKTSLPLHLAHPQQSLLAWKECLRRKKSYAAETAFSSQVPSQDIFFYSFPEIKPAAASCPLLSCTWGLMVLLFFDRLEEGGLQPQNNPAFPITGPEGVELLLNACSEFSLAECYSRYRLPAHTSGISDPAVLEKVLIIYIAYKFPDDADAAGPGTRI

SEQ ID NO: 932904 - protein, 147 aa, Homo sapiens
MSVQSTAKIFIFIACLKGGEQGGFSMGTPLKMAGVRMTFDVDGWQTPSKRPLLAPRDFPMELHLPAEESPRYFTKADIQMANKHMKRCSTSYVIREMQIKAMKYHYVPRRVAKIQNTHNTKCWWSLKLNHHAAHLTVIQTEHRNPDF

SEQ ID NO: 932905 - protein, 142 aa, Homo sapiens
MLKTLNKLGIDGSSLKIIRAIYDKPTANIILNGQKLEEFPLKTGTKQGCPQGLTTPIQHTIGSSGQGNQARETRIKLTRDVKDLFKDNYKPLVKEIGEDTNKWKNIPCSWIGRINIVKMAILHKLIYRFNAILIKLPLTFFT

SEQ ID NO: 932906 - protein, 158 aa, Homo sapiens
MVNHTMFFDVAVDSEPLDHVSFELFAEKFPKTAENVRALSTEEKGFGYKGPCFHRIIPAFMCQGGDFTHHNGTGGKSIYGEKFEDEKFILKRTGPGILSMANSGPNTNCSVFHLHCQDGVVGWQACSLWQGERRHEYFGGHRAIWVQEWQDQQEDHHC

SEQ ID NO: 932907 - protein, 194 aa, Homo sapiens
MPHNTVEQPCRRGGCLLSKALDQGLCQQTWFFHQRVGVAEPQGMVSLGKVLDANYLPPTDFCETSKGRERRIPRLPTPSSSLPTHARTLLRPEALAVNPASVWGHLLTLAINSFLYGCQRLRKVESLLPVPTTPSLAIEITPPQSSLASVPPCLLTPDSFFPECLSSFTGSTQYHYTKNMEDLTTKVILLLFIG

SEQ ID NO: 932908 - protein, 135 aa, Homo sapiens
MTKELVTMILTLAEASHEAGCALEKWCGHTIRLNNEDGSKSPGGHGGDSGPDNFHHQSVRLSGRKQPFKQSPTLAHGTYRIKMIFHLDSSHIRTLQYLNSPLVPTPLLQTGRRESIISLHYHLARCLPICNPLIG

SEQ ID NO: 932909 - protein, 171 aa, Homo sapiens
MDEESSLGVQDKVWIQVLLSTYQVGKLEVLYFLLGTSFFFLIFSVEQSSEIKWEKTLKMLNNRMEIAAVIPTFSNQHSDQSATIRIKARPSTSKDYNLQKAQMIIGIFKQLRNFKLRSATTGHSPKAGDLWDPAGRVAVSKSDGLKTREADGVTLSLRLTASRPAGTADQK

SEQ ID NO: 932910 - protein, 156 aa, Homo sapiens
MSAQLVDAFPSSEGVVQSSALQLFSVLTGISYAFYQGVGPELKVKCQWPWRWGPFESLPLKARCGLLSSLGLASLDCDTAPCFETPFFHTGLIQRACWEKRGGRKPCQHVTRCLATGENKQEGKMSLRLPGRSEEGGDFGPCLIWLGLCRDGHALI

SEQ ID NO: 932911 - protein, 142 aa, Homo sapiens
MLSDPWGLRKGLGREMFSCKTTEGNQLEAGAAEQSKSSWEITGSAYEDGMRPSTDWIRYSHIMDGNLLYSESHPKNTCVETPVMFDQRSRSLCPSQTFRPSDLAWCFSLSILAHILVRPLLGLPLLAQMGGAHSTSLNQALC

SEQ ID NO: 932912 - protein, 154 aa, Homo sapiens
MQQGNCVVNCGVQVPRSNVQSISHYDDDDDDDDDDDDLMLLKIVCLKCSVFHKVFKEFTKIANNIKLIDNETEPTSEWVVTACSLLARDAGEGVPTSGWRRWDSQCGKFLQHRATRPGKGKGGSGTWGRLVLRAGAVFGPRVEVSVSSVSLTTL

SEQ ID NO: 932913 - protein, 143 aa, Homo sapiens
MGDPNQWSLICLCRQGAEREDPEHWFEVWDKRSAGPGDIPCREDQRPSEGQGCPVLSGDKQGEKRPNTHKREVDQQGCSIRGSLLPDKGVSGSRGLLGDSQEASVKRAEISSSQGLEVSTSMEGSRSGKSGLVTKGLMHREGI

SEQ ID NO: 932914 - protein, 138 aa, Homo sapiens
MWKLPKPGLPPSEATARALHWPLSATAAVAGTQGTKSLGYTQHGDPGPSPRNHFFLLGLLAWDGRGCREGLCHDQETFSPWSWGLTLGSLLLMQISAAGLNFSSENGFLLHCQVANFLNFYAVSLLKQNAFNSTQVTF

SEQ ID NO: 932915 - protein, 179 aa, Homo sapiens
MSFTMSTGSQDSSQRDWNPQCLAQSWPSRNLCRMNECMGHGEMKGSVTLSLGGHGKAASLSDQCTLIHVLSGRCWKSEHLKCKLLCPFPGPQVSNIGACDDHPESVISQLESHEADTALDYSSGKARTCAVSPPAFQPKVEAVPGTRALSGHWCSFSKAACLCTISGKIPKLPHSSGVA

SEQ ID NO: 932916 - protein, 143 aa, Homo sapiens [sequence omitted]

SEQ ID NO: 932917 - protein, 141 aa, Homo sapiens
MCPRWSEHSLVLYILGTRETSIDICKMNIGSVWKGRTTQARMSSRSQDSELYLPCQRWQPEKDLPEKDSADIAGFEDGEMRLSQGMQVASGAAKDKEMDSPTDPPEGMQTCQHYDFSPKFNYDVTWCEFLHVRGSLHFLNL

SEQ ID NO: 932918 - protein, 161 aa, Homo sapiens
MGPSFSSLLLFLTEEPEHNRREVRVSSFSLGNSPLRTRGEAGWKEDTGVVGGCPDQQPLLHQPLRLAELQSGRRGPASISSVSSGRQHRRPSQGSWLQLDCHLVARMIIALLSLARCFPSSVPVVEAGVLREEELASQRICPGICIVGPVCESLSWERQEK

SEQ ID NO: 932919 - protein, 179 aa, Homo sapiens
MTDTCFYCVIFRNPALLPDVTSIVKIWNCNEASTVHVQGSSYRYGHLEHPEGREVANVPSSVLLSCNAIHWVTHHHGPFALSLWDLGDVGEPKQSYAALASAFAGMLKKVTKVVSKTLAWNIPTALLCELFSSTAPASSEQTTAEHVTAGNAQMAPVTGSLHVRARMASTAVPFPVLSF

SEQ ID NO: 932920 - protein, 141 aa, Homo sapiens
MLKLNRRWMVLGGGAFGRQLDHEGGDLINRISAIIREIRKSSLPPSCHEVDACTYISHHLNAAVASADSCRCASDSKTTVVTDMITQKYQHILGKFLTRESLILPRLAKQTLESCAGYGTVLSSVTCPEYCRTSTIPDPAG

SEQ ID NO: 932921 - protein, 151 aa, Homo sapiens
MCLEFVSSGGFVVSLPSGVKLQTFPVSLTAHKSGADPKSELQQQLLQGTKKQSFHAVEGHPSRLQPLAWVACRCHLGAKAWNQGPQEPAWCSTPLWPSWYLRTSHKALDIVPGYCCWFFNAQGLFSQQMMNHPGLSPSLQGNGFPSGLGCI

SEQ ID NO: 932922 - protein, 194 aa, Homo sapiens
MYTYKWVSSTSKSISANPGLRAEVKMWCCLAQSFLAPPISPFAILALLAEMRLQRGRNFSERYKIGPGQMDLGVVNIWISNIKIKYTEASKEAENQCGRKEQEPEHNGCKGKINAGQTKGTIVYEIQSLSSTFPRYISKAVVLNVQSLSQQHMLLPERWLECLFSNPTLDPLNQKHLQNFSRIRKCCWHELHCQ

SEQ ID NO: 932923 - protein, 150 aa, Homo sapiens
MLKHCPALILSPSMPLSPQLQLRSLFNFRHRQLPFNRLVHNSVRTFHKRLSLDKFKTEGLIAVPPQPARSRSHRTFHKGLSLNKFKTEGLITVPPRPARSRSHMCVFFSLSSLPQFPDSGSAYSRFSLLITPEASPLLSNSLPSFTGAIS

SEQ ID NO: 932924 - protein, 144 aa, Homo sapiens
MRHGVFTIGEKIHVPGTQLQGKQRAVEAHGYDIVEAEGPDTNPRSISPIPRGRLQVHDLKPCVDLNSCSSIPVVISWDKPTDVERGAEEVWKGRGRVQRCKTWQGLVTEWLEEEREQLRMPRGPGDLRQKCEEHGDSNHMISLY

SEQ ID NO: 932925 - protein, 270 aa, Homo sapiens
MKPQTLVLSVTVLKNGISSNKIYCKERKKPPFPENKANLADFRFWFGWPAFIPLCGPTHILLIGPFCRELIGPFYRELIGPFYTALISPFYRELIGLFWQSADWCVYKPLARRKSSPSPHPPRNPAGFTSHQQWLRDFPAPSLGIPTAQRELVPDNQEEKKGNKKEMETHHCGQRPHEEGIAVHARDPASDQAQQAPGAPVLGGRAHAHPEPRRPARSVRSPGCRLRFSLHTSPLAEGAGSGLSQPQRQAPTAQRRAEGLLERGQSRRRG

SEQ ID NO: 932926 - protein, 309 aa, Homo sapiens
MRARFCDQLVLPGFITTVTLIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVSAAPTYQPPKGNNLHYDTLVFQPSFHHFIF

SEQ ID NO: 932927 - protein, 137 aa, Homo sapiens
MCLAVLMGVHLPTDSTINQPFVFVGTTALCSLNYGLRIFGEKKSTKKFAHSNALLNPRECVGIVLAGTTTRREQMNGRKDWKKEELSQGMSQENEVLKPLLPHLASGLCGAAQPAGISEWVWEHLRAGVLWEAIHLG

SEQ ID NO: 932928 - protein, 161 aa, Homo sapiens
MNYKAAAACVTLKRASIAQLPTWPLPEDLITTAAHSAGKSILRDLEGLEDPAKEAVQGESVRNPEITVPRKPGEEGKSGSLYVLFSLPGTQPHPPPPIPTPPLACLTTILPSGLNLQVTSSEERPHLYINVAIVYWAPIMEAIDPVYSSTETTSELPLNCR

SEQ ID NO: 932929 - protein, 288 aa, Homo sapiens
MTDAAVSFTKDFLAGGVAAAISKMGVAPIERVKLLLEVQHASKQITADMQYKGIIDCVVHILKEQGVLSFWHRNLVNVLRYFPTQALNLAFKDKHKQIFLGGVDKRTQFGSYFAGNPASGGAAGATSLCFVYPLDFAHTCLAADVGLGNCLVKIYETDGIKGLYQGFNVSVQGIIIYRAAYFGIYDTAKGMLPDPRNTHIIISWMITQTVTAIAGLTSHPFDTVRCRMMMQSGRKGIDVMYTGTLDCWRKIVGDEGGKDFFKGAWSSVLRGMDGAFVLVLYGEIKKYT

SEQ ID NO: 932930 - protein, 179 aa, Homo sapiens
MGSAPVGLGACGGLYVQLPQGGECTCGLGDYAHRGLKALGRVWGAVRGAALTGSCTLREARRRGSCECWGARGGTRRDCPRKWLRTHAPHPTFHSRHDDQEVRKGCGDNRYNLPALEPEVEKSALCGGNLPRGAPRCSTRRIRNLKAQKGLELQLGAKTLLLGPFQAVSSIGKGLDKHG

SEQ ID NO: 932931 - protein, 190 aa, Homo sapiens
MAKAGLSLKGLINGMMPGYFPGLPHAISISTITSQAPEHPGSTRKAGHTLDCLHRPRAVQWLTTSSLNSQLQQLQLQLQQQQQQQQQQPPPSTNQHPQPAPQAPSQSQQQPLQPTPPQQPPPASQQPPAPTSQLQQAPQPQQQRENLEQPREDAEIKSFSAYTSVLLPPRKVRNAQAQAPCVSLCRLIIL

SEQ ID NO: 932932 - protein, 138 aa, Homo sapiens
MGSFQQEEEIRGSTGGDHQISRYSENDQGIALETHLCLTSYHTLGKLAWLDHLGTIRNNRKRQGLSAASAYRSQRQSHSPCEQPCLTVALTNNSIKPKSQVGWLHPTIELREQAHITLEPRQPAPPTCEALPDNHAQK

SEQ ID NO: 932933 - protein, 138 aa, Homo sapiens
MYLNSFLSSVRDIPLVSISFSTGILSKLTISESFNNCTIIAWQELSILQLLSSLPACQEKGLLPNLLYEASIDLIPKSGRDTMKKRKLQANIPDEHRCKNLQQNIGKLNPSAHKKVRGPHQIPNLLAPGSWISQLPEL

SEQ ID NO: 932934 - protein, 135 aa, Homo sapiens
MEGVSDAEIRLRRAGRQECLSQLKLCPQPPLPPGPLSQADGSFIYKLLTGAAAFFSEMPCPERRNLERLSGYSGALVVSAPKGISWSVGYEDHGKSVVSGPDSSIPHGTVPHGFPWLGEGVPLPLVLPRLIANLK

SEQ ID NO: 932935 - protein, 151 aa, Homo sapiens
MNKDSLEVRRKMEKLTVIETKSWRAAITKLEGSSMEWEILHTVTTGMILSHNAGQCQKAEVPSQPHHSDGFNILYFSLIFENLISGEIHPLDQNMVEKAKGEADMCKAAKPNGHPALSIENPEEKLAIKNPNKRMLDNNTFFSINHFILNL

SEQ ID NO: 932936 - protein, 152 aa, Homo sapiens
MTFCTGSCFQFLIHVRLRKNRKEIFLPVNEQYLHNAYLAYFCRLWLTMALGKTLTDMLKASEQLVPILAFKDPPMREYHPINWRKECECHEASIKTQEDRVQGASGADHVEVPRGWHSQGGHESSVPLSQYLALCISSSVSIAVTFLINWCA

SEQ ID NO: 932937 - protein, 214 aa, Homo sapiens
MGSPWHWGRSGGHSTGTCLESGVMGVCLMMGFSVAGLVLGSKKKSSAYLPLLPPSRQHISKCGATCGEVKPAAEICISNEKLNVNHQNNGKMSPGNVRDLDGSPSHQRPRGLGQKNVFMVQAQGPATLCSLGTWCPVCHLLQLQPWLKGAKLAPCTGKAANTQCQPVKAATEAVPCRATEVELPKAVGAHPFHQCALDTPVSPYIVGQLVALQT

SEQ ID NO: 932938 - protein, 211 aa, Homo sapiens
MGSPWHWGRSGGHSTGTCLESGVMGVCLMMGFSVAGLVLGSKKKSSAYLPLLPPSRQHISKCGATCGEVKPAAEICISNEKLNVNHQNNGKMSPGNVRDLDGSPSHQRPRGLGQKNVFMVQAQGPATLCSLGTWCPVCHLLQLQPWLKGAKLAPCTGKAANTQCQPVKAATEAVPCRATEVELPKAVGAHPFHQCALDEITSLAKKIIVLV

SEQ ID NO: 932939 - protein, 196 aa, Homo sapiens
MGENDSRACQRFSWQPLPSQAERPRRKKWFHGPGPGFPGCVQPRDLVSCVPAARGMAERSQHRALVVASEGASPKPWQLPRGVEPVSAQKSRTEVWKLLPRFQNMYGNAWMPRQKFATGTEPSWRTSARAMQKENMGSEPPHRVPTGTPPSGALRRGPPSSISQNGRSIDSLHHFLGKATETQCQPVKAARKEVVL

SEQ ID NO: 932940 - protein, 159 aa, Homo sapiens
MGRNQCNKAENSKNQNASSPSKDHNSSPAKEQDWMENEFDELTEVGFRRWVITNSSELEEHVLTQCKEAKNLEKREKRMKRNEQRLQETWDYVKRQNVRLIDVPESDGENGTKLENTLQDIIQENFHSLARQANIQIQEIQRTRQRYSLRRANPKTHNH

SEQ ID NO: 932941 - protein, 140 aa, Homo sapiens
MTTRTCLRGKFDFYLPHTLSLDPMSSSFTIPSSPTIAAIMVTTTTDDDDDDDDDDDDDNSGATVTVLKLGLPKNVILLTVNPLSFNSSYLCSNQAELPYGWEKIDDPIYGTYYVEQLLELDVSCVSSAVPPAGRGDPCPR

SEQ ID NO: 932942 - protein, 133 aa, Homo sapiens
MYNKENNENDFKGASSTAVTHSKGLQTFAKCKKLVTFQEGMRCPEQSYPKVQQVLENGVSKRVDSEAFFNKEFRMKYMLFCMTVCCFQENNNKLSLKRMAGDGISSREFKVVFAKKEGQSDIVSNISFINLNK

SEQ ID NO: 932943 - protein, 237 aa, Homo sapiens
MLVQEYNYSCLKISMHVVQCDVIVYINEVCVLGHTHADVVKLFQSVPIGQSVNLVLCRGYPLPFDPEDPANSMVPPLAIMERPPPVMVNGRHNYETYLEYISRTSQSVPDITDRPPHSLHSMPTDGQLDGTYPPPVHDDNVSMASSGATQAELMTLTIVKGAQGFGFTIADSPTGQRVKQILDIQGCPGLCEGDLIVEINQQNVQNLSHTEVVDILKDCPIGSETSLIIHRGAILTH

SEQ ID NO: 932944 - protein, 134 aa, Homo sapiens
MGMNPSSVIYMSLDKLFSLCESQFSYVIEKYLLHLKIIHQSCLSCPEPCQCHPSLPLVTSASYSGRHLQRRKQVAPIQTSVIIDVLGFPGTCEEFRRKSSQLQVLSLQKGKRDARGEHGYNGQPLTEPFHYENN

SEQ ID NO: 932945 - protein, 141 aa, Homo sapiens
MLIGPPLTFCCANWFLTSHRLILVPGLGPVPKSPGGLSKTQIAGPQSQNFFFSWAGGKGSEFAFLTSFQVMLKAAEDRRGFPVSILQWLGYLVQVTFRLKTSLFPTHIMTDSFVVQDIWKHEGLIFVCMCVVCKWGQGCCY

SEQ ID NO: 932946 - protein, 261 aa, Homo sapiens
MNKFVVITTEGTLNELENIISQMMHVAEYLEWDVTELNPILHEMMEEIDYDHDGTVSLEEWIQGGMTTIPLLVLLGLENVSISTEEGGLVNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLTMELKIQIRAVVFFPAIQSKLDEASKEVKY

SEQ ID NO: 932947 - protein, 136 aa, Homo sapiens
MSWGCSSRGVSLCFPSNSQDPLPQVCWSLLEVHSRPRLPGYQQRSLQNSKDCCLLIPLEVSSQRGTHHMPARALLYEVSVDPCLEVCPSQETRGVGRQEYLSLLKLHPQPPLPPGPLSQGDGSFIYKLVTGAAAFF

SEQ ID NO: 932948 - protein, 146 aa, Homo sapiens
MVKMTSYWSRLQYYPLMAHRSMPQDMWEDFLCNLLEEMSENKIRKIIPLKSDRLFYKKNCSKAKRGKETAEEEFEASRAWFMKFKEGSHLHNLRVQGKEASALGEAEESYLEDLAKIIDDATTTLIIQLPSTSMQDPPAAEKIITR

SEQ ID NO: 932949 - protein, 162 aa, Homo sapiens
MVIETVVHPYYGILISNKKKCVLDISGAEGVYDYGFAIGRLVCFHTDKPYGQEAIVYCLLKDDSLVRLVCHMSGAGMDFPETDDTSGPPSPRLLIFKTSVNNIYIIRLKKVFSRVVGGDSSLCPKLGKNILLSEYAGLILLSQHTCTKSDTTGRVIGPQDSH

SEQ ID NO: 932950 - protein, 145 aa, Homo sapiens
MQESSTINASLIKTLLKTALLPKEAGVVHCKGHQKASGHMAQGNVYADKLNSTLRHDQGQNNNQKLAQLAKAACLLRRKKRRCQYCQSCCIFKEDKNPRNIRWIQQNELTEKASTGNTLEEVWQSWQWKAQSQNTGIRFDLGPDI

SEQ ID NO: 932951 - protein, 144 aa, Homo sapiens
MRTRGHRKGNITLRGLLWGGGIIYVKKSVCIKGFASSAETSLRNGWRVGWISRCPQRQVRGQMCVNGLVQGSWERNVMKFSMPLQTDTHTALSGYNIGEWKMEQNLATTLTKIPLDIHETEDGALEWSTATENLLFHSLFCMDT

SEQ ID NO: 932952 - protein, 331 aa, Homo sapiens
MANMSLNPNLWMYEYLYAYVYAEEDRKMWESLELQRDLLNGFDQNADNDMDNEIQAEVVSDGAEELVGNWSKGDSCYVLAKRLVAFFPCPRDLWNFELERDDLGYLVEEISKLQSIQEVTWRMYGNTWMPRQKFAAGAGPPWRTSAVAVQKGNVGSEPQQRVPTGALPSGAVRRGPLSSRPQNRRSTNSLHCAPGKARSSMTAHESRQVMWLYPAKPRPREPTFCISMTWIYPMSLLLNLAFPKDLEHGNNAAKFFAMASSAWATLSIFLLAFWSQPFNQSLRTSNFSSSSCLLLSPPNSSNLCPLPSFKAPFKYSDIFNNPPTPRYRFLV

SEQ ID NO: 932953 - protein, 268 aa, Homo sapiens
MVLSALMVVSMLMVVSTLMVVSTPMVVKHADSGKLMVRSDGGKRSDGGKRSDGKRADGGRCSDGGKRSDGGKCDGGGCCDGSKCSDGGKRTDGMCNDVGRRSGGDGALMVVGPLMVVGALMMCDGGCSDGGGCSDGGKCDGGGCSDGGRRSVGSKYSDDSKHAVAGKHCDGDVVASQDLINTMTLEETPGETEASYADKWRKSVLEREVRTCTDPEALRAQQVRGTHESQRSSQVESLEKAMYPSQVITHCMLHVQIQRTGLSEHLLQ

SEQ ID NO: 932954 - protein, 208 aa, Homo sapiens
MVRPILCRCSRKNWFFAKLTIRNTGMDGKHSADGRFFKSVQLCEQSTRKQSHAPGVTHGWHSQAALGGPMLMAEASYHRVFIEGRVGIALRVSVGCVHGGATCYQEVRGPGCGEPGARKPMVPQEPGRDEDLNPGIWMDTGIQSSSSRLDEGMEAEATGCNFKCIMMVMVMMMVVIVTVMVMMMVMFDSYNDNGDNSIIMMVMMTRLW

SEQ ID NO: 932955 - protein, 195 aa, Homo sapiens
MLNNLLFYERISELNSLNPGILNQLLLSSIFLLLSLTLFSNMIRDQSIDETKGYTCQQFCHDSTPNKGDRVIYNLTRPPYCCVPFPLAGTGPQILYLSRLASSLELLKRGKGRGEQRKEEVTCGMVRKHLSEDQEKMDRYIQSYESKELPTKNAILRETVLHKWRDTDFPASTRAEKFHHHQIYPARNAKGSPSN

SEQ ID NO: 932956 - protein, 224 aa, Homo sapiens
MGPGSQSKLADSFPQEPLMILVASDGAVNCTSRARRSSDGAVKCSSRAPGRSGRLSIATLEHTADLMGLSIAVLEHTAHLTGLSIATLEHIADLMGLSIAALEHRADLMGLSIAALEHTADLMGLSIAALEHTTDLTGLSIATLEHIADLMGLSIAALEHTADLMGLSIAALEHIAENSGQEPLRLRLHPATCTVKPSCKASGKLNFKCHIDVPNKMSHTHRVY

SEQ ID NO: 932957 - protein, 160 aa, Homo sapiens
MCTAYVRVHSWRVCSIQVPALIHRPLNIDSPLSGCPTVYSLTSYRAPWSLPNFSNYGQSTYKHSVSTSATYNQAMQEAANVANVISEAGVSSPSVNASEVRSLLPHVCPHMCDTRLSSDLHKHSTVLHYYFHVGITPDLQTVNLSRLRGQLVQPSSHPGA

SEQ ID NO: 932958 - protein, 137 aa, Homo sapiens
MADRCNPVEECMSKNDLRRLVNYYKLGGNEATTVQRSMLMKLVCSKNTKKLKKDLAKQRKHSDTYHLDSISRFNTAFVYNMPFGLHNNPESYSLHFHTCTNKGVKKLLQTCTERVTVLRNGVVTIPPLYFHPNSQVF

SEQ ID NO: 932959 - protein, 140 aa, Homo sapiens
MIQSLMLPLACVLGKMAHATHPRGAGEYARNDTYGYKDRVSKFDSVHLRALLTSDIAPFCELDCVSFYILEATVFPSLIHAVACAPHLADEPVDKVLQLCFPVFLTFLLTIVELQSTSWSLVSSGLHAIMGNAAFRHRVP

SEQ ID NO: 932960 - protein, 160 aa, Homo sapiens
MHLQSNSIQNAPAIPQHPECTRSPTASGIHPQSHSIWNAPAIPHPEHPECTRNPTASGMHPQSHSIRNAPAIPQHPECTRNPTASGMHPQSHSVRNARAIPHRQPMERNDNDYAVVSSDIDEIHLLINTGSHTFNDQSRPASSNKQQIFKDQPGHRQPRI

SEQ ID NO: 932961 - protein, 234 aa, Homo sapiens
MALLYPQFLCTTISKDECLLGCYNFMYQMNVTVGLVELLLYQWVWSAAMGQIQLVPSDSCLVFVHTVGLGGAATGSFPQGVCLLLRYQQSSADAEPNKVDIIAFPLYRLEDGGLQDQIVGNRSAICLEDPFQRDNINVPGKDGARTYNWQAAFKKHYIALHHKQEESEKLPQPRGAYEAHFLLTLAFQLKTPTEEEGSLANSHVELWLWDGRGWWKDKGGMPTEYCDSNRRPTN

SEQ ID NO: 932962 - protein, 142 aa, Homo sapiens
MRAFCARQALMVHHGPTLALNFYHFEKKSCTAFSHSGREILHPHSQSLRKRNPASPFTLTPEKKSCTSIQSLRKRNPAPPFSHSGREILHPHSVTPEEKSCTVIHSHSGKEILHPYSQSLREFLLPRSQATTHLLSASKDFL

SEQ ID NO: 932963 - protein, 145 aa, Homo sapiens
MNPHRCGQAIFHKEATKAKIDKSDYIKLKSFCTAKEMINRVKRQPTERENIFVNHMSDQEVITKTCTEPERLNIKKTRKCNLNHNEVSSHICQNNYYQKGNSSSIKLLFDALNYSIKLLRVQNVNENLVLGPPNDVFYFIIIIFT

SEQ ID NO: 932964 - protein, 135 aa, Homo sapiens
MTGDVLDPIVIWDEPLLNHHVFKFIHVELGEAPLLRDMDLLVARELELGPAGKSSVLTDKEGTMDEQAKPTAVRCSVTYVSQNESTENSSLRSHEDIRLENGNISDIKRDLAKILRDSVFSEKKKKHVIINLIAP

SEQ ID NO: 932965 - protein, 152 aa, Homo sapiens
MSAVTSCTSLESKSSTEIKLSSPGNRAPGGRGSCERSFSQLKCSCLPALKRAADLPAQHLSSAKGQTASSGGSRTPVPPDRETSPSRGQQTPHTGELQLASDRCPSGTKLPEEGAGNNLCCSAASTGDTQANRVWSGPPANSSRPAAEGPDC

SEQ ID NO: 932966 - protein, 237 aa, Homo sapiens
MPWCSFTGYFINNANIFLMALEVGKSMIKVKTNSVPKAALRFQDGALNAVDSHGRRETKGNADSDMDDEVQAKEVSDGDEELIGKWSKGHSCYVLAKNLAALCSCSRDLRNFELESDDLGYLAEENSKPQSIHSDLAASNHLCFPQNGRSTGSLHCVPGKPMGTQFQPLRAAMTTGAKLSKALEIHPLHQCTLNVGHGVKGDYFGNPVLHLLVAPLKPLQPHQGFFYNTVFTHAEML

SEQ ID NO: 932967 - protein, 134 aa, Homo sapiens
MKEHYSPSEGDEPCSLNFQCGKSHESECQNCHRDSWLIPQPSINLSLELAAQMVLLWLGLPVLCEEEWSCVIYALKRFCFDAFPGFVSRFRAPFSNSYSGGLVLANSLSICLSEKDGMFPLYMMLSFAGYKILE

SEQ ID NO: 932968 - protein, 147 aa, Homo sapiens
MCGFFSDIHCEDLVELLVVKLTKILVHTEPPYFINYSLDFPTLVLVPVEVSTAQPLTVITLLIDLCKQGKYFKTIVYRDFQNTILTVKTEVYLSSCNNLYRQIMLTLALVREGRMRPPMHLFSQLDLGAPSVLISAFTGEALLRLDK

SEQ ID NO: 932969 - protein, 136 aa, Homo sapiens
MKLKPSTVFQAAGLPRAEEDRPQPFQSHSVEEGMICSCTSLQNHTSHPSQCSESDPRLQVCWSLLKVHSRPCLSGYQQRRRGTANIAEQQMLLPDCSSGSFVSEGYPALWGVSLPLLAVPPSAVCHSFPWLGKGIP

SEQ ID NO: 932970 - protein, 201 aa, Homo sapiens [sequence omitted]

SEQ ID NO: 932971 - protein, 164 aa, Homo sapiens
MGAWRDHDDSAFTEPRYHVRREDLGKLHRAAWWGEVPRADLIVMLRGPGINKRDKKKRTALHLACANGNSEVVSLLLDRQCQLHVFDSKKRTALIKEDECALMLLQHGTDPNLPDMYGNTALHYAVYNEDKLMAKTLLLYGADIESKNKKLNERFVECTQNCMG

SEQ ID NO: 932972 - protein, 206 aa, Homo sapiens
MQKHGSNNVGLSENLTDGAAAGNGDGGLVPQRKSRKHENQQFPNTEIEEYHSEEQNDTRKQLSKEQNARILQDEILTTKQKQIEISLSHKEEKELLHENSMMQEEIAMLRIELDTIKHQNQLREKKYLEYIKSVKEKNDNLLKAIQLNEEALTKAVVQYSGQLSILTTENKMLSFELQNVRHNNETLEMEIQSCHFRLATALHDCD

SEQ ID NO: 932973 - protein, 135 aa, Homo sapiens
MTAFLLKRKNRTKLLRPECEMGIGCKQNHDTDLGMFTKWHLTPNQKGSWVRMSYPGSIYNPGRGQHEGGETNGEILHGLNQRKNKDGHSLPRTKRSSAFLTGSNEHIGLNGLLPKNLLFTMEEEETNGVEKLDED

SEQ ID NO: 932974 - protein, 182 aa, Homo sapiens
MNKKTEVQREEGTLPRSRFYALWHVVLATDYVMIPQAVTPVAVFKVTSSTMATTVQLQGHVPIAGTYWTDLLKQLFALDPGVEGAAPTTAPAPPAPPPRPLRNLITQYAFQGGGGNIPQVVTGAQKTMEDVAIFVSQTLKDRFLDVPGRSKWVMVMDGEGEVLSFYCFNYRGIATEFRETRN

SEQ ID NO: 932975 - protein, 251 aa, Homo sapiens
MGNTCYVNASLQCLTYTPPLANYMLSREHSQTCHRHKCCMLCTMQAHITWPLHSPGHVIQPSQVLAAGFHRGEQEDAHEFLMFTVDAMKKAFLPGHKHLDNHSKDTTLIHQIFGGYWRSHINCFHCHGISDTFDPYLDIALDIQAAQSKAPTSRTLTLHTSAKVLILVLKRFSDVTGNKLAKNVQYPECLDMQPYMSQQNTGPLVYVLYAVLVHAGWSCHNGHYLSYVKLKKAIGIKWMMPRSLPPVSLLS

SEQ ID NO: 932976 - protein, 273 aa, Homo sapiens
MAALSLEAKLRDSSDSELLRDILQKTVRHPVCVKHPPSVKYAWCFLSELIKKSSGGSVTLSKSTAIISHGTTGLVTWDAALYLAEWAIENPAAFINRTVLELGSGAGLTGLAICKMCRPRAYIFSDPHSRILEQLRGNVLLNGLSLEADITGNLDSPRVTVAQLDWDVAMVHQLSAFQPDVVIAAEAIVSLVGVLQRLAACREHKRAPEVYVAFTVRNPETCQLFTTELGLDTAVDCRTLEHRLYRRIHHATVLSTQLMEDEQGDYREGKLAP

SEQ ID NO: 932977 - protein, 141 aa, Homo sapiens
MFPVRHVCQQRTLTTPSCVFSSRRRLETTVNWTALGNTDEQSQHRFVLQCLAPFSARLATPGLVDLGVSLDTSSSGLDLPMKLVDMFSCSGLGFVRNRVCPGMWQLQRAWLCEEPSVSRDVAAAAGLAFVRFSIAISKCSP

SEQ ID NO: 932978 - protein, 226 aa, Homo sapiens
MLKFYNGLSEVEAVGLPAGTDPLDPTDMNGVHFDPEVYLDKLPRECPLAQLMDSETDMVQQIRALDSNMQTLTSQCQVYKCVQNWWVLGLTDFKNEAVDPPGGARGLAGSGVKLQIFTWVHGLAGFRREAADLLGRQLRPGEKSSTAAAGPGAKPLTAPAGKASRQLLVQGHQAHAHPELQPAGKQHTRGLKGSSSAAKVGAQAEEVPRVNEGCEGCQHAVTSHKE

SEQ ID NO: 932979 - protein, 151 aa, Homo sapiens
MGAHLLHRSDLDVRHGVKGDYFGALRFDCPATCQTCMGPVFKFTNSLFFLIHFAETDHIRNMDVKGVAFQESMMFRQYHYIEGIPQLGTEQGRGRTGVKPEDLGPVEKLLTEEAWLRLNGLHLGSWMKEELQRVEEWQAMTSNRSCGEFLW

SEQ ID NO: 932980 - protein, 161 aa, Homo sapiens
MFYLLKRANCASSIIGRLTKGSDSPIVISCPSYSLMPTSSYKMSTSLEFLMGLTSSQDSGLCYPWSTDSNVNLFQKHPRRHTQKYILSALQASFSPVKLTQTFNHPRGIWDIGPITSSLELMAVEDCCGTTRDLGLFKRKHSLSTVSVLSLECANVVQMTT

SEQ ID NO: 932981 - protein, 156 aa, Homo sapiens
MHEKSTTVIQSLPTRLHLRDWGLRFNMRFGTEDPDRISGIEARSNWYVSAYFTKGVSKHKKYKRKQKPKVEITDQLTCLDKNSCTCLARLCRFCTNNSAIIMGSFLALECRATPPPSGSFAKLYTVCQIISAHPECTHLYTCILACYLYCNYDLSV

SEQ ID NO: 932982 - protein, 139 aa, Homo sapiens
MGVAAAEPGTGENHLVCWLLRPLEKHSNWAGLSRFSRKPIDGCASRRNITEFFSQPGMTLGKECIPGDQPTLTENRTYVEILGAGFLYTRGVMNIYERRNRTCTEAVLAQRKHVGNEGLSGRYKIYTLFSNIKMKTAVN

SEQ ID NO: 932983 - protein, 142 aa, Homo sapiens
MQRRRRERARAEASHYPASNYTYKAIVAKTAWYWYNNGHIDQWNRIENPEIKPNTHSQLIFNKAYKNIKWGKDTLFNKCHWDNWQATCRRMKLDPHFLPYTKINSKWPIFKSCSLFTILLKQLLLYYAYYSLNSTTIYRYIV

SEQ ID NO: 932984 - protein, 145 aa, Homo sapiens
MREKDFQEPISTVDRAPYRLEQIQDQTQWHTRTIPALSEAEVGDHLIETSLGNMKTSIGSFATRKRGTGIIYHCPNPHNTLCSNLVLRVTSLHETGTQVTGYASEQHGCPAGLLLLESKEKESTVLNDKNGESKEDAIRKYEVNV

SEQ ID NO: 932985 - protein, 145 aa, Homo sapiens
MKAAEKAAEEKLEASRGWFTRFKERSHNHAIKMQGDAASADPTKITDEDGSTKQQIFDVDETALCWKKMLSRTSYREVNACLQNFKIQKCNSRHMTIKAVWPPRRENSPLFTSNVVIKDNEQEGPSRGKCRDLWTMWKRVFLSHY

SEQ ID NO: 932986 - protein, 181 aa, Homo sapiens
MWICEIIKSLSFINYSVLAAGSWGRGDTTLLWPPSLGPYWVRPEARTALGLIQGPWQTLPHYCQCSLKAQWLFYQHMVNLARLVSFLEGKKLPLAQCLSRDAVWEPGPKVRNLEILLVLYSTVTELAPMLQDKVLPTLLFPFLRQKKSLPMATATTGLHKLVANTSMPVLSSIPGWAQKSP

SEQ ID NO: 932987 - protein, 136 aa, Homo sapiens
MVSSGFRVLAEMSAVSLMSFPLASKANLLMQTCTGKVMWGVAMGSGEATVWGGNMWVWCAAIGATLLLLVQKLPYGLLSHHFSKHLSLPPQMSIVVKGFPPAGGPESCGESGLLLVSSTHPYSLSCCGSKMSPNAQ

SEQ ID NO: 932988 - protein, 143 aa, Homo sapiens
MCSFSFAVCRRLVLTCSVRSSTLSQGQRAFLEVAQRKSEVGRVGGLSSGAGPLGGLGFPRTAPAKLCIVLLLLVGGLLAPAGAWPRVFMKDIHKDHASDGASRSAACKLKHRKENLSGWESECEMDWKPNYKLISTLGLQALK

SEQ ID NO: 932989 - protein, 135 aa, Homo sapiens
MTSFFLDAGQELRTHQAGVPSRAGDMPGLAAGPAWSLLLCQHSKQPTGPCTCLLTCSLPPGAEHVGQVDEAPPAANLPLLKSMPSYCFESHTIRLCHPLPLVAEVINLGQVYCKPPPHLHILLFIRLICENHKSG

SEQ ID NO: 932990 - protein, 252 aa, Homo sapiens
MVALCQELFVLNLPPVMESLLPARWQVTQFPSLVLHFHLPNFISWSLQEADPETVEPADCLLGNAPWSTPVEGQGEMPNWAVGEVKLQPPQATAEGVLELKSLVATVCLHDPESEGLLKCEAPGTSLTHPGPDASEHTLSTLIIASEIVPLHVGTNLWSHQQCHPSLAFIIAFPGQFSVSYNVSYCLSHPVTACYSRVGSTKWLLPGSAPSVSAFPLHLCSSTALPGDPQAWQRKNRADRDRERERNRNVLG

SEQ ID NO: 932991 - protein, 169 aa, Homo sapiens
MESSYILELISTHKHLSLEAEASLFEPQMMLQPKGTPLFQPWRRPRFLTHGNCESGPSAAGLLEFAGGPLQTLFAWVSPVEAVEQQILHNSKYCCLIFPLEASSQRGTHLYEVSVSPYWEPQQWQMPLTLPGFCLAGQSQTAALAVSKAPWVWDLPSQAQDIISWGAIC

SEQ ID NO: 932992 - protein, 167 aa, Homo sapiens [sequence omitted]

SEQ ID NO: 932993 - protein, 171 aa, Homo sapiens
MQPWINSSTPLNFDLVTSKVIQIASLAARGQQSEALSQKRKEEEEEEEEEEEEEEEEEEEEEEEEEEEEEEEEKLHRCYPPEVNMTIYIHEESILLSLLEEHRTQGCQPCSSLVVSDLDVIVCESSTLHKVVTDLKLREMRHKTKSILIDFPFESTSHVPPQSLPSETGNA

SEQ ID NO: 932994 - protein, 155 aa, Homo sapiens
MDEAGNHHSQQTITRSENQTLHVLTHKWELNNENMWTQGGEHHILGPVGGRGSTGGITLGEISNVDDGWMGSAKHQGSCIPAIYEQSRGISNNKESVSKMMKTTDSNTYINNYQTLPLSLISSATLYNNCNFSIISIPCIPCGNHHCGLSIPLSV

SEQ ID NO: 932995 - protein, 142 aa, Homo sapiens
MCLLSACFNSSGDPKLSVPQLQCKFTVFVASTWVIHHHFYGTCGCDLHFGVCLGGISHWNSAEWLEFAAVTNSVAADAASQHPASAALLMFCFFLLASPFRPCELGPMGWEPSGLPDESDRSLNFKAPEKMDMDEIGKHHSQ

SEQ ID NO: 932996 - protein, 146 aa, Homo sapiens
MLRCSQDVYQRCFSPQMTNQKKTPVQQGEYEFSFGPTGFEVRIQCPYKASQSQINKEQSECDLSIPILHVDHLKKTDCVHEEGRIMLRKEGEDIIDYTDEYDLWGPHQKLGQEVSYFNMLLDTVISKELDVSLAKVLHSFCQDLSL

SEQ ID NO: 932997 - protein, 149 aa, Homo sapiens
MNQLIPPSLATVLENKSELTPFFSRMICSRTKFNSLCMKTHNCFYHPAYIFLTSKDWYQFFFVQLVEIDYEFTGPRLLGVDSEFYVCHFRDFRLVKKSLLGASRLIWRSVVLNLFGARTGFMEDNFSTDQGVRKGWFWDETVPSQIIRH

SEQ ID NO: 932998 - protein, 144 aa, Homo sapiens
MCTLVTYVYIYHAGVLHPLTRHLALDVLGYGTPLDRGQAWKIGRTSSGLALQRDGFPAPLLAHKPMFLNPVSILRVRAPFLLKCQAQILAQYSGAVHCNPEAQEPAHSYFFLAPWDKAGALGRAVWQEGLRNRCTLVIWKKGYH

SEQ ID NO: 932999 - protein, 142 aa, Homo sapiens
MKPLCINTMFFSVIQDTTGNKNPAIQSGAVDHFVKPCHRIVKPTMPLLAHHVSIDKIIPTLLNGVFSKKTGGMITSIHVTRTLDHPEASIHVMRTFEHPVEWFMWQRAKAYQQAILMEADSFMSIENRHKPRGSEIKGIITH

SEQ ID NO: 933000 - protein, 142 aa, Homo sapiens
MCGVISEASVLMVLSCIGGHLMVATVWKHNGTVIDDEIIKKLIGQRLVKAQEESCPEIDKRSSRKAFPDLVCDIVFLQCFQSKGTVSQNNNSNNDKTEPTIGKNVEQTEFSYTVMKNANWYHRFKKLLAVSPEAENLNICIT

SEQ ID NO: 933001 - protein, 157 aa, Homo sapiens
MYIMTKEHNKSNFIFLHVVDNYSTRQRRSKHLLHKAAGKRERKEVPHFKTIRSPENSITTRRTAWGRLPPDPITSNQVLPLTLLQCAFPMSARGYCLKVSDRNQCAQNAARPQAGKVHTSVYPVEHPELPGTNEYERKMLVTEGQPPLHFSQKDLSA

SEQ ID NO: 933002 - protein, 182 aa, Homo sapiens
MGEKTYGSWRMTVDYCNFNQGVTPIAAAVPDVVSLLEQINTSPGTWYVAIDLANAFFSIPAHKAHQKQFASAGKASNIPLLSYLEAIKCVMHSSIPPSNGSVIYVIRLEQVLKAQDILEGEWGRDIFPVGRASSSALVVHFAWKKKCPDELLYTDSWAVAGGLAGWSATWKKHDWKIGDKEI

SEQ ID NO: 933003 - protein, 166 aa, Homo sapiens
MVNTEWQLDWIEGCKVLILSVSLKDKLLHLVPPKSKKEARHLAGLFGFLKQHIPHLVMLLQRIYQVIQKTASFEWGPEQEKALQQVQAAVQAALPLEPYDPAVPMVLEVSVTDRDAVWSLLQAPIGESQQRPLGFWSKALPSSADNYSHFERQLLFCYWVLVETEC

SEQ ID NO: 933004 - protein, 243 aa, Homo sapiens
MTTTTTTITTTTTTTTMTITTTTTTITNTTTNTTTTTITTTTTTTNTTTTTITITTTTTTTTTIITTTMTITTTITNTTTTNTTTTTITITTTTTTTTIITTTMTITTTITNTTTTTITTTTITTITTITTMTITTITTTTTTMTITTTNTTTITMTTTTTTTTTITTTTTTTTITTTTTTIAMTTTTTTTTTMTITTTTTMTITTTTMTTTTTTTMTTTTITSITNTTTTTTMTPPPPTPPP

SEQ ID NO: 933005 - protein, 174 aa, Homo sapiens
MPQEALDAMEAQGPRRDLQNESPRPKYRVPGGHRGETRWKVDFTTVGVGAFLDTGGNQLTEQPGVFLEEAILAQILKEDWKPQGAEINRGNTRTLPSRRQCSGWSGGEETSKNQHRNPTVATRDNQAWRRSRATKAPIDKASFLKMAVLRFTKALDQKRDKAHGTDEPRFGCPT

SEQ ID NO: 933006 - protein, 142 aa, Homo sapiens
MRTNRGESNDQIYSYHNSAVRLYFLGIFLISSSSSSPPSPPPPPPPPPPPPPPPPPPPPPPPPPPPPPPPPPPLSPPPPPPPFLVDSALSGSYTGAIESCLQERFQALERNLQTFSQLVLNLTTGPGLEMDQVPSQLSYVVT

SEQ ID NO: 933007 - protein, 173 aa, Homo sapiens
MPSTMIMRPLQPCGAVSPLNPFFCITYPVLEEDRTMWESLELPRDLLNGFAQNADSDMNNKAQTEVVSDGNEELVGKVPTGAMPTGAVRRGPLSSRPQNGRSTNSLHHVPVKVADTQHQTMKAAWRKEVARKATGSEVPKTVGTHLLISVTQIMLFSLKKKGNLKTCDNKDES

SEQ ID NO: 933008 - protein, 191 aa, Homo sapiens
MESIFFAAVCICSLARNGIEKGIGGSDSGWTYYWRKGFGDLLVLVFPIVGVLDKKIFLGVSPQAAMAELGSREQVLKAAVEPSSWALDYTTTVVPKGHSNSYSPEGWGVVVIQTTGSRVLCHGTGEEGVLWRLCTWGTRHSCNSRPGTNRSQWQLGLWGIRYHAVVTLDPGIMVHKNSTGFVGPGTTTGCK

SEQ ID NO: 933009 - protein, 207 aa, Homo sapiens
MFSGQETQRAEDCGQVARGDVNGTPTASASFGRWELGPLHAKGQHEQNEGEDGLSEELAKLCSRGREYLKLGLSAKITKYMKGSKETLRGENGQHTGLGRQLDNGDRMSGQSWFHSMLVNELSPGSLQSSGPQLTVELEVPQHPPLPPSRAPLLLLNGERMEPTLETRDLAKWVGQEVPGKRQTELQNAVRERKVMRPAQEHLADGG

SEQ ID NO: 933010 - protein, 139 aa, Homo sapiens
MNFKVVFSNSVKKVNGSAPLLQVCWSFLEVHSRPHLPGYYQQKLQNSKDCCLFFPLEASSWRGICQMPARAFLYDVSVSPYWEVSSSQGYRGIRAIRQGHLSLLKRAHGCRFPQVFCPREKGVLIYRLTGAAAFFSKMP

SEQ ID NO: 933011 - protein, 151 aa, Homo sapiens
MLSQLHRTVFANVISCKNNNYPVCCQRVLAFTKCLNTPRLRNDYLCDNGWRNGDFVRPNNLLKVTRYEAECKPSPARLFKAMQSSLYCGNLTINPTIPPLRTEWILNINLGDCDSAGSLFPWDLPFKRCSIENICNVQPTKGKYPRCVSNS

SEQ ID NO: 933012 - protein, 144 aa, Homo sapiens
MVFPPPHLPALHQFPWMQQNSHEPESQAASLASRYSVAIAYHSTTPPGLQPPTVILQDFLSGTQIILVLTNFQDKVPYGGRKCEKVAMKQSTVAPKVMYHARMQIFSHPYKLRGTRGEVGKEQRIHKVTIGLVDCWWTARDHPR

SEQ ID NO: 933013 - protein, 138 aa, Homo sapiens
MKKSSESRTGGDERILELTAKAVGLNLLNISESDSPSWYIPNSTTTTTKYPSKLGNSLWAKLSAEIRIYSSISPDELPQYLKGRRKMVLRTSDARGPPQPHGSGVSPPTSKTQRFQGNERQARICANVVVFNMVRFPG

SEQ ID NO: 933014 - protein, 138 aa, Homo sapiens
MFRLWAPGLSHPSSRSPGVSVESCMLELTRGTMQAKCGGEERSGDCHPGQDPFGCCPKEAAFPGPPPLDLQFVKLSMETGSKCDTQDVRECDSSTGDMNHIMPHISIASRARITWQWARKHRLGQKVLRRAGVLSLAK

SEQ ID NO: 933015 - protein, 161 aa, Homo sapiens
MVKLCLHQKIRKPVRRGGTHLQSQALGRLRQENQLPLASCQQHMPGSQLLSVLLEPAVWCPPFKSLSFQQLCNAPPLRNLSTGESNQKSNHLPFELLSCASKMQMLTIKTNMTTVLEQGPAGVGSVGGISLDSGRSSGCPSGSWDGHVGIQELGLVTFDVK

SEQ ID NO: 933016 - protein, 148 aa, Homo sapiens
MLGVCQSSSFLRGSSYTWLCPECSLWFLLLGTTLSLTVQLLWRPACHQVLLGEVLRVGGLPEDSSASAAMSLPSVVSLCSQERRHVAAYPAHRRANCDKCQGELDSEMQHCRKYVNVLNQYSTLFAKRGSSAKLAITPASYPVLFEVR

SEQ ID NO: 933017 - protein, 137 aa, Homo sapiens
MGRPQVGFLVKSISIGLADSQHSPPDKGVVIPCSTLCVFQLRPQALLRDAIIMKGLIPAGFLCTAKPNDADRSYKLALMGSCFIYSGADLTLPSPSESMDLEITGFSLHTVMLSPKMKEMRNRKGLGFPADSSHSLQ

SEQ ID NO: 933018 - protein, 138 aa, Homo sapiens
MECGIPGCPQIGRGENEGLKKFNDLSRAPGLVGAWSWDLYPGSPNGIVTLIISAPHCQGYADPCQPRLTFRAFESEEVCSESYLFSCCQPCEGSWQPWAVCPHLPQAPSPWQLNETFIEAVGPQHFPACKQIPIIQRR

SEQ ID NO: 933019 - protein, 135 aa, Homo sapiens
MYRTKKIRPMVNLSISSFNGVKGEKADFNEMKNDWKEKIKQGDEIWRTGGGEGDVNIREQVNSCNKNRKTRVKMDADAISWQMILGSMDLALGDRKAEEQRPTADKLTDVHKGCHRTKLAHVLVEENNASQKAME

SEQ ID NO: 933020 - protein, 286 aa, Homo sapiens
MSSFTVTSQCARHTVKNATFRATAFIGNFQVFQAERSCSVKDRKAFQSCRNDNSQGLNELCWLTLCSAIANTFTTHSYKTFKMVLSVWKSQSLSSQYCIPEENGLKGGGPAGESSEQWCTKECGVDVIEGEVPLLVGLWPVDINCCQGSNKGQVNMGWNNRERFHGSWRSKYDSTHRKAPPAFFLLLLSKCKVHASEGDKHCEDDDDDDDDDNDNYYIIFYMEPYAYISTAPTENGLMDRLIPLAPIHHQKNPLEPAMMDELGEQSSRTKAEELMGIYELDLSLRA

SEQ ID NO: 933021 - protein, 174 aa, Homo sapiens
MNSLVAQISSGMTGSQWEMLARAPGEESWVLEPGLVLPTPSVTCATSPWCLVSSSVKSESDNMISPASSYSKICVFVYEIIQGFCVRLKSCYVPIRSNPTLPIQILNFASTDDRGGSFDPPKPHPIPLQNIPPQSHPQRKVLFAEGSLRQLFPSQTQGEGWCLPQSLVMGGPRL

SEQ ID NO: 933022 - protein, 156 aa, Homo sapiens
MRKNQRKTAENPKGQSASFPPNDRNVSPSRVQNWTEDQMDELTEVGFRRWVEHVLTQCKEAKNLDKRLEELLTKITSLERNINNLMELKNTALELCEVYTSINSRIDQAEERISEFEDHLTEIRHADKNREKRMKRNEQSLQEIWDFIKRPNLQLI

SEQ ID NO: 933023 - protein, 139 aa, Homo sapiens
MSSPQLGLYGGVNRIANGKLTHRDINLQETKWNPVMSIVRGPAIFEGRRKIYGNINFGTGLLQCTGKSIWSWSHDTRVEIIIRTLLSRMTVLVCFYTADKDIPETRQFIQDKDLMDLQFHVAGEASQSWHKATGSKVIS

SEQ ID NO: 933024 - protein, 152 aa, Homo sapiens
MEPSAGRLHYTIPHLIFSLCHFNISGYAIALQWAIKRGRPFPGEKSCDLYHRQFPTFKVEVRFPKGWANSSCRVRQKESVGVVCKATEDLIPGSWICYHWYLELIRTMETMERSVKRGPGAAEISSDSGGRAPDRALIPNRLDTFLSQKRLN

SEQ ID NO: 933025 - protein, 183 aa, Homo sapiens
MEIYAYGIDRTREEGHASHVTGSVARRDADLLERRASMGCGNHVGQQEVPAAQLWEEDTGEHNDMSDCPAWLGKGNVKLWNSVDDGCESGEALRDDVEDFHIPGEELPLGSEFLGGEREKLGDPPRAGDELLGDGSKNMWYIIDERGDSEESSEEDTAEPNGFIDFPSRVRQTLRPLIRSAKI

SEQ ID NO: 933026 - protein, 165 aa, Homo sapiens
MEIYAYGIDRTRKEGHASHVTGSVARRDADLLERRASMGCGNHVGQQEVPAAQLWEEDTGEHNDMSDCPAWLGKGNVKLWNSVDDGCESGEALRDDVEDFHIPGEELPLGSEFLGGEREKLGEAGMNLEESGLGDRSYSPETCESLGDSWVHGADSRRNLGMAGE

SEQ ID NO: 933027 - protein, 136 aa, Homo sapiens
MGCGNHVGQQEVPAAQLWEEDTGEHNDMSDCPAWLGKGNVKLWNSVDDGCESGEALRDDVEDFHIPGDPPRAGGELLGDGSKNMWYIIDERGDSEESSEEDTAEPNGFIDCPSRGEREKLGEARMDLGVSVLGDRS

SEQ ID NO: 933028 - protein, 188 aa, Homo sapiens
MFWNPISALESYVRNKLSDHSRSIVESYLWDKHSDHSRNVLESYVRENHADHSRIVVESHVRHKHPDHNRSVLESYVRVNLSEHSSSVLESYRRDKHSDHSKRVLESYVRNKHSGHSSSVLEFYVRDNHSEHSWGVLESYVWDKHSDPRIIVPESYVRKNIQNTEGVFWSPMCMTNTHTLMVVFWNPM

SEQ ID NO: 933029 - protein, 763 aa, Homo sapiens
MRAKQSNPHSCVPESYVRGKHSDNRSSFLESFVRDKHSFPRSGVREPCMRDKHSDHTVLESPLWEKHSDPRGSVLESYVTDKDLDHSSSVLKSYVRDIQTLLAVFWNLIVLEFYVMEKHSESSSSVLESYMTEIHVHPSSSVLESYVRDKLSDPRSRVLESYMRDKHSDPLSSFLNHYVRDKDSDLSTIVLESYMRLKHSDPRCSLLESCVRDNHSDNSRSLLEFPVRNKHSDPPSNTGSSVLESNVRDKHSDNSRIVLESYVRDKHSDNRSSVLESHVRDKHSDLHSSVLEWYVMDKHSDNHSIVLESYVRDKHSDNHSRSIVLEYYVRDKHSDNCSSVPESYVRDKHSNNSGIVQESYVMDKHSDPRSGVLEFYVREKHSEPNISVLESYATDIPVDPSSSILESYVRDKHYDPSNSVLESYVKESHSDTQHSRRVLESYVRDKHSDTHSRVLESYVSDKHSDNLSSVLEYYVRDKHSDTRNSVLEYYVADNHSYARSSVLESCVKDKHSDHSRIVLESPVRNKRSDLHSSVLEFYVTDKHLDPSSGVLKSYTIIAVYWNPVGGTNIQTIEAVFWNPKRETNIQNTEGLFWNPISVLESYVRDKHADNCSSVLESYVIDKPSNNSGSVLESYVMDTHSEPCGSVLEFYLREKHSEPSSSFLESYVMNIHADHSSSVLESYVRDKHSDNCSSVLESSVKDKHSEPSSSVLESNVRDKHINHGGGVFWNPMLRTNIQNLVAVFWNSMSGRNSQNTVAGFWNPM

SEQ ID NO: 933030 - protein, 2259 aa, Homo sapiens
MESFVRDRHLEPSDSILEHYVNPRSSVLESYVRDEPLDPSSSALESYVRKKHSDTRSFVLESHVRDKHSDNLSHVLESYVRDKYSDPSSVLESYVRNKHSNNSGSVVESYVTDRLSEPRRSVLEFCVREKHSETNRSVLESYVMDIHVDASSSVLESYVKTNIQISKAVFWNPLSSVLEPYVTDIHVDPSSSVLESYVRDKYSDSSRSILESYVKDSHSDPHSSVLEFSVWDKHSDPHSSVLESPTLVAVFWNPMWETNIHTILAVYGNSLRGTNIQTPAAVFQNPIALEFYLREKQSEPSSSVLESYMRDIHSDHSSSVLEPYVRDKHSDRRSSVLEFCVKDKDSDHQSSVLESFVRDKHSDHSKSLLESTVRNKHSEPHSSVLESYVMDKHLDLRSNNRSSVLESYVRGKHTDTCSSVLESYYVRDKHSDPLSSVLESYVTDIHVEPSSSVLKAYVRDKHSDPRNSLRESYVRVNHSERRSSVLEFCVRDKHSDHSSSILESYVREKHSNNCRCVLESYVREKHSNNCRCVLESYDKEKHSDPPRSVLEFYVREKHSDSCSSVLEPYVTDLLVDSSSSVLEPYVRDNHSDPRGSVLEFCVRDKHSDPSASVLESHTLVAVFWNPMWGQTFNHSSVQESYVRDKHLDCRSSVLESYCSGIPCEGQKLGTQRQCSGIPCEGQKLGTQRQCSGILCEGQTFRLQQQCSGIPYPDSSVLESYVRDKHSDHSRTVLEFPLRNKLLDPHSCVLQSCVWDKISKPRSSVLESYVRYKHSDNRSSVLESHVRDKHADPRKSVLESYVRDKHSDNRSSVLESNVSDKVSDPSSSVLESYLRDNHSDTFSSVPESCVRDKHFDHCRTLLESLVGNKHSDPRSSSIIESHVRDNISERHSSVLEYYMSEKYSNILGSVLESYVTDKHSDPRRSVLEFYVREKHSEPSSSVLESYVKDIHVDHSSSALESFVTDKHSDPSSSVLESCVRDKHSDPSCSVLVSYVMDSHKDPRSSVLEFFVRDKHSDIHSSDVESHVSDKHSDHSRSVLESPVRNKHSDSRSSVLESYLKDKHLGPSSRVLESYVRDKYSDPDNRSSVLESYVRGKHSNNSGSALESYVMDKHSDPRSSVLESYERDKHSDPPDPHSSVLESYMSDKHTETSSSVLEPYVRDKHSDHARIVLETYVRDQHSEPSRKVLKSCVRDKRLDSRSSVLESYVRDKYTDHSRSVLESYVRDKHSDPHSSDLEFYVRDKHSDIGSIVLESNVRDKHSDPHSSVPESCVRNEHSDHSISVLESPVRNKHTDPRSSVLESYVTAKYLYPRSSVLESSVRKTIQNLVAVLWNPIVLEFCVRDKHSERRSSVLESYVKDNHSDHRKSALESPVRNKHSDTSKSVLESYVTDKHSDPSSSVLEFYVREKRSDNHSRILESYVRDKHSDLSCCVLESYVRDKHSYNSGSVLESYVTGKYSDPRPSVLEFYVREKHSEPTSIVLESYVTDRHADPSSIVLESYVTVRHVDPSSIVLDSYVRDDHSDPRCSVLEFCVTPINLHPSSSVVESYMMDKHPEPSSSVLESYVRYKHSDPSSSVLESYERDNHSDPCSSIVEFCVRDKHPETHSSVLECSVSSVLESYGTNKHLDGSSSVLESYVRYKHSEHCRSVLESPVRKKLLDPHKSGLDSDVMDKHLDPSSSVLESYVRDKHSEPRSSVLESYVRDKPSELSNCILESYGETNIETTARFRVLESYVRGKHSYTHSSVLQSYVRDKYSDHPSSVLESYVRDKYSDHPSSVLEYYVRDKNADSRSSVLESYVRDKNADNHNRRVFWNPMGGINIQKTARASDILRFGQTCIPSSQCSGIYVRERHTEPSSSVLDSYVTDIHVDPSSSVLESYVREKHSGTSSRVLESYMKDNHSDPRNSVLEFCVRDKHSDHSRTILESPVRKKHSDPRSTVLESCVMDKHLDPSSGVLESYVWDRHSEPRSVFWNLVDKHSDNHRSVLESDVRDKHSDSCISVLKSYVKDKHSNNRSSVLESYVRDKYSDPDPHSCVLESNVTDKDLDPSSSVLESYVMDRHSDNRSSVLESYVRDKHSEPSSSVLESYVRNKHSNKQQRDFPEFYVTEKDSELRSSVLVFYAMDIHADLSSSVLDSYVRDKHSDPSSSLLKSYMRDNHSVPRCIVLEFCVREKLSDNHGSVPESYVRVKLSEHRSSDLESPVRNKHSEPCSSNLESDVTDKPLDPSSIDLESYLRDNHSDPLSSILSSYVREKHSDQSGGVL

SEQ ID NO: 933031 - protein, 140 aa, Homo sapiens [sequence omitted]

SEQ ID NO: 933032 - protein, 192 aa, Homo sapiens
MVPFINDRFETGVHINSVTARKEGHASHVTGSVARRDADLLERRASMGCGNHVGQQEVPAAQLWEEDTGEHTDMSDCPAWVGKGNVKLWNSVDDGCERGETLRDDVEDFHIPGEELPLGSEFLGGEREKLGEPPRAGGELLGDGSKNMWYIIDERGDSEESSEEDTAEPNGFIDCPSRVRQTLRPLIRSAKI

SEQ ID NO: 933033 - protein, 183 aa, Homo sapiens
MEIYAYGIDRTRKEGHASHVTGSVARRDADLLERRASMGCGNHVGQQEVPAAQLWEEDTGEHNDMSDCPAWLGKGNVKLWNSVDDGCESGEALRDDVEDFHIPGEELPLGSEFLGGEREKLGEPPRAGGELLGDGSKNMWYIIDERGDSEESSEEDTAEPNGFIDCPSRVRQTLRPLIRSAKI

SEQ ID NO: 933034 - protein, 137 aa, Homo sapiens
MLKFVRLLSILLNLTVLVHESSVKAHTPCLGDADGESATEKIFGEAHGPVSFWGGVTNHIIREILGSASLQASEWWSPCHIIILSKAFLSKMPFSISMLDPNLKLGEEIIAMKLVFIHFSLQICILIWYLFEEYQIY

SEQ ID NO: 933035 - protein, 219 aa, Homo sapiens
MNIKQHVLLLPNSKFPVATHSKREENDADLEPALIFSSKVELEAHVSGAVDCFPQIVKDQRVLGLWTGLTVHLLEFKMGCKAAETTHNINNAFGPGTANECTLQWWSKKFCKEDKSLEDEELSGWPWEVYNDQLRAITKADPLTTTGEVAEKLHIHHSPVIQHLKKIRKVKKLSSRSRASGIAGLTLKRYIQLSNPGTLTMEGMASTTENGPFHLGYNC

SEQ ID NO: 933036 - protein, 134 aa, Homo sapiens
MTNTCTSEPLPPCSQANRYHMTGINLRVKLQTFLVSVTAHKGSADPKSEQQQDLLQSAKEQSFHSVEGDPSGLPCLLGWPAFIPLFGPAHTLLIDPFYSTLIHIKAKIESDKDKQAKKILFKAIAVEERDRNTV

SEQ ID NO: 933037 - protein, 139 aa, Homo sapiens
MGELVSMPNCSSNVSGKFYFCVLPWLLHKYLCLANYCQHSNKGVYTLAPMPLLAQVPKLQSLHIGPCFRPLLCGRSMGTYNLREFAVKGVSLPIGSGLWSCSQWWLYQCLVSDAHEVATEQRPETWAQVEGLKIGDLVQ

SEQ ID NO: 933038 - protein, 141 aa, Homo sapiens
MCMCSHAVGLLGSRLMLGNVCKESSDVIHLQVSQPWIPAPTLVEVAGEGSGLCVGPWLCFVDCTGFVLVGLPPGGGTFKRHLKKVCLGFNNHFKMTVAQSIIWKIYNLGSNGHTGALESRDDGYYGYFTHLEKKDQQTTCF

SEQ ID NO: 933039 - protein, 139 aa, Homo sapiens
MIHFLKPAQVVIGTKTVPVIPGFRLAPADPDSMPAPETGPLQAPSWFQLYQAPVDSGSRPALAKPGFRLIQVDPSARPASAEGGSRNTPPDLGFRTALVDPGPRFSPMDLDLRPILEDIGSRSILLPGWLLKTRVQGLF

SEQ ID NO: 933040 - protein, 155 aa, Homo sapiens
MNFGTFVDGFIQKASSGRFHGGGVWLSSTLRLFTLTLGGWCQAHGFVLWTLKIKHLLHWRGKVFFLSIQGILEMETGHSAGTKLASALIDIWCVSSQNKINNVEYQKLNTYSKVKYIKKKDNTQISSLPNCFTKFTISYGLEFMFTYYICMVKIL

SEQ ID NO: 933041 - protein, 196 aa, Homo sapiens
MARCGGERKPGWTHVAYCEISQYGLRWGEDQKADTKDSAGPPMASYAPALPCLNPGPFLCPAAILAGDRERPPTQSRVFVKGTRTSWDRARDRGQQPWGRGASCRLKRVLRDQPSQQCRPLCKEQLMHSAQSDDFPPVLTWPRFSSLGDKGGMRDVENPRYQPFRFQPCPGNIKGIEHSTLSCLGGTTRRLDKRGP

SEQ ID NO: 933042 - protein, 177 aa, Homo sapiens
MPHPALAHARCTASTCPISNRQGSDLPQVGPCHPLKVRWNELPTRNFNMWTLGKMKEQTVALSNRKARKGKREKYCLWRGGEGKELREAREGPTHCSNSELKFRGLLISREGIFFRSTISSRFPISGEKQFPMSHDPLHAESCHPQPSAECKADLISLISLLSCLFFCKVFKILKYF

SEQ ID NO: 933043 - protein, 166 aa, Homo sapiens
MPAPTTAHAKDETAQLYGGDNSWTQEMVMNCCVNLSHGSRPLVFSYLTPRAAAVNAEKGAESNWEDGRNVSNSVACVGRNGEFREYRDQRACWATFPTTASIRVNVIPSLSLYGGRTSCRGPSSDTLSRATQHLNQRVGVSSPVTKSTLLSCIPTFTITHLYFYDS

SEQ ID NO: 933044 - protein, 155 aa, Homo sapiens
MASLSSRPNSVHLPGPQSLYNLSLAHITKIVFTQSRCIKCYVPGTLLSELQVLAHLIFMSALRAGHRYLRHIFTDKDTEAIRMQKPFTEISSLELEAEKVWKHSTLPEMPEDCTAHCIMSWFSTRIPRTRNSQFCLHRQIVIPPVMTEWTLVSPC

SEQ ID NO: 933045 - protein, 238 aa, Homo sapiens
MQGRTFVLWGSAPSSDCLSIVDMDEGVAHFSLDKLFLSVLVNHTNNKPYRVIGLLHYLSSLNNQDHKEDREKPDLVALTNTFKNLKNWKSTRDREWFLETGLALEKRGVKLQTFTVSVTVYKGGASGVVHSSWCVHGLTDFRSEAADLHTVIAYKGGVGPKSEQQQDLFQRVKEQSFHRVKGDPSRLPVLAQLACFYSLIWPTHILLIGPFYRELIGPFYRKLIGPFYRALIGVFTNL

SEQ ID NO: 933046 - protein, 795 aa, Homo sapiens
MEWNGMERNGMEWNGMEWNGTERKGREWNGIEWNGMESTRVQGNGIEWNAMEWNLPEWNGMEWNGMEWNQPECNGMEWNGMEWNGTTRMEWNVMEMQSNGIEWNGMQWNGFNLNGMERMESTRVEWQGLEWNGMESTRVQGNGMEWNAMEWNHPMEWNGMERNGMEWNGMEWNGTERKGREWNGIEWNGMESTRVQGNGIEWNAMEWNLPEWNGMEWNGMEWNQPECNGMEWNGMEWNGTTRMEWNNQFERNGMEWNGMELNGMEWNAMEWNQPECNGMERNGMEWNGNYPNGMECNGVAIEWNRMEWNAMEWIQIEWYGKNGINTSGRAWIGMQWNGINPSTGEWNGMECNGMESSVMEWTGMEWNGMEWNGMEWNGMESTRLQSNGMEWNAMEWNLPEWNGMEWNGMNAMDSTRLQWNGIEWNGMEWNGMELTRIESNGMEWNGMERNGMEWNGMEWNGMKWNGMVRNRMEWNEFAGECNGTECNGMESSGIEWNGMEWNGINPSAMEWSRMEWNGMEKPEWNGIGKEWNGMERNGMKSTRVEWNGMEWIGMDFNGMKWNGMEWNQSFRVEWKGMYWSGKKGMESTRVECKTMEWNGKEWNGINSIAMEWNGMEWNGMEWNGINRNRMEWNGMERNGMEWKGMESTRNGMQRNRMEWNGMEWNQPEYRGMEWNGKQWNGVIRNGMERNGMEWNGMEWIQLDDNRMEWNGINPNRMEWNGMERNGMEWNGMEWNGTERNGMEWNGMESTRVQGNGMEWNVMEWNLPEWNGMEWNGMKGNGFNSIAMEWNRMEWN

SEQ ID NO: 933047 - protein, 167 aa, Homo sapiens
MERNGTEWNGMEWNGMEWNGIEWNQLDCRGLEWNAMHWNQPEYTGMEWNGMQWNIIIRNGMERNGMEWNGMEWNGMEWNQLDCNRMEWNGINANRMEWNGMERNGMDWNGMEWNGTESNGMEWNGINASAGEWNGMECNGMESSGIEWNGMEWNEMQWIQLDCNGME

SEQ ID NO: 933048 - protein, 169 aa, Homo sapiens
MSLPRWALRHPLGVETSSLDDRGYHHCQMNPMQERVSESELPNWLLTFFPYWVQLIYEQSESTGGLFPSLLQQSWLGTPAVWPPDFLPGPWETYIEPHPHINSSHHQRLSTRVVGCRVLWAGHSEAQVCSMVPGVPWTCLWSPHLLSGWLRLKASVTMCGFCLHFLPQS

SEQ ID NO: 933049 - protein, 227 aa, Homo sapiens
MLMTEVTFLPVPSSTHARHLLRLYSWRRCVGGQSTQILPSHSVESRSPKSPSWPPPSVPPLGYSRYFYASSNERGNSLQQSRRAPALSRSCPSICLVVAHAPRAVKYCDHHPCFSVIRKRSHVHVQENGANSQHQRCESRDWDVAASKDCCQPPKVGRRQEEFSSKASERVWPCQDLEFSSVKLISDFWPSEHPDHSLYSEDSQVLPPQLFQENGTTVNHKNKEDKP

SEQ ID NO: 933050 - protein, 176 aa, Homo sapiens
MRIHWKFAPRKSGLCSKPLGYTLDTLYLPKRKRVAQFICCMSEQGLHPLKLDVIGAGGSAGKVNHLDESLKCQAIGASTWWEASVPLHVDSFLLLCKRLHDIVGRLPSKQEERNTESQREALYMCSELHFYDLALEVSYYHSADQYQVSKLELYSRGGTSAPPFEVGSIKNFQIYF

SEQ ID NO: 933051 - protein, 146 aa, Homo sapiens
MATTPILVMTFLGNSSEFLTLIQSALLPFPLVSSESPASHKEIYHSVICENSSHFASCLCGEVDGVLLMLRYCCGILRTRERPWGVNRRIHLLLNALRPSRLNVQRLGPEQRQHLTFIHTSQKRWASLKQAYGYGHVKARIQRQNN

SEQ ID NO: 933052 - protein, 163 aa, Homo sapiens
MQKGSGETNSPSPSLPFCQSLVIPPCGCAHLKAKGKRLRYVALKGQLPGTENRSDFQNSATASAHLGSCRCCHSPEAGKSGSRHGKWYIQEYNVPAVIHGLGEGHGSYCLQKSAAPARSTFAEHRPPTMKSATGHWDLCHCYCRKTQGPREPAGQQQHWTDPS

SEQ ID NO: 933053 - protein, 159 aa, Homo sapiens
MYGIISEGSSGPSAAGLLEFTGGPLQTLFSWVSAAVAAEQQILVNHKCCCLIVPLEVLSQRSTRPCEVSQAACWENHYSLQSCQIGTFKSAEVIAVFCFSVPCPQRWSLQRQADLLKLWWAPPSLSFQATLFTYSSLGNGGHRSPSLTATLQFDLRLLC

SEQ ID NO: 933054 - protein, 153 aa, Homo sapiens
MVIRLMDLDPFSWGYVFIERGMQSILLKLLLDLFLPSGINTISPPRLQNSTGPQSKKIILAYEDVHSHIPGPRTLGIRQCSSASYWDKKKVRLYGKNHITTLAAGGRFPPLLCQIPQKSEKSIQGEPSFILPHVECEHTLMKASPSCLCLLLF

SEQ ID NO: 933055 - protein, 167 aa, Homo sapiens
MDFVRDSSSPATTTTISLSPDQTLKRKKEHKNKKPPSNDSNFKKIKKHQPSQIRNQCKTSSNSKSQSVSISPNDQTKSPAIYPNHIEISETTDLEFRIWIAKKLNKIQQTVETQSKEARKTIQELKDNIASFQNNQTELLELKNSLYEFQYISGSLNNSLNQAEERI

SEQ ID NO: 933056 - protein, 135 aa, Homo sapiens
MLIECVEAATKIHALILMEPYPPSVAPTDPRWSSPAGTPNISHMMRQEQVSSKGSQNGTDAECSPPIHPSHCRSCGPRRIFCMWCHASLEKGDCSQRKLILLPFTHGIFRFCGPKKCISLTPEFWDIQDGILACA

SEQ ID NO: 933057 - protein, 187 aa, Homo sapiens
MALEGLCSALKDGQNVGIKHIPAIQYDIWIQTSNEVILLHQIILSHIHQTRSVSTFWTLLHVKESSFDEHYYIEPSFEYYPMEHSNESKRDIVAVYDESSSIENLKAKFRSTVANDGMLKTGIGVIQMWADEVQVKQPQEKVMACKTAFHKTGFQEMFDPPYYELFSLRDKDISADLADLSEELNNH

SEQ ID NO: 933058 - protein, 145 aa, Homo sapiens
MVTIEIPTTHLSMGHPVFHSLVLVPVLPRLLGAGLGAHGHLTLPQADNPTCPPAVASSGDAGPHCPLVSMRPKWALHPQHSHLLRHTSEVSGASMAVGHDATSKQGSECNGKSRDFASKLSSIWVLVLLLCLGVNFESLSSSSDS

SEQ ID NO: 933059 - protein, 158 aa, Homo sapiens
MGGWKWTGVPALFLAASALLAFPKAQRTVPCLWQELRDLGSTPNTAGESASPLEGIDDKRLAVVTTEGNEEVPPRQRCVCWSCPTLCTLTSREQIQMGQGGSIYTVEIGKHCHQNQLFPHSPAHPCSQELGNEAAVRVKAEIPPPGHVIGLWWGKPGG

SEQ ID NO: 933060 - protein, 167 aa, Homo sapiens
MGVTSPLDKGPMQRYLKTGPSAAGLLEFARGPLQTLFAWVSAVVAAEQRILVTRKCCCLIVPLEVLSQRSTWPCEVSKIKKGNRNTDTFLNSMVAYTIKSYSPQRRIAVPRAQVQGCLWPSKSWPAMACHLIMLTAEGSWDRCILHPPGTPRTYPVTGFWTSSAPSF

SEQ ID NO: 933061 - protein, 208 aa, Homo sapiens
MPQYQHWENKNTHPLKVHQQHLKPSRNASFETSPRNSKVSIPESAQPSMMQQAFQVTLMQHKCLWKAASLPQGWRNKASVWEALMGPCMGLGASLKKEDPTEQSENLRRGMLHLLGDAGGNSSLILTLDQSQSSCTFSHGTVEPFHPGVILTELLVSPAGPQALLRAGTASDFKTWRKINANQCFLSSCTRVLAQKAIINVCWMCQAL

SEQ ID NO: 933062 - protein, 141 aa, Homo sapiens
MASSWRVWHLLALCLFLSSYVVSHLLGPLYIAWASHSMVVSKIGFQDIGTGSCSPGKGCLGQCLFLLLRLLVGGVTESPCLRVEKQTRLLIGVVTDTSRDSLHFDAQLNQTHQWAPLLTSCEGITRPFSGAPSHAEDMSVP

SEQ ID NO: 933063 - protein, 166 aa, Homo sapiens
MAHCSLELPVGLFGFWGQHIHHFSVLLQPINQVTRKAASFEWGPEQEKALQQVQAVEFWSNALPSSADNISAFERQLLASYWTLVETACLALGHQVTMRPELPIMNWVLSDPSSHKVVQAQQHSIIKCKWNTCDQAQACPEGTNKLHEEVAQMRMVSTPATLPSLP

SEQ ID NO: 933064 - protein, 177 aa, Homo sapiens
MVGKAKWKPLELPLPRKIVNQKQYCIPGGTEEISATIKELKDAGEVIPIPTTFPLNSPIWPVRKTDGCWRMTVDYCELNQVVTPTAATVPDVVSLLEQINTSPGTWYADIDLANAVFSIPVHKAHQKQFAFSWQGQQYTFTVLPQEYINSLGLCHNLILVMVNTEYQLDWIEVKREP

SEQ ID NO: 933065 - protein, 144 aa, Homo sapiens
MLFYKALSPCSFFQYFSVFFRLDNFYGSIFKFTDFFISHLYSPVETIQLCESDHPQVKEKKSRKLTSIPVTLTLFWVATNGHCKLESVVMDNRPPLFSRPLLGGGSEFRRDAAQYLAEKSINHLSQVERPESMGTLSFDELGAH

SEQ ID NO: 933066 - protein, 392 aa, Homo sapiens
MTAELREAMALGPCRPVKVKKEEEEEENFPDQASSQQVHSENIKVWAPGEFRQTGLDGSEEEEKVLKPRTFSYWFQKLRYSANLVVHQRIHTGEKPFECHECGKAFIQSAKLDVHQRIHTGQKPYVCSKCGKAFNQSSNLTVYQKNLSLEKTFRRSKCEKAFSYSSQLARHQKLHITEKCCKCNECRKTFTGSSNHIVHQRIHTGEKPSACNDSGKAFMQIANLIVHQRSHTGEKPYECEFGKTFSCFSHLIMYQIIHTAEKPYDCSECGQAFSQLSCLFVHQRIHSGDLPFVCNECGKAFTCSSYLLIHQRIHNGEKPYMCNECGKAFRQRLSLTVHQRTHTGEKPYEYKKCGAAFISNSHLMRHHRTHLVEQQVRKRKTSSIGHNLLPPK

SEQ ID NO: 933067 - protein, 136 aa, Homo sapiens [sequence omitted]

SEQ ID NO: 933068 - protein, 162 aa, Homo sapiens
MSFFFPGCRGTELNRTGAPGLPTKTPIVSADINSDESGWEAFLVKCTDGASWCQLPPLGGHKQKKAKPSKLVHLADSASTKTSHIQSSSLMRSRHENRIHTSEKGQRLLLRAPGNSGALQDHGEPYGDFNLERERKETPFSKIAYFVCVDKQEVNEVRRLIS

SEQ ID NO: 933069 - protein, 163 aa, Homo sapiens
MPECLIYREGQLDCSSGTLLSNLSCLIISHLWIQPPLSSEVAPSNLAFTFLCHDLEIIPREKAWDVGCFFWMYLVMTGCCQRRLTFDSVDWERRTHPQEGPLTMWVGTIQSAARGTRKSRQEKVEEADLLGHPAFIFLLCWVLPALEHRTSSSLAFGPLDLHQ

SEQ ID NO: 933070 - protein, 151 aa, Homo sapiens
MGSRVSVCLYQQHENRLIHSSFYFTKKGVEALRKEVKRVRSHDYYFTARDDHRKEFTIYFLQFLWAYVHFMFVSLQYILLPCARIPCWISEYGKNKTDKASDRLHLRMKEADKRQTNESTTTSHKKRRQGDREKNYSRKRISLSNKGPNHT

SEQ ID NO: 933071 - protein, 140 aa, Homo sapiens
MFSSGFITIYCQVTLMEIPTMVPDTGQGHCLAKRLCSIPIHSHPHHRCPHGQDTVIPIRSSSPSILINITIVILTIASSSSHHLHHRHQHHHHPYYRIIQLPSPSSSRSTPSTCVIIPIPNIIIITVNITTVIIYRPRAS

SEQ ID NO: 933072 - protein, 145 aa, Homo sapiens
MEWKERRQGEQLQGHVNNLGGVFDLDGRSNQLQGLIQSKSLNLLNSLKAERENETSEETSKSNRGWFMTFKGKKLTLFNTKVQGEVASADGEAAASYPEDLAKIIDESSYFKQHIFNADETPFCWKKMLSRTFIVRGEKSMPGFK

SEQ ID NO: 933073 - protein, 128 aa, Homo sapiens
MHSVNSPARENKTKQLAQVLHTSQEDGTRSIHLAVPHWLEPRLLCLGTPAILSHTIAIPTVLDVVVAVGLKQTSICIFDGEFLEESDVTTDLTGGVAQAVMQVIGSDCKQMKLCSLTRCSPRAVWPGS

SEQ ID NO: 933074 - protein, 135 aa, Homo sapiens [sequence omitted]

SEQ ID NO: 933075 - protein, 149 aa, Homo sapiens
MKAKRRLTFESVDWERKARPQGCGHHSIGCQCGYNKAGRRSILLMLTLGVQSQLGMEHSKWLRSHVCGLNKEEWKAGFSRDNGTLGFSLHVVSGLLLLYRLSTWSLLVVFPVESLGFLHDGSGLQSAQKQKSPGLLKTATVTLLLHSLG

SEQ ID NO: 933076 - protein, 169 aa, Homo sapiens
MSLAAPFMKEHLVYRAILLDCSKTHTSGSKKCHLSVVLAYNFKHPSWLESSDHLQRCGRGGFLKESESVGNMGNEAFSWLRRESWTWHRMDNGKSWGPLKAGSVLVGQPEAPPGPPVFPMAPRMTLEEEPGKPKVTYNTFLVLCDPHHCPPLKLRHPCRNSVSLNSSPR

SEQ ID NO: 933077 - protein, 175 aa, Homo sapiens
MPLGQARLPAGEASAGRGTAGSGEGARRRGLRRERERYRWIRRGCAQGRPPQGEVPLDQARVRAGEASAGRGTAGSGEGARRGGLRRERYRWIRRGCPQERPPQGEVPLDQARVRAGEASAGRGTAGSGEGARRGGLRRERCRWARHGCPQERPPQGEVPLGQARVPAGEASADL

SEQ ID NO: 933078 - protein, 189 aa, Homo sapiens
MRSLRCDEALEKSFPHGKCSHRTVYSHGHFQHECLCFLLIHVLPAGVYGQERSLCSPLNTGTKAECELQEYGVEQWDLHVQQNEPRTRPYTLYKINTKCKTIKVLGDNVGEPWRIAELLTCLLRLRNENSPGLQKHFQGSPLSIALAFLSQWNEFHCPGPNDFAGAVENGKGMLLGDGDTAEDMGYLNI

SEQ ID NO: 933079 - protein, 343 aa, Homo sapiens
MSSAWCSRQPGQSSDLCSLQKKGPHLVDKEPFGLYVSPHSGFCKRIYTVHTCMSPYTLDCVSASTRCTPARLPTLWILRARPHGARLHVSPHSGFCERVHTVHACTSPHTLDSASASTRCTPARLPTLWILRARPHGARLHVSPHSGFCERVHTVHACTSPHTLDSASVSTRCTPARLPTLWILRARLHGARLHVSLHSGFCERVHMVHACTFPHTLDSGSASTRYMPARLPTLWILRARPHGARLHVSPHSGFCERVHTVHACTSPHTLDSAIASTRCTPACLPTLWILRARPHGAHLYVSLHSGFCECIYTVHACTFPHTLDSASASTRYMPARLPTLSIL

SEQ ID NO: 933080 - protein, 161 aa, Homo sapiens
MNINSHYLDTDGEGGGAFEWMIKEKNKSGEATGNKRSFHPGPFATHKYGEVASRVHPGNTQRTVKPQTACTHSQTTDGLYAQPNRRRPVPTVRPQTACMNSQTTDGLYPQSNRRRPVPTVKPQTACTHSQTADGLYEQTNHKWPVFTMQRKEKQKQKLIFT

SEQ ID NO: 933081 - protein, 139 aa, Homo sapiens
MVHNRIEINVHRMQEGQPSGLNATAPNDEPGSHSTLRGKATRGSNVATKGPPHTKGPPHTKGPLHVNGPPYAGPPDLGPMALSLPGQSSEAPHLHHNGVVPSRARGSLQTHVWSPGPLKSLCTSFLPETTNVLSKRHSD

SEQ ID NO: 933082 - protein, 227 aa, Homo sapiens
MKTCPTSTALPSRQQGRRCRVWRPRTKTGQSWWSCPPHSDLTMVGNCPHSDLPMVGNCPHSDLTVVGSCPHSDLTMVGSCPHSDLTVVGNCPHSDLTVVGNYLPKVGSCPHSDLTVVGNCPHSDLIVVGNCPHSDLTVVRSCPRSDLPMVGSCPRSDLTVVGSCPRSDLTVVGSCPHSDLTVVGNCPRSDLPHKPASGPSPSNCTAGTPPRRGHAQAGQCPARQCLL

SEQ ID NO: 933083 - protein, 204 aa, Homo sapiens
MERNGMEWNGMEWNAMEWNQPEYNGMEWNGMEWNGMEWNGMECNGMESSGIEWNGMEWNGMQWIQLDCNRMESNGMEWNGMEWNGIKPNRMEWNGMEWNRTERNGTEWNGMEWNCMEWNGMVRNRMEWKELEWNGKEWNGMEWNGINPSAGECNGTECNGMESSGMEWNGMEWNGMESTRAQWNGLEWNGMEWNNPNGMECNGE

SEQ ID NO: 933084 - protein, 1015 aa, Homo sapiens
MAWIGMEWNGNNPSTGEWNGMECNGMESSVMEWKGMEWNGMEWNGINSTAIEWNGMELTRIEWNGMEWNATERNGMELNGMEWNGTERNGWNGMEWNGMESTRVQGNGMEWNAMEWNLPEWNGMEWNGMKCNGFNSNAMECNRMEWNGMEWNGMELTRIEWNGMEWNGMEWNGMEFLQTEWNGKEWNQHEWNGMEWNGMEWNGMEWKGMIRNRMEWNEMEWNGMEWNGMEWNGMESFRWNGKEWNQPEWNGREWNGMETNRMESTLVEWNGKDWNGKEWNGMEWNGMEWNGINASAGEWNGIEWNGMECNGINPSAGECNGTQCKGKESSGMEWNGMEWNQPECNGMEWNGMEWNGTTRMEWNVMESKGVEKNQSELQWNGMEWNGMERNAMEWNAMERNLPEWKGMEWNGMEWNAMDSTRLQWNGIERNGMEWNGIKPNRMEWNGMERNGTELNGTEWSGMEWNGFVWNGMECAGEWNGMECNGTESSGMEWNGMEWNGINPSTMEWNGMEWNGMEWNGMPSNLMEWKGMESTRVEWNGMEWNGMEWNGMIRNRMEWNEMEWNGMEWNAMEWNGIVPSGIGGNVFEWNGKEWNQQSGMEGNVMEWKLIEWNQPEWNGMERTGMEWNGMEWNQLDCNGMEWNGMDWNGMELTRIQWNGMEWNGMEGMEWNGMQWNGIIRNGMEWNGMQSNGINSIAMEWNGMERNTLESTRVEWNGKDWNGVEWNGMEWDRINSIGMEWNGVELTRIELNGMEWNGTERNGMKWNGMEWNGMESTRLQGNGMEWKAMEWIQLEWNGKNGINTSGMAWIGMEWNGINPSTGERNGMECNGMESSVMEWKGMEWNGMEWNGINSIAIECNGMELTRIEWNGMEWNGTERNGMEWNGMEWNGKEGNGMEWNGMEWNGMESTRVQGNGMEWNALEWNLPEWNGMEWNEMESTRVHGNGMEWNALEWNRPEWNGMEWNGMKCTGFNSIAMEWNIMEWNGMEWNGMELTPIEWNGMEWNGMELTRIEWNGM

SEQ ID NO: 933085 - protein, 187 aa, Homo sapiens
MEWNHPQWNGMEWNGMESTPVHWNGVEWNGMEWNNPNGMEWNGINPNTMEWNGMQRNGVEWNGINPSAGECTGMVCTGMESSGMEWNGMEWNGMEWNGINSIGMEWNGMEWNGMGLTPIEWNGMEWNATQCNGMEWNGMVSTPLHGNGMEWNGMESSGTECNGMEWNQLYCNGMEGNGMESNVMEWN

SEQ ID NO: 933086 - protein, 2744 aa, Homo sapiens
MEWNAMDSTRLQWNAIEWNGMEWNGINPNRMEWNGMERKGTERNGTERNGMEWNAINTSAGEWNGMECNGMESSGMEWNGMESTPLQWNGMEWNGIEWNGINPNRMECNRMECNGTEWSGMEWNGINPSTGEWNGMECNGMESSVMEWKGMEWNGMEWNGMEWNQLDGNRMEWNGINPNRTEWNGMERNGMEWNGMELNGMECLQTKWNGKEWNQHEWKGMEWKGMEWNGMVRNRMEWNELEWNGMEWNGMEWNRSDGMEKNGINQSEMEGNGMEWKLIEWNKPEWNGMERTGMGWNGMEWNGMESTLNGINPSVMEWKGLEWSGMEWNGMEWNQLDWKGMEWNGMEWNGINPNRMEWNGMERNGMEWNGMEWNQPDCRGMEWNGMKWNHPEWNGMECNGMEWNGINPSAMEWNRMEWNAMEWIQLEWNGKNGINTSGMAWIGMEWNGINPSIGEWNGMECNGMESSGMEWKGMEWNGMEWNGINSIAIEWNGMELTRIEWNGMEWNGTEWNGMEWNGTERNGMEWNGMEWNGINASAGEWNGMECNGMDAGECNGTECNGMESSGMEWNGMQWNGIFRNRMECNAMDSTRLQWNAIEWNGMEWNGINPNRMEWNGMERNGTERNGMEWNGIVWNGMEWYGIEWNGKNWNGMESNGMEWNGMEWNQPECRGIGIGENVFEWNGKEWNQPEWNGREWNGMETNRLDWNQPEWNGMERTEMEWNGMEWNQLDLEWNGFNPSAGEWNGMECNGMESSGMEWNGMECKAMESTRLQWKGMEWKGIEWNQPDWDGMERTGMEWNGMEWNGMECNGMVWNGMEWYGIEWNGTNCNGMEFNGMEWNGIESTRVQGNVMERNAMEWNHPEWNGMEWNGMESTRVQWNGVEWNGMEWNNPNGMELQWNGMEWNGMECLQTEWNGKEWNQHEWNGMEWNGMEWNGMIRNTMEWNEMEWNGMDWNGMEWNGIVPSGIGGNVFEWNGKEWNQPEWNGREWNGMETNRMESTRVEWNGKDWNGKEWNGMEWNGMESTRVQENGMEWNGMEWNGINPSAGECNGTECNGKESSGMEWNGMEWNQPECNGMEWNGMEWNGTTRMEWNIMESKGVEKNQSECNGMEWNGMEWTGLEWNGMECNGMESTRVQWNGMDWNGTEWNGMEWNLPEWNGMEWNGMECNGFNSIAMEWNKWNGMNWNGMESNGMEWNGMESNRVQWNGVEWNGMEWKNPNGMESNGEERNGMEWNGMEWNGMESTRLQVNGMEWNAMEWIQLEWNGKNGIKHEWNGMDWNGMEWINPSTGEWNGMECNGMESSVMEWKGMEWNGMEWNGMEWNQLDCNRMEWNGINPNRMEWNGMEQNGTEWNNGMEWNGTERNGMEWNGMEWNGMERNEMEWNGMEWYGMEWNVQGNVMERNAMEWNHPEWNGMEWNGMEWNQPECNGMEWNGMEWNGTTQMEWNVMEIMEWNATEWNGMEWNAMAWNQPEYNGMEWNGMEWNAFKPNGMERNGMNTSGMEWNGMEWNGTIRNRMEWNEMEWNRMEWNGMEWNGMEWNGMESGMERNGINQSGMEGNGMEWKLIEWNQPEWNGMEKTGMERNGMERNGMEWNGKEWNGMEWNGMEWNQRECRGMEWNGMQWNGIFRNGMEWNGMEWNGMESTRVQWNGVEWNGMEWNNPNGMELQSNGIEWNGMQWNGFNLNGMERMESTRVQGHGLEWNGMESTRVQGNGMEWNAMEWNHPEWNGMVWNGMEWYGIEWNGTNCNGMELNGMEWNGMESTRVQGNVMERNAMEWNHPEWNGMEWHGVESTRVQWNGVEWNGMEWNNPNGMECNGEMEWNAMERNGTEWNGMEWNGMVWNGMEWNGIEWNGTNCNGMELNGMERNQRECRGMELNRIYPNVMEWNATEWNGMEWNGMQWHGINPSTMEWNGMEWNGMEWNGMPSNRMEWKGMESTRVEWNGMEWNGMEWNGMEWNQRECRGMEWNGMQWNGIFRNGMEWNGMEWNGKEWNGMEWNGMERNQRECRGMGWNGMQWNGIFRNGMEWNGMEWNGINPRAMEWSGMEWKQPEWNGMELNRINPNVMEWNGTEWIGMEWNGMEWNGMQWNGINPSAIEWNRMEWKAMEWIQLEWNGKNGINTSARAWIGMQWNGINPSTGEWNGMECNGMESSNGMEWNGTERNGMEWNGMEWNGMEWNGMEFTRIEWNGMEWKGMEGKEMECNQPECRGMEWNGMQWNGIIRNGMEWNGMESAREWNGKECNGMESSGMEWNGMECKEMESTRLQWNGMEWKGIEWNQPECNGMETTGMEWNGMEWNGMESTRLEWNGMEWNGMELTRIEWNGMEWNGMEWEWNGMEWNGMEWNGIIRNGMESTRLQWNGMEWNGIERNGMELTRIEWNGMEWNGMEWNGMEWNGMESTRVQGNGMEWNAMEWNHPEWNGMEWKGMEWNGINPSAGECNGTECNGMESSGMEWNGMEWNGMESTRVQWNGVEWNGMEWKNPNGMECNGENGMEWNGMEWNGMEWNGINESAGEWNGMECNGMESSGMEWNGMEWNEMQWIQLDCNGMEWNGMEWNRSEWNRRECIRVEWKGMESTRVEWEWNGMEWNGMEWNGINPSAGECNGTECNGMESSGMEWNGMEWNGMEWNQPECNGMEWNGMEWNGATRMEWNVMESKGVEKNQSECNGMEWNGMEWNGMECNGMESTGVQWNGMEWNGMEWNGMEWNGIECNIMESSGMQWNGMECNRMECNGFNSIAMEWNRMEWNGMEWN

SEQ ID NO: 933087 - protein, 469 aa, Homo sapiens
MEWNATEWNGMEWNGMEWNGMEWNQLEWKGMEWNGKEWNEINSSGMEWNGMDWNGLQWNEMEWNGMESIIPSGMEGHVMEWKEGNGINPIGMQGNGMEWKGMEWNQLDCNGMEWNGMEWNEMEWNGINQRNGINTRAGEWNGMECNGMESSGMEWNGMKSTPLQCNGMEWNGIEWNGINPNRMECNRMEWNGTECSGMEWNGINLSAGEWNGMECNGMESSGMEWNGMEWNQTECNGMQELNRINLNVMKCNGKEWNGMEWNRMEWNGMESTREQWNGFEWNGMQWNGFNPNGMERNGINPKWIGTKWNGMEWNGMEWNGMEWSGIKSIAMEWNGMEWNGLEWNGMEWNGMEWNGIKWNGMEWNGINPSAGEWNGMECNGMEWNRMEWNGMEWNGMESTRVEWHGMERNGMEWNGINSSGKEWNGMEKNGMKSTRVEWNGIEWSGMDCNGMKWNGMEWNQSFRVEWKGM

SEQ ID NO: 933088 - protein, 145 aa, Homo sapiens
MNKDSHSKTCKETILVIQARDDGSLDQGSSSGIDEKWLKSGYILKMEPVGFPNTLDMEYVRQKGHDSGNLVFGLCYLPSSIETIGGGAVKEWAKCTYTNALNRILHCSEDWKPRRVLIKSATRPYIPIFKVSPPENSSSSLMTPI

SEQ ID NO: 933089 - protein, 140 aa, Homo sapiens
MICYGQRSQCLRFPEAAADMVLTRAPAQGSLELELWAWRHEKTSVLGTVEHHTECEVAFFHQVFAGLTVHWERSLPKEREGLASDKPLTAHTLLTRFGREGPLLPLLVLVLFEFCACTDYCFIPTSCCPHESTHTEKPRN

SEQ ID NO: 933090 - protein, 188 aa, Homo sapiens
MKESLELLRDWLNDCDQNADSGMDSEVQAAKVSDGNEELIGNWSKGHTCYVLAKSMAALCPCPKDLWKFELKGDDLGYLAEESSKHQSIQDVTRLLLTIHWQLAGCAWKSHRHSTPTRESSCGGCTLQSQMGGVAQGPGNPSLHQCTLDAAYGVRGDYFGVLRCNDYLADFELFMGPVTPVFWLISPF

SEQ ID NO: 933091 - protein, 136 aa, Homo sapiens
MGFPLWSGPSAAGLLEFAGGPLQTLFVWVSPVEAIGQQRLLPIPSPGSFVQEGHPPDASQSSPQSSSAVLEIHCSHQSQQTGTFKSAEAAPTAARCKDCGKSIVSGPECTTPHGTVLHSFPCLEEGVPRPFAIPRH

SEQ ID NO: 933092 - protein, 166 aa, Homo sapiens
MPRGIHLPDLNTSQQVLPPALEMTIQHEIWTHDRDKLLLVSLHSTPCRREHISKCVWDLASHSRIQQEQASCGADGQIRHELVSAGSSWQLWAPAGARSVWNPWLEPEGVFHYSPNSTVCRLTAQLTPCHITWGGCPLPVTMNSWCDSIFGYPQSMCPELLFDVQG

SEQ ID NO: 933093 - protein, 148 aa, Homo sapiens
MIPASLELLVNFLGTNILNYFPLTTAPKGEIHCHDLITFRQEPSPTLESTIQDEILMTREQYILATQQNNLPRTENAQLYPVGIYGWRKRCLYFFVLLLLVTMIVNLAMTIWILKVMNFTVKYNYMVHPNMYLFSSINVPAFPCPFEV

SEQ ID NO: 933094 - protein, 186 aa, Homo sapiens
MLSPLAFNTTQCWKLWPVHTARQGNPRVQHNTVLEALAGAHRETKKPSRSTQHSAGSSGRCTKRDKETLAFNTTQCWKLWPVHTERQGNPRVQHNTVLEALAGAQSKTKKPSRSTQHSAGSSGRCTQQDKETLAFNTVLEALAGAQQDKETLAFNTTQCWKLWPVHTERQGNQRHTHQKGRHALVP

SEQ ID NO: 933095 - protein, 165 aa, Homo sapiens
MQSHSRVISHAGCLTQMYFLVLFACIEGMLLTVMAYDGFVAICRPLHYPVIVNPHLCVFFVLVSFFLSLLDSQLHSWIVLQFTIIKNVEFSHFVCDPSQLLKLACSDSVINSIFIYFDSTTFGFLPISGIFLSYYKIVPSILRISSSDGKYKGFSIRGSHLAVVC

SEQ ID NO: 933096 - protein, 194 aa, Homo sapiens
MALLTVPFPLGVPCRPQLDKDVFGFHHGGAGNWIIHPKKSGQRKTRFSEEGDIEPRELTKRQILELWRRQLSLGLARSVDLGTPQKGPRGRLTERRRKAHRMLKLYNGLSKGEAVGLPAGTDPLDPTDLNGAHFDPEVYLDKLPRECPLAQLIDSETDMAQQIRALDSDMQTLVYENYDKFIPATEIDKQHKTV

SEQ ID NO: 933097 - protein, 232 aa, Homo sapiens
MRWAALKRDTTLGLGFAFTSLCLLLLGSVSRPGNGPDGSSGSVFQTAALGIPAQPLHPDLRGGTVNFNLIVSGNELSGKGSISQLALLTSGCRTLVAMLCGSGQLKRDGEAPSKGSGGWRHVLFPFLPALPPGMGEWRGSALMARWGRLVHEDESGYQGDGTGDRGAWDALTLRAGAAACRLAVVCEDPLFGLSGPSIAESNPQWNCLHLFHTTQLLHNPSRIPPLIPSHSC

SEQ ID NO: 933098 - protein, 169 aa, Homo sapiens
MRARTSKFFSSCRLAVRSSLLMIIDGLLPSVLPFLGQLHPQGCGLGYTCEQKSWWFRTRRHQMDPPSPIRYANLGETDQKPTVNELEMITLSWLNAEEGIQSLGEVGMQERIRLSRHPHSPWEGPELTPFPTIMGNACERGAPEPLMSCDCSSLWATPYSGETSTQWEY

SEQ ID NO: 933099 - protein, 143 aa, Homo sapiens
MSANADSFYFFFSILYIFDEFLSCSTIHCSKSPNLGSAHKFWTVFVDCGSDGSLIFGVFAVLFGLLGFSGSLGAPTGPCWCGLWIGKGFTGPAARRLLVEEGCGGTHVPVSWAAQAPLVRAGEPQAMDNRVSLSSCLQWQAPL

SEQ ID NO: 933100 - protein, 146 aa, Homo sapiens
MVVLLQGKGQHNMRQGPRTAELCTVFRRGCELLLCRVGRCFRALQAPCRPLLTVHGLHLPYLLSCPISCSWLWFPEGSRLHRLPCVLTLCPDLLTSTGVLLALWVVRGQESHAVHGEEGGSASSHLAGGSGPGVGKPIPPGCCSVL

SEQ ID NO: 933101 - protein, 159 aa, Homo sapiens
MLVLYLSLAISYQPAVPGKLFPWEDGCGQGFLGKAYVLFPHAPLQGVFSRCDSETAHFNGGHSTTPTCLLPLDSEVSQAQVAHGGRLPEVDVMLGVQGGSVCVPCKQSLVAVNRVAFCGAATPVSGCRLSVCEGNSCSWPKPTGLAREGLSHTLFFLLG

SEQ ID NO: 933102 - protein, 148 aa, Homo sapiens
MLNQPCIPKLLVMMSYPVYIFLDSICCISSNDCHTYLQEYWSVILFPCNIAGLGFRKVVTSLSKFGSVASSFIYYQYSAKNQGDPSVMLFPTSSHLTLHELPSESQPSEKLSLFMHFGLGTVSKGKKPLTRCQADAGTMPWTFQPPEP

SEQ ID NO: 933103 - protein, 147 aa, Homo sapiens
MHTIILQPDNEHRTAIQKSAWLRRLRTCPDGTCRFSFPGAAGTGGAAPAAGQRPACQPHTWALVQALACSTSCPAAGQGRFSAALPLSGMGSAGAGCRGCTHHAHIPRRNRQGPWKYGRCTHFLIHTIPIKNTASGPRHEFGLLELT

SEQ ID NO: 933104 - protein, 135 aa, Homo sapiens
MRWEMSTVYLKSSRNRASHLNSPYTTIKPSMSSGQKPQRLKGDKPTKMRKNQCKNPENSKSWNALFPSNDHITSAASILNWAEMAEMTEIEFRIWIGRKIIELEEYIETQFKKPRNHDKTKQELTDKIASIEKRI

SEQ ID NO: 933105 - protein, 145 aa, Homo sapiens
MAAGLSHAVLVIVNKSHCCAAGVGPTEPGKGENFLVCRLLRRWEKLSISAGVSHFSRYPVKWPCIGGNVFEKVLQSLHIGFAGNILGPCGSRYETLVYGAVLEHMFTEVVPEPWSAGSGMALGSTGVCLDPRFCGACVHRGLPRT

SEQ ID NO: 933106 - protein, 181 aa, Homo sapiens
MKVHQDSARRDRWSHPTTILLHKSQSSQATLMLQEHRMFMGEAYSAATGFKMLQDMNSADPFHLKYIIKKIKNMAHGSPKLVMETIHDYFIDNPEISSRHKFRLFQTLEMVIGASDVLEETWEKTFTRLALENMTKATVGLPSHSKWANPPRVLGMPAAAPGTQVMLGMPSLVGYQAISIQ

SEQ ID NO: 933107 - protein, 148 aa, Homo sapiens
MAARTTENTAEVCLTCQINIRAMTEMEMYLCLRRREKAVSSFPQGHQYKAERSPARALAQSAVTQRLTKFLSNFAGMVWVFRKKKSSKLNVLLLRETHAERKETHKALMTSFTKKVLRNCQRCQWTQLRSLQLFVNNSLSPYLAQRLH

SEQ ID NO: 933108 - protein, 150 aa, Homo sapiens
MINVKLFNFLKTGHLNIQSVETKEKILKNEAHVQDLENSLKKANLRFIGHKVVMKEIGEESLSKGIISDNYPNLEKEMSIQVQEGYKPPDKFNPKKTISRHLKVKPPKIKGKEIILKNSNKKKQITYNEAPVHLAENLLVKTLQTRRELG

SEQ ID NO: 933109 - protein, 141 aa, Homo sapiens
MDLPFWGLEDGGPLLTAPLGSAPLGTLCGSSNLTFPFHTALAEVLCDADTGLEVGMRIETAPMEKLSHPGNMKMKEGAIELSPCLPALWLDQPSTGANFTWHKDGVLITTARKTYKNKVSQNVISNVISSILPVPRFWQKL

SEQ ID NO: 933110 - protein, 194 aa, Homo sapiens [sequence omitted]

SEQ ID NO: 933111 - protein, 152 aa, Homo sapiens
MTAQISMVVKRAVVNAKMSDDDQDEFDWLQRQVVEIFLDIFLEVANPICGKLLMLRSLEEEEESEKQPKKKCPVRSKRSGHWSVISQGQPTGRGWMQDHLGIPGQEANASQGQFFREEFQCEPWAVEEIDKFLDTWTLPRLKPEEIENLRTM

SEQ ID NO: 933112 - protein, 160 aa, Homo sapiens
MITEYVSAWRCSSPTCCEPKLWKRLWNWVTGRGWNSLEGSVKDRKMWKSLEFARDLLNGFDQNADNDMDNEIKAEAISDGDEELVGNWSKGDSHYVLAKRLVAFCPCPRNLWNFELERDDLGYWVDKISKQQSIQEVTCVLLKAFSFKRERAQKLGKFAA

SEQ ID NO: 933113 - protein, 163 aa, Homo sapiens
MARVGQRKGNVGLEPQHRVPTGAQSSGAVRRGPSSCRPQKGRSTNILHCVSGKAADTQCQPVKAAKRGLIPCKAIGTELLKAVGAHLLHQCDLYSPTRTFENPVLTRSLLTARTIGKEQGMNLVTHRSRISKKTFRIKHPGNNQLRASHPFKSYKKQFTTCCL

SEQ ID NO: 933114 - protein, 154 aa, Homo sapiens
MGGTGGHYPKRNNSETENQMLHVSTYKRSKGILWELFYQGTNAVDEDSTVMTQSPPKGPVSKYHYNGDSISADEFGKCETGVEQMSRGIALERKFHRLHQPKFPFQPGQEIALDYGAKFSTDARTWKQGKRARAAAEMNGNMDPAVPCSYWLRR

SEQ ID NO: 933115 - protein, 149 aa, Homo sapiens
MWMCMACDGYVAHFFSILLLKPLGEHTDGQAVGLRSHGNVKLYIVPPVDGLLAYRHLPVCSPHPLDVQQLVCSSVDVFLLTSFELCPLGYDLHKRFSVPLLLCDTGSLEEAKIGYFPSLMSVRLWIQPPKNSRSFFNVSPLFMFSGKES

SEQ ID NO: 933116 - protein, 136 aa, Homo sapiens
MGGAAMKTSDMPWRHFPHADKKFSYHTGKILWRYNRIFKRRGLESCEKGRREETGRKKRGERKKERKQRGEERRGKEKRGKNRRKEKRRGEKMTEEKRGHDRYLAISASQPSLLRHLTSRHVNEPSRVFQSRRALK

SEQ ID NO: 933117 - protein, 142 aa, Homo sapiens
MGRAAVKVSGIPWRHFPHLYLRPPKPDFTVHITISILGTILRQHVSVGPDRRCPVQPNDCSQLCIELTPFRTSYKASLLVRNSISICFPEKGVMSPSLMKLSLVGYEILGWNFFSLTMLSTSPQSLLACQMSAEWSTGSLMG

SEQ ID NO: 933118 - protein, 214 aa, Homo sapiens
MDTQWDLNSDHGDWSHKRLLTCVLEGLRRIRKKPMNYTMMSTIIQGKEENPTFLERLQEALRKYSSLSPHSLKGQLILKYKFITQSATDIRRKLQKQALGPEQNVEVLLNLATLVFYNRDQEEQAIKEKQDQRKVAALVMALRQTNLGGSERTENGAGQSPSKAYQCGLQGHFKKDCPTRNKLPPHPRPLCRGNHWKVHCPRGQRLSGPEAPNR

SEQ ID NO: 933119 - protein, 224 aa, Homo sapiens
MVERTPDHRLDHSHSYKGQKLYKSRTGTVIWWGLNRTENNPFNKFPKLQTVWAHPESHRHWTAPTGLYWICGHRAYTKLPDQWEIEKIMSGPPKGSYSTIGLPHGHKTAQGIPNPHLHAQLDHTVKAVLEIITSETGRALTHLARQETQMRNAIDQKRLALDYLLAAEGRVCEKFNLTNCCLQIDDQGQVVKYIVRDMTKLAHVPIRFAIGLILDPCLENGFQL

SEQ ID NO: 933120 - protein, 165 aa, Homo sapiens
MPLHSSLPNKSETLSKEEEEEEEEEEEEEEEEEEEEEEEEEEEEEEGGGGGSSGGGGGGGGGGKKEEEEGEGEGEERRRKKKKKDYAPRENDLGLLFIKQKSLTEDAHTLTICLSDFFLTPVAVENGNICWSRQNWEEGMVRHPSWQSEECRNRNSQGLEVGIEQ

SEQ ID NO: 933121 - protein, 150 aa, Homo sapiens
MWASNYDILYSTWSIWLLMLVYVSRSSHALFFSSIRAQAQGDPNSVPEPLAGVIGDPARKPDSLKKDRQLPVPVLAADPPPRSSNGLHSRQLSPLPLVSLSRFPLRGCKNAGSMVGSLDPGGLGFATVMIESAKCPETESQMLFLIEWLA

SEQ ID NO: 933122 - protein, 160 aa, Homo sapiens
MNYCQGRSALAPTLTVFSCDSPKQVSLNLLQDITGLKTRCWSGLWFSSDARDLLSGSQGVGRIHFLRVGAKFLVFLLAFGKELPSSPRGCLQFFAPQGQKGGTDPDPKGGFLDLMQEGIQAETRCSVDISSDLEAWNQFFVTGLVSFLRMTELLPMTMHR

SEQ ID NO: 933123 - protein, 142 aa, Homo sapiens
MIGPRFLFQVFLFTPGDSTVSTMSDTVSHTCASDMILVTASATHFTWLQMTSLACTHQLPSAQVWGSKYYLRGDLAMVSLAKPRLYIYQKSKEHLKIKEASNAEETYNLLLDDVVLRTWKPIPIECQIGISLDVYKATSLTN

SEQ ID NO: 933124 - protein, 148 aa, Homo sapiens
MCLFAVAQGRRISRVPLTILSPVLCTQQMTNKCGYEEGMEDKDNSGNREDGSTDSVTWGFEKGDRYWLPLRSCGIMMLEQVSTFIHMQEVPFKYLISISNAFWHSVKCNVILVTCYFIMLQMYIEITIQLDYLRWSLDISRNVAEWVA

SEQ ID NO: 933125 - protein, 175 aa, Homo sapiens
MASSRVPYDQLTEEEKARFTDGSARYAGTTRKWTAAALQPLSRISLKDSGEEVLVTEGRMLLPRDTTIIALNWKLRLPPGHFELLLPLSQQAKKGTTVLAVVIDPDYQDEISLLLHNGGRTTNGPDPSGMKVLVTLTGKNPRLAEMLAEGNGNTEWIVEEGSHQYQLPLCDQVQR

SEQ ID NO: 933126 - protein, 168 aa, Homo sapiens
MTIPAYRGCAQTVFVSYSSPFDIKSHIPPHFNAKTLTQAKENANRMKRQPMEWEKISAYYSSNRGLISRIYKEIKHCNSTKNPNPIKNGKNDLNRHFSTEGIQMANKYIRKCSTSLIIRKMQIKTTMRKCFQFLPVQYDVVCGFVIDDISQKKTYKWPTNIQKNAKNH

SEQ ID NO: 933127 - protein, 180 aa, Homo sapiens
MYKAKANFIVNCHLSGPCGKEGESPGADAEFAFHPCRQGPTHTDPRGSEFQPRGNWESISPDEKKEEQHRPECKGTQRNESAKDRRIGQWRRRRTGRQAKGVRGLDGHGYKMPGQGQGRCSSTKSRIGVAARRSRGPFARAVSVECRERRSQTAVCLKKENWEVDRWKTSQEARICRLGW

SEQ ID NO: 933128 - protein, 351 aa, Homo sapiens
MYKEMNAVFLPANKESIQQPLDQGVILTFESYYLINIFCKSISALGIDSSDGPGQSELKILWKGFTIIDAKKNTHGAGQREVKPELQPLFMPVERPYYAPPLTPAPATQMPSTPGFVRYNPYSHLTYNNYRLEGNPGTNSQVTASYAITIPKPPKPPDKLLMPYPPEDPDDYDDGFSMKHTATAHFQRNHCLISEILSESVVPDVRGNDNQEKRRKYLESTDSFNDELKSLCGLKVEVDMKKIAAQSSIVPKEKQAASKGEEKKDDKNIPMEMEEARFEEMTESQQNSEEGTFNPEDKESGQEWVDSMAEEGTSDSNIGSDSNSTIVQEPPKDPIPEDEKKRVNLALFYVL

SEQ ID NO: 933129 - protein, 118 aa, Homo sapiens
MPNLLLVSHLVTIESNRAKANPYEILKQTFRKLIRHLPPLDFRYVRKNKYFFVTEGRCKVLVTIVCTKHTQLEPLQGTWGMGVWQGCEDGPWKWRSLHGIFSVSWEPGYSSPHASRYC

SEQ ID NO: 933130 - protein, 152 aa, Homo sapiens
MPGAISISPARLHSQPEEGPGLIFLFWTLIGPINSATTWALTSLGQAWVEFYIEGKKRDGSRCFPEGSVDSGGDLWTAAAAHYLAVWLCDTCQPYKEIPLTLESTLGEQNLSLRQIRDEGETLLFPPVAGSSGLGKCLFEHKVPVAFIHRKM

SEQ ID NO: 933131 - protein, 126 aa, Homo sapiens
MWNSCSEFDLQLSVPAWRCRKKLKTHNPCKDGNEYFSAKEEIEGPTHCLMISEKDDIWTHKHYNLWKMVSNFSTMMSEPWWEPQRESRGEKFLPFVSTGFYMPDTWELQRPLWVYLASRMKVDLCV

SEQ ID NO: 933132 - protein, 140 aa, Homo sapiens
MKKLMGSELVSVVWCDDAGIGTQMVESEFGSDIISTAWAAVVWCDDAGIGTQMVESEFGSDIISTAWAAVVWCDDAGIGTQMVESEFGSDIISTAWAAVVWCDDAGIGTQMVESEFGSDIISTASFWGRHNFSEFYLVVK

SEQ ID NO: 933133 - protein, 141 aa, Homo sapiens
MPVLIFEAWSWLPLLLLLLLLEPQLPEEPAVTAFPNKALAHETTKKETTPVNPWPVLVTIGNGGTGTPCLASMLFIFPGGHPPGQFLEDKTLHCLWWTSGWLGTTVSSPRTVLILREMLGLLRAWPERLLQNMFTWELHTA

SEQ ID NO: 933134 - protein, 151 aa, Homo sapiens
MQSGNPVSRGCLENDSLTLSIPLSSKVAREVWEFPLVLDHLYLALLFDEGRASKKGGQMTMAGHGGGEPGGQLRWCGCAMLERKAPRPGERARALEQKRGFLPSFLPSFLPSFLPSFLPSFLPPSLPPSLPPSLPLSLPPSLPPSLHSFNR

SEQ ID NO: 933135 - protein, 270 aa, Homo sapiens
MGFSFCLMKLPQTPGEVSLTGTLTCDQIVEGVVDGELLLFGKYGGQEKSSCFENSRIFRSPVPGTEDKDHTNNYYTIKGSVGTSEEPKKAPGERDPFFKLLPVPECEKAAVNENESYVGCKGCKDWALQNRERRMNGRGTAERSKSRASKNEMQSQSKSRPTPESQPSHFTCEPHYYRPGGGPEASNRSHSLRPCLTSWSIQIPSLTPREVTEQKAALLPAQVHTKHNLSGKLWRKWQKRYCRKLVVKREPQCYGNPETEAALFSEEGRA

SEQ ID NO: 933136 - protein, 201 aa, Homo sapiens
MCHGGLLHPINLSSRFEASHALGIYPNALPSLSPNPHNRPRCVVFPSLCPNVLIVQLPLMKMPCPVKRNLVRQSGYSCVEFYPVLSTVRGNPPAQASVMVDTPAHTKLNCPRLTSDCCAGSKNFKPVVLSLLDSLGVGPAERDHLDPWLQPPFQECEQFLSRWGSRCHSVGNAEITCLLCWSHWELQTGAVYIRPSCQILP

SEQ ID NO: 933137 - protein, 143 aa, Homo sapiens
MFKDPVWGSSLLGKTCHWLDYRVNRTQKESGGPGGPNTGLLPSLFILIHPRKAFFQYSQEYWKFSGNIGIFPEIFLIIQKPQPESEVSCARSSTASQQPVNGQSTQQSVNGRQTQKGTNNYFPVTLYTRPVLNSSDRYFLRRR

SEQ ID NO: 933138 - protein, 136 aa, Homo sapiens
MDFKPDALFRWELGVLDAGGIVLHVGETFHGGLKMDCGRLKEFKGKLEVEGNNFTEAALLQLLQRRTTPSVESGSSGQTYTKQGKIGPHKNRNRIGADAWFVLATSYIHSWIHDLIETTVSFVIGLCFVCFIIFKC

SEQ ID NO: 933139 - protein, 165 aa, Homo sapiens
MAERSTVCLHIHFVYSFPRSFLCSLLPVQPGFPYGLQNSTQDLETTLQVASPFWIKPMHISHLLIDVSCLPKMYETKLCSDHLGHMSSGPPEAVSFISKVERPEWNPGLFDSTFQGLLMSLSSSQYSVQHSQLEALSPGAFFTLVLKMDEHSLLFPVFLITYRTL

SEQ ID NO: 933140 - protein, 268 aa, Homo sapiens
MSKTSEEAEIDENVMNSEMQMKIETLIPAPPHVGRAASIAQKSKDSSKQAHSDRNSPQRIRSWRKSKRACLAITENWTSWGHIFHPQLDGNFQTGFMISHSGIKLSSGRCRILYPVFRGLVGAQDGHTVENKVCPESIQNTHCVGCCCLLAGEGPPGMATEDDLSSSRWGPLVLMLQILSTSPALGPNALIALIDSTGLRDGCYADVPSAIPGKNTSDGFMVEEARGNECGFGCERQKGTSHPENDMNECGRHGIEQLICKDGPELER

SEQ ID NO: 933141 - protein, 170 aa, Homo sapiens
MRGSKRRASGLYYSIACLCWCVAIRPGGTAINKPSVFRVRNREEGNTGKWDECQVDQRDTVMGVRCGIRNNMGARIEVWARNNGNCGRLNKETAAAAARRHDGWPKTVRSSCMDKKATGHNPGPCVRIPTAQPALWLWVMKKVGMSQRELGWGQFLNLSSRNGNRSGERI

SEQ ID NO: 933142 - protein, 159 aa, Homo sapiens
MMLSEILSYTLWKLTPTPLDLANSPQYNGAVSLFPGRGSAGREIIDTHKIVKAGSRGITAFSSYGATNALDIPAFIIKFSEVRVRPSHSLIDSPRATSSPASSIHDHKGLVPVKIAFLLIQPGGFSSDHHVHTGSQCSGLERLLHEKTEYMGFSIIHGY

SEQ ID NO: 933143 - protein, 373 aa, Homo sapiens
MEVRRGFHAILSPASLLDAGHPASSRSLGSTFQPVEQLPFHSRILCREDLKVARRPCSQHVLWAIVHEREKQCESQRSHRRRKRSTPWLSLWCPARNDACKCDCAFLGQFPEKVQVEWWAEVTHILSLGNEESVTSWLSTLEFSCQCQQEEPMQSQEDSYNRPPRLTGRLHCACSSIGQTDVAACTPREQFTWSLLEIQIVSPLPGFTESGTQFDRPCSKSIPPPHPSPGEDPCTPLPSLRARCPSTAISCALHSQPETVEMELKPSDHVKLIHYYEKNMRKSNPLDSITFHPVPPPMTYGNYYNSRKKCNKNSYYKKVTSGPSYIVNLLTLGKAAPWCDPVHRLAAVGQERRDDEKEGMEIAQCIMCQENLQ

SEQ ID NO: 933144 - protein, 137 aa, Homo sapiens
MARAHLDRGGEGVLVPDTEGIDAGQVSPKTGAFPGRVLSFTQERIPGQAGGVKQQLELKRLCTEAAERFLLAEQGYPIGNVPDSVSHFIQLPKMKTFMKMSTFAANWPEVKVGLETPEIAAGVRILGIFGSSDDCEF

SEQ ID NO: 933145 - protein, 157 aa, Homo sapiens
MTVTAYEHGLDNVTEEAISALVYAVENHPKDILTSVVSRRKAYRLRDDHFKYAFGTFTAPCAGQNPASHPPPDEAEQQAAFLLACSGDTLSASLSAANMYELFEALRVHREVIPTHTVYAVNIERIIMKVWHPNHEELKTKFTTSAWQPRRGFCCAK

SEQ ID NO: 933146 - protein, 151 aa, Homo sapiens
MESYSHYDPHLTPPGPTCSSGPSAPVCMVDSNFPGGSMGCTRGLSFFTLLFLSGILTGNILDQESPVGHRPLPVCSLLGTRPHNRRWRPSVKEAVSVRQGKKPSPGTSAGTLMSDFKPPKLERMGIYEHGPSPDTKSATNWTLDLQLPKRA

SEQ ID NO: 933147 - protein, 139 aa, Homo sapiens
MEKLLIPRLHKICAEEGDWVLSSHGATVTTASSSDSSPASPAPLPKHHCNRPGSRCPPAGDMQMMPLVNGIDVERLNAEGDTSFPARGHQAAVCVWENVYVIVTLNPLPTAQFQSFAYIPYLYEYPNSLKPSRVFQGEV

SEQ ID NO: 933148 - protein, 143 aa, Homo sapiens
MHLLEKDTPFQRGQSVPGREVDQRLGEAHNYLLQNAAGILSSCLKREGVATAQSPHTCEHRPSVSKAFSYDLKMSIAAEQPLIKPSDLMRIHSLTREQHGGNHPPDSIASTWSLPWHVGIMGITIQDEIFGGDTAKNITASFS

SEQ ID NO: 933149 - protein, 138 aa, Homo sapiens
MSREELWPFREPRPPGSLSQGCDMLDGCSRSHLQYIWSSHSLVQSWHQCLAHHSSQHAGPHASLLTLPLPLCTWLVLGRHGIQAGSTSEAQSTGTTAGQNEPSECEQNSSRGAAIHGSFWLAKQHMEDSVTLALDPQW

SEQ ID NO: 933150 - protein, 140 aa, Homo sapiens
MGLNWEGPLIHRLFAINAVGPRYWHVPHLQPNLRLEDSTFTGFKTCLYRGLAVPFLSSSSEGPTVTLEYACTVVCAGGPKTNPPRILRDDYTSFVMMHNSLCAGDMEGGQGSRGKGRAWSPVRAPPRPVPMDLEAMLFSL

SEQ ID NO: 933151 - protein, 216 aa, Homo sapiens
MIVRLPQKLTLLCNRTPELIPPVCNFVPPDQSLPIPFTPYPPPVSVCTLGIFVENQLAISEWIYSCVVSFVPLGLQGGGSRRRQCGLKATPALQRTNIYQVTSSNHHKGHSDYAHLPPSWPDFVHLSILISHPSLQSSHMSTNHKQLRDSPDPLHALSPGMLSMSFCLPGRLFLPSIWQACTLPEDSAPMSLLQEVIPAILGCDQEGFGHWDDFEA

SEQ ID NO: 933152 - protein, 174 aa, Homo sapiens
MLPVKWNITGIPYYTVGQLLRACLGPERVLTRADGFYKGHSLPSAPAPPPSLCVIFLPSCEEGHIYFPFCHDCKFPEACPDMRNCESIKHLSFINYPVSSSSLLHCENGLIQVGWDFPLLVRIIGKFLITKRLNYDVICGLGTDYLGLALFPLTAVSLTLWKMLRQLPILLGPF

SEQ ID NO: 933153 - protein, 140 aa, Homo sapiens
MTSRQNTAESTSNSFSPFPRRDMRTQALRCTGVRGVQTDSAYSEGDGMRNNTPKRRWLHFHREADKFQADTTMNIHQEKPDLTQQWMPWHCDNYSCFCKLFICLPPWLHFWNLGNRDNAFVMVLSPMLAESGAHEAVNSA

SEQ ID NO: 933154 - protein, 188 aa, Homo sapiens
MEIKLIPLFQSRYLSLLLLPEAPQPTGQLEENGNRKNKSSGFQNFIPEDGGLLCSADEVPGAFNELKRHLSEEASEVTDWFENNYVHSRIRRHLHNSDRHTQMKDPVETRRRWPFISQENKEASEETSPVDTLILGFLSPEFCEDGSDNFQAVHMSDQKLKLHQCVHYSTFKAPERVNRLEHSDISCF

SEQ ID NO: 933155 - protein, 2908 aa, Homo sapiens
MELTRMEWTGMERTRMEWTGMEWIERNGLERNGLEWKGNEWNGMEWNGLKWIRNEKNVMESDGMELNVLESSRTELNGMASNGMETKGMELNGLKLECNGMEWNGIEMNGMESNGMDWNGMDSNGIEWNNMEWYRMEWNTNGIESNGMASNGMDSNGMCSNGMESNGLISNGMEWKGMEWNGIEPNVMDFNGMETYRMDSKAMNGMDRYGKTSNGMELTRMEWTGMERTRMEWTGMEWIERNGLERNGLEWKGNEWNGMEWNGLKWIRNEKNVMESDGMELNVLESSRTELNGMASNGMETKGMELNGLKLEWNGMEWNGIEMNGMESNGMDWNGMDSNGIEWNNMEWYRMEWNVMERNGMEQNGMELNGMEWNGMEMECNEMERSGIEWNGIEWSEMEWNGRERMDWNKMKSNVEWNGMEWNGIEMNGMESNGMDWNGMDSNGIEWNNMEWYRMEWNVMERNGMEQNGMELNGMEWNGVDSNGMKPSGMESNGMELNGNEMEWNAVDTNGMDWNGMDTNGMDWSGMDTNGMEWNGMEWNGMEWNEMEWKGIEWNGIKSNEMASNGMDSNGMCSNGMESNGLISTGMEWKGMEWNGIEPNGMEFNQIMECNEMERSGIEWNGIEWSEMEWNGRERMDWNKMKSNVECNGMEWNGIEMNGMESNGMDWNGMDSNGIEWNNMEWYRMEWNVMERNGMEQNGMELNGMEWNGVDSNGMKPSGMESNGMELNGNEKSNGMASNGMDSNGMCSNGMELNGLISTGMEWKGMEWNGIEPNGMELNQIMEWKAIELNRMECNEMERSGIEWNGIKWSEMEWNGRERMDWNKMKSNEWNGLEWNGFEWNRMEQYGMVPNGMECNGTEWNGTEWNGTEWNGMEWNGVDSNGMKPSGMESNGMELNGNEKSNGMASNGMDSNGMCSNGMESNGLISNGMEWKGMEWNGIEPNVMDLNGMESYRMDSKAMNGMDRYGKTSNGMELTRMEWTGMERTRMEWTGMEWIERNGLERNGLEWKGNEWNGMEWNGLKWIRNEKNVMESDGMELNVLESSRTELNGMASNGMETKGMELNGLKLECNGMEWNGIEMNGMESNGMDWNGMDSNGIEWNNMEWYRMEWNNQMEWHRMEWTQMECARMEWIEWIDIKWNGMEGNGMEWNGIEPNVMDLNGMESYRMDSKAMNGMDRYGKTSNGMELTRMEWTGMERTRMEWTGMEWIERNGLERNGLEWKGNEWNGMEWNGLKWIRNEKNYGMESNGMESKGLERNRMERNRIDSNVMDCYVIDSNGMQSNGMHSNGMECNAMEWNRMECSGREWSGIKWNGMEWNGIERNGMESNGMDWNGMDSNGIEWNNMEWYRMEWNAMERNGMEQNGMELNGMEWNGVDSNGMKPSGVESNGMELNGNESNRMEWSNGMDRYGKTSNGMELIRMEWTGMERTRMEWTGMEWIERNGLERNGLEWKGNEWNGMEWNGLKWIRNEKNVMESDGMELKGNESNRTEWSNGMDRYGKTSNGMELTRMEWTGMERTRMEWTGMEWIERNGLERNGLEWKGNEWNGMEWNGLKWIRNEKNVMESDGMELNVLEIDSNVMDCYVIDSNGMESNGMQSNGMECNAMEWNRMECSGREWSGIKWNGMEWNGIERNGMESNGMDWNGMDSNGIEWNNMEWYRMEWNAMERNGMEQNGMELNGMEWNGMEWSGLKWNETEWMEWNAVDTNGMDWNGMDTNGMDWSGMDTNGMEANGMEWNEMKWNESNGMESNGMDSNGMCSNGMESNGLISTGMEWKGMEWNGIEPNVMDLNGMESYRMDSKAMNGMDRYGKTSNGMELTRMEWTGMERTRMEWTGMEWIERNGLERNALEWKGNEWNGMEWNGLKWIRNEKNVMESDGMELNVLEIDSNVMDCYVIDSNGMESNGMQSNGMECNAMEWNRMECSGREWSGIKWNGMEWNGMERNGMESNGMDWNGMDSNGIEWNNMEWYRMEWNAMERNGMEQNRMELNGMEWNGMEMECNEMERSGIEWNGIEWSEMEWNGRERNGLEQNEIERIDSNVMDCYVIDSNGMESNGMQSNGMECNAMECSGREWSGIKWNGMEWNGIERNGMESNGMDWNGMDSNGIEWNNMEWYRMEWNAMERNGMEQNGMEQNGMEWNGMEIKWNGIEWNGLEWNVLEWNGIEWIDINWNGMEGNGMEWNGIEPNVMDLNGMESYRMDSKAMNGMDRYGKTSNGMELTRMEWTGMERTRMEWTGMEWIERNGLERNGLEWKGNEWNGMEWNGLKWIRNEKNYGMESNGMESNGLERNRMERNRIDSNVMDCYVIDSNGMELNGMQSNGMECNAMEWNRMECSGREWSGIKWNGMEWNGIERNGMESNGMDWNGMDSNGIEWNNMEWYRMEWNAMERNGMEQNGMELNGMEWNGMEWKSNGMASNGMDSNGMCSNGMESNGLISNGMEWKGMEWNGIEPNVMDLNGMESYRMDSKAMNGMDRYGKTSNGMELTRMEWTGMERTRMEWTGMEWIERNGLERNGLEWKGNEWNGMEWNGLKWIRNEKKVMESDGMELNVLESSRTELNGMASNGMETKGMELNGLKWNGEESSGMEWNGIEMNGMESNGMDWNGMDSNGIEWNNMEWYRMEWNAMERNGMEQNGMELNGMEWNGVDSNGMKPSGMESKGMELNGNEKSNGMASNGMDSNGMCSNGMESNGLISTGMEWKGMEWNGIEPNVMDLNGMESYGMDSKAMNGMDRYGKTSNGMELTRMEWTGMERTRMEWTGMEWIERNGLERNGLEWKYGMESNGMESNGLERNRMERNRIDSNVMDCYVIDSNGMESNGMQSNGMECNAMEWNRMECSGREWSGIKWNGMEWNGMERNGMESNGMDWNGMDSNGIEWNNMEWNRMEWNAMERNGMEQNGMEQNGMEWNGMEWTQME

SEQ ID NO: 933156 - protein, 1256 aa, Homo sapiens
MESNGMESNGLERNRMERNRIDSNVMDCYVIDSNGMESNGMQSNGMECNAMEWNRMECSGREWSGIKWNGMEWNGIERNGMESNGMDWNGMDSNGIEWNNMEWYRMEWNAMERNGMEQNEMELNGMEWNGMEIKWNGIEWNGLKWNVLEWNGIEWIDINWNGMEGNGMEWNGVDSNGMKPSGMESNGMELNGNEKSNGMASNGMDSNGMCSNGMESNGMISTGMEWKGMEWNGIEPNVMDLNGMESYRMDSKAMNGMDRYGKTSNGMELTRMEWTGMEWTRMEWTGMEWIERNGLERNGLEWKGNEWKGMEWNGLKWIRNEKNVMESDGMELNVLENGIEWNGFEWNRMEQYGMVPNGMECNGTEWNGTEWNGTEWNGMEWNGVDSNGMKPSGMESNGMELNGNEKSNGMASNGMDSNGMCSNGMESNGLISTGMESKGMEWNGIEPNVMDLNGMESYRMDSKAMNGMDRYVKTSNGMELTRMEWTGMERTRMEWTGMEWIERNGLERNGLEWKYGMESNGMESNGLERNRMERNRIDSNVMDCYVIDSNGMESNGMQSNGMECNAMEWNRMECSGREWSGIKWNGMEWNGIERNGMESNGMDWNGMDSNGIEWNNMEWYRMEWNAMERNGMEQNGMELNGMEWNGMEIDSNVMDCYVIDSNGMESNGMQSNGMECNAMEWNRMECSGREWSGIKWNGMEWNGIERNGMESNGMDWNGMDSNGIEWKNMEWYRMEWNAMERNEMEQNGMELNGMEWNGMETERNGTEWNALEWKGVQWKGIEWNEIEWNGIERNRMEWIVMERHRMEWNGMERTRMEWTGMEWIERNGLERNGLEWKGNEWNGMEWNGLKWIRNEKNVMESDGMELNYGMESNGMESNGLERNRMERNRIDSNVMDCYVIDSNGMESNGMQSNGMECNAMEWNRMECSGREWSGIKWNGMEWNGMERNGMESDGMEWTGMEWIRMESNGTIWNESNGMASNGMDSNGMCSNGMESNGLISTGMEEWNAMKWNEVESSGMESNGVKWNGMDAKGMDWNKMKSNGRNRTERKEMERNGMHSNGKEIDSNVMDCYVIDSNGMESNGMQSNGMECNAMECSGREWSGIKWNGMEWNGMEWKGMEWNRMEWTGMEWIRMESNGTIWNEWNAMKWNEVESSGMESNGVKWNGMDAKGMDWNKMKSNGRNRTERKEMERNGMHSNGKESNGRESNGMKSNGMESKGIEWNGWLWKDIEWNGIDSNGMDWNGTDSNGMDWNGMD

SEQ ID NO: 933157 - protein, 1334 aa, Homo sapiens
MERKWNGSLWKDIEWNGMELTRMEWTGMERTRMEWTGMEWIERNGLERNGLEWKGNEWNGMEWNGLKWIRNEKNVMESDGMELNVLESSRTELNGMASNGMETKGMELNGLKLEWNGMEWNGIEMNGMEWNGMEWNGMDSNGMEWNNMEWYRMEWNVMERNGMEQNGMELNGMEWNGVDSNGMKPSGMESNGMELNGNESNRMEWSTNGIESNGMASNGMDSNGMCSNGMESNGLISNGMEWKGMEWNGIEPNNGMDGYGKTSNGMELTRMEWTGMERTRMEWTGMEWIERNGLERNGLEWKGNEWNGMEWNGLKWIRNEKNYGMESNGMESNGLERNRMERNRIDSNVMDCYVIDSNGMESNGMQSNGMECNAMEWNRMECSGREWSGIKWNGMEWNGIERNGLEWNGFEWNRMEQYGMVPNGMECNGTEWNGTEWNGTEWNGMEWNGMEMECNEMERSGIEWNGIEWSEMEWNGRERNGLEQNEIERIDSNVMDCYVIDSNGMESNGMQSNGMECNAMEWNRIECSGREWSGIKWNGMEWNGIERNGMESNGMDWNGMDSNGIEWNNMEWYRMEWNAMERNGMEQNGMELNGMEWNGMEIKWNGIEWNGLEWNGLKLNVLEWNGIEWIDINWNGMEGNGMEWNGVDSNGMKPSGMESNGMELNGNEKSNGMASNGMDSNGMCSNGMESNGLISTGMESKGMEWNGIEPNVMDLNGMESYRMDSKAMNGMDRYGKTSNGMELTRMEWTGMERTRMECTGMEWIERNGLERNGLEWKGNEWKGMEWNGLKWIRNEKNYGMESNGMESNGLERNRMERNRIDSNVMDCYVIDSNGMESNGMQSNGMECNAMEWNRMECSGREWSGIKWNGMEWNGIERNGMESNGMDWNGMDSNGIEWNNMEWYRMEWNAMERNGMEQNGMELNGMEWNGMEYRMESNGMQLYGMELNGMESNGMDQNAVDWNKMDSIVMDCNVIDSISNGIAWNNGMDRYGKTSNGMELTRMDWTGMERTRMEWTGMEWIERNGLERNGLEWKGNEWNGMEWNGLKWIRNEKNGMEGMEWNGIERNGTESNGMDSNGIEWNNMEWYRMEWNAMERNGMEQNGMELNGMEWNGMEWSGLKWNETDGMESNGMELNGNESNRMEWSTNGIESNGMASNGMDSNGMCSNGMESNGLISTGMEWNGMEWNGKWNGIEPNYGMESNGMESNGLERNRMERNRIDSNVMDCYVIDSNGMESNGMQSNGMECNAMEWNRMECSGREWSGIKWNGMEWNGIERNGMESNGMDWNGMDSNGIEWNNMEWYRMEWNAMERNGMEQNGMELNGMEWNGMEWTQME

SEQ ID NO: 933158 - protein, 1010 aa, Homo sapiens
MELTRMEWTGMERTRMEWTGMEWIERNGLERNGLEWKGNEWNGMEWNGLKWIRNEKNEWNGIEWNGLEWNGFEWNRMEQYGMVPNGIECNGTEWNGTEWNGTEWNGMKWNGVDSNGMKPSGMESNGMELNGNEKSNGMASNGMDSNGMCSNGMESNGLISTGMEWKGMEWNGIEPNVMDLNGMETYRMDSKAMNGMDRYGKTSNGMELTRMEWTGMERTRMEWTGMEWIERNGLERNGLEWKGNEWNGMEWNGLKWIRNEKNYGMESNGMESNGLERNRMERNRIDSNVMDCYVIDSNGMESNGMQSNGMECNAMEWNRMECSGREWSGIKWNGMEWNGMERNGMESNGMDWNGMDSNGIEWNNMEWYRMEWNAMERNGMEQNRMELNGMEWNGMEWNGVDSNGMKPSGMEPNGMELNGNEKSNGMASNGMDSNGMCSNGMESNGLISTGMEWKGMEWNGIEPNNGMDRYGKTSNGMELTRMEWTGMERTRMEWTGMEWIERNGLERNALERKGNEWNGMEWNGLKWIRNEKNVMESDAMELNYGMESNGMESNGLERNRMERNRIDSNVMDCYVIDSNGMESNGMQSNGMERNAMEWNRMECSGREWSGIKWNGMEWNGIERNGMESNGMDWNGMDSNGIEWNNMEWYRMEWNAMERNGMEQNGMELNGMEWNGMEMECNEMERSGIEWNGIEWSEMEWNGRERNGLEQNEIERIDSNVMDCYVIDSNGMESNGMQSNGMECNAMEWNRMECSGREWSGIKWNGMEWNGIERNGLEWNGFEWNRMEQYGMVPNGMECNGTEWNGTEWNGTEWNGMEWNGVDSNGMKPSGMESNGMELNGNEKWNAMKWNEVESSGMESMDEMEWNGRERMDWNKMKSNGRIVQNGKNGTEWNALEWKGNGMDRYGKTSNGMELTRMEWTGMERTRMEWTGMEWIERNGLERNGLEWKGNEWNGMEWNGLKWIRNEKNVMESDGMELNVLESSRTELNGMASNGMETKGMELNGLKCYGI

SEQ ID NO: 933159 - protein, 143 aa, Homo sapiens
MRDTDDPAPTEASLLLPFAYLNLPLSFCLPAQTDLWPFRHPCGPSTRDTGTIGWIPKDLPAAPMLCVGAFPKSHKHPGLEPVALALTLGVPCGLLGRETPPWDYPAPTQSSLLLLSACLNIPLSFCLHVLALLHPHCLPMEPS

SEQ ID NO: 933160 - protein, 146 aa, Homo sapiens
MPNRSPWVSAWALGVAALWSTSQDGARQPSTTVANISKADPDGVAACDRNTQTVSRSLLEAENAAPPRQLHRNRSPKVSLHRLRQNQKTTNGVWVFEDASQKEKEETGLGRGSPTFLGFYVGLSQMLNVTNYTASITSFDQPPVDF

SEQ ID NO: 933161 - protein, 138 aa, Homo sapiens
MHGKITPSYPTSAREKNEGKNGERRFTNAMKSGTATQWSYWAPGWLGSVCKESYDVICVQVSQLWILASALVEAYLSSDTPWVRLAVAAVGDGNVVPRPMELCSQGVMAVPEASLRSPVKWRRAGSHRPHPAPTQLTP

SEQ ID NO: 933162 - protein, 143 aa, Homo sapiens
MRQLLQEPADTLKKNLSEPSLEATPHCHINLEETQDSKKELATALSSCIISFMQFDDLTAELEAVSLQCVYLAENNQVTQQELSMKKVQQECEKLEENKKMLEEGIVNLMTHMEKYGRTCLKGCVEDRKKKPHLQCLGHNVRG

SEQ ID NO: 933163 - protein, 170 aa, Homo sapiens
MHHLEICPFIPRSLSRTAYSQCEITPGTGRPDHFCPIWDSSNECLPVGLADTVQPASHLKLCCSILFHPSSSFIDSGYSRPWVRLSTLLASDLTQQSPSGSGHRSAYVTPPPIPVSIEQRDRLCLGESKGREQESWPGNSENSSKSYLRPSRQYVYKFARTTVFLALGAL

SEQ ID NO: 933164 - protein, 136 aa, Homo sapiens
MHHDQVEFIPGMQGWINIHNSINVIHHINRIKDKKHRIISIDAEKLHLIKCNIYSQQKTVNKLEKPKDHQNTVRSDKQIHNDIIPEFCIQFWTDDYTRELANLCLSFLEWIDESSKNYHLKKDDEIDDADIIAHFS

SEQ ID NO: 933165 - protein, 129 aa, Homo sapiens
MPGFINTLVFTGSEVCPALEWKHNAWCKQSREDYQLCEFAANVWMELGLLSHSGVDVNKESQNLCFCSTLPSPRMSFTINVFCCILNLMKSFIVSHLYPTQHKAGICGKYRKITRNTIALVIQALFDSI

SEQ ID NO: 933166 - protein, 157 aa, Homo sapiens
MVGIWTVENTSLTSPLSICTRDYSSFSFYSRSRGTCTFVTQSIKETSFADTTTATKTPGVFSGSFYSLHRKPITETMSITKEEGSNWKRQRRRKGASYVASGKIACAGKFPSIKPSGLVKPIHYHKNSTGKTQCHDSITSFQIPPTIHGNYGSYNSR

SEQ ID NO: 933167 - protein, 159 aa, Homo sapiens
MSMPTRRALFQVWKVIEIDKQISLCAHWVATWVHEMRGHEGTAAVQRWAESKYVSIAPSQAHNANKNCSVCQQERQKLQMAMGQIPWWEGPKHSWQVRLMLVALGGYKWVLTGIDADSGLAFAYPVEDANAQSAVKESEQNILHTFAQAAVISSDQGTH

SEQ ID NO: 933168 - protein, 282 aa, Homo sapiens
MLLLLPLLWGREGVEGQGQQENGYTLQVQREVRVQEGLCVHVPSSFSHPQVALTNSPQVHGYWFQEGADTAQDAPMATNNPKRKVKKETQGRFRLSGNLQMNDCSLSIGDARRKDQGPNISSLGTMESGRPGNLTCSVSWALLTLIPKPQDHGTNLTCQVTLPEAGVTLTRTVQFNASFLEGQSLRLVCAVDSNPPARLSWTQGSLTLSPSQSSNHGLLKLPRVHARDEGEFTCRAQNPRGSQHISLSLSLQNEGTGVMLGVVGGAGATALVFLSFCVIFIV

SEQ ID NO: 933169 - protein, 157 aa, Homo sapiens
MILRVTLRILISLPRGTPGDLQLEGRAWADLVPSARPQTSTWRLQTHNPHCCPSLPAFGSTQREQLGQTRHPDLPTASLPAVPWDMCGCVFKGKDNCRGSEVGPLPAEGRFRTAPGCPSELCELGKYQYTYQTNLPDHGHKPVCKEELTPHYSENHR

SEQ ID NO: 933170 - protein, 178 aa, Homo sapiens
MQALLSLQLTLSWHWSYAVLCYLADGVRCAWCAHPAGHDGTHRTLPQYLSPADSRFIFPEGQRGGVQPALSMNDCLLGFLAGDIPSASPHPHEVTTPQGPGLDPPGPKPENCKQLTRELGEPGLPGEVGMRGPQGPPGLPGPPGRVGAPVSEGTCLGRGSTPSPGIKNQVLASSSTCI

SEQ ID NO: 933171 - protein, 156 aa, Homo sapiens
MFPGSGRLHAEFDLGSCIVSRMGPVLTHVSTEDWPRAMLQVPAHAGKTQSPALLRGSSSNPTLRYTGIEIRPLLPPAPELHSNSRSCVPRASVTPNATFMSSPCEGRSRGPTERADQQTNLQKHVKALGRGNAHMAESNRRTLPLLPGSSHEGAST

SEQ ID NO: 933172 - protein, 144 aa, Homo sapiens
MKEAAAAGVQGERGLDGFPGKPGDTGQQALISLRKGSFVFSECVIHAAEPAQLQMRKHGDRELRLVEEELSSNKHSPESQGRPGPSGVAGPQGEKNQNPENALEGGTSNYAEMFVVSVQGDVGPAGPPGVPGSVVTAETEKPQP

SEQ ID NO: 933173 - protein, 316 aa, Homo sapiens
MHLVNVSQCLGDWPRPTWDLSGTPQDSLSGRKIKSCQTVTHVKSRCKANIRLQEGKPVKEILGKRENGAQSSYVRMGSFPVVQSTEDVFPQGLPDEYAFVTTFRFRKTSRKEDWYIWQVIDQYSIPQVSIRLDGENKAVEYNAVGAMKDAVRVVFRGSRVNDLFDRDWHKMALSIQAQNVSLHIDCALVQTLPIEERENIDIQGKTVIGKRLYDSVPIDPRFQATGEKPWELSALSVLHTCMNQFDLQRIVIYCDSRHAELETCCDIPSGPCQVTVVTEPPPPPPPQRPPTPGSEQIGFLKTINCSCPAGEKKARP

SEQ ID NO: 933174 - protein, 143 aa, Homo sapiens
MRAPPLWMRLGAFRKGLDGGAKKFIASGSSGKACIQIAGKGTWLTINVFHIVFIASHLHLAFIDVVCAKPIEKPAGQQQASTILCSIICQANLHTIFWQFVCVCCADYHIPLYTGISNLTNDISVDNSNIGFFLVSASIDFLI

SEQ ID NO: 933175 - protein, 139 aa, Homo sapiens
MKGTWRFKSMTAPGPLAKVLTAHTPGRSNRTVSSDVTDTGRSDLWKQAWTGEQFWIFHGENKELEEGGSAEALRRGRTWDPHKDRLCFFHVLLGAKLTFSCVADSLGYMMENRISGLKCDTDVFATFEGDDVVMLQWLY

SEQ ID NO: 933176 - protein, 144 aa, Homo sapiens
MISFDSLSHVQITLMQEVGSHGLGQLCSPGFAGYSPLPQLLSQAGSECSFSRCMVQAVSGSDIIGSGGHSSTRQYPDGDSPSKLFQPLPITQFQSHWICLQQHNTLLGPIYSISPFHAADKDIPKARYWVNGDCPREQVNPVER

SEQ ID NO: 933177 - protein, 143 aa, Homo sapiens
MIPKAKISWTSLKLKTSVLPRMSSSRKLKKIIKKVKRQSTEWEKIFANHISHHGMISGIYKELIQLTNKKINNKILNMDKESEQTFLQRRSIFTLAKKWKQPNVHQLMNGLIKCGIGIQRNTIWNIKRNEIPIHAVTHLNLEN

SEQ ID NO: 933178 - protein, 159 aa, Homo sapiens
MCLTCSRSPRHELESLSPKLLVSALKIWIEFWPERKALGYPRHSIFCTKIHRGELSTHTDLFPKTSKQVGDSKQCLSPGQAQSGHSEKVQMTKVMHRHPSLLLQLRWSLFLGLYTGLENGYSRLGAVAHACNPVIPALWEAKANGSLEVGSSRPAWPTW

SEQ ID NO: 933179 - protein, 138 aa, Homo sapiens
MSPKHKSRDAGNWDMPKRSHKVFPLGKKVKVLDFIRKEKQSYAAVAKIYRKKESSTCEIVKKEKEICASFAVTPQIVKDKPIRPFLRPSKARSIGVTVIGEQVSWEVRVGNRGSFLLPETDVELSGSSASRLSFPFSR

SEQ ID NO: 933180 - protein, 235 aa, Homo sapiens
MSKSESPKEPEQLRRLFIGGFQHQAFRREFWVCHYAAAEEVDAATNARPHKVDGRAVEPKRAVSREDSQRSVAHLAVKKIFVGGIKEDTEEHHLRDYFEQFGKIEVTEITTGRGSGKKRGFAFVTLDDHDSVDKLVIQKYPTVNGHSCEVRKVLSKQEMASASSSQRGRSGSGNFGGGGGGDFGWNDNFGHGENFSGYGGFGGSHGGGGYGGSGDGYNGFGNDGSHFGGYNDFGN

SEQ ID NO: 933181 - protein, 133 aa, Homo sapiens
MDSTKMKDQDFGELKTRTATVRKSQILVHRHLIIYAIVIEKLIFEGLNASPNGESLELTEGNSAWGNTLISHLRKGVPCPKTVAKKEKAGGMLKEGIVVIGEDSSMRVIAPENLPVGQDVEVEDSDIDDPDPV

SEQ ID NO: 933182 - protein, 136 aa, Homo sapiens
MWLPAEEADILRFHTHSCTELEGERGETQLGGQGLISVLQGVCSELLGHQYQPVPPSEEKEKEDNGTQKNKNDKKRSVSSMRLKNPIQIWQSMVISENDTHFEGCSFSQTSVRLRTSPTADMIDQRKHLALSEVHD

SEQ ID NO: 933183 - protein, 284 aa, Homo sapiens
MWIFLTEQRAGGRGIDLPREVPRSEAVTLTVKVCGFTPKVSKTMNPPEGRSSGHIWTSEGTNSRHTIFKNCNTHSEGQSNFSPKWSPSSCATATVSRMPTLGSPPSFTPPPAPGMPPVNPLAPDMVGPGVIVDKKIQKKMKKFPKKYLGLQMCATDGSSGPSGAATAITPAAAGKAREGGGQPTILETTMMGPATTECWGHRRSLWQHRPCPECQRRPSEGLEPLSQETREHDWVPGSMEPVGIGDKWELCPFQVGRAGAPQVQLQIPKPWLKLRHPCSLGSWE

SEQ ID NO: 933184 - protein, 143 aa, Homo sapiens
MLGASQQCLSHPRSPQGCPRRAVKNQTLEKSACVSHGRPPQVKTNCRVVGVGHRNFKVCPGWAITPQALEHDDYVSQKAPKAKTGQQNGVVRPQGPMGTLRQAEGRCGQTTRNAGSPPRRPLPSQKPPGLSWAGCKPPDFGEG

SEQ ID NO: 933185 - protein, 140 aa, Homo sapiens
MGARALGSIPGCLFLSKQDTKGSGKAAESRGAHPGLDLQPGIWPRVTVWGRAPMGGGGATDMPMRDGRNSGAFEADRGEKYQGLSGVNESLTQGPHGPWWGHKRGCVGRGPPRVTVWPQCGLYGWGETQGYVEAGRGEKR

SEQ ID NO: 933186 - protein, 167 aa, Homo sapiens
MNGLLLLAFRHDYEAYTATWNYPKVHYIILMPLHPRSLAPIYKKERGLMDSQSYMAGEASQAMGRRQRRSKITSYMASATDICIFTICYICQMYHHHLIHFIHHHQIHHHLIQSNDAIIITVSLQHFLSAFRFQGTPLTGTPDVYKKLLGSKHIKDWINMNSIFYNT

SEQ ID NO: 933187 - protein, 129 aa, Homo sapiens
MLSGKCHLLAGGQPAQKQSIKPPKLGTFTESIVPTPPPPLEQALVSMAETHRQFTSQDSVQTTLSISPKLGRLAGWLDLEEATSTGKGGEYYIKGIPHGTKESEQQPSALDLPSDRAYPNEKETENQPW

SEQ ID NO: 933188 - protein, 145 aa, Homo sapiens
MGCRFHSEQIRKLKDMTQKVGGQRDFLSPDLGKMFDGVHTQHSSHWLHHSHTKGNDRTWIEVSEKVPIRIKSTSMKSVFTCGSECGLELPEVYGLTIIGTEHTHRTLLLFNLQAVGGKEHRKFNSKLQLLLIRLDMYAWTIRFVT

SEQ ID NO: 933189 - protein, 163 aa, Homo sapiens
MPPLRAVTLTARVCGFIPGVGKTTNPLEGTKSGHTIFKSCNTHREEEEVSQGLNYERRGVQETVKLEYEENHLNGYLMSRDVILKEHRWRSAYSQELAAGCRCNLCPTPHGSQMSEVGSEVSLVGGTCFFKLSAWEKSHFMSDNFLEVSICLFNQIGGKDRLV

SEQ ID NO: 933190 - protein, 145 aa, Homo sapiens [sequence omitted]

SEQ ID NO: 933191 - protein, 146 aa, Homo sapiens
MVKKDNNLISYHFYPNALTALWQTISTCHSGQRVLYGVLVHDHLSQLSKEFEHYSPTTKDPRTKKEWIRAPSVNKPGESILSVLEKDQLFEIAHDSGLKMTTTKMRLQSTLDISKTLRCYCLPSPPNGTVLLQEKKLRAPTVSTLW

SEQ ID NO: 933192 - protein, 135 aa, Homo sapiens
MHTQKAERTNARTLVTQMASVKNPPNDGTKVWDYMKRQCLRIFGIPEREGKKVNNVENIFQNIIHKNFSNLAREANIQIQEIQTTLTRFYTRRSFPRHIIIRFSKVKMKERMLRKIERAGYLQKDPHQTNSGPLN

SEQ ID NO: 933193 - protein, 160 aa, Homo sapiens
MCCMVLRNLLSLEFYFYCAAIQQYVWYNFSYLDLMKIILCLIMWSALESSAERLSVAPGVSVLEVAELLPTQLPQQGVPVFKLTNSFTCLINSAGEEPHLIDIIVPHPQIGPKDSLVSCPNWVVSFKSSGYFLAKGVSRSFIQELAWNGDLRTLPTALGY

SEQ ID NO: 933194 - protein, 153 aa, Homo sapiens
MKTDNDIKMTPYGTLKKDRISLCYRGWKYSSVITARYNLALLGSKKPITHSEGFPQYQKCNYYQILDNIIRIQGSNAPAATNCYGDRWLQAGLTVPDPSSEKVGRLKPSSLKSSKSFSVQLCSVAGPSAAGLLEFTGGPLQTLFVWVSAAEAA

SEQ ID NO: 933195 - protein, 150 aa, Homo sapiens
MPETYQKLRKWQSYTDLVQLLFSPHMWGTEVITVMVALREAEDHPQDRRVHAIKKGKVHPLQVTTPQDKKGPQQVTCMQRSIDLIAGGVAQEKIGSPPMECCWLYGSNCPRATIPENAQEGTKQCCLTQPRLDAAAQLFADRRRDWALPV

SEQ ID NO: 933196 - protein, 160 aa, Homo sapiens
MTSLCVHMLRVALTPAPCCVCPLQTLDANDHEKEAKGELRAAWCRPSDTPWHEQPGNCRQDVDDSRRQTGSWAKRGSQELSRCQNDLPAEKSYPLSISSQLRSEQKSGQPAYSEELPTVGLLSAESCILIGMTCLQQPCHKKPQGLAKLNLDFWTSAFPR

SEQ ID NO: 933197 - protein, 140 aa, Homo sapiens
MSLGKPNTMLDLEGMLIKFNLIDTNTEERQFYNQYRILFLKKVKKHKHSLLGAAAGREVVMGEAVLLRAHAQEAMASLQSSSNNRRWRPGQKTWKISLFRGNSWSPSETIGTIQPSPGDDERPLEPEVATPGEAPLSNQP

SEQ ID NO: 933198 - protein, 155 aa, Homo sapiens
MYAKFWCLLLAFCPHSITMRTKAQGRKIGDCGSENPWVNCEGRPEKLHGRGTEYMLNTDLGPRIQSTKFFDAVRSFLVDTEFDSSCQIVPCDWSTHNSDGGNSGRGLGVNCCECEKVLPAHAKALVKASCKCHTLEIVTVLSVLFAAFLGWNAVE

SEQ ID NO: 933199 - protein, 141 aa, Homo sapiens
MAHGSGDVEALGCGPGMRIKVRPDPELSLAFQTNTFSAFWMIPCGCLMNTSNTTNTTCPLTLQTHTSVKRCSDFSVALAQDLGVTPEMFYHDPYLTHQQNISGTTVVTLVLETNACCVGTKKKKYHLNINLIFSASQSLLL

SEQ ID NO: 933200 - protein, 138 aa, Homo sapiens
MSPGEGAQLLSGCASLTEPVAACCCGTAVSVRLPSSTVTEVQSDSFYGKDMCISLSGVLPLKKDFQKSLPPGLRFSSRQCEEHLGAKETIHRVNRKPTEQEKIFANCTFKDDLISRVYNKLKQTNRQKTTPFKSGQRT

SEQ ID NO: 933201 - protein, 145 aa, Homo sapiens
MMTHQRCQISHPCHLWVKGIDDMNDIKADDHLILIWVDYFGLPGKKQHKKELTGIAGLEGGGTGHEPTNALVSHTSLIYSGPLIGNDFTKTEPWDCVLPLCYKGNMNKKGYDRGPYNVIAFFLRLKQALVGKENMNSRSCHLLIL

SEQ ID NO: 933202 - protein, 142 aa, Homo sapiens
MFEKLKLTYLKLLTYGDLVYQLVQAFYTTCVTLPYLRCQRRGREQEPGFLEAAAALSDQLTGCCDVSLLIGDLSNLLMNVFSTISFPLKTSWLYPIGFGDEINRDLQQIGEQQLKNRGYTAKDINAHSISDHYLLHTMFAKY

SEQ ID NO: 933203 - protein, 145 aa, Homo sapiens
MNEHYKDSLKVVSANTHAFEEISRHSVWCYLAPEDSRLTLAVSVSAGARNRAFLPVSSPVRDPAEKRTPIVSGRCASVPLSLSSAGLVLHATGLAVPHGALFHSPHDSSLSGEKQNGKEREELLKLERQCNFNASTDGLFYMFPI

SEQ ID NO: 933204 - protein, 135 aa, Homo sapiens
MSTDFNVKSATALVPNKKVIISFQVLKSGIDFSFLAMDVLFGIFFQQKAVLFTPKICLKPKCLIVKVDDHCPCSMPMFFKFKGIVKYFLNVAQWSQGFHTRYGYSESIRTENGSRKRKKRVEDEREGSEIKAFSM

SEQ ID NO: 933205 - protein, 146 aa, Homo sapiens
MTSSHLLPTLLLCFVHRVSQWTDCQRLGCQEFGVSRKWTKLYDQNKHFGEFKFAFPDTTPLSSLPLNLRGIQTSVSAGVSYRAQPKVYVFKRNVLKHWARVTVWWFILKGLSCVCKSVCECVCMSAYVCEYVCVCVNVYVCVCVCV

SEQ ID NO: 933206 - protein, 301 aa, Homo sapiens
MAFGIFSLFAPVSSIFMDFSTFVLLVFVSLDTVFRHRHIEHCHAFVENWPLYHYVMSFCVLEEISCLKGALSGVNAVTAACFGLVLAWFTLLYELHCAPGETAEQYSEYPGKECIERRCRDMRQQDFSLRGVRLAGHRQEKEGQVQLIKEVEGREQLLRVVTCGPPPRTGPPSLTGHFPRLVYLLDWSTFSNWSLPQTGLPPGLVHLPGLVHLLGLVTSPDWSTFSNWSLPQTGLPPGLVPSLDWSPPRTGPPPRPVTSLDGLACTASWQLQAHWGLEPTCPPGVSSPSPHPTLSHWSQDP

SEQ ID NO: 933207 - protein, 154 aa, Homo sapiens
MYTSVFPVGVPQSKELPGLRVWHFVEPQPLQLVELHADVLNGELQHVPVAGQVLRRVAPLIQWGFKRVRGGSGGSTFNWICLWFQQCTLSMLSEEHAERTALRFLTQSQDLGPPAALRAAEPGRARLCLMVWGKRNGFSSLARSWVVLVTSPGG

SEQ ID NO: 933208 - protein, 367 aa, Homo sapiens
MLNLAAAVFRAHVWSGAPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADNHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQLFQMPPVRGTMWPLSVCAGLILLCSFFQLTCVVENGRSPSFKD

SEQ ID NO: 933209 - protein, 199 aa, Homo sapiens [sequence omitted]

SEQ ID NO: 933210 - protein, 392 aa, Homo sapiens
MFLFPIPKQILGFTFAHVTYCLTLNSPYIYGRWSSTDCPTLDRPYVHGRWSSIDCLTLDSTYVHGRWSSIDCPTLDSPYVHGRWSSTDCPTLDRPYVHGRWSSIDCLTLDSTYVHGRWSSIDCLTLDSTYAHGRWSFIDCPTVDSPYVHGRWSSTDCPTLDSPYVHGRWSFTDCPTLDSPYVHGRWSFTDCPTLDSPYVHGRWSSTDCPTLDSPYVHGRWSFIDCLTLDSTYVHGRWSFIDCPTLDSPYIHGRWSPTREIYFRFHSVVKMTMLFPHLQNENARPVTFMFAVALSILTKAPERREPTQSDRWEAVPFLVPPSSCSTLGPATKLDLPILDSTFTEWPRHHKLMTFLSSSEDATIRSSRTAEFLWKPDIWGNEAGKVPTADLHFL

SEQ ID NO: 933211 - protein, 172 aa, Homo sapiens
MKSQQPTVVEETVREDASSPGAYGFLLTEELQVAGDVTPGSLPRGGNQSWAWKDDRQQGGDGEQPTSSQRSEEEENCQGNKAFRGQITKDLHWDQANPCNQRVEGLKQKAETSGSDAEWVSASHFLHGCKNFRKCTVMQPPPKPRHAALPLTAVLSSCCPLLSEPCLKNFLS

SEQ ID NO: 933212 - protein, 223 aa, Homo sapiens
MVPATVIGGAGQQCHGVKIYLPSTEQCHGVKIYPALRRTVPQVDNGMGAIGRVDLCLLSGQWHGGHGQSGFVSVDNGIGATGRVDLCVLSGQWHGGHGQSGFVSAEWTVAWRPQAKTDLCLLSGQWHGGHGQSGFVSTEWTVAWGPQAETDLCLLSGQWHGGHGQSGFVSAEWTVAWGPQAETDLCLLSGQWHGGHGQSGFVFAEWTVAWGSTGRVDLCLEQE

SEQ ID NO: 933213 - protein, 167 aa, Homo sapiens
MAPLRSRKTPTEQQSLAHPLRQSPVPSTHGASCRRLTDSEEDMLPSELTVPFFPRTPTPRIRSTLVAFSSSSNFSMECCFPGFYSPQPLLFWHQNLSLEKRPAKLTKTEYEWIPVASMEEPPRCVLLLGVEDCVEDSVGRTVWKKDSQPPTWLFNGGSALSGLVKKS

SEQ ID NO: 933214 - protein, 162 aa, Homo sapiens
MSTPAVGLTDPEAELLDTSKEKGKLETFWLRPATGRLCPRAVPADPGSSMVCDVLITTAEAFGESPEQPSRHSKEVHADSESSGTTLGTNSMMTILQIRKPRLSLLAPDHKSQSLDLSKSSLHITADGKLCSLRVQRAFAKGSQDRLSAEHIPIKGGISRFP

SEQ ID NO: 933215 - protein, 160 aa, Homo sapiens
MPFPGSDCGTVVQFSGVRYTHCRATTTTVLLQNLLSSANCPSAPVHQTANLNAVMCVSRGRAQAGVTVHQVLRGRAQAGVTVHQVLRGRAQAAVTVHQVLRGRAQAGVTVHQVLRGRAQAGVTEHQVLRGRAQAGVTVHQVLRGRAQAGVTVHQVLRGRA

SEQ ID NO: 933216 - protein, 768 aa, Homo sapiens
MPANVVLGALSWVHVFGALSWVRVLGALSWVFVLGALSWVRVLGALSWGLCRVESVAAHFAQSPLELRAQALWVAGGSVQTTAFRVPPALPSHLAHGRDTAVNPPERSSVTFSEQLLSRLGGHVGKRRNKNIPDYFMLLWRGKAARVLSVRGKAVRVLSVRGKAVRVLSMCGTAVRVLSVRGKAVRVLSVRGKAVRVLTVCGKAAWVLTVRGKAARVLTVRGKAARVLSVRGKAVRVLTVRGKAARVLTVRGKAVRVLTVRGKAVRVLSVRGKAARVLTVRGKAARVLTVRGKAVRVLTVRGKAVRVLSVRGKAVRVLSVRGKAVRVLSVCGKAARVLSVRGKAVRVLSVRGKAMRVLSVRGKAVRVLTVCGKAARVLTVRGKAVRVLTVCGKAVRVLSVCGKAVRVLSVRGKAVRVLTVCGTAVRVLTVCGKAVQILSVCGNTVRVLTVCGKAVQILSVCGNTVRVLTVCGKAVQILSVCGNTVRVLTVCGKAVRVLTVCGTAVRVLTVCGKAVRVLSVCGKAVRVLSVERPTCASCVWRGKAVRVLSVRGKAVRVLTVCGTAVWVLTVRGKAMRVLSVCGKAVRVLTMCGKAVRVLTVCGKDVRVLRVAWKGHAGPECAWKGRAGPDCVWKGRAGPDCGKAVRVLTVCGKAVRVLSVCGNAVRVLTVCGKAVRILTVCGKAVRVLSVCGTAVRVLTVCGKAVRVLSVCGTAVRVLTVCGKAAVRVLTVCGKAVRVLTVFGKAVWVLIVCGKDVRVLSVCVERPCGS

SEQ ID NO: 933217 - protein, 196 aa, Homo sapiens
MIIIIIITIISITIIILITTIIPIPIILTILTIITIIIITITIILTITIITIILTITIIITVILTPIILTITIITIILTITSSSSSPSPPPPSSSSSPPSSPSFSPPPSSSSSSPSSPSFSPPPSSSSPPSSPSFSPPLSSSSSSLSISSSPPPPLYLLIMSHTVITGYYVLITNDYSRDSLPLLLTPIWSIISSF

SEQ ID NO: 933218 - protein, 142 aa, Homo sapiens
MFCASLGRICVLLLLDEVAYRCQIQLIDGITQFNPVIAEFLNFCLLDLSITESRYSKSPALMVDSSIPPGSSTMSSVPYLTVDTFLYLLKSAAEPLERSVLRHFFHTYPGLQRAQGPLEVKAAGLPRPFLNTHIDLVYAQLC

SEQ ID NO: 933219 - protein, 146 aa, Homo sapiens
MGGPWTHYIAMLGSHSPVTAAPSPNLNTALLPPPGHRISDCTQSCDSSTFSQPKCRPSPSSWPRNQRLHPAHVTAAPSPNPNATLLPPPGHRISDCTQSCDSSTFSQPKCRPSPSSWPRNQRLHPAHVTAAPSPNPNAALLSPPGH

SEQ ID NO: 933220 - protein, 196 aa, Homo sapiens
MVWLRTHPNFILNCSSHNPHMLWEGPSESKETGGILPCPRDLWNFELERDNLGYLAEEISKWEIIQEEAEHKSLENLQPDEAIEKKSPVFREKFKPTAETCIKDVWKCLDVQVEVCAEVEPSWSISARSIQIGKVGSEAPHWVPTEALCNEAMRRGPPCSRPQNGRSTNSLHCAPVKATDSMPACDTSQERIGPTW

SEQ ID NO: 933221 - protein, 158 aa, Homo sapiens
MQIFRYFSHPMGSLQYCCIEFPHEEPAIYTEGECTCLLAQRSKSPMYGTPSGHTLRNRQSYMQFRGIPEEGIVITGDDGSVCVVAPEDLPVGQDMEVEDGDVDEPDPVMYSHHQGTLDCICIATEVVTRTTCPIIHLLWETLPLIEKSLWLLFSFATP

SEQ ID NO: 933222 - protein, 145 aa, Homo sapiens
MTTASASQVRQNSHQDSEAAINRQINLELYASYVYLSMSYYFDRDDDIKKPDCDDWESRLNATECALHLEKNVNQSLLELHKLATDKNDPHLCDFIETHYLNEQVKAIKELGDQVTNLRKMGAPESGLAEYLFDKHILGDSDNES

SEQ ID NO: 933223 - protein, 259 aa, Homo sapiens
MGKKQNRKTGNSKKQSTSPPPKERSSSPATEQSWMENAFDELREEGFRQSNYYELQEEIQTNGKEVKNFEKKLDEWIPRITNTEKSLKDLTELKAKAQELREEPRSLRSQCDQLEERIQEIQRPPQRYSSRRATPRHIIDRFTKVEMKEKMLRAAREKGQVTHKGKPIRLTADLSAETLQARREWGLIFNILKEKNFQPRISYPANLSFISEGDIKYFTDKRMLRDFFTTRPALKELLKEALNMERNNWYQPLQKHAKL

SEQ ID NO: 933224 - protein, 169 aa, Homo sapiens
MYTDWETPPSRFRQTFHTGKLWLASVVDLQKTPADLQQRGLTVRRKTNKKGNSTNVNKKDVHSETPSKGHHIKDQSLAFKWQTVEPRFSVKIPGIQCGRCVLGGPVCLVSNGWSNRPWKCARTYLFTLPDRMTTTHDILLLCMASAACSAQLVQGKAASEELTASKTGY

SEQ ID NO: 933225 - protein, 144 aa, Homo sapiens
MLSQYYCCEGFTSGITDEIGGGYQTLPKAYHQRWRMRKTDCMQSSKSERWRLHVYPTRQEGWGSSVAGRAQSSMEFWGLEAVLQEYSTDVVPRMSLEWGRGLLMCQGGAGHQVRPTFCRLGAAGERSQDTGRMQVRGLREKGWR

SEQ ID NO: 933226 - protein, 175 aa, Homo sapiens
MLLVCRLKFQPPPSVGSCAARASPTSTFPCSTVPSPIDHPRAEECGRTERDWQAAPPVAPVWDPLGEASCAPESDGDFSGIVNAPVSTLSKQTTQALCKMDQSAGCGWGQKEVTANTSEHQKEQTPDTPPLRTVTLTRRVRGFILEVSETKNPPIPDTLTHLALGELKDGNLQNL

SEQ ID NO: 933227 - protein, 209 aa, Homo sapiens
MSSSPNLDVSNEITEGLYTPCDIGSNMILSPPGYWERYHSAEDPELQSVLALLSLSLSLNLVTVLRNLLSILAVSSDSPLHTPMYFFLSNLCWADIGLTSATVPKVILDMQSHSRVISHVGCLTQMSFLVLFACIEGMLLTVMAYGCFVAICRPLHYPVIVNPHLCVFFVLVSFFLNLLDSQLHSWIVLQFTIIKNGSFCLTIKLSPPF

SEQ ID NO: 933228 - protein, 677 aa, Homo sapiens
MESKRITEWSRMESSNGMEWNNPRTRMQSSSYRIEWNHRMDSNGIIIERNRMESSSNGNEWNHHRMEMKWNRMELSSNGINIKRKKTELSNGIKENLRLDPNGIIWNHRMDWNGIIEWTRKGSLLNGIEWNHRMVSIGIIIKWNRMESPNRIEWNNHRMESNGIILKWNRMELSNAIEWNYRMQSNRIIEWTRMESSNGMEWNKSNGINIEWTRMESTSNGIKRNYRMESNRIIEWTRMESSNGMEWNNPRTRMKSSSYRIEWNHRMDSNGIIIERNRMESSSNGNEWNHHRMEMKGMEMNGIVIEWNRMDSLNGIRWNHRMDWNGIIEWTRKGSLLNGIEWNHRMVSIGIIIKWNRMESPNRIEWNNHRMDSNGIILKWNRMELSNAIEWNYRMQSNRIIEWNGMEQSMNSNGIIIEWNRMESSSGIEWNYDQMESNCDHHRMDPNGIIIQRKLMESTSNESNGNTIELKRRIIEWTRMESSKGMKWNNPWTRIQSSSNGIEWNHRMDSNGIIIERNRMESSSDGNEWNHHRMEMKGQHQTEKNGIIEWNRRESSNGPEWNHLMEWNGIIYGLECNHHRMESNGIIEWNRMESTSNGKKRNYRMESKRIIEWTRMQSSNGMVWNNPWTRMQSSSNGIEWNHRMDSNGIIIARNRMESSWDENEWNHHRMESNRFME

SEQ ID NO: 933229 - protein, 773 aa, Homo sapiens
MKLKWMDSSSIGFEWNHRIKLIEIIIKWNRIVSLNGIEWNHHQMEMNGIVIEWNRMDSLNGIRWNHRMDWNGIIEWTRKGSLLNGIEWNHRMVSIGIIIKWNRMGSPNKIEWNNHRMDSNGIILKWNGMELSNAIEWNYRMQSNGIIECNRIESSNGLEWNHRMEWNGTEWNHRLESNGINIEWTRMESTSNGIKRNYRMESKRIIEWTRMESSNGMEWNNPRTRMQSSSCRIEWNHRMDSNGIIIERNRMESSSDGNEWNHHGMEMKGMEMNGIVIEWNRMDSLNGIRWNHRMDWNGIIEWTRKGSLLNGIEWNHRMVSIGIIIKWNRMESPNRIEWNNHRMDSNGIILKWNRMELSNAIEWNYRMQSNRIIEWTRMESSNGMEWNKSNGIIIEWNSMVSTPNGKKRNYRMESKRIFERTRMESSNGMEWNNPWTRMQLSSNGIEWNHRMDSNGIIIERNRMESSSDGNEWNHHRMEMKGSSSNGFEWNHRIKLIEIIIKWNRMVSLNGIEWNHHQMEMNGIVIEWNRMDSLNGIRWNHRMDWNGIIEWTRKGSLLNGIEWNHRMVSIVIIIKWNRMESPNKIEWNNHHMDSNGIILKWNRMELSNAIEWNYRMQSNRIIEWTRMESLNGMEWNKSNGINIEWTRMESTSNGMKRNYQMESKRIIEWTRMESSNGMLWNNPRPECNHHRIESNGIIEWTRMEKSLNGIEWNHHRMEMNGIIIEWNGIELWNEIQCDHHRMDPNGIIIQRKLMESTSNESNGNTIELKRMELP

SEQ ID NO: 933230 - protein, 188 aa, Homo sapiens
MESKRIIEWTRMESSNGMEWKNPWTRMQSSSNGIEWNHRMDSNGIIIERNRMESSSDGNEWNHQMESDGIIIKWNRIELWNEIHCDHHRMDSNGIIIQWKLMESTSNGIEWKHHRIETNGIIMQLKWMDSSSNGFEWNHRMKLIEIIIKWNRMESLNGIEWNHHQMEMNGIIIEWNRMDSLNGIRWNH

SEQ ID NO: 933231 - protein, 174 aa, Homo sapiens
MESSNRLNEWSRMEPPPNGMEWNHRIESNGIIIEWTRMESTSNGIKRNYRMESKRIIEWTRMESSNGMEWKNPWTRMQSSANGIEWNHRMDSNGIIIERNRMESSSDGNEWNHQMESDGIIIKWNRIELWNEIHCDHHRMDSNGIIIQWKLMESTSNGIEWKHHRIETNGIIMK

SEQ ID NO: 933232 - protein, 203 aa, Homo sapiens
MTWLMDPNLDALRHTQKEKAHVKKETEIGIIELQARKPKDCGKPSAASEKPTAEGAKGKILRDYSENRELHEWILWALFGNKTFPAIMTNYCIQHKLSPYLKQLFSPPGSPENKITLLPFKILLLLLNAFSPTKELIALSLLSAYKQPSPPAPPLLDAQVHRVLHCNPFHSALALCSITHAPSSEAAKNQRLGVSVYAKKNCL

SEQ ID NO: 933233 - protein, 211 aa, Homo sapiens
MLLRAALSSWAQTIPPCQPPELLGEPGCWWPHPYGFARCIPYHSLLGLELLVCGSPILELQAPSIVGGGLWFHPTVHPASITQTGSTDGADHTRGLLNSAHSFRCSVGLQHSTASFYFQISSLRYGRFEHCPFSLSLLQHCDHIPPWFLTSQTSDSAPHPPKLASKTFARVLLLTRPLRSQMKQQRGAVAGQLSLTQASVTTVSALTEWLS

SEQ ID NO: 933234 - protein, 135 aa, Homo sapiens
MGPAVGPVDPNEVNPVSKEENSFPKDGNTLNVEKNDPIPRRLLLQGPLQFPKKSLEPVCSGGILVLTLSHTDLGKSPNLLHLISSSSVNNISSCTSGYPQRSESRGWKGCLPTCVHSSTIQNRQNVEATQVPVKG

SEQ ID NO: 933235 - protein, 179 aa, Homo sapiens
MLVFLQEMNKPCGCPQDVCNHGDWRDPWIPNIGLVTPVRAMSQLNLNVKTERGQTGVMLTSTPITWGQIKKTTQEAEQLLECQAVAYFINEIGIESPFLFQKGEKGKKKGGNRHQEFEESLFQPSRITEKFKTSVEEVNAYVVDIPKQLELKVDPKDVTELLQFHDKNLMDEELLLVDE

SEQ ID NO: 933236 - protein, 208 aa, Homo sapiens
MRHACFPFTFHYAFHFKNYAKTHTLVFRLYDYFAFKGSQSESQNLTSREDDSVVLSLWLKAGEPLANRWYSCDGIGGPSGVAAAKTPLRTSRKWEEVEAPPPMELAGWEPMLLDAAAAPQLWFQIQASLCSQGFRKPLPLQASKCLLLLPDLSLIPVPPEQSCGRAQAVSQTARCVRTQDSADTPVPCRLSFLQTLSTEEEWRVGGWG

SEQ ID NO: 933237 - protein, 141 aa, Homo sapiens
MQLRATCMCWASSLPPHSHLPRRVPHVEPREVPSHGGSWEPALSIGPCLLTYKSTLFSGSVERCSSPPVGSPHSLLAGFRAPCQSSRFGETAAQGSAGVGASKGRTAHSSPQWDPVNKPSLISCLSASPTCWVSCLLPCPG

SEQ ID NO: 933238 - protein, 160 aa, Homo sapiens
MMAQNLIKTTKVKGIVDNKKQTNTKNKGGASSLSRLLAVCATFMPLVAVWRTREVLCEVVQARLPVPSPPPFPPASSTGFCVDRSWGDFEGSLAGPFGSITELEESKGRNHKKVHLTAPELKGSQCWKNDGGEPGLFSDLLFSTGTISPMRLTYPHFVSL

SEQ ID NO: 933239 - protein, 149 aa, Homo sapiens
MRNYPLSHYVGTVLRGGTSQSLHNMQNFLLVHLIMRSFLWPCSSLCTLSVVGWRQLAPACPKDHRILLRDFPGEDGHSLADGLAGDNEDEGRLETSYIFSGHMQNPALGTVDPQEYVSTFQRILWTSHFLNIPFKFSARLLFSPTCIAP

SEQ ID NO: 933240 - protein, 147 aa, Homo sapiens
MLHFPKPPWPATPPSCSYKTPQDSSRQTYKRLDVVRSRSVEEDTRTWTLRGHREQHAGGRTHQQAQRQAINTAERHGVPQRRSLGNPGFTVDGKTPTAFQAETLHEKERRIPPEAGRPAENTCNSSGGELVHLKQTDDIGKKRKGST

SEQ ID NO: 933241 - protein, 159 aa, Homo sapiens
MNLAVHMDVILRVASGDSQGEPGTLNKGSVSRQWRNLNEEALSLTRYGWIWIADLIVAFGPTAKEVGSALFFLACYLGTEQGEVAAAIGTVQVENDFPDQKALFPWAYRICLVFKASLHPTPPCWLQWLPSPSPLYPSTSCSHSLLTAAFFPLKLLHKL

SEQ ID NO: 933242 - protein, 136 aa, Homo sapiens
MESYNVDMGNWRLKYILHINLHDPCQGLPLLKDLSSKQAANLFPWQRMEAVACDILLIMQPGHGQPAFLQGDRKLRHRRAKGLYGQTSGMHGGRSLEHGALEPLLPSSDTEVLPPGGHLCDSSGNLKYRLEKSDIF

SEQ ID NO: 933243 - protein, 142 aa, Homo sapiens
MRDFCCLNLEAMKTYISLMSVLPFDNHLPGTGRKRVDEQIEIGTSMADPSDELLCGLQYGKHSFGNSKMMAVEKQWVYRQMIGCFSLQQCGSGHLPVSCMITQLPVGGTTATEAGASLEEMRVTQAERLGAHRVEISVVENE

SEQ ID NO: 933244 - protein, 232 aa, Homo sapiens
MLPSKTHTQAPHWLWEGKSPASESPSSCVDAAAGRQLRSGRLAFPCPLVIGGDAPGEQSSEGEAQGDPAEQPSPVMSQSALHKAKEAAIQLAPHVWCKSCFGTRLQAPFLQTSSRASPMRRSRSVQGPISQDMEVQRSCDPGELAAPASVAVPTAGVLSWQLPGWQPRGTMLKAERQTEERTRGREVLPEGSLPWSLPDSSPGHGEALSDGWGTEATLPAVLFLSRPGRGYQ

SEQ ID NO: 933245 - protein, 497 aa, Homo sapiens
MKHGAFVRLQVFSMQREDPITTTAIITVISIATTANITTVTWSSSPSAPPSLPHHHLLHHRHHQHPHRYIITISITIVTHRYIIITTTTSITTVTISTPIVTSSSSPSPPSLIVTSSPPPPPPSPPSPSAPPSLRHHHHHHHHHHQHPNHYIISNTSITTGTISTPIITSLSPSPPSPPSPSAPPSLHHYHHHLHHHRHHQHPHRYIITSTSITTITISTPIITSLSPPPPSPPSPSVPPSLRHHHHHHHHHHQHPHRYIITNTSITTGTISTPIITSLSPSPPSPPSPSAPPSLHHYHHHLHHHRHHQHPNHYIISNTSITTITISTPIITSSPPPSPPSPSAPPSLHHHQHLHHHRHHQHPHHYVIITITSITTVTISTPIVTSLSPPPPSSPSPSAPPSLHHHQHLHHHHHHQHPHHYIIITITFIITITISTPSLHHHHHLHHHRHHQHPHRYIIITTTITVVTPPPSPPQMSSLSSSSMAVPSDLCFYKNGS

SEQ ID NO: 933246 - protein, 359 aa, Homo sapiens
MGMFFRVFVVMEMFCGVFMVMGMFCGVFVVMEMSCGVFVVMGMFCGVFMVMEMLCGVFTVMEMFCGVFMSGNGEEHTAGWEPLRARLSQGHRKSTVEQGQDTRMWSPFLAGLEFAITQLWSEVYCAHCLEEPRVSAWVLGIWILESVVNAAGYLLIQPQCSLETATVPPGGRWSLRSAQEQPGFREGSLTPTALPVCRACPGENPFSGSGGALTLPPVSLWRPLACLHLAGLARHLPAPGPCACSESLLPHGTRAGLGSPEGQLCQARMPPWFQGAAVPSEKALQAVGPPGHSSLFWQPLLPRGPCSPPWLLAYPQAMPRAGGDGPGAGSLRQLPFKPWQSESPSMPKARGEGGGSEDA

SEQ ID NO: 933247 - protein, 153 aa, Homo sapiens
MVRVGPPGHCLSSVLVCLQSEALWWEAGKEGRLQEVFQDCSSARSGEASLLGHAPTLRVSDVPPSSCLILDNSSTVTPAGYGPQWCLPQRGNLRVKNMVLGKLCQWCLAQSKLQQRGWHHQAQPATGHDTRASWIPAPRWLLQATPLQGHCSP

SEQ ID NO: 933248 - protein, 142 aa, Homo sapiens
MLDTRSAGSASLTPPGPLRHESEDGLESRKKGDQVYGGSGHGASAVDPTLQRLPRGPELAWKGQKPPGHHLENESEQDRLAALEAATEARRGEWKTAVVAHDSRKGAPPRAQGSVVKGSVYLSKQEDCHKLSGIPGTPRVKF

SEQ ID NO: 933249 - protein, 164 aa, Homo sapiens
MTVIMNMPCWTQPLCALINTVPEKKEQAIGRSKGGLSTKIHARTDALGNPTGFYLTAGQAHDLNGADVLLDLSLSQTWLMDKAYNSRDRVIDPIHKINGQVVMPSKSNAIDQRDYDQHLYKARHLIENFFAKLKQYPGIATRYDKLAQNFLSAIYLASIMIWLN

SEQ ID NO: 933250 - protein, 554 aa, Homo sapiens
MCEMYHIITLIAPVDKIDSYSQTAINIWSSNKFNIIVLDFLQLAALYGGGPMTLNKSTRDDLKKLKVMTTKTTINAIDMSPLIGEWQGVGDPVVMLFGRKGTPCFIDFYANTDGNYNLYVCGVSGAGKSVLLLEILAAYRAVGAKLFILDVGRSFKNFVDLAKGTTFDFNSGRSLCMNPWSWIQVAEEEEEGGLNTFQQELRMLLPIYSKMASPKNSLNQFQEALLEEALSATWREYGNENNVDNVQAYLLQIKDQGGQQVDRVAFEFANSYKHSQLMACMARILTDAPALRSVVMFCVTSRIMKEMYLTRDRKKLCFIDEAWQLLGDDAETAKFIEEGYRRARKYNGIFGIGTQGIDDAFKNEASRAAYTNADWKIFLRQDEKNFQELIDSKKKIDEIINEDNQKKEKVEPELKTEKVSSQKVSKIDKWINGLKFVIATALISLLVTFPGLYLVKKSQVKVGVVDVQALLVEHEKKVTQQLYANQGLYQNSDAASLNSGAVEEQTKQFLLKLEGSIDDINNNCGCVLINKAALLTQSGNVVDYTQKVREALEK

SEQ ID NO: 933251 - protein, 354 aa, Homo sapiens
MNHEYLARQTYKLLDVEHIDGGTHGWLDVKRNVPTVTNRTMRSFAGAVRGEPRLLSSPTPGENLPTISPSDFPQVTSTQETEHKSSENLQPDNVIEKKSPFSGEKCKLAAEICISSKEPNVNTQDHGENVSRSCQRPSRQRPPSQAQKPRRKKWFPGPGPGSPCCVQPRDLVPYVLAPPAMAERGQHTAWAGASEGGSPKPWQLPSGVEPVGAQKLRIEVWEPLPRFQKMHGNDQMPRQKFAAGAGPSWRTSARAVWKGNVGLEPPHRVPTGALPSGAVRRGPPSSRPQNGRSTDSFHCVPRKATDTQHQPVKAARREAVPCRATGAELPKTMGTHLVHQCDLDGITKFRFNGK

SEQ ID NO: 933252 - protein, 238 aa, Homo sapiens
MNPFHGRHFQGEIILWAVRWYCKYGISYRELQEMLAERGVNVDHTTIYRWVQRYAPEIEKRLRWYWRNPTDLSSWHIDETYVKVNGRWSYLYRAVDQRGDTIDFYLSSRRNTKSAYCFLGKILNNVKKWQIPQVINTDKAPTYGRALSRLKREGKCPPDLEHRQIKYKNNVIECDHGKLKRIIRATLGFKSMKTAYATIKGIEVMRALRKGQASSFYYGQPQGEDCNSDHMRFSHLDV

SEQ ID NO: 933253 - protein, 148 aa, Homo sapiens
MYSAILYLLSGAFRPSAFNVSIEMKLIWEFCLMTEESLYHCAYIFMPEYGWVHMYREAKKFVSENEGALGKGKGKRWFAFKMMMAKKWAKFLRDFENFKAACVPWENKIKAIESTIATAKDSRDSTLIDLTSKCVNVCMLGWGRQNII

SEQ ID NO: 933254 - protein, 137 aa, Homo sapiens
MSQKLLQEILIAPTQTNRTACGDSHCELLLQEILQEHTRKAKKIHTLFGGSSFPLQALRDSQKTVSAQSKSSEIQGVEEAVGRALWALLVPREAISDFVLQGLLGRTASKIEERPQGKGNSQLHFVTILTEHKVPRT

SEQ ID NO: 933255 - protein, 153 aa, Homo sapiens
MGFFFYCISEATCGNNPELGYSEDHPFMLLEKVTFPSLSLLGHDSQLGLLPTQLLSAYAWLLALFSMAVICPANTLLNLGPTERQSWRLSVLEAGSSRSGLDPPEGCEGELVPGPLLASGGSLASFCVPWLVEASSQSLPSSKATVILDWGLP

SEQ ID NO: 933256 - protein, 139 aa, Homo sapiens
MDIRKTTFSNLIRRKRKKEEEEEEEEEEQEEKRQEEEAEAGEEEKEGDKEEEEEQEGRRRGRKEGKKKRRYTTSREHHGFSQKERSCVMLSVFEESKNYTFSNSRFGQSLFPSFKDYQEHICDQQRYYYYDANVTKEAI

SEQ ID NO: 933257 - protein, 446 aa, Homo sapiens
MSKLLNCLEQKSLLNKLQNEKGADFYITNKLQSDVELLIVEPSFEQKSHSNVPGLPPIEVASLSRIPEVRCLMTKEIKNVNTQGRVLEDNSFWLLPAGEIRHVGNSSKGSSWGQSKGPVKVLHGSICNTIWSSIASSQTSNGGGSLSDYSSSIPSTPSISQEELRIDVPPTSNTPTPVRKQSKRWSNLFTSQKGSNPDKEKKGLENRADSIRRGRAIPIKQGMLFKLSGKGLKKWKKKYVTPCDNGVLTYHPNLHDYMKNIHGKEIDLGRTTVKVPGKRPLLATSACARISSSKTNGLTKDMSSLHISPNSDTGLDDSLCSSPSISSTTSPKLHTPHSPQANRKKHQRKKSTNNLKDHGLSGTAEGQEENFIIVPLTGQMWHFEATMYEERDAWVQAMESQILASLQSCESSKSKSGLRSQSEAMALQLIGNMRELQLCGLRDPES

SEQ ID NO: 933258 - protein, 568 aa, Homo sapiens
MAIARLSVKVGKAGKAAPHAEYIDRDEEKKLKQEQAETDLEHSTYGNMPKWAEHNPITFWQAADLYERKNGSTYREYEIALPREMNAEQRLELVEDFIQSEIGSKYPYQFAIHNPKAMDGKDQPHVHLMFNERLQDGIERDPEQYFKRYNAKNPERGGAKKDNTGKGYQERKTDIKDLRQRWADLCNSHLEKHQIDSRIDMRSYKEQGIEKEPEKKLLPSQAKDPEIREALQQSRIAYKELEQLDLGDPKKDLKDLKNSPISDKEIKQGIESFKADFDSFKQLALEQYKQQQKLEREQQKTMNLERTEFKEEELAPIKKLDLNDLKVPMPKNLDQLLIWTSELAQYNYAQFLNQSEQLKLVDEDNLEEQAEISQKLRFYRGNALIENQIKDFYLKKLLDQGEATVKGYIKSPTKKNTRYAVISYHDYDFVSFATPEILNKFPADLINFVQKETPKTLADIYPEEAVFLSAIKKFIKPFKEQYKKLADKNREIKEHNTVAHKIYIKIKNKEATLQKPTESKPKESNPKTTENSAVPVEMKQGTIQKNMAPQEKPLTVIKKRKFALNKNK

SEQ ID NO: 933259 - protein, 189 aa, Homo sapiens
MFSELSNPESLPAQGQAQNSAQSPASLVLVDAGQQLPPRPPQSSSVSLVSSGSGQAAVPSEQPWPQPVPALAPGPPPQDLAAYYYYRPLYDAYQPQYSLPYPPEPGAASLYYQDVYSLYEPRYRPYDGAASAYAQNYRYPEPERPSSRASHSSERPPPREVRRALRGVGVVLATALGCAFQGLSCTCSL

SEQ ID NO: 933260 - protein, 139 aa, Homo sapiens
MAVLTSKDVGVQDVMPGAATVPRPPAQVNEKNQGFRGVGHFLLHVSAPDPAAFMSFVQLAHVGFHAHGCQGWLLCLMLGPSALEPTGRAGTSLASSSSSLGLWDVPCLLVPSLVTRVDMRLREAHGGTTPIAHLVQSDS

SEQ ID NO: 933261 - protein, 151 aa, Homo sapiens
MRLAPSNLKEHHLGDNGFYHWGMPVQVHCVVSAFVRSAESQPHSHSHKDIPPISSLLGASNNFYECPQVPRIKLFLSRHTNPFTITPNIQNVGSRVLPGPENLDSNSVLSRSGVHMGDKETLTPQPAAHPGVRKQQQMQGLGTLPWALHGR

SEQ ID NO: 933262 - protein, 155 aa, Homo sapiens
MGCPLRDEVAAPPRCKPREFPVAPPTSPSAHVGHRSAAGALARLTSQKPSSLSEQFLSLLRAYNSKGSQLSGLEKYLVTGCPRTPQIVTVLEDRCPGQQSKTEKAMPVSRRQLTSWPSMVKHTWGSVRVTAWADTCPGHPQSCCWIICKVVATTD

SEQ ID NO: 933263 - protein, 160 aa, Homo sapiens
MKPWFLVSVSSDKWKRGTRKGLYQPNQKQKLRTHDCVLSLGHPGREWKLLNTKSCMPTGKGAPSPHSLHSAQRAEVEEANISAAAPSFYRGSNPSPDQAAFCFHQRKPESRGNSFPSNSQDPQLQVCWNLLVVHPRPCLPGYQQRRLQNSKYCRTANVAA

SEQ ID NO: 933264 - protein, 156 aa, Homo sapiens
MEKCVVWADPEAPVHRQDTTNRAQYQSKPKTCGPQTASECPCQSIQASGWLPPKFSILPKFTKYLYELHVLTPWTRETSSPLFGHSQGWHWGSSAGPGTCGFQFQGTSEHFLATHKNNGGSETVGIQMAPQEVAAQSCHNRGAKRAPASSLLLPGW

SEQ ID NO: 933265 - protein, 193 aa, Homo sapiens
MDSPYIISLHILKLWSQPSPQPKGEPFVLRYSSFHVLASEYSGLNIQPLSTRVWTPAWIPTCFVHPLNSQLPKSAYGSYHTYHTVVHMSVLSYPLSPGYILDSWSVLRKRPTGSGSNPPNRAMCELLEAVEQSWRTASQDQEGFQEGPETMKFGDEFQKSSFSDEVKTKQNFYQYSYPKSMGCFPVTYLCFLI

SEQ ID NO: 933266 - protein, 152 aa, Homo sapiens
MVPALEQCRQQLSLKGEGWTGSRSRAFQVGIPLGPGISGVLGCARVPGVPEGSDVPRVPVVPGDQVCQEQGVPGTRYAREPSVPCVPGASRDQVCHRTKCAMGTRCAQGLFTSGVPDVQGTRCARGPGVAGIPGVPEVPKFCYFKNVIQEKP

SEQ ID NO: 933267 - protein, 161 aa, Homo sapiens
MLGAACYDLHSEDNTQDVASQVLFDQQPSSSGLPKPPVSQAAYSKDSPNNAETAGACGGGLLLADRTCNLVPCAYTWRQRPVFSGNIVLQAPLAVEIHSKRNPFKKKSTQHLAINHLDSAARSKGVCYCQYSRRKARLRNDGGWILHSGNPVRLWTRDSSS

SEQ ID NO: 933268 - protein, 133 aa, Homo sapiens
MCEPRGTQPWPFAQLFPDSLFFFRRMKLDVNFNGCRNEAKRLKGTSPALWSWSPPELEPSGAGALRKQEFRHAEKLGVLCGKAADAASSPPPPLPNNCVVRVPERQVRVCKLAGMALPSGVAEGLRTCTMVNE

SEQ ID NO: 933269 - protein, 131 aa, Homo sapiens
MHPFIHPSVHPSIHPFIHPLIHPTTHPPIHLPIHLSIHPSTHHPPILPPIHSSIHPSIHPSIHPSTYPSTRPSIHSSIHPFIHPLIHPPINPPIHASIRLPIHTNVQSKNGSLNNLQFPVTEQKRVKAVSG

SEQ ID NO: 933270 - protein, 174 aa, Homo sapiens
MRSLSSHTLPLCIAPDNHGPGGTAINKSSVIRVRNRKEGNLGKWGECQVDQRDTVMGVRCGIRNNVGGRIEVWARNNGNCGRLNKEGLPRPLGSVSLQPLSREDLGRSQRASGQSSRGSGSGYQKSGFTWGVEGNRHEKCEKCFPPVHTLIGSQCKELLLHLRQCTGRLLVDGR

SEQ ID NO: 933271 - protein, 125 aa, Homo sapiens
MEQYILKYTVNYCLIGGFIKETVTQTNDPLKNKCEVALLWLLWILQVLGRNICSKPIICQLPYTTKLSWIPCLTRITNDSNYQGIWQEFQEEQTGSGGPYKENTVWSTRCSCSQEGFNGMQSPFR

SEQ ID NO: 933272 - protein, 157 aa, Homo sapiens
MTTSIYILRNSVKSFQFLYFLANTCALLIIAILSAKGSHERLYREEWCTLAQILCISHRLHNRQTRTFPPVPMPPGPWVSSTKQGSHLGRHKASCRSFVFFSYPNGTWNTSEKELFTPLDRGLKPGSQVVWLSSFLPHRAQQAKIHWLEILTASTAV

SEQ ID NO: 933273 - protein, 156 aa, Homo sapiens
MFYDTKIQALSCRSVGVYQRSTPDPVCLGISSGVCRTADIGEQQMLLPDHSSGTFVSEEYPAINERGSVGVGPSEPGTGYNLLACHLLRPSEKRSIRVGVTRFSRCHLSPLSLARKGNSLTPCASRVRRCLALHWLRLGALHPLSCPQSNTPQHSL

SEQ ID NO: 933274 - protein, 514 aa, Homo sapiens
MVGSAGLGREHSRLYLSGKAEDSRAFSQQTCSPEPEKREVSVRLNQHRYSLLAITAPDIATGTSTQCSPPISAWPSPCSPRGSRDASTSPPGQPLPLLAGHHGVDTLNPASSSQADGEPGSRLYWLPLKNEWSRLCLLLCCWLPWTLASETSSIMASGLAKQLPSCSLAVTLPADLSSQHDSNRDMGCSLSPDQGPGATLRTPGGFLYSQPGLPSSEGSTGAGGGCSYILSQGCHHLKARLGLEEAAVTLSARAAIIQRLDWGWKRLQVSEKATGRQTMHPAGVFAEAWMLPVGLSDTEPLLEPAPGSSQCALIICFLSASTDNENLSKAGPCLHCPVVSRRKMFGDRQGPTHWANADVGPAGFWGWSRSRELLLPVLLQLLLPPLLLWLSLPPLPPQLSLHHRYRGCHCHHCYCSCHYHHCHHSCHSTTATAATAAVTTTTATAAVTATTATTAVTATTATAAVTTTTAPMASTTTTTATEAITTTTATAVTAAITLAVAMVTVVLGRGVLGI

SEQ ID NO: 933275 - protein, 179 aa, Homo sapiens
MHRVHPPTPVETHGPPAPGGSMVPSLDNITLASLISSKFQSWDGALAMCFSSFFGPGFLDGQQLARSLAAAVWETRPGGWRGWQGTKFNSQGLCAGGSGNGMEAQGGDTKKESEKEHSAVEGGCPDLPRMPAGALGAELGGLASVLWGPLQALRKEWHCPLPYSCLNYQAPVLEFPAEA

SEQ ID NO: 933276 - protein, 154 aa, Homo sapiens
MGEYGAVSKYEVEANKMEMKETAKQDTLWQMSSTSKPVLNTREVNPLKKFTIPKIRRTAEKEGKEKQVTSYMDGSRQRERAYAEKLLFLKPSDLMRPIHYHENSTGKTCPHSSVISHWIPPTKHGNYGRYKVRFGWGHRAKSYQTTMELIKMIK

SEQ ID NO: 933277 - protein, 2457 aa, Homo sapiens
MINWFLGKQVVFGYMKRTCSLNNCTVAKRFGKGKDATVTFVHFKKPVDPFVQENCLCNALNSEINPFISNISNSYGNVQNGNISIPETYSGQTEHSLAEIRDTSQVLAHDSDISLMPSDAKDSVNGDLLLNWTSLKNILSGLNASFPLHNNTGSSTVTTSKSIKDPRLMRREESMGEQSSTAGLNEVLQFEKSSDNVNSEIKSTPSNSASSSEVVPGDCAVLTNGLDTPCFKTSVNDSQSWAHNMGSEDYDCIPPNKVTMAGQCKDQGNFSFPISVSNVVSEVENQNHSEEKAQRAQQESGNAYTKEYSSHIFQDSQSSDLKTIYQTGCQTSTVFPLKKKVSIDEYLQNTGKMKNFADLEDSSKHEEKQTSWKEIDNDFTNETKISPIDNYIVLHQEYKESESHNSFGKSCDKILITQELEITKSSTSTIKDKDELDHLALEWQITPSFESLSQKHPQHSVEYEGNIHTSLAIAQKLMELKLGKINQNYASIITEAFPKPKDIPQAKEMFIDTVISSYNIETAHDSSNCSITREHICVHRKNENEPVSLENIQRDYKETAYVEDRGQDHNLFCNSQLSNDIWLNVNFKKQTDRENQNEAKENSASCVENNIENIYGDKKQDSHTNENFSNIDEKEDKNYHNIEILSSEEFSTKFNLICREDNAVSAATALLESEEDTISAVKQKDTENTGRSVEHLASTTFPKTASSSVCVASNAAIQIASATMPALSLNNDDHQIYQFKETCSSESPDFGLLVKHRVSDCEIDTDKNKSQESFHQSINENLVLQSIELESEIEIELEDCDDAFIFQQDTHSHENMLCEEFVTSYKALKSRISWEGLLALDNGEMEVLESTTGRENSDQHYSKESNYFYSSTQNNETELTSPILLPDLQIKITNIFRPGFSPTADSLALKDSFCTHVTEATKPEINKEDGEILGFDIYSQPFGENADYPCEDKVDNIRQESGPVSNSEISLSFDLSRNTDVNHTSENQNSESLFTEPSNVTTIDDGSRCFFTKSKTDYNDTKNKKEVESRISKRKLHISSRDQNIPHKDLRRHKIYGRKRRLTSQDSSECFSSLSQGRIKTFSQSEKHIKSVLNILSDEASLCKSKCLSRKLDKAVVHLKKAHRRVHTSLQLITKVGEERKGPLPKSYAIICNNFWESCDLQGYSSVSQRKYYSTKHFSSKRKYDKRRKKRAPKADISKSLTHVSKHKSYKTSGEKKCLSRKSMASSVSKSHPTTSHMGEFCNQEHPESQLPVSSTSQSTSQSVYYNSSVSNPSLSEEHQPFSGKTAYLFSPDHSDEKLIEKENQIDTAFLSSTSKYEKLEKHSANHNVKDATKENSCDANEVINESNSVSLSCIKENINSSTGNDCDATCIGHTKAKTDVLISVLDSNVKHFLNDLYQQGNLILSDCKRNLEVKWTDPIERPKQNIITGNFLMGPLNLTLIASKKYSIPQLSAAAVTDSEGESSKSYLDKQRILTVDSFAASSTVPHCEQSCREKELLKTEQCSSGNCLHTDGNETNVTENYELDVASGTEEDKSYGENIVELSSSDSSLLLKDNVKGSSSETCIVKKDTEDRITWKVKQAEKAKDSVYKRSMTEGSTVNTEYKNQKNQISEESCLNEKIITTNLIDSHLSTKNTTTESVPLKNTVSNPLNKREKKGEIKVSKDSQSDLTLHSEIAYISKPGILGVNHTPILPAHSETCKVPTLLKKPASYVSDFKEKHCSANHTALIANLSQILQRADEASSLQILQEETKVCLNILPLFVEAFERKQECSVEQILISRELLVDQNLWNNCKHTLKPCAVDTLVELQMMMETIQFIENKKRHLEGEPTLRSLLWYDETLYAELLGKPRGFQQQSNFYPGFQGRLKYNAFCELQTYHDQLVELLEETKREKNSYYVFLKYKRQVNECEAIMEHCSDCFDFSLSVPFTCGVNFGDSLEDLEILRKSTLKLINVCGDSPKVHSYPGKQDHLWIIIEMISSKVNFIKNNEAVRVKISLYGLEHIFFDAAKNLVWKERTQSFSKKYSQKKDEERLLRVNKCAFSKLQKIYDTLSKDLNNEPISPIGLEEDTIIASRKSDHPINEATISIENSKFNSNLLAHPDICCISEILDQAEFADLKKLQDLTLRCTDHLEILKKYFQMLQDNNMDNIFITEENVLDVVINHSHEAIILKPEAIEMYIEIVMVSETIHFLKNSIAKKLDKQRFRGMLWFDLSLLPELVQCQEKMASFSFLKDNSTDVCLWKVIETAVSELKKDLDIICKYNEAVNCSYAIHLLSRELQELSEIKKLLKKSKYFISTYIDFVPYIASINYGSTVTELEYNYNQFSTLLKNVMSAPRKDLGKMAHIRKVMKTIEHMKMICTKNAELTISFFLCQMLYNRRKILQLKRKEKMNIHIVKPGENNNKFSISTMLPPVSECINKNISNSSKKRPSTVDKCEDSQEQQQDTTVSSCKKLKVCMF

SEQ ID NO: 933278 - protein, 146 aa, Homo sapiens
MLPLQGDEKWVMSLISDCFLYLFSVSFGNMKLKPDEGDFSPVQCSATDPPWGSQSALLSRSWIQCLMTGWDPPTGTARHLIQEHFHQHQVSAPLGQSSQRKEQAVIFAILQPPLVTPPSARGTQMNRVWSGPSENHRNPMEEGLTC

SEQ ID NO: 933279 - protein, 166 aa, Homo sapiens
MGHLTLPSLASANCQHSGRQASLNLKDGEGAALLHTKFPARSRWSTSGLPPGSPQNWQCMNGIDDVTSKKDICKVPRLPRQLVLRKAAWGVAAVLAGRPPAFSVAEGTAPTPQPGHLAMPSDCGRWLSGKPVLAADFWGFARTYPLLLSCPQNASSQKESESVSRH

SEQ ID NO: 933280 - protein, 138 aa, Homo sapiens
MDGFETLEKMTRKNTFYRPRRPQEPRGPSRRRRRRLDPRTRPAEKTFKQRRTFQQRVDVRLIQEQHPAKSPVITERYQGEKQLPVLDKTKFLVPDVRDVNMSELIKIIRRRLQLNANQAFLLVVNGHSMVHRTQRLFG

SEQ ID NO: 933281 - protein, 242 aa, Homo sapiens
MSTRFVTAITLTWVLGWKPSSWFRSSSIVLCTSRSPDFSLSKCLVPMASSSSVKMMEGAFSLARAKASRTSLAPSPVNICTSWGPVNIWTILLLIIGINIQELDDVGDKVHQGFVHIDFLTVLFDLVLHGLELMGDSQQLTLHDLDLTVQKPCALDDLLRGRGAQALEERVCWGLVRLPLLQGRAVRETRKTSCLPEYLSLQEIVPEACWRQIAEGLLHVSECELASKEPWMDFELEKMPNI

SEQ ID NO: 933282 - protein, 199 aa, Homo sapiens
MFNSLETFPSEFSSLPFPSCTDIHPTPILTQRFGWRGLIDLEGLACSIQSFRYSRHPRIILSYWHGMMSFMTWCLAILGSFPSPRWGMHYLHCFPPLNSSCDRSQALNYWEKGKMGCKSFKSLNFGFEIGFGERGYDGEVDPGYKMIGGSLSKAVITERVLQAKAGVPERAYTNGRPDYIKLPSLAQTGADLQAGSFES

SEQ ID NO: 933283 - protein, 142 aa, Homo sapiens
MHLLPYRRDFGPHKVAPVKVHQYDQFVPSEENMDLLTTYKKDYNPYPVCRVDPIKPRDSKYPCSDKMECLPTYKGAGRGLRVKNAPCLSWGYISGCPLQTTEEWCLVAVSSCGESQKEKRALASSLQSLYSSANPFMKVEPA

SEQ ID NO: 933284 - protein, 675 aa, Homo sapiens
MVAEFGEVRMWEIGKWSPCSLTCGVGLQTRDVFCSHLLSREMNETVILADELCRQPKPSTVQACNRFNCPPAWYPAQWQPCSRTCGGGVQKREVLCKQRMADGSFLELPETFCSASKPACQQACKKDDCPSEWLLSDWTECSTSCGEGTQTRSAICRKMLKTGLSTVVNSTLCPPLPFSSSIRPCMLATCARPGRPSTKHSPHIAAARKVYIQTRRQRKLHFVVGGFAYLLPKTAVVLRCPARRVRKPLITWEKDGQHLISSTHVTVAPFGYLKIHRLKPSDAGVYTCSAGPAREHFVIKLIGGNRKLVARPLSPRSEEEVLAGRKGGPKEALQTHKHQNGIFSNGSKAEKRGLAANPGSRYDDLVSRLLEQGGWPGELLASWEAQDSAERNTTSEEDPGAEQVLLHLPFTMVTEQRRLDDILGNLSQQPEELRDLYSKHLVAQLAQEIFRSHLEHQDTLLKPSERRTSPVTLSPHKHVSGFSSSLRTSSTGDAGGGSRRPHRKPTILRKISAAQQLSASEVVTHLGQTVALASGTLSVLLHCEAIGHPRPTISWARNGEEVQFSDRSLSGSSSVWTQGDEGWPDTQSYRCTCCTYYTTMMPSPLPASQFIKCRILLQPDDSLQILAPVEADVGFYTCNATNALGYDSVSIAVTLAGLCCHTVLQSHMLPPCISV

SEQ ID NO: 933285 - protein, 142 aa, Homo sapiens
MSSRRAGHSLLFRGLRWRAALPALCVPLGRGVHTQDPSPCRSATRLQESWRILPRAQEGMSQPFCGLRALRTSPCPPLPWEPHAPQGEAAGLSHRHLPASMPNGHARSSVLESNHIFKNQAPASLSPGTLGKSPIPAPRFFI

SEQ ID NO: 933286 - protein, 135 aa, Homo sapiens
MRKPRLSGAAESLGFAKRLLWAGHLPSCKRKHRPGEPGDPGPPHRRGAGTRPLEELLAFTVSAWSLVNGRLPSGKLLLRDSDPGWSEASTEAVGPAFRPPSHDRTARRRFCEPGGGPHHAETVGAFILDFQPPEL

SEQ ID NO: 933287 - protein, 177 aa, Homo sapiens
MNLGVAFLSLAHWKSCGVVSQGYERPKTEAQRGQENCPKSHRRQWEADAPAGSADSKAWVWVHLQEETQLSQKPSDSVAAHVFQEQNKHKPISAGEPCLGLHSAGGRVRRPRPLKTRTQSRGPSLPRNRILAGPRACWAWSGMLQLLGFGAGRKGRWNKVEGLRSPWSAWRLPPSPL

SEQ ID NO: 933288 - protein, 145 aa, Homo sapiens
MTVAGVQKLIKRRGPYEMSPSLLDYLTMDIYAFPAGHASRAAMVSKFFLSHLVLAVPLRVLLVLWALCVGLSRVMIGRHHVTDVLSGFVIGYLQFRLVELVWMPSSTCQMLISACTTPAKMPPTYCLMQRQPVLAQDNASTSCRC

SEQ ID NO: 933289 - protein, 125 aa, Homo sapiens
MCTCIPDGHWQPLPPPPPRHVLGTRDRGEPFWDGWRPWTPRHMAVPEGWCCLVAAEGRNPHTAQAGQRWQWCLHQPLPLEPILPSQPHGLRAGSSGLQRFWESQCPWNEFIFCLNQLETISVAYK

SEQ ID NO: 933290 - protein, 270 aa, Homo sapiens
MFSLQVERLSGEELTQEQSRGADPHLDEIPDSEQRLRWVETFGVVWEGERGYFAREEMQDSVARGRRKRSRVTVDTRDQAIEGTVAGRRPSLGFLTCREAGKGEEMESPAAPPEGSTALLSLVSAVRPAADFQPLGLWNTFVCVNHAAVVNYYSSHGEGTHCPWATGKERTARGHHCCCAELTARSAWSRQAQRLSPQRPERPVQASPASLARAAVVRSCVCCSSSSERAWCWAQCTERGCGNLPISGERGLLYNNISLVTAEDQQDECV

SEQ ID NO: 933291 - protein, 174 aa, Homo sapiens
MTPSEMSKRTSGSSLASGTTSLPPATPGRKEPENGEGFVLRALGQCLPTWHPTCSTATMRSQAEGFTQQHTEGLAARLATAELWGSSAARDWPCRARVCRIERGLSQNPQPELDPSVLSMLPMATRGRDAVTPRCLLAGLPRLANASRGHQRPGRHYPTLSAGRVTVNPPGAQK

SEQ ID NO: 933292 - protein, 182 aa, Homo sapiens
MKTVGLQPGEPLQKVPTGICGPLPAETIGLLLRRSSLSLKGVQIHTGIIDSDYNGEIQIVISTSVLWKAEPGDSIAQLLIVPYVEMGKVKLNEQEDLEAQINKAKQIIGHLKPYHEPDVKEEILGGSQGPPGCSHVETDTEEDPNCHKQHPLNTATHLATDQEAVTDGGRKPEESRTTSHNE

SEQ ID NO: 933293 - protein, 144 aa, Homo sapiens
MHMVDQPTWGLAGWGWGYEAITLARSMGAQLVDHSGGISASSGPWKWSSNSGYECKPVLLASECVFQGSSAFTWKIWESWELPRDLLNGFAQNADSDMDNKVQAEVVPDGDEELVGNWSKGDSCYVLAERLAAFCPSPRDLWNF

SEQ ID NO: 933294 - protein, 144 aa, Homo sapiens
MCLVAPYVCPWLYPQADLTICSSRAGSSQIGATFSKFQSVLILLKEMLVISRRMHGLTSEICATSCDFHVRTCQRCHVACLFTLKISSFTRFLGLLEFGFTTESYLEHAGILQLRLPSQKLWELNNEDTWTQEGERHTPGPAVV

SEQ ID NO: 933295 - protein, 150 aa, Homo sapiens
MLGYEKKEISCYRKSYWKLAVKCEQCEQRQKVFQPHQSCLQRVKDIGCKVPQFHPGLKAGFLPACPGHETPPVSAIIEVIAVPKDYSLVWRNCVETCMNAGLSNEGPHANSAVDRCADNQNQLPNIYHGADISHTCCTFSELVAHRKYEA

SEQ ID NO: 933296 - protein, 147 aa, Homo sapiens
MAQPLNRGPLKEKKEPGIREVGRVFQAEEEARHEPGMGTGISDSGVPPEHQICLGSRNNGVFFIFCGRKRITRLLYWKQGDEKTSFKAQIAVKKFVQTTQIREEGTLDHGEMSGGGIEAALIEAYPDWDPRDAEKEQLLRAEFLEKQ

SEQ ID NO: 933297 - protein, 145 aa, Homo sapiens
MSEVLTQLCPLWLPRDKLNCNIIYNSDNLSNHDMNTFIKSERCVSTGSGINVKNRCEAGSLETFSDHTGIAKKTLLKYKCLGSIGRHSDSVGLRKGPRICISNKVLMLLIWGTHFKNNWHGEFSEVTSSMVAYYFTKFCHPYSQG

SEQ ID NO: 933298 - protein, 148 aa, Homo sapiens
MLFTNNSSSPVQPASAGFLFQTLLSMDSRSADKLFQQIANQKIFESIYDLENRGPQPLGHGPVPYSSRQAVGRQALPPELCRLLDRRWHWILTGVYKIYKRKKIDSQFHMAGEASQSWQKASVWAPVSESQDSPTALTCSFIENCERL

SEQ ID NO: 933299 - protein, 244 aa, Homo sapiens
MSDFSYVITLQRQFQWEIERKDAVAVRHSQRMPEIASKPPKLEEAKKHSPAGFRGTVTLRHLGLRVFSLHNYLHKDDSSITLDSQFLEFFSFKSPLPFYLTSISKMHLLPIIKTPSHLISRFTEKLSRIYSSHTPPPRPQAQTPPSPTSHQSGAFAGTGRSAIVAMIHSFSLPLMASESRGPDELALSFLVKMRTLSPDDFKEAYENQCSGSHLTDCTAGTHFAQGISSMSAYGAHLVENSKQL

SEQ ID NO: 933300 - protein, 343 aa, Homo sapiens
MIVLRCGVFRAQLFTERGKYISSLEIISCVCEACASKTPNALHKHQLNITALAFFSPCHGKEVAERLQCRWDGDTSVGNSDNRKHLCLPVAQKVKLLEKLEVVCEVSFRRDGVRMDTIYDLRKQKDKLLEFYAESDENKLMIKRKTMLKAKNEDLDYTALKFLKMCGDRASDDHKAAEKFIDEFAKVIADESLMPEQVCNADETSLFWHNYPRKRLTKADETAPKSMKNKYNNTSLNSMLAAVTRGVDPFHKLEEVDIEGVFNINNEASITHSLTNGEIVEMVLNPGDRGNSDEEDDIVNTAEKVPVDEMMKTCTGLIKGLEQCRFITEQEIIMQFIKSKGDI

SEQ ID NO: 933301 - protein, 156 aa, Homo sapiens
MQNKINIILLPNSINVNKGRLRAPWSSSNASVWEDTRYLADRKRHSPFLGGVREHSATSFLWKARYYPGLPAVINRPKPLPVVLCFNGRVPCPLSCSSRTPGSSLKFVVHSDRRNTESLKVFYLSYKCIEENADVCCLLSLCFGYLKGKGPRPLIT

SEQ ID NO: 933302 - protein, 126 aa, Homo sapiens
MSTLSRETKALSYPSPTLKRDYGDQIIHGILVKVWFTVDLWVLCVNEVAVSLIHVCNWSEHVVSLVEYNCFLSYTKGGVEKSPKKDCGTGEYVFLLLRRGYIKIKYTVFVKFSSTTIRRANKSSVA

SEQ ID NO: 933303 - protein, 175 aa, Homo sapiens
MWGWSSHTESPLGHCSSVRRRPQSSRPQNGRSTDNLHHVSGKATDTQHQSMKAALGTVPHSGTGVEVPKALRAHPLHQCGLATWQCGEKSNPGKEDNEEDRLMKRNSSSLMEKVEGQAEQRERRVSSSHKFFLWQQGTLDWRKEWRDKSWQGLPDHWENGTNDLLHAGFPEIFRL

SEQ ID NO: 933304 - protein, 230 aa, Homo sapiens
MTERSSAGKLGTQKNQDSECEGQDPEEIKEKKGKLKKVYFTSQSVPPAELSEWPPPPSPPNGYSRKRRLWEEPKLLIRVIPQTNISETKEKTENSRQANSPTWGQIKKLVQMAKDNLKAQNKLKTTSNLMVAMLAVLTMAASLLTIGATQNFTYWAYVSFPPLIRSPSLEGINCLVMRILTQSYGEVKEPRSPANSWVSEPSWMKILQPQSSLQMTAALAEKLNATYERP

SEQ ID NO: 933305 - protein, 143 aa, Homo sapiens
MRLWRNMKQQQCIEEGICLWHRKGRGLQISIRWSRIWFTAEETFEQHPEGGEGVHAAKHQRTDKLRLDISFQVNKFRGQIPIRIIGKLPGKSTEVLFDQGTEGKSLFVKVQDDPQTLTRNWKSKDLIKASNAKKQLKQKKEEK

SEQ ID NO: 933306 - protein, 157 aa, Homo sapiens
MFQFGLAMFQISRKDMWLLVTVLLDSTDLGPWSSNLASPELLIPWVWNGAQEFAFLTTSQVMPVLLVQGPQLENPCLLSNGCLSRHWHYRLTMEPSRSPYAGVTEGSPLAFLVTSHNVPSAPDPIPAGKRYDVNSTIDIKDEQWRMECGRTRPGESG

SEQ ID NO: 933307 - protein, 137 aa, Homo sapiens
MPLPYGQVGIMNPSQSRTMAHGRAGVNSTQVTASLLHLKGEEPQPQVLSSCQPVRDHTLTLEEEEQPRLLVAGGAFLAVAGRVSRLYGRVPVPGLGVGVHSVLTPPGSEFQRSRAFGGELGGCAFDLALQEHKPWST

SEQ ID NO: 933308 - protein, 168 aa, Homo sapiens
MEGRAPGTPTGSIQGHDLPVVGCRLCSRTATTGRLQQATLLVWVHGRGPAAVLTSWSFELRQSRGHYNQACRQRQSVFKMAHTFLKCLAAAPPGFEQSPAGSGKCATPLMSCCGTAKHPRDGYNLSQRVPWLKETGTLRGRWLQRGPENRKDILKADRFDLAKDKLAA

SEQ ID NO: 933309 - protein, 118 aa, Homo sapiens
MGNAPASGTHLPWGGCHAAYGISPVAGCSCRVLLKRLHVAWDSIPVMPELTSEYSYDDFHSVTGADRRQMARGGVQESKVTVSGAKPHRRLASGSVTIWSKIALHNNLQSSQVEDVWY

SEQ ID NO: 933310 - protein, 144 aa, Homo sapiens
MARIQRAAVARVIVKSKRIKLPQHGAGPEQVAAAGWEVASFYSLICPRPCSVSVLSECPFSILPFREATFRILLIGAFYRVLIAAFYRVLIGTFYNPLASYRALIGAFLQSADWCILQSSCKTEKFSKSPLDPGSPAGFTSHHL

SEQ ID NO: 933311 - protein, 217 aa, Homo sapiens
MYVSHVIKHDERIVEMMIPRGHCDGLNYVPKIHMYWEFKLEPPVPQNVTAFGGRAFKESVVLHDGSWSWLIQPPVIFTSANPELAVPMGSVQQWSAQALALDHLETESFHCGLEASEPSPYTNGFGKWWGTEGRHKGWTASGSVLNECARPPAQVSALLEPAPCAQLQLAPPSPYSTMRTKGGCAAVIRALQVLLRVHLHGRLFANVNTILNSQAIG

SEQ ID NO: 933312 - protein, 176 aa, Homo sapiens
MENEYRGQLQAKCHLTHRWVQQGDCGGPGKGCQPQAREHLCRQEPLNLLCDSGATKFFPMGEAASYTLCCQGPRSGWETSHEQLLLLSGHGSLVHGLLWPLLLPLEESPITITSLAIHIVGGGDWAVSGCHVALSATSSLETDRSPGLVLRPDHAQVVFDRKSELPADRCDGRSAF

SEQ ID NO: 933313 - protein, 127 aa, Homo sapiens
MSSRFIHVAKMTGLTSTVDGDIQLMHCSEGQMAVTGNDELCRHRAEQKKQNTDMKNSQAQNNMCSRNKFQTKGNTKRIGMGASWGGIWKQGNKERGALKLLEPTLRLHLKDGEHLRIQTSGLRGLCS

SEQ ID NO: 933314 - protein, 192 aa, Homo sapiens
MDGCNCQSYGHQMTSELTALCPAGAQSFRSALVILAKQDGFAFPLGSSQRPLYCSHREDSPISSSTSALRMNKGFMIKHSDLIFSACPPCPISSFWVSCPLSTPPNTPGKCSRRLPVNSGDVLTRMQMLHLVSLARSCQASSLSLGVISFSFPGVQTLLPKAHHHQNRLWSCSASECGPADTLIPDLQAPEL

SEQ ID NO: 933315 - protein, 142 aa, Homo sapiens
MHIYSFHSSPCLAVHMCVCMYMYAYIFVHVYVCVHVLVCMSYSVQAAVTKYHRLEGLSNRKFISYSSGGWKSKIKVLADSVCVKKKRTWHKHGPGQAPDVKPVQNGSQLFIKELRSRTFPRGQNSWPQEGHSRERLLPCEWV

SEQ ID NO: 933316 - protein, 143 aa, Homo sapiens
MELALVQMPLTEWLDHIREIQRRKTEGGEDDVKMEAEIGMMGLQAKKYQGTSEANRSRKRQRTDCSLELSQVLQPYRHLDVRQTSGLQHSVANLYRSAATSFLASSEELVVPRPYSPFQQQVVLGKLDIHMQNNVVGPLPNVM

SEQ ID NO: 933317 - protein, 173 aa, Homo sapiens
MDSLWQKETQKMLKPDSTALARQEVSDPSTLPYLANCRKIFFPVIKQKPVPEKQCLEDFPTNLDRPLDIVADLPSLIMVLPLQLTSLTKHSFLVDDHQPEPGSDQSTEAVHGMPLYLEAGCPRSRCQQAWCLVRVAVAASKNDQSSALLEATVKGIQDLSSWQRSKNFLPARL

SEQ ID NO: 933318 - protein, 178 aa, Homo sapiens
MVDSLPCASGKAADTQCLPMKAARRETVPCKATGAELPKTMGSHLLHQRDLDVRPGVKGDHFGALKFDCPTGFWTCMGPVAPLFWPIFPIWNGCIYPIPVPPLYLGNKGGKADGSMSWGGDVATTGDGEAISSGKKVSSEFTNSVSPASSGSSHMSPFQVAGSHSFPINALTLTGDTW

SEQ ID NO: 933319 - protein, 148 aa, Homo sapiens
MTSAKDIEPVGAPVRQEVLCPLPSPSPAITVRWQTGPVSGRHLSVPESSQQAWWPWCSALEAPCCLVPSLGLSLALFVELAGLWLRICTSSVLQPAATVVSRGRSALCAAQEVLASLCPGMKLPSLRPTLQAKLSCLCLAFHFLSLWV

SEQ ID NO: 933320 - protein, 126 aa, Homo sapiens
MALRVREWSNPNPPPTLLPIPSPAELSFHCAEHEEMETQRGEEAHLRPPAVEDLILLAGLKSRPEQLHSPVRKPNTNFPDKGSLWSAGNSCCTNLVSTRSRNAQALKMVGSLGRLDKNEELSSYEP

SEQ ID NO: 933321 - protein, 147 aa, Homo sapiens
MSSSTSYWPQGCFQGSQHSPLQPGKEHNHWQAGLTHPQRGHGNRPETHTAETASPMAAPTHFVPDSQLDDVAMRVKKRPYFHKVVPPQPLTSSKISSSPQGKTLYPFISSYSPLPFSLLQPPICSLSMDLPILDISYKWDHIIHDLS

SEQ ID NO: 933322 - protein, 178 aa, Homo sapiens
MPPELEAGRAGQLPALTEKGVPMLLCILSPETEESSGTPEFMAVSSDGSCLWGFQTRDRLPAWLSAAPWSVEEVGFLLTAATPRQGAEQLCLEEPGLFWAKLCCFPLPVMLLELGKETFPWELTDWRDPSQASGGRNFADKGTVAHCVSTAQGQGDKEFVEESKSWPGISEQSERGEG

SEQ ID NO: 933323 - protein, 162 aa, Homo sapiens
MTLRGRGCCLTWGPAEMVESGDPSGHRLFPFSPTTQGFRSRPEPGGNGESRPKDSSGGPWLYKTHGTGICSASATSQGAPQTASNHQQPGERPGMSPPSEPQKEPLLLTPSFQTSGFRSGEISAAFSHQGGGDLLQQPQETDTEAMVWGQECMIRSSQPLVL

SEQ ID NO: 933324 - protein, 295 aa, Homo sapiens
MPPAIELTQAAGGRPRARDPTVLSCLSLTPPRFVNKDDHGTKFWPMRTFRKAIVLLTEKEGGKGSEGHMGTTLPNLGCEREGHVGTTLPNLGCEREGHVGTTLPNLGCEREGHVGTTLPNLGCEREGHVGTTLPNLGCEREGHVGTTLPNLGCEREGHMGTTLPNLGCTTTLGDNRRHLVKCSCVPWERASHETPQVRYGVRQRHQRSSFSLQILRPPDSCLPRADGPRHHFEKQFPRMKLQARRGMEPRDSPGVPAGVPGLTRRYLLYFPGVFQGLSERRIEIDVLVVYSMCPP

SEQ ID NO: 933325 - protein, 179 aa, Homo sapiens
MRWPHLGPPYPRIPLFLLTLSARPAASRAEESAPAGLMWKSKPVAVDLGPCGVDNPRAQMLPSAACISIRELDPQATSGATQGPTNTSVALEPNFVPMKRRKPWLGGKMSRPKAGCKWNAERRAEFGPLVLIVTVLVLLKVRWQQAAPELDWLDANPSSTTCELYGHGQVTSSSCALVF

SEQ ID NO: 933326 - protein, 142 aa, Homo sapiens
MRCLPAWIEQPRPLKGAISQRARAMQLHLATPVTSLITTSLESRNKVGVTRVQLHKLLSNSSPLEVPGHWAPMWLDACTEGFHGAVKEKKSYCPLTYVQSNHRTNAPFTPRVLLLGPVGSGKSLQAALLAQKYRLVNALAPA

SEQ ID NO: 933327 - protein, 149 aa, Homo sapiens
MSSRQLLGWQHQCWPWHFLFGQLCTVAELWALSSWQGPVSPDQTSTGRTCGPAGPAQNLGSKVRAFGNEITTTFIVCLPRTLSHSQRSQESAVIVPQTCQREENCLGRHPEEECPPAWPMVLLHTDGWQPAPCDKLIRPNLSMPGSALH

SEQ ID NO: 933328 - protein, 181 aa, Homo sapiens
MEEKLLASLSGCLTQSSPTDSSALTLKPQQRACWVALLAEGRLILRANTVLTKLVLSTASHLKGPVPFASLKRDLPESGQESMIHMPPHGVESARFLYVLPMCTKFDLGHLYSSSFLRPSVFLTRQNIPSRSLWWQSLEFPGREPLQKMVPDMPSVTTVQRMKQIHVQGMFSLCAAFIKSN

SEQ ID NO: 933329 - protein, 136 aa, Homo sapiens
MRCLELWSPNTLGTDDVQSPVLGTSLPHTCPPETGAQSEVCPNNKASPLDGFCRPPPGAERAGPAPARGVAQGGGLRSSVLTPCDASLVVPCAFCSEAAAKEMACLRLYSTLWKDGKQTVIDKSSHECNKFNSKVS

SEQ ID NO: 933330 - protein, 154 aa, Homo sapiens
MGAGSLQGCSQTGTGEHVGAWKLGDNRDRRAPKRESQPWLGKLLAGCPNVCCSQQREGHGVDSFPLPLVVLTSAQLWLSLGLLWASEGKKYTLVGPWVAMGGPEKAPQIPTLVHGTGSPVPNLQALPGLKVGPHQGPTPFCREACLLPAAVHGA

SEQ ID NO: 933331 - protein, 161 aa, Homo sapiens
MTEAEQVGDRHRGGSKVKTEAKIGGMRPQAQECHAGRQKLRNVSITRGHWLKTPQIWKSMSYKLKHTYLYWVLCPCVDHPVFFGVPLFAQAPQLEKHRRTDTSWILRLFLPPGTGRQSAWLCEWRSCSLAQRDSFQGAPLRGGRDRKVVLGGTSWDMGQAS

SEQ ID NO: 933332 - protein, 638 aa, Homo sapiens
MCPPPLLHGSCSWGDRYLCPGGWGLPRTCQRGWSHGLPLPPPPPAAQVAPIVSPGNARPWPQGAHGEGSLAPSQAKARPDDSCKPKSVYENFRLWQHYKPLARRHLPQSPDTEALSCFLIPVLRSLARRKPTMTLEEGLWQAMREWQHTSNFDRMIFYEMAEKFLEFEAEEEMQIQKSQWMKGPQSLPPPAPPRLEPRGPPAPEVVKQPVYLPSKDGPKAPTACLPPPRPQRPAETKAHLPPPRPQRPAETNAHLPPPRPQRPAETKVPEEIPPEVVQEYVDIMEELLGSHPGDTGEPEGQREKGKVEQPQEEDGITSDPGLLSYIDKLCSQEDFVTKVEAVIHPRFLEELLSPDPQMDFLALSQELEQEEGLTLAQLVEKRLLSLKEKGCGRAAPRHGTARLDSSPSEFAAGQEAAREVPDPQQRVSVETSPPQTAAQDPQGQGRVRTGMARSEDPAVLLGCQDSPRLKAVRPTSPPQDHRPTCPGLGTKDALGLPGESPVKESHGLAKGSSEETELPGMVYVVGSHHRLRPWRLSQSPVPSSGLLSPGGRGPQGALQSPSAQKRGLSPSPSPASKSKKRPLFGSPSPAEKTPHPGPGLRVSGEQSLAWGLGGPSQSQKRKGDPLASRRKKKRHCSQ

SEQ ID NO: 933333 - protein, 165 aa, Homo sapiens
MVYGTSEVIGQRQSLAAKPRRSQSESLGPEFQGLWEWLPGIPWPGGQISGTCSKLLGEEVLEERLAAAVQAKAGLAAKGEGEGVEGYLPLPQKSREGVETRREGVGGLAAKGEGPRQVSLHVMAPNFMRVRVKRPPKRLCVSNMAVYFTWVQYLLLIGKENGVFG

SEQ ID NO: 933334 - protein, 168 aa, Homo sapiens
MAEGTGDLARLGVGWFCLCSLGQHLRVPTTRSQPASSARVLYSLSTPSTGMLELCQSPLGQCKRPVEVTSQDGRPGGSHSCLIPVVFTPREVGPSSAAPTPESPGGTLRRKQFRMHEVNGTNEHRGYLRWLNTRRFLVGNTWKRRGNSAPLPPYLGLRVSSTGSFIIT

SEQ ID NO: 933335 - protein, 321 aa, Homo sapiens
MVQEKNTAGALGLLTELQNVLELLRSTGTGMLLNVSLKQSADEEVTSLAKSLVKSWKKLPDKPSNTCFICSLARSTSDSVRMKYREMLPAALRTGDDCIEMGTDEEELGSRTEEAIDPERGNTGMKYKNRVQSKISNLTDAKNPDLRKNAPCGNIPPDLLARMTAEEMASDELKEMHKNLTKEAIREHQMAKTGGTQPDSLTCAKCKKKNCTSTQVQACSAGEPMTTFVDCNECGNQQKNTSLKHSSAHMSAPTHCTELRGSMCLTGRAPRAASCQETVETEALSPSARGTEILPTTDSFLVQLIRHLDYSLRGAPEQRTC

SEQ ID NO: 933336 - protein, 338 aa, Homo sapiens
MDLLVLSQGHQANIPDIIHIHKEALTKVTESRQHVAEGKTEVQRLMMGEIQERLECLHKKEPSANSQDNGEKALKAFQRSFQQPLLSQALGMRREWFPGPAPWPGCCVHPQDTAACIPAAPAPAMAERCTVWERYRHSTPASSMRAAAGTYHCKPTGGDLPKALGAQPSHPCAVDVGQGFQKDDFGAVGLNDGPAGFWTFMYPAVMKIGENVKAGSQVANSQRDVCSSPCCHRPWDLGEKSGFLGQPHGPAAVCSLRIQLPASLQLQLLHQPCLKDAQIHRPTKSFVPSMGKNYRHSTPAQPMKAAAWAEHCKATGAELPKAFGAQPSHPCALDVGQG

SEQ ID NO: 933337 - protein, 141 aa, Homo sapiens
MIKHQGKAAFLVHDRRWSFGFTDKTCLFCLYQKMKGIEIKRRERLKCGAKIERRKRLRDSEGGPEVVGGSFSWSKEQEDRGLICQGRSPDPSHGTKFHVCPCEETTKQALCEQHGCLFHLGAGGLSPKRESAKGDKGGAVL

SEQ ID NO: 933338 - protein, 153 aa, Homo sapiens
MGKGNFPDPHRSINRQITNADLWKHQKDVFLSAISSGADSPNSKNGNMPMSGNTGENFRKNLTDVIKKSMVDHTSAFSTEELPPPVHLSKPGEHMDVYVPVACHPGYFVIQPWQEIHKLEVLMEEMILYYSVSEERHIAVEKDQVYAAKVENK

SEQ ID NO: 933339 - protein, 138 aa, Homo sapiens
MNFSKVLTMRTLFSRAITNSAAANIPCQNPPVHAHSLLLEVLGDRESLTSTSAEISLNSSKVIVPLYSAVSHLQQHLKLQKLKHFRNSDISSLRTGHDDDGGFVEWKRGKCGERKEKSDCCCVCVERSRHGRLHFVLY

SEQ ID NO: 933340 - protein, 251 aa, Homo sapiens
MSATSLQIPKPRRLAQAIILAHDEVHRGGAWGSEARVELDRRHSPQQVAKRDGSAGLPIPSGDGRRLFPEEWGGVRNGNRWRRSPGPWPALAPAHAWPLRRESRRPGPPPARLAQPAQVSAASLGNYRPPAAGAGRAQGPRPRHSQPPKESCTVYDGRQRARFHKARERGRGGAAGAVTSRAATPRGCPAPALGRAWGGSDARPPVHLRRFVLPPPPPSLSGLCLDWASGPVSKATVEDSHDDADGGDNLD

SEQ ID NO: 933341 - protein, 152 aa, Homo sapiens
MLNRIALNELIEQSVKWAWLPITSQCLTTKGRNSAGRTEGEQGRLPVGGIFACGVIMCKSLILSEAQSPHLENADQNHIYFIGLFCTLSEEVNAKPFMQCLLHEKLNSDAPKQVKNELHLGKNSSMPWNVIKILKLGDEFTFFVWVRICKWK

SEQ ID NO: 933342 - protein, 160 aa, Homo sapiens
MPHTAGYPSVTKLPEERSGSNIGCSAIFAVLQLPLLISRHTGSGVDLQQTPTDLQLRVLLEGELTNRKDIHTKTPSVCHHHQRPKLKEDVRAHCEEAKNVEKRLDEWLTRINSVEKSLNNLTELKTMARELRDACTRFSSRFEQVKERVSVIEDQMNEMK

SEQ ID NO: 933343 - protein, 144 aa, Homo sapiens
MWFLQYKQAFHPAQIHNASTPAFCVKKKSPLVSLPCVYRPQEAKREKENRTVLKRTSSTWPIEGAQQVIVGLPHLSQQKLFIFKVECSISEGVPASKGFTTRGIPQTSTVTGNFSPALPPYCLLRTLGPLKCDSIRGGFPDTGM

SEQ ID NO: 933344 - protein, 189 aa, Homo sapiens
MPPKELFTPEARETPNPPRGTNNSRCAALRAVTLTTVCSFTTEPARPRTRQKEETPNTSEHQKEQTTDTPPLRTVTLTVRVRGFILEVSETRSPPIPDTISSRKAKYIELTQVVLGEAFLYINSQTETQMRKTIPFATATKRIKYLGIWLTKEGKDIFNENYKTLLKEIREDKDTEKLSMLLDRKNQYH

SEQ ID NO: 933345 - protein, 139 aa, Homo sapiens
MAAGTEVLRDPRPVGPYMGLSSASAQTPGGSLCCSGGSWWPWEAVPLWLHWVQALQLLSQAGIKYLQLFQAHDASCQWICLSDGGPILTGPLGSVSMGTLCGASNPTFPFHIALVEVLHEGSIPAADLCLDIQVFPYIL

SEQ ID NO: 933346 - protein, 138 aa, Homo sapiens
MGATIQDEIWLVTKGIVLNKKTVMQGGLSSKECYRFKFFSRLREQTIIYTGTGRQGFMEGSNAPVCTLEAYFPGLYCIAAATWVTCDPDRSESRKGTDRRETGGQVVNVAMGRKRNNSSSNYTLSTYANTLSPSFTLC

SEQ ID NO: 933347 - protein, 125 aa, Homo sapiens
MNRVWVTEITCFTRHGEQQVRNPWVENDSGMLDEKQEAYVADGVSEVDPSSSGPREVVTHQSVPSWWALYFTCCSLSPLKAKHDLSAASSQSDFAEGSNDFVCSRRIEQGLANDSPWTKSSPMFL

SEQ ID NO: 933348 - protein, 212 aa, Homo sapiens
MSLPDSPEESSGSLSTAFEGQTASSSGSLAPMYPDWETPHSRVRQTLHKKELQLASGRCPSGVKLPEEGTGRNLCCSAASASDTQAKRVWSGPPANSSRPAAEECLFSSKGSQLLTSKGTKLWLIKNSSELKEHVLTQRKKAKNLEKRLDELLTRITSLEKNINDLMELRNAQYENFVMHTQVSIAESTKRKKGYQRSKINSMKVRRLEKKE

SEQ ID NO: 933349 - protein, 178 aa, Homo sapiens
MVSSIWYVFAAAGTDCSFPCLVLPSGAFVGEVLLDTILKSVFQPGSILPFTIRYTNQTDALPREEESGEAVWLWRLCEATLDSTQFKLLSCFVYTVRGKLPTQASVMADNPPPTKLQCPRSTSDCCAGSENFKPGDLSLLDSMGVGSTELDHLAPWLQPPFQGSEWFGLTGIPGATGV

SEQ ID NO: 933350 - protein, 163 aa, Homo sapiens
MILAHHNLCLPGVNEVLAACLCRLLNKADNLQKEDTRCQVHPAIIGVYIDFGEIEFNKCTLRMIADTNSMSRRLNPIIIPEKCALLKKNQKYIDSGRFMDRKEEIDVQKIEVRDIPFTNLAKTKNTEHPGSKRIRDAKNYPLTIRLEEGAWFLFEYAKKIQSN

SEQ ID NO: 933351 - protein, 137 aa, Homo sapiens
MADAPPPARLQPRKLISDYCASSEQGSVGMGPDEPGMGENLLVCWLLRPWEKHSIWAEVSHFSRMVRSPRPQGGPEVPSRSRGLESKTLELYLVFCYTATELTLKLKDDSTEFMASQFLCSLHHTAAAGVGEGWQFR

SEQ ID NO: 933352 - protein, 158 aa, Homo sapiens
MCLELVPSGGFLVLLTSRMKPRTLMAIAAIDSDSSDGSGQSKLKTCWKGFIILDSIKNICVRNVASHLLLPVSFKAMKGLILKNLRNVRNVVKPSVVPVPFESMKFLICGFKKPYECKKCVKAFRCSNFTRTHEKTHTGEKPNKYKEYENVCNFPSSL

SEQ ID NO: 933353 - protein, 141 aa, Homo sapiens
MFYSSIKQFVVKAKKRIILFSVDVAPCYNLTNSVQGFRLPYISANTGYFLFLNCSHPNGYEEIPHCGLICISLMISDVEHLFLLAICTSSLEKCLLKSFAHFYFLFLNFISILSGVQEVFGYMDYIKIIDKNLEIKIHKEK

SEQ ID NO: 933354 - protein, 141 aa, Homo sapiens
MSFNQEEEGKLLKSDPTAKGQLLPFNTPATLHSPQPMTDEPWMQKGSLSGDELTEGCGTRGRWTGLLFLGLLQLVGGVDKAFRVFGPSFVQGWQEKLHCRGSGQEAFSCLWRLCPGSCQVGTGLIALVGGGWRPKPGGPAW

SEQ ID NO: 933355 - protein, 151 aa, Homo sapiens
MWKGNTGLEPLHRVPTGAVPSGVVRRGPPSSRSQNGRSINSLHNVPGKAAGTQRQFMKAAARAVPLKAIGVELPKDLGAHPLHPCVLNVSHRVKGDYLGALRFNDRVLDFHGACSPFVSVNGAPFGTGALIQCLYFHCILEKQKPVQPVEL

SEQ ID NO: 933356 - protein, 168 aa, Homo sapiens
MGVGLGKWANSRGILRHNRNASQPIGCGGCMRGEAKIIYTLLTTGPPKNPPTTSVRHEQVTDPQCRVWTSADLDSDGHPVIWTWLSITTIPGLFTVRPIYRLKGLTFLSTQVEISEYSRQAGIEAYHRSQKLFFHLECTSIFPHGLLPDFLTTATKDIDSYIQTDIQN

SEQ ID NO: 933357 - protein, 145 aa, Homo sapiens
MVWDAQFITDTVGCKAASKLILIDCSCPGTDQNSFDSNVVSVAAEQSIQNAQWEGSSAMLARPDAKIISPTCQLAKAPERTCASDSGNPTCYKQPCFTAEDDSCPRLNGYNLMEMSVPLTRRHLKARKMAIYPEIHCPKHSKRPQ

SEQ ID NO: 933358 - protein, 145 aa, Homo sapiens
MKRGNWYKSITSFFLLHWLIYEEKRFDWLIVLQAVQEPCLGSPQETYNHGNRQRGSQHLVSYDPLHRAMLSRLQEPFLTLALSGLAVTVPFPARILTITVSRSSMERSIGIQGNEALSLITYKELRLDSNHSVAKAQERIRNKMP

SEQ ID NO: 933359 - protein, 141 aa, Homo sapiens
MAAVIPGELYYARRDKDYLQHIHWGTDVTDQMSLYYLPPQEGFGHKEYQDQEKGTQVTMHTVRLIMCIETKSLMFQRAVPAPFLLLPPGAPVCPLSSCRSLPLSPLPNHQPQTGAVHLLLIPWSVGGPLRLGIVSPMVVWP

SEQ ID NO: 933360 - protein, 148 aa, Homo sapiens
MMPTSGHSTAWLLPFAGGLLQSPVASVSPIPGERDQSSVCRILAGLAEAPAGRSCQVRRNGSGSSLKRQSGDDLARQLCCVVREPSSSRPSVLSTASRLEQKLVEFQNSQYHRPTKEHYVDCLSYKVTITTAIIAWYRSAEPKEKKNG

SEQ ID NO: 933361 - protein, 154 aa, Homo sapiens
MCGTWNFELERDDLGYQRSCEKRATILQSPECRSTNSLHCVTEKASGTQCQPMIVAVGPESCKATGMELLKAVGAHSLRQHALDVRHGVKEDYFGALRFNDYPAGFWTCMGLVASLFRPTSLIRNGNICLMPTHTHPEKSNGKKYTEEVVSGYH

SEQ ID NO: 933362 - protein, 125 aa, Homo sapiens
MGGLKFKLHQLLAFVMAKDLNYSEPCFLYLQNLHITHFTREEEDITTDTTEIQRIIRYYYQQLYDNKLKNLEEMDTFLDISNLPRLNHEEIQNLNRQIETNKIEAVIKSLQSKKSQGPDGTTAEK

SEQ ID NO: 933363 - protein, 169 aa, Homo sapiens
MKAAYFLPNLPVPCVFLISVKELFSSSCSGEKTWRHLQLIRSCQTLPISISSGFKTQQMLTMLCAHGGDALVEEKTKYALLQSVVCVASMSSLSLCIHPTGPHSLHTIRLKRDGKIIPGSGLVLPVTSVVAFQQEVTEGSAPRPAMVLGYCPALLASYSQRAVMCLLRI

SEQ ID NO: 933364 - protein, 260 aa, Homo sapiens
MEKYCLKNNITFKILLTADNALAHAPLIGDLYSNIKGDVTKEYINGTWKKTFKSFNHDVKGFVKDEEVTKINKAVVEMTNNLNLGVCEDDIEELLEMIHEELTNKKLLELQEEQIAEEEARGKIITGEAAAAILDPDPDPSPAHIMPPPYNPDSWEPSHEPVTSQPQYPSLKGLQHDIEQWRNAIQNFPFPSTSKESAPTLFPLKEVPQEWGAIGFVNAPLTSLEIQTLTKELKPLFDDPYGWQIKLINSWDLNYTLALS

SEQ ID NO: 933365 - protein, 167 aa, Homo sapiens
MGANLAGTDLIGTFEMHFINPSSSSPPFLSSPSKPSSNQTAIPSIPNDKTKVDIVEVNDLRQTLAIETGYQDANSWLEWIKYSVHMLNKSNCYACVHGQPEAQIVLFPLGWILQLGTINNAKLSFCSILKSNTLRVSPRRPSSFHLPTSISPCVSHNKGKTWHSLEA

SEQ ID NO: 933366 - protein, 152 aa, Homo sapiens
MAEGKEEQVTSYVDGGRQRQRACAGKLHLTITIRYMRCIHYHENSTENTCPRGGTDPILPLGPSHNTCEFKMRFDWGNSQTLSPPNYKGKFSNCGIRKDDRKKGVLRKIDFLVALCQTCFYLIQFSIARQTVLSWILRRGIVNTQRSKTACP

SEQ ID NO: 933367 - protein, 138 aa, Homo sapiens
MQSTLKMSLESGPEDPDLRDNCRIRVAHLTSRHKEATPDIPDNALPVTPLRRPVPPPQCRASSAGLCPIDDILLFHIYLLSLDDIIITHSYYIHTDDHQIQISSPTCKRIPRVMRSRRELGYDSLLCHEQESRYVFRG

SEQ ID NO: 933368 - protein, 148 aa, Homo sapiens
MIQTIGHKIMQGMTAARTPDSYQVTANSSRRSQSVEMQPGSAVQQSKGISLGGHCPKHLASPGDTLSSLSAMADEVKECNQTIVKVDVDGILALRRLDQMIPKVPPNEFLMNFHISFTLHPTARKFGNPSILNAKQIVIPSIKILGVM

SEQ ID NO: 933369 - protein, 151 aa, Homo sapiens
MYPRQSQETEPCQRPTSSSSFSCPWHGSTPQLDATTILIFAIIFSLMIIFKLYMNGLILCMCTLFSFTKNFFLFIILDYHCLLTQCCCQEVSYQFNLLSLALFDFFFLLAFYSFGMMFFSLSALNKILIYFPTFLVVLSKKVGPAMIRNGI

SEQ ID NO: 933370 - protein, 157 aa, Homo sapiens
MTENSSVDQGIQQATSPLGSGIVTKVFLSQFECGVLFLMPKHGNLCCAISITDLYPRTSLFDDNKNNIVFLIFNFSVHCCYKIIYHFSMTRYCGRLWMKDSYPGEVNSTIGIANVKFAHAIRGEEKEFPGQNIKNCFPPIYIFMEDKDQNYNDQKRW

SEQ ID NO: 933371 - protein, 141 aa, Homo sapiens
MMTMAVFSDFHKPELCNWTNMYGCPPALQSLSWEAMEERPCIPSWGEHEVWGRRQLAESGGLAEGLVGWQDTRRDELSFPGRFGRCRLLAGLRVFLYLDHHLLSSSVMSAAVDSLPAVPRLLPCVLSTQPTEAVCASLLVV

SEQ ID NO: 933372 - protein, 126 aa, Homo sapiens
MLLLRGPRVVFFSPLTCRLGSLPPLLTGLLFVPLTSPGSAPACVVPLYESMYSNRLAPTYKDRLSELVTLRPESLQMRSRKPRKALSILDKRISKSKNPEARKKWSVHGAVTEITESETAVIKGLL

SEQ ID NO: 933373 - protein, 138 aa, Homo sapiens
MPSVSGVCQRRHNKCSNNCSFNEEHFTSVSAVPWACSTPGVVKVGLDSVICGGWLNLPFFIFPLRYERQDSRITPTRGITLHRTETVLPCLQGGGGLLAPKCGATSGFLEHFQVISPALLQFLGLLKKLLGKPVMVKI

SEQ ID NO: 933374 - protein, 117 aa, Homo sapiens
MLPNSYPKVCSNLYFYQQCMKVSDVLHPCQQLVLSVFYVLAILGRCSLAWKHGNLLSPWVAQLEAFDPSPQQKLLTCFLTTAKQWVEVLVWFRLASGSVAFGENKSPITSLKKQVGN

SEQ ID NO: 933375 - protein, 151 aa, Homo sapiens
MREVGVFPPSVSRSRLRECSSRLCCPLEASGGKCVKSAFSLLPFPGAACVNVLPGSAAPWRLVEEEEEERKKGEVKTETLFGQSGAFSTFGGTALTLANHGTDLCHHMGVDRGGWWHLGSLLGFPVERNILCSSTGEQGGQGSVSSNQQKH

SEQ ID NO: 933376 - protein, 144 aa, Homo sapiens
MPTSQNQLYSLPFCWSREDLQLVPKAGGAPVCPGPLPAYVILPAVLASHHIQSLPIPQGHSLLGEALPPAVHSEGAADPSRTWQQRAETHNDDEIRKEDKNNKVVEFRSHRDKRKLFSGVSDHFQRKDIKMLMSRMTQLNGPAT

SEQ ID NO: 933377 - protein, 224 aa, Homo sapiens
MGLPSAAPPGRSCCGSGAGGNPQPAGGLRQPGCAPGLRLAPGPLSSRDCFCLAARFSPAHLLRCQTARAALSFSPSGTHCRGVPQARSQSLLARPRRRLHPRSPPSGAHPPPENSRRAARLRAECGLLSGARPNKDGEGFARGLKPFAISEQPQPKTTLERRAKNGYLLPALKSEAGRCGITTVRLQSNRTHSSHPHLPQPPPKQHTFRLKKRRMVFTQFPFYR

SEQ ID NO: 933378 - protein, 163 aa, Homo sapiens
MAVASTWVCAPSGGLGEVALLPAKARPYGVGRSAGSNRMPWLGPPWAVIGRLIIGQNGVLSTPAVSCIIRKIKAAGGIILTASHCPGGPGGEFGVKFNVANGGQGGMHRSRGATCDVCGRRSLPPHSHNLLHAPGEPCCGMCRKLSMLADFLEEVKFELRCEE

SEQ ID NO: 933379 - protein, 140 aa, Homo sapiens
MGSKSHLLSPPELLRSTVDSQPVYYIGGNISPSGNYVLFDRWVYTLGVQVVHPSVLRVISSSSTLNIKNRITGAISPGGCTLIAMLGVMSCSIPWILGSVSQGECTPTEILKLISCSPSLDIRNNITGRCTPPTVLGEII

SEQ ID NO: 933380 - protein, 124 aa, Homo sapiens
MTAVRSMLLGVTEQPWRPSALTLAGGGQKEAGRGSFSNKLGKKFPHITHVTLATRRTISTTEWKKMTMLWERMDASRRARYPDANQSHTRMQAFASLPTFSLTGVLWSSCISMWTSLARLRTVS

SEQ ID NO: 933381 - protein, 152 aa, Homo sapiens
MGFPGSSCSSHNSSGSEPCTIRGGLHGADGAARSSNNGSSEDTDNEFQYFSRNGRLAMMLRAKVFRVCSIKSQGFAEELSMTELGKGLGGTISEKRGKEKLALQRCYEESVIIIITIIIIIIIMDMDEAGNHHSQQTNTGTGNQTLHVLTHK

SEQ ID NO: 933382 - protein, 146 aa, Homo sapiens
MVGPSAAGLLEFAGGPFQTLFAWVSAVEAAEQRILLNRKCCCLIVPLEASSQRSTQPLNSIVTDKSNSNCCSPIIYRPSPAPHLWKIVPEDIHSLVLLACLDYGLSLFLNQKLPCKEAQKHMLKCHWHEWEASTKLQVIAGHSVED

SEQ ID NO: 933383 - protein, 143 aa, Homo sapiens
MFHLKLHRYPPSQPTFFKWMIICVYSDVHSFTEGARGNLYVCTLKVITHWLALSCSVLCLGIRHKEASRFSQTVPESEYRQTPQSAIEPTLLVQTLPFLMVNFSVENSLAFPVKGICPPSCSKSLWNPPVILKCASKILTTDT

SEQ ID NO: 933384 - protein, 137 aa, Homo sapiens
MPGYAQRPDPMLAHTPLATPHLACPWHPGIQAGSTPEASPNNPLDVTLKLGHHDGLQSMRWRFQNFCCIEEGVRRLRDMEILDGLTMEYLRTFNLTIFSEHRKLSFYKHLEEPYTMGNLAHEERAFMVEKYKQRTHP

SEQ ID NO: 933385 - protein, 168 aa, Homo sapiens
MPAEHKRQEKEEVDKMTEQKMKEEQERRKKKEMEERMSLEETKEQILKLQEKLLALQEEKHQLFLQLKEVLHEEEKRRRKEQSDLTTLTSAAYQQSLTVHTGTLLLSTQGSPGGHNRPGTLMAADRAKQMFGPKLLTIRHYVGPATAFAETPEHGQFQGSPGGAYGTA

SEQ ID NO: 933386 - protein, 170 aa, Homo sapiens
MAQSAPATAGATTPESTSYFRCIKVWVPRQKPATVVEPCKEPLLGQCQGERWGWSPHTESPPGYCLVELWKQVSHSPDTRMVEPLAACTLSMERLQEHRSFSDRGSGKSYQNTQFQQLLFRPHPVFLIRLQIFALFLACQREKWPSLLTCHWLYLSPYVAVANLPPKKIK

SEQ ID NO: 933387 - protein, 146 aa, Homo sapiens
MIQCEHTEPWPYSQAVPHTPSPFSHTRISRSHPDLLDLGLIALASENSHTFPLDLANGDALSLLILDFPLLAAIGSSYVLLFFPLCKTAPPGSSAFGFKNDLDYKCLLRQAQPPRQKTCRGLGGIFSGTSSSAGEARNLLQLLFLD

SEQ ID NO: 933388 - protein, 146 aa, Homo sapiens
MYITITKDQRNIASCQQQSWTGNDFDELRQEGFRRSVITNFSELKEDVQTHHKEAKNLEKRLHEWITRINNLEKSLNDLIELKTMARGLHDACTSLSSRFDQVEERVSVIADQMNEMKKKSKKKRTKPPRNMGLCENTKSASDRCT

SEQ ID NO: 933389 - protein, 606 aa, Homo sapiens
MAAATAIIPPSEEGPQYKGANVRVSIFMTIWSIGRSTAETLGPPGSLEMGVLTFRDVAIEFSLEEWHCLDTAQQNLYRNVMLENYRNLVFLGIAASKPDLITCLEQGKEPWNVKRHEMVAEPPVVCSYFAQDLWPNQGIKNCFQKVILRRYKKCGHENLQLGKYRKSMDECKVHEECCNGFNQCSRTTQSKILQCDKYVKVFHKFSNSNRYKIRHTGKKPFKCKECEKSFFMLSHSAQHKRIHSGEKPYKCKECGKAYNEASNLSTHKRIHTGKKPYKCEDCGKAFNWLSHLTTQKIIHTGKKPYKCEDCGKAFNQSANLTTHKRIHTGEKPYKCEECGKAFSQSSTLTTHKIIHAGEKPYKCEECGKSFNQSSIIHTGEKFYKCEERGKAFSQFSHLTTRKRIHSGEKPYKCEECGKAFKQSSTLTTHKRIHSGEKFYKCEVCSKAFSRFSHLTTHKRIHTGEKPYKCEECGKAFNLSSHLTTHKIIHTGEKPYKCEECGKAFNQSSTLSKHKVIHTGEKPYKCGECGKAFNQSSHLTTHKIIHTGEKPYKCEECGKAFNNSSILNRHKMIHTGEKLYKLESCNNACDNISNISKHKRNCAGEKT

SEQ ID NO: 933390 - protein, 156 aa, Homo sapiens
MVSQAKSLRPLRERESRSLACRQKGKKVVTAALCSSVVKILHFHMWRSGFDSPPRKPPTEKRWKIRDPWRKEVPDFSNRPISLGYKVPKPVPSTNRQAATGRVTFTQDPSVATRCQSRIMQGPAKMVNSQEESSSFSILEFTKGSMMTLDFPFNVR

SEQ ID NO: 933391 - protein, 434 aa, Homo sapiens
MSRQTTSVGSSCLDLWREKNDRLVRQAKTNIVAPGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQGLQELITGNPDKALSSLHEAASGLCPRPVLVQVYTALGSCHRKMGNPQRALLYLVAALKEGSAWGPPLLEASRLYQQLGDTTAELESLELLVEALNVPCSSKAPQFLIEFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGDLNFQFSSYLLEVVVVEVGSL

SEQ ID NO: 933392 - protein, 137 aa, Homo sapiens
MALPVMMNSDLTLYHQTEILEGPVCSRLVEFPGQEMLPAWQGVHESLNTQGLMNTQIQVHESKNTQVMSKEDIIYPSQLNLSRQHPACYVSHIFQKPSLNPMFSFCYFLIFLHLSGTNLLEYVIILAITNCSPSVVS

SEQ ID NO: 933393 - protein, 138 aa, Homo sapiens
MSPPDSGARLSSPSGFRTGAAGGAVCQSPAVRPHSSALGQEIERSAGGRALLGDPVHPPQPLAWVLSPSLPGAGRASRLLRVQGPPSPRPPGTPAGPQAPRAAPVPAGASPSTPPCKLRELSPALVSPERGSHSAVVG

SEQ ID NO: 933394 - protein, 271 aa, Homo sapiens
MRDRRGPLGTCLAQVQWAGGGDSDKLSYSLKKRMPTEGPWPADAPSWMNKPAVDGNSQSEALSLEMAGLSLPSGGPVLPYVKESARRNPASAATPSAAVGLFPAPTEYFARVSCSGVEALGRDWLGGGPRATHGHRGQCPKGEPRVSRLTRHQKLPEMGSFWDDPPSAFPSGLGSELEPSCLHSILSATLHACPEVLLKDETKRIFLDLLNPMFSKQTIEFKKMFKSTSDGLQITLGLLALQHFELANSLCHSLKYKQNNASRLILRVVLE

SEQ ID NO: 933395 - protein, 242 aa, Homo sapiens
MKVAALSRATKKRSASHPVGLEGHTSGYADSLMGSHRRASRATVGGGTNQDRCEDPAGAQSRLSRRALHRPVTQAEWLVYLLALRNLSASVSSSEKWGSAIKKRHSSSNGISNSNEVVRAECVVILSPFYRLRRAAYLGDPAAKPRKPDPPQQAAPQNRRPSFVGPELMAQAQRGCRAAQGARPSPQQGGACKPQLDLSGRCGLLTAGRDDNDIEGLTSGSPVIRADSILNCWGTLRPTKEL

SEQ ID NO: 933396 - protein, 143 aa, Homo sapiens
MKYREMLAAALRTGDDCIEMGADEEELGSRIEEAVDPERGNTGMKYKNRVQSKISNLTDAKNPNLRKNASCGNIPPDLLARMSAEEMASDELKEMHKNLTKEAIREHQMAKTGGTQPDSLTCGKCKKNCTSTQKNTCRLEGFS

SEQ ID NO: 933397 - protein, 330 aa, Homo sapiens
MKGLKCLAKEFGSCTCVQQFLSSCLTSKKNEDMLTVEGKKGRRQSSENEEDSPHQKLTLLDLNVSIQVPHNHLDGLCDQQHMVDVAVVCPELVGSLLTDFKNEAVDPHESRLVHFTESCLVRFDRVLIGAFTISELDTKVLHLPTRLARYRVSTRRFSKSPPESPVGFTQWIPLILVPQVELPASPSRAPALLSPWVVDGTGRCGAGGVARQGGSGCAGAHGGVEEAHAWWAAGPQPCPEGRQLRPGEKSSAAAGPGAKPLTARGLRATGPPSAGPAEPTPTRNSRWPASAQHAAPVLTRASSSTPPCKLREPALALASPEGGSHGAAAG

SEQ ID NO: 933398 - protein, 123 aa, Homo sapiens
MPKYGINLSVHQWIKKMWYIYTIEYYLAFKKKEILSFVMTWMDLVGFVLSEISQAQKDKYHVISLTWGNLQQVELIDAESRIMVTSVQGYGWGNAEMLMKTQNISVRMNKFRRSILQQCDYIY

SEQ ID NO: 933399 - protein, 136 aa, Homo sapiens
MASPGCLQQVPLPCALAGSYADPVMTFITLHYKGYINSVIAHCYSNNNGFWKKEENTPDNRNSRKKGLVVPGGIECLENIISGNKQLKQQRGRGQDTEGLVCYALGMGNHGRVSNGAVRSDLNFMKDSGLGHWKPI

SEQ ID NO: 933400 - protein, 137 aa, Homo sapiens
MTKYHRLGGLNNRHLLLTVLDAGKSKIKVLADSIPGEGPLPGLQMAAFLINSIKSRVWFYGKDNDAGLTPVEGEWEGKIVRKEEYQIPCNSRKVLARESYQRQKKNCKDTAEWRRKPSLRDSGCLCVSAGHDSPRSL

SEQ ID NO: 933401 - protein, 190 aa, Homo sapiens
MGQKKGIFLHLCQSPFDQRLLPCERLTPLYFKVCTFVRMPYVATAEKPQKPKTRGLRREQGRLSELLSDTKVICKTESSQVLQWKSFPLIPFPNKYAWMLWGVLHITPFMQPYPLHTDRAIHTFCQRLVNQSNSILNRSWTGYYERIFWLMVLEAGKSKIKGPHLEKAFLLRHPMAEGKVKSPHGLSTSH

SEQ ID NO: 933402 - protein, 139 aa, Homo sapiens
MNTRHEDACLLWGSFLMMKKKADLYDYQHRLPGPWVFNWVPSGSCERRPKGEKQWLLRKDPPPDYLVGVGQDRASTYEPLGKDVPPSRQHPKYETVSLNFPAQGSETVLFKILTVPPPTHTKHRGRTVCPHPLNSGVAM

SEQ ID NO: 933403 - protein, 139 aa, Homo sapiens
MNTRHEDACLLWGSFLMMKKARMYRPVDNIPNMKPFPSISPHRAVRESLDLASGRGFTLTPCVTTAWSLYSWFLSVCTVEICPPAPRLLDCWKDWLIPGNDASAFTFSQLAKCTTQASSAAGRQGRKGPCSGASCPSEN

SEQ ID NO: 933404 - protein, 128 aa, Homo sapiens
MLSCVSHSARREYSENLIVHAARRDTLDQCGFIFPKSSCPFAPPIQSINDQHLMDATSPEGLGLQQTTNSKTLSAPMAHERGPEFLSPLEGYRGEQMGILATSSGVHCISSVKAGPSQLGVDVSGATG

SEQ ID NO: 933405 - protein, 274 aa, Homo sapiens
MVSANQTASVTEFILLGLSAHPKLEKTFFVLILLMYLVILLGNGVLILMTVSNSHLHMPMYFFLGNLSFLDICYTTSSVPLILDSFLTPRKTISFSACAVQMFLSFAMGATECVLLSMMAFDRYVAICNPLRLPFCGDNIINHFTCEILAVLKLACADISVNVISMGVTNVIFLGVPVLFISFSYVFIIATILRIPSAEGRKKAFSTCSAHLTVVVIFYGTILFMYGKPKSKDPLGADKQDLADKLISLFYGVVTPMLNPIIYSLRNKDVKAAT

SEQ ID NO: 933406 - protein, 212 aa, Homo sapiens
MGATECVLLSMMAFDRYVAICNPLWYPEVMNKATYVPMAAGSWVAGSLTAMVQTPLALRLPFCGDNIINHFTCEILAVLKLACADISVNVISMGVANVIFLGVPVLFISFSYVFIIATILRIPSAEGRKKAFSTCSAHLTVVIVFYGTILFMYGKPKSKDPLGADKQDLADKLISLFYGVVTPMLNPIIYSLRNKEVKAAVRNLVFQKRFLQ

SEQ ID NO: 933407 - protein, 303 aa, Homo sapiens
MVSANQTASVTEFILLGLSAHPKLEKTFFVLILLMYLVILLGNGVLILMTVSNSHLHMPMYFFLGNLSFLDICYTTSSVPLILDSFLTPRKTISFSACAVQMFLSFAMGATECVLLSMMAFDRYVAICNPLRYPVVMSKAAYMPIRLPAPGLPFCGDNIINHFTCEILAVLKLACADISVNVISMGVTNVIFLGVPVLFISFSYVFIIATILRIPSAEGRKKAFSTCSAHLTVVVIFYGTILFMYGKPKSKDPLGADKQDLADKLISLFYGVVTPMLNPIIYSLRNKDVKAAVRDLIFQKCFA

SEQ ID NO: 933408 - protein, 294 aa, Homo sapiens
MVSSNQTSPVLGFLLLGLSAHPKLEKTFFVLILLMYLVILLGNGVLILVTILDSRLDTPIFLTPRKTISFSACAVQMFLSLAMGATECVLLSMMAFDRYVAICNPLWYPEVMNKATYVPMAAGSWVAGSLTAMVQTPLALRLPFCGDNIINHFTCEILAVLKLACADISVNVISMGVANVIFLGVPVLFISFSYVFIIATILRIPSAEGRKKAFSTCSAHLTVVIVFYGTILFMYGKPKSKDPLGADKQDLADKLISLFYGVVTPMLNPIIYSLRNKEVKAAVRNLVFQKRFLQ

SEQ ID NO: 933409 - protein, 209 aa, Homo sapiens
MERLWSLMLLKEKRVRRQQMLQGLVVFQFKAVHMQQTGPPRNYQQNYQNSESGEKNEGSESAPAGQAQQRRPYRRRRFPPYYMRRPYGRRPQYSNPPVQGEVMEGADNQGAGEQGRPVRQNTYRGYRPRFRRGPPRQRQPREDGNDEDKENQGDETQGQQPPQRRYRRNFNCRRRHPENPKPQDGKETKAADPPAENSSTPEAERGRTE

SEQ ID NO: 933410 - protein, 221 aa, Homo sapiens
MVTYKLVLIRCGESTWNLENHFSSWYNANLILVGHKEAKRGRQALRDAGYDAEESDRILWTVLDAIDQMRLPVVRTWCLKEWHYGSLAGLNKAETSAKHGEAQIKEGKWVLTAAHGNSLRGIVKHLEGLSEEAIMELNLPTGIPIVYELDKNLKPIKPMQFLGDEVTLCKAMEAVAAQSKAKKRRPAGMLLSPGTPSLAIPSSAPAPCTCHTDHICRHLML

SEQ ID NO: 933411 - protein, 149 aa, Homo sapiens
MLNDVEHLIICCLISLFACTGKFLKKLLLPVLPHGQKNLKASLLFLFIILLCLCPDFPLLWILGDMTSLSHQRASFLSEASYSVTSLSLAQYCSGLESSFRFTGNLSGGYRDFPYESPLRYYQRSTTQRYICCNLLYVDTSSPKGHRSR

SEQ ID NO: 933412 - protein, 214 aa, Homo sapiens [sequence omitted]

SEQ ID NO: 933413 - protein, 140 aa, Homo sapiens
MRLEKTTYGMNSRKKQGEKACKEDGAISVTSAHETKKEPKGGEFTIGIWQCEGCPIQPLMGDRQEHMSEQVQEPATLALAGANSLWALQQHLGGVPAIPRPQRVCYNVVLALSSTDSSSVGPLPHCMEQLPSASEGKGPV

SEQ ID NO: 933414 - protein, 148 aa, Homo sapiens
MRTTILMAPRQTLCLSLVEIDINPERQYPLKLEVRKGLEAIIDNLRFQDLLKLCNSPCNTPILEIQEPNREWRLVQDLCLVNETVVPVHPETPLKNTDWILFMDTSSSTEQGIHKAGYAIVTLNDIAESASLLGHKCSTSQEIEWATS

SEQ ID NO: 933415 - protein, 182 aa, Homo sapiens
MSLPILGIISFTNFSHSGGVWSNSSFSKTSRGGVSPPPPTGNGCGLLLGEKPQLTPPQNSRCGCSTQGCLSLRLPCSCDPFVQCLSLATSEQTSAALNLKIKSHMTQTFKGIPAPCDQSLMKTLEISKSSYTGSSGGAERQPCAEQAPFLPRPPAAAGATESSVSACLLPSVVFSSLHRVGE

SEQ ID NO: 933416 - protein, 144 aa, Homo sapiens
MSNTSSASILGAIFSTKQEFFASLLDENVQVILCPYRAVEKLLSIEGQTQHCMMEYTASSFAYFQKYVQTKPSRFQIPVDVMSSAVGLGSVQCCDLTCWEYGCLHCPTKPLANCQQVQREIPSSSCSGNAICGMPTEQTLILSG

SEQ ID NO: 933417 - protein, 148 aa, Homo sapiens
MGKKQSRKTGNSKNQSTSPPPKECSSSPAMEQSWTENDFDELREEGFRQSNYSELKEEGQTHGKEVKNLEKKLHEWLTTITNAEKSLKDLMQLKTKARELHDKCTSLRSRLDQVEERQKLYKPEESGGQYSTFLKKRIFNPEFHIQPN

SEQ ID NO: 933418 - protein, 172 aa, Homo sapiens
MTKLDEQVKLSKPHFTDGDTNSKRENELCSRFWEKLFGTCMEQLALPGLDFPLHVSDLTTISLTIKIWTLTPVQSHVSAPVHFFALDILITTQDGEFPQQAFGQNTVGKCSIESGPGAWGDSGRPGQLSVALMASRQPDLRLCHFYIYCDGERQYFPRERLCCSHGAPSHLT

SEQ ID NO: 933419 - protein, 142 aa, Homo sapiens
MQTSKFCQRVKEKVAYTVSVWWKDIVAQCLRRWAPPLLPPRCDLGRVPSWETLLQREASNIRRRQARSFLRSSVAAKPFHFMTSAESWRKTTPNTAQTGSAHRKAIALVGGNLPWFPHTGSQIIPFAPKSKRLSFVVSTYHM

SEQ ID NO: 933420 - protein, 190 aa, Homo sapiens
MESKRIFERTRMESSNGMEWNNPWTRMQSSSNGIEWNHRMDSNGIIIERNRMESSSDGNEWNHHRMEMKGIVMIGIVIEWNRMDSLNGIRWNHRMDWNGIIEWTQKGSLLNGIEWNHRMVSIGIIIKWNRMESPNRIEWSNHRMDSNGIILKWNRMELSNAIEWNYRMQSNRIIEWTRMESSNGMEWNSQ

SEQ ID NO: 933421 - protein, 154 aa, Homo sapiens
MLQPQRQKPPPIPIPDLDDLASEVTHVPEASPTVLTFPPVVLTGTSTDGIPFALSLQGISFVLPSPEEELNGGFQRLLRTERPGPKSCKLEYNIHFKSFILGMYAEHQLVLDSGPKEEWAELTRWACNREAADRKTLQIGALQHELPGVGSNVA

SEQ ID NO: 933422 - protein, 131 aa, Homo sapiens
MGSTFGVASALTLTATSTLGSDPSPHHRSNRLFTQQPAGPFINGRAGHSSAQTIWWGLQGSGPTLHSQQLLSGKPQPARKQGAQFYWCKELNSADQCKTLEDDLSSERRCSPADTLTAFQQLIHVHAKLAQ

SEQ ID NO: 933423 - protein, 137 aa, Homo sapiens
MRAVNQGERAEKPGADGPVLSLNKLVKEVHEEQALSWAPKPTVSPLTSCSSSSSSSSFGPLLCPAGTPPSSSRLISAISKPYNRHREARSTCMGTGNSQSEPSCRILEAMVRQVQQDPVVQTELPGILRAPLAPGGR

SEQ ID NO: 933424 - protein, 160 aa, Homo sapiens
MEDNAAMALLLKRSFLLDDLFLLGLEVLFTELACFLGLRPAGLSLVSQGLLAGFVCLQLVAVFRENPLVFEHIPLQLQPAQNPQSPHPRDLLWHSGIGCTPPLTYAQVPALPAGQGAFPALSPGMDRHRLAVTQDQPIFDQLPDLLTEVGIGDFIVSEFS

SEQ ID NO: 933425 - protein, 138 aa, Homo sapiens
MILIRPAGLSGVHILLSRAYEDHSLVKLHSRDLERDCCAVGDRWNSSRAGAGGAHCEQSERRHRTTLVTATAGGRFLVSDVDGHPALPALSAETACPESAPAREANWSHWASVEEDASHLPNGDLSWVSPELIELSLV

SEQ ID NO: 933426 - protein, 199 aa, Homo sapiens
MMHTLCGHCGSKACHLPKSTCGKCGYPAKRKRKYDWCAKAKRLKATGTGRMKRLFSDGAVSLHTRSLKYGKLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 933427 - protein, 158 aa, Homo sapiens
MRKLFSFGRRLGQALLDSMDQEYAGRGYHIRDWELRKIHRAAIKGDAAEVEHCLTRRFRDLDARDRKDRYRGLSLRWEGAPGPASLQPLGRGPWRAPGTLGAAEPNGASDCFPSLAIPHLHKPNKNIKVLSFLHDTVYLTIVMIFKNVHNGVKKDLLL

SEQ ID NO: 933428 - protein, 149 aa, Homo sapiens
MGASRTLSYHQLPQEHLPLPRIQAPLSSQFWQDIQGELWAQPVPGGGCIMTPQPIPSGTHPKTPYFLGLSRQGQRRLALKLKHYVHAGSAWHWAGMVQAPPPFPSGPPSRARLKQSWFPRGTWWSLQQLAATRGQAAPCPQHHSHRYYG

SEQ ID NO: 933429 - protein, 250 aa, Homo sapiens
MAEPRAKAARPGPQRFLRRSVVESDQEERRAWRQPRRRARSPRSPCSAGCFCLKTRRLSRSAPADARRPRARSAAPADAGPEPVGTQEPGPDPIAAAVETAPAPDGGPREEAAATVRKEDEGAAEAKPEPGRTRRDEPEEEEDDEDDLKAVATSLDGRFLKFDIELGRGSFKTVYKGLDTETWVEVAWCELQQAVAAPAGIPAETSSDPGPVTQRWCLVELWGQLGKAWKCAAGSPASASAELARHPVQI

SEQ ID NO: 933430 - protein, 145 aa, Homo sapiens
MTEYDDYVLDSPYKVISIFPDLKYFPSLDGCLDPASHWEASAVMEIPAHDTRVSFGLARHSQMTAELVCHHISVISRYKFAVVSYVWLVLQKKHQVLVDGFNCSHYVSDMVKKQCAEHVLTEVYAHRASPNFHVINFPVMCLPGI

SEQ ID NO: 933431 - protein, 148 aa, Homo sapiens
MTNTKGKGRGTRYVFSRPFGKHGVVPLATYMHIYKEGDNVDTKGMGTAQKGMAHKCYLDKTGRVYNITQHALGTVVNKQVKGKILAQRINVCIEYIKHSKSRDSFLKHWMPERPETSNRHRQTIRQTNKSLAGELGKGEAQQRPNGEL

SEQ ID NO: 933432 - protein, 439 aa, Homo sapiens
MYGTSHKFMEKKNRPSGDLLNIYELFQKVNASNRPSSLRLLNEPQKWDYGSTGVATNSDPNIYFLIQKIFYMFNTLKSNRSQLHSTMDILSLKVNPTEMVAKFQLPPPPHSSSWAAELKQMVDQSLSGGVLAGCPLVQLFPKLFSCSRAVDPGHFLDHKDEEDGLSLDRSSTMASDHVVDMQDLTEFLDEASSPSEYAVFLLHWLFPELFDHCKLGEYYSCYGDGSKQELEPQRLQIICNYTEVYFSHMQEEEAWLQQCAQRINDKLQGLRLDAGSEDEPPTVEDSSKGEQRRSKKIWLVLINLDKLEIPQPNLEVPGTDCLLSKEHLHSIYESSLSIGNFALHLLVPLFPKLFTHENLHKQYSSSGSLGKKQLDLSCIKLIRQYVCLLYLHAKNDRFWTLEFMGNLRRDTSRGAPTSSSARSTCWPPVQRHEELCNQP

SEQ ID NO: 933433 - protein, 337 aa, Homo sapiens
MAEGEGEASTSSHGDGREKAKREDMGYCQGVSQVAVVLLMFPKEKEAFLALAQLLTSKNLPDTVDGQLPMGPHSRARAQPGPLLWSLLPLLLLSPEAAPAPQSRAASPSQAPGEARESLGAQQGREPAARAQVCGKPKVVGKIYGGRDAAAGQWPWQASLLYWGSHLCGAVLIDSCWLVSTTHCFLKTSSSFILSSGREFPGPCVCLLNPDMRESIGSVCAGHLQGFSSVCTMLLKSQAPKNYQVLLGNIQLYHQTQHTQKMSVHRIITHPDFEKLHPFGSDIAMLQLHLPMNFTSYIVPVCLPSRDMQLPSNVSCWITGWGMLTEDHKRGVGEAGG

SEQ ID NO: 933434 - protein, 137 aa, Homo sapiens
MLFNFVANPDNATEALLRLSAKAVQFHGSEPMCRVSHPPLQQQKEQFLHPQGLPCIPFGANLSPLHQLLATTDLFSIPMVQHCPKCSMNGIISPQRQLQVSGRSDTLVRLKGVCVEASNHHCPFSDRSSLYILDTSP

SEQ ID NO: 933435 - protein, 204 aa, Homo sapiens
MVPCLPDASAPATVKRGQGTAQAIASEGPSSKPWRLPCGVEPVGSQKSRIEVWEPSPGFQRMYGNAWIPRQKFAAGAKPSWRTSARTVQNGNVGLEPPHRVLTGVLPSGAVRRGSLSSRPQHGRSTDNFHCAPGKATDTQCQPMKAARRGLYPAKPQGWSCPWPWELTSCISVTWILPLPWQHSGITTPFSGNDLMTQKLPPFS

SEQ ID NO: 933436 - protein, 186 aa, Homo sapiens
MSAVSNCTVAKKAVVKGIFDKGTIGKSVEFKEIVVMGYFLRVIVLKGLDSKSVENKTDFATSDVDKGAAAMSTMLMFLLKVIVTKAVVTNDVAAMEHVPKDDISIGIDSKVTVAKEVISKCIVPGAIDWGTCSSKFFMTPSSLSPEGNGEREKWLWFALFVYLPNANVTASIDYVTDMLLVIFDMM

SEQ ID NO: 933437 - protein, 196 aa, Homo sapiens
MGIQDEISVGTQPNHIKSLEPRFPRSFSRENCADTPFLAANCGDVWQASPPQKNPEFLKAADHTATQPAKLQMPNRHQPSFYLIAIPIQKEENKRPCSSTSAQKRRPLFLVMTDYENEKGMKAESSGEMLLNASNQVGLTIRVWSAYSISRNDVALISKGRCTCFWEYGLYQLNGQWDKNGYQVLGKGLEECGVIV

SEQ ID NO: 933438 - protein, 135 aa, Homo sapiens
MAKGPHILGTGGAHRQLGDGNATTSLIIQESLNIGVEFQKQHKGSNTRTSHVSLLSYLLFSHWPKQVTRAWPAGMEGDNQRGRHREGYCFTSAVPKMEQGTLLGPAPPPFHHPAPPSMEIKENIEFLQGKFQAPS

SEQ ID NO: 933439 - protein, 477 aa, Homo sapiens
MTAKEMKATESAAQPAPLPKKEVDVSPKQDEGVLKVIKREGTGTEMPMTGDLVFVHYTGWLLEGTKFDSSVDRKDKFSFDLGKGEVIKAWDIAVATMKVGEEEDLTEEEDGGIIRRIGTRGEGYVKPDEGAMVEVALEGCCKDQLFDQRALHFEVSEGENLDLPYDLERAIQHLEKGEHSTVYLKPSYAFGSVGKEKFQIPPNAELKYELHLKSFEKAKESWEMISEEKLEQNTIVKEQGSVYFKEGKYKQALLQCKKIVSWLEYESSFSNEEAQKAQALRLASHLDLVMCQLKLQAFSAAIESCNNALELGSNNEKGPFRRGEAHLAVNDFELAWADFQKVLQLYPNDKAARAQLAVGQQRIHRQLAWEKFYAKMFERLAEEENKAKAEACSGDHPTDTEMKAECKSNTAGARNRYYGLHCRNNQEANFYNVTQADKPSCLRMLAKEHMHGAVGILGIRAQHLLRTLCSVKYELRI

SEQ ID NO: 933440 - protein, 165 aa, Homo sapiens
MFPTHTATKDIVVTATVAKCMADIAIIALVTITVATLAEGAIPMTTVAKDIVIKMHLLNQGWMVTTATKTVAKGNIARGKGAKEIFAMKCAVTKNIVAMATIAEATVAKIIGAKGAVPKERVLNLKKLLLWAIFLESLFLKALIVRVLKIKQILLRVMLIRELLL

SEQ ID NO: 933441 - protein, 158 aa, Homo sapiens
MQKWTEASRNTIFVLHVLTQVDAKEVLTHVDAKDAHGGDEGTSKDSLLLTVEGVVTHSYGWGSGVEELHATQGHLGKHQMTWGRGILIGCLRVIKERVEGSGLWVVWFAYERRASGPCLLFLGVSFTLYSQYQCNIGFSLHNPFIHLFTLTDYSFFSP

SEQ ID NO: 933442 - protein, 298 aa, Homo sapiens
MVPCALCLQEERHCVLTWQKAEGQNRGSPLPPVLVDLLNDFDKNADSVLNNKVQAEVVSDGDEELVVNWSKEPLYRVLTGALPSGAVRRGPLSSRPQNCRFTDSLHHEPGKAVDTQRQPMKTATRWAIPCKATEAELPKAVGAHLLDQHDLDVKHGVKGDHFGTLKFDYLAGFWTCMGPAVTATGHDSFDGSGQSQFETFWKGFIMIDATKNIHDSPEEVKIAALIGVWKKLILTLINDFEGFKTLAEEVTTVVVKIARKLELQVEPEDDLPRGSGKLSRNVHLKHEPGAFVHLSHTG

SEQ ID NO: 933443 - protein, 161 aa, Homo sapiens
MVLISVQIGVLKVACKWVVASSGRRQWEVPLGCERLVELGPPDLEILGTEAYYCQTLRRCHGIQGRFGSAQSLSQIIVSVTGELLSSARLYEGLMFSQIPKPVTLSIGVFLAMFQSEVIGESAELEPDGRLVGRGLDLGKGGDGETNVIQMGALVHVTNLQ

SEQ ID NO: 933444 - protein, 195 aa, Homo sapiens
MENIEKPHLNIRRRRKRKKKSKTKTTQILERTQFTLRCGKGKEAEEERPQVPLIPTDLPAGFILRLSTCGHDDRANLLTRAVSTSPAAQSPCSKPLSSSSVPPANISLPSVNPGPEPDHKGQPRNPESDKSARPKLSPLLCPAFTGKPTQAVAWPFPSSFLPPGLPAASPCRPAGPATSLISSECFKSDVRLSFQ

SEQ ID NO: 933445 - protein, 227 aa, Homo sapiens
MRWHFKFIKIYFKRKQHKTLENLQPNDVIEKKSQFSEEKFKPAAEICISNKDPNVHHQDNGENISRTCQRPLQQSLPLQAKRPKRKKWFPGLDSGAPCCLPPSDLMPCIPATLAMAKRVQGTAWAVDSGGASPKPWQFHMVLSLTVQKGNMGLKPPHRVPTEVLPTGAVRRRPLSSGPQNGTATKSLIMHTGRLQTMPVHESNQEGGYVLQSHRGGAAQGHGSPLLA

SEQ ID NO: 933446 - protein, 203 aa, Homo sapiens
MLQPEEPTSVGTDLPCSPQPRHAAAVQMMPTVNPRKLQNNAAPGTVGDPEKMWRELRGCPGGDVETVQRLSRRRRGKSSEAVPEKTWRAQRMSQTRESSEAVPEKTWREFRGCPGEDVERAQRLRDCPGEDMETAQRLSARRRAESSEAVPEKTWRELKGCPQEDVERVQRLCSSEGRSPVHAFPFAVRMEIGDAASYTADRC

SEQ ID NO: 933447 - protein, 166 aa, Homo sapiens
MPELNLIGSWILPYCVCFLSQSLLLGLLLDVELKVNKSETNVNVFLNTSVNTITDSKCASKPEQSTTLPSSGEDNKYTRIVIPQGLTKAPSYFPQVLNQDLKVLNFTCDSVLMQYMQDQMISTAFFRERGSWIQIGHYKISVGQPQFPNGSLEIPPQTGASKCGHP

SEQ ID NO: 933448 - protein, 398 aa, Homo sapiens
MTAKEMKATESAAQPVPLPKKEVDVSPKQDEGVLKVIKTEGTGTEMPMTGDLVFVHYTGWLLEGTKFDSSVDRKDKFSFDLGKGEVIKAWDIAVATMKSSNDLPITPRLCLKDGGIIRRIGTRGEGYVKPDEGAMVEVALEGCCKDQLFDQRALRFEVSEGENLDLPYDLERAIQHLEKGEHSTVYLKPSYAFGSVGKEKFQIPPNAELKYELYLKSFEKAKESWEMISEEKLEQNTVVKEQGSVFSNEEAQKAQAPPLASHLDLAMCQLKLQAFSAAIESCNKALELDSNNEKGPFRRGEAHLAVNDFELAWADFQKVLQLYPNNKAARAQLAVCQQRIHRQLARKKFYAKMFERLAEEENKAKAEACSGDHPTDTEMKAEWKSNTAGSQSQVETEA

SEQ ID NO: 933449 - protein, 282 aa, Homo sapiens
MANIFFLIYTYCQSLWYAFISSMQTDEYSKLVLVEWGAAVKLSKNVEPTSELGNRQGFKRKQHKTLENLQPNDVIEKKNEFSEEKFKPAAEICISNKDPNVHHQDNGENISRTCQRPLQQSLPLQAKRPKRKKWFPGLVSGAPCCLPPSDLMPCIPATVAMAKRVQGTAWTVDSGGASPKPWQFHMVLSLWVHRSQELRTVQKGNMGLKPPHRVPTEVLPTGAVRRRPLSSGPQNGTATKSLIMHTGRLQTMPVHESNQEGGYVLQSHRGGAAQGHGSPPLA

SEQ ID NO: 933450 - protein, 176 aa, Homo sapiens
MVIFTFESWHKAGPIVPGYRPTFMVSGTRPVPMESGSPQHQFSFQVRPSTRSTFASPSCRPIPAPGNRPIQSHAGTHTFKLQDGPCSSRLQHKVNPYGPNSRPVFMVLGSGPTQYQNSPYELRLKDLPSARLASWTQAPGLSLKTKSTLMGSGTRPVTSDPGASPHPQTQDPDLPM

SEQ ID NO: 933451 - protein, 163 aa, Homo sapiens
MLNIKNLASLKVSGRLLARKAKMKLPSAKKRVTWIRKQMKITVLNTPSPQNHFGFLSDAVALQAISTVIVLANAVETTTVKMIPNVVCQRIQVTVFVQPVKSKEQKKTDREMSLRVLTMSVWWGHSETIPMAVRTEKQRAMLASAVPSASSKSRKVTTLTKQC

SEQ ID NO: 933452 - protein, 144 aa, Homo sapiens
MPIVDWSLCHTRGTEINNMESPSLRKSVYRENKCANNPLQWAYIKWVEPSCYGVIEGGAELANALDASENLEVQAMVKGGPKQVQGKASLMEHLPAANCTGFKMVQLTHPKFLCEIQEPSLGVWIQTSFCNTSSGKNPNLTLSW

SEQ ID NO: 933453 - protein, 132 aa, Homo sapiens
MDEGGNHHSQQTNTRTENRTLNVLTHKWELNKWTQGGEYHTLGPVRGWGDSRHGLFGYERQEWVELPILPSECFPAQRKAVPDNNQYSDSKGVLEVGKPKTKMLADLVSYSIDTGRAGEYCVAPVMKMFLGP

SEQ ID NO: 933454 - protein, 148 aa, Homo sapiens
MEIVTKCHRCKTVVLNKSTYMEVHKDFLRAWIMLRMFSQPHVSCEFFPKKRSVVTKKPCFSSTWNLNMKHCLGGKNTSAGVGVEEGEFHVWYKACILLSFYHTCGEYYNCHISFSYITNVNENEQTEVQGASMVLYKGLSFGVKQNQA

SEQ ID NO: 933455 - protein, 277 aa, Homo sapiens
MVAGMEVIHGQQGLPLTKADLATATAECPICQQQRPTLSPQYGTVPHGDKPATWWQVDYIEPLPSWKRQRFVLTGIDTYSGYGFAYLVHNASAKTTIHGLTECLIHCRGIPHSIASEQDTYFMAKEVWQWAHAHGIHWSYHVPHHLEAAGLIEQWNGLLMSQLQHQLGDNTLQGWGKVLQKVVYALNQCSIYGTVSPIARIHGSRNQGVEVEVALLTGISVLPYPVVKVDGKLQQPNPSRTINGPDPSEMKVWVTPPGKKNHDLLSCLMKAKGIQNG

SEQ ID NO: 933456 - protein, 148 aa, Homo sapiens
MPVVPATKEAEGQENCLSPGIQGPCGQYREAGQAVGTKSAMSSTVAEEATTAVKADGSRPSLIERPAHSEDPYHRPGQIVQSSKQKYFTQLFCNGLSYKLYWFLCSPLFFMSYVFLFSHFSSSFTFFGDVFEYLFQKVFLGGPDIKPQ

SEQ ID NO: 933457 - protein, 198 aa, Homo sapiens
MRVNCKALTKFHFPALAKLQTSLIPLEENPSTPCSITHPPGPACCTNTCKDSSENEKNLKAEGMPAGPNLTYQGRIPEGDSRGNSQIPTTRRRAMRLDRGIMSVFIGEDSNECEVDPKYLNDYHIDRAITLPNSRDTVYTVVYVKSSRRPQLSNVQSVQLKALVLHMASATEINGIDQFLPDDGHSKALGQPDLDPHL

SEQ ID NO: 933458 - protein, 234 aa, Homo sapiens
MLIAKTMGKMLPGHFRDLRGSPFHQRPGGLGDKKWFHRPGPGSHCSVQHQDMEPCIVATPAPATAITGEDFRECMEMPGCQGRSLLQEHSLCGEPLLRQCRGITWGWSPLHSGAVRRWPPSSIPQNGRSTNSLCHAPGKVTGTQQALRAAMGIVPCRVTGAEVPKTLEAHPLHQHALDVRHGVKDYYGAIRFNDCPTRFWTCMGPVAPLSWSISPPWNGSIYPVSVPLFYLGSN

SEQ ID NO: 933459 - protein, 245 aa, Homo sapiens
MMATLSCKTGKFLLGILKGEGVYEQGAVPGLKAGFHWGPTPFRPGAYLLPTAINLPSTAPTVPRMFMQWDVCRPTLSCPKFSLSLPPMGAQSLEGVKAAGGWHVSIASTCTRGQFATVPGLGLNFAPKSEQALGAQRGQAAEAGTSEPVGTGGFLDPQSAGMPWSTVGLGGGRGTWEGATNSEGGGAPACSQYLCLLPASSTEDAAPTAPPSAAARRLHSGRSGWAAAAITYKRAYEAMHSGSHV

SEQ ID NO: 933460 - protein, 213 aa, Homo sapiens
MGLWSRDSAEEAENCDPGPPGTAALSLVFKDLLNGFDQNADSDMDNKVQAVVVLDGQEELSGNWNKGLSCYAKRVVAFCPYPRDLWKFELERHDLGYLAEEISKWQSVQEEAEHKSLKNLSQNGKATDNLHPAPGKATDTQCQPVKAARTGAVPCKATGVEMIKTMRTHLFHQRDMDVSRKVKSETVSRSFYTQLCEQPIGLFCTLNGPFIHS

SEQ ID NO: 933461 - protein, 138 aa, Homo sapiens
MEPMLNLEINVTNLTTRFKFKIPHKKITPKSGHQPLDLGPALNQDDLILRSLIIPAKSLFPNKVISTDGISGDFLMKELCTQTTMKGTQRKLAAPFDLKVRRKEISDSGCELLLWIMDCPTGTEQQQFSLPGLCTTLS

SEQ ID NO: 933462 - protein, 148 aa, Homo sapiens
MIVRTPQSCGTAQVLYNQQVANSAEHVSFPSSWQVLPCPGGPEMPSGSQSLDTGKELLLELQAALPVVGEVCPTHERSCEHICVHSSYNGCSLDNPQPKDMTARGTVHSRVEGLRKGPVAELKFWGPSYLKYGLKEGSQFLELRGMKV

SEQ ID NO: 933463 - protein, 285 aa, Homo sapiens
MYVVILLGNGTLILISILDPHLHTPMYFFLGNLSFLDICYTTTSIPSTLVSFLSERKTISLSGCAVQMFLSLAMGTTECVLLGVMAFDRYVAICNPLRYPIIMSKDAYVPMAAGSWIIGAVNSAVQTVFVVQLPFCRNNIINHFTCEILAVMKLACADISGNEFILLVTTTLFLLTPLLLIIVSYTLIILSIFKISSSEGRSKPSSTCSARLTVVITFCGTIFLMYMKPKSQETLNSDDLDATDKLIFIFYRVMTPMMNPLIYSLRNKDVKEAVKHLLRRKNFNK

SEQ ID NO: 933464 - protein, 159 aa, Homo sapiens
MTMAVLSNRKGGNVGKRKRNQIVDDYAGHLQAALNVAKGYRYELVFAKILDFEIHRVPFEDLWTVEFGKFLVTYFQIQILSLSILSLMMSLLGAEPIEKWLQVEPIDIESHSYSQRHGKETEKEQIRKPIFSGFLPLDCLPACASSVQTNWKILVREAW

SEQ ID NO: 933465 - protein, 127 aa, Homo sapiens
MALSLSCQPCEDVSASPLSSAPIRIHSNAGKGGQEEKEKIGLKLCFPVLHDLTSSALAYQRLPCTDVRLHNLLKMNFPNNSGPTHLGINHPIHDSQLTRVAGKKGFRIATLRYHTCASVWGILFLLL

SEQ ID NO: 933466 - protein, 189 aa, Homo sapiens
MPSPALAHAQWVALTVLHPLSEKPLREKVKMESSLAISKARESYENDLRGLCAAGCDRKCFFSFPVEASVISMLLTVISAGNEISSKSWLQECIKLRNRDLNNSSINLTKVKILVNNRPPTGVSENCYRAVPSVCLKQQSLIALNLPQDFSRFSSLSLPRHNFRTKMGMDHKDTEVFHNFTQLNSKKCT

SEQ ID NO: 933467 - protein, 147 aa, Homo sapiens
MKPQTLAVSVTVLKDGVSGVSSFRCSHVSGVSSFRWVRGLADFRNEATDPREDTEKPHENSAEDMLDALIYLKLSYGNGLINQTKMGVLQYQRLPPRISRYDRFHSTDPMLCSSWPHFLCPPEHLSCTDPNMSNSAASFNHVKSFYP

SEQ ID NO: 933468 - protein, 144 aa, Homo sapiens
MNVVNAQGLNLGGTSPVELYSPWIVPERLSIGESMLHSCGRSPSYVYGGLPGVYKDPFSKALYGYRGCLPNVVPGDQSLPSPGVNSCWFEHFSVVLESCNQKDSEICSALCGQLSLVWYKSCIQSLCQNNDSCEKEPIKLFIKL

SEQ ID NO: 933469 - protein, 159 aa, Homo sapiens
MMMMMMMMMMMITMMIDESRFLKNTFRTACACPHAPPSPPPQEDLLVLIPEGKVEDLSGKVANGIGQIAHPEEQHTLLLGYTDHAVHDAIDPLVRHDLLTGTLHLQQQLDPLAGGHGIMEMAAMLYGSESDTRELYTKTQRKSKKCLLVHFPPEKRNPK

SEQ ID NO: 933470 - protein, 266 aa, Homo sapiens [sequence omitted]

SEQ ID NO: 933471 - protein, 277 aa, Homo sapiens
MGGGEQCPEGVYNPCDIKSNIILFHPGIWNNITGGVYTPCDIERNVTPNLNIRKNIRKEYKITKWVYTPCDIGSNVMLYPLNIRNNTTGGVYTTCNIGSNVNLVPPGYYKQYHTGGEQYYIDVHILCDIESNIILSAPWILRRRSQEQHHKGGVHPLRYWEEYHPFLPWILGQYNRVKEQYYKGVYAPCDIRRNIILYLLGYLEQYHKRVYTQCDISSSIILSPLNIRSNIPKGMHNPCNIGSNVILYPLDIRSNITGVVYPTFNIGSNVNLSPPGY

SEQ ID NO: 933472 - protein, 151 aa, Homo sapiens
MGLLDEDLDALWAADKSAAYLQKVNSLNTPHKVNTVRLISCPHFPLCSLGTRLEIKGPSSRRLESVSETYTVADADWFNKIQPVTGSPPTHCPCALCWDYRLAQASSASGPCLSCLIQAAESVWVETRKSEDKMALFLLWSRKPLESQAFS

SEQ ID NO: 933473 - protein, 134 aa, Homo sapiens
MEQALSILQQPYGKVAILIWVSVPILPYWEGPPGLGLQPPCHQSYRVNGSSATPWTEPSGATESSLPPPCLIHTSSKLQLTQGEEVNRCPTGTPPPPICSSLDREPLSHSIDSPSWSDCIERLLTCITLGWSPQ

SEQ ID NO: 933474 - protein, 162 aa, Homo sapiens
MDVFGRLKAMFSLEPLGSQVAMEATVLLPALAPPLPAYPPSQCMMGHHFTWATSTRPEASSRCHRLNSSVAFDHICSVSQSCEQKQREDAVHQALVGSGLPWQSGHGSGVQMMEGRPLCCCSRAKQERAKLLPFPQLNVHLPHFPLISSSLQYPFYPFALAG

SEQ ID NO: 933475 - protein, 179 aa, Homo sapiens [sequence omitted]

SEQ ID NO: 933476 - protein, 142 aa, Homo sapiens
MDHPRAEECGGMARDWQAVPPASPVRHPLGEASWAPESGGDVENLYLKVCKHTNQHPVSSLGFVNAPIDTLYLATLVGPWRTFVSTLCIYFTPEASETTSPPEGANNSRRSALRAVTLTARVCGFILGVSETKNPSSPDTAI

SEQ ID NO: 933477 - protein, 147 aa, Homo sapiens
MLPLHLQNLLARHLGNNLYAKLQPVWPYLPGTFTPGNLPVSSGFMFSLTSRMKLRTFSSQGTRPLVPAACFSKMVEAGRELARRHIPPGNGESPSVYHVAVTGEVVGEINTLVKTRSPVKNTSSDVSRRRVQVESEFSGNYHMGVTA

SEQ ID NO: 933478 - protein, 146 aa, Homo sapiens
MSPGLGTMGKVLQRRGRELGLEGLGNGAGWRGASNADSGWFQSQDAIPETSYLHCLSHPVVAVFAPHILPLLTSPFILPQPDMLSVQPTGSGSQEFPRTSSIDCAPLRSRKEFPSALTWQIRWTGTISKEIRKYQGMGSIQSFGYL

SEQ ID NO: 933479 - protein, 204 aa, Homo sapiens
MTCLSFDYMFLPPQPIDRRERDDLYSFTGELAFSVNAPCSFTQGISSGSSSVTLAGVQHSKPSETCPTVCLSPTEDGSSLISWVAYCLKHQECSLTAEEQARQHSELSEHKPESASQPKSSDSTPFCPLTLHTALEGWCHVVAERNQNQTRPQTPLVDVVKRSLEPSFTVWLMVEMLAKQVFGMSCVVTVVTSGSRIKSVPPGR

SEQ ID NO: 933480 - protein, 136 aa, Homo sapiens
MIESRLLPLLLAKDGRSPGESRAGYDTLKRCIGETALDKSLASRSLPSRGRKGKKILVLLIKGYVRRTIHYVNIIEMSLLLVCGPFTQSQQTMAHFQQFGASVVCSSARCRHWHNAPWCAMFVGLMHILRSLIYFD

SEQ ID NO: 933481 - protein, 201 aa, Homo sapiens
MHSPFFPVLTLGCCFQSASHMFCGLFQLSSYLFPATPGIVFATLRDLKFPQLVCILQVFTPRLLWPWLPKPLSRCPPLTPILLLDIAQREEAAHWSNFPAIPSNTIHSFHGLKILDTNWGNCLVYQDFLNPLCGRQATQVPRQETEGTSSVAKSVKEQHPLLSRPGKGVSLSPGEFREDSAPPPFVEGLTLVRLARSYPEA

SEQ ID NO: 933482 - protein, 151 aa, Homo sapiens
MSSAFSDGPELFNDSDSNCKVLVHAKDPHRRIDITGTLTQGAESVLESGRVPPGKKKWFHAFKRFQVGTGTYSLGQALPRHVAVAPPLVVAGNLVETKVHFQETSGAVQYALVASLVSTRFRRRCWCLKQINGTGATVGYRVRSKCSILNS

SEQ ID NO: 933483 - protein, 134 aa, Homo sapiens
MQPGLPVGQLARRGPPPALASRGTRHKPYLDNVSSNTSLGQLVSVVNQARTTSQCGHPCGRSYGEFGYYGELGHQGAQCLLPILLDKPERKEGSALGSCKNQSSNVLTSANAFRAKELQITAISLGVWLHVGLA

SEQ ID NO: 933484 - protein, 202 aa, Homo sapiens
MGCREWSNKRDNGNISLPWNGQQAGLTDAGLPVVGNPALVHPQEAHEAEGPRSFIQPFKDLAFSLYEDPSRLPLLALGEGMGEWPAFIPLFVPAHVLLIGPFYRVLIGPFYRALIGAFYKPLASYRVLIGAFYRVLIGAFYKPLASYRALIGAFLQSTDWCILQTSCKTEKFSKSTLNPGSPAGFTKGAEGHMNFIQPRNNI

SEQ ID NO: 933485 - protein, 148 aa, Homo sapiens
MATAGNRVLMLGRKVCLQEPNPNEQSRTVRPLGRGESPTADVWVCECQLSGASRTRHTQRGFEEGSAFQKWSKQDGEWKARSMKSEADLCKGSFQYDFTGELGSIGDISRVISARDKGAGLSYTYLVFHGLRAAEEDVSVQTRLALHI

SEQ ID NO: 933486 - protein, 168 aa, Homo sapiens
MSSSRILKVCECTNRHSVSSCSGGALENPCVETLYLTNLMGTWRTFVSSSGIVNTPISALTKQATRLYQSAGCGETTSPPGETNKSRCTALRAVTLTAKVCSFTPEPSETTSPPGGTNNSRCATLRAVTLTANVYSFTPEPARPRTHQKEETPNTSEHQKGQTPDAPP

SEQ ID NO: 933487 - protein, 149 aa, Homo sapiens
MVATGDAPRDPQWSELFSTSCPQAPRAALPQGPLCVYTAAPDSEEVECVAGLGAALPVPLSTTRLGSRVKLVHGFWGPVILGCGEWDVCFLGKVLRRCGIWPYSTPVQPCGSHQAIGSSLSHCSHCQLRHMPPSPFLFSLDLCCARKVV

SEQ ID NO: 933488 - protein, 144 aa, Homo sapiens
MPPWLTLPTSSKALPFTAVMRPDWKKDPMKLMFLCPVGAIYCLRRASNSSAQSLNTGNTPGGGDRGTGICGYSVCQGFYKTDLQIKAAETPARANAQCMTQGEATHFSQSRGPRPFGWTNVNISITFKSFYVNLQNRALAFDLA

SEQ ID NO: 933489 - protein, 332 aa, Homo sapiens
MELNGIISWTRMDSSNVLEGTRQMDSNGIIIEWNRMGSSKGLESNLQKDSKGIINAIIIKWNRMESSNGIEWSHCLMQSNEIIVWNPMKSTSNGIDWNHYQIELNGITEWNHHQMDSNGIIELTLMESSLNGTERNNQMETNGIIIEWNRMWNLKESPNGLQWNNHRMESSGIIECTRMESSNVLEWNHRMESNGIMVERKRMESSSGHEWNQHLMEWNGIIKWNGMESSSNGIKWNHQMESNGIINEWNRMGIEWNHHRMESNGIINKWKRMKSSNGIEWCHRMDTKGIIEWNQMESPSNGIQWNHHRMECYEIISWTRRESSSNGIEWNH

SEQ ID NO: 933490 - protein, 187 aa, Homo sapiens
MESKGIIKWNRMQSSNGIEWNHRMESNGITIEWTRMESSLNGIEWNHRMDSNGIIIDWNQMESSNGIERNHHQLTKTLNGHEWNHHRMESNGVIKWTRMESSSNGIIIKWNRMEIEWNHRKELNGIIEWTRIESSNGHEWNNHKMESNGIIKWTRMNGIIEWTRMESPNGLKWNHHQMESNGIIEWK

SEQ ID NO: 933491 - protein, 218 aa, Homo sapiens
MESNVIIEWNRMQSSLNGIDWNHHRIELNGIIKWNRMESSPNVIEWNHRMESNGIIEWNCMESASKDIEWNHHRIESNGIIEWNHPQMENNHQMESLNGIEWNHHRMELNGIIKWTRMESSSYGIEWNHRMESNGIIIEWHQMESSSNGIENNQHQMESKEIIIEWNPKESSSNGTKWNHHRVEPKGVIIEWNRMESSSNGIEWNHHQMESNGIIEWN

SEQ ID NO: 933492 - protein, 483 aa, Homo sapiens
MKSIGIIEFGRMESSSNGLKCNHHRMETKKSSNGIERNHRMDLNGIIIEWNRMESSWNGIEWNHRMDSNGIMLERDRMESSNGLEWNHHRMKSSHQIDSNGIIDWPRIESSSNAIEWNHRMDSNGNHRMDSKGIVIEWNQVKSSNGLECNHRMASNGIIIELNRMESLNGPEWNHHQVELNHVESNGIIEWTPIESLNELEWNHRQMESNGIIEWNRMDGIERKHRMDLNGIIEWTRMQSSSNGNKWNHRMESNGIIIEWNRMESSMNVIEWSHRMDSVRIIIERNRMQSSSNGIRCNYRMESSSNGIEWNHRIDSKAINQWTRMESSSNRIKKCNQMESSNGIDQNQHRMESSNGIEQNHHRMESNGIIKWNRRQSSSNGIKGNHRMESHEIIEWHQTESSLIRIKWNHLMDKNRITIEWDRMESSNTIEWNHHRMEENVIIIEWNQKESLNALERKHQMDSKGTIIMWNRMESSNGLELNL

SEQ ID NO: 933493 - protein, 232 aa, Homo sapiens
MKRVMEMDGELPRLVVLHVYCCTTMTAAREFDTGHEVGRKVEDTLERKEWNGKQWNRMEWNAMEWNGVEWRGVEWSGMEWNGNIIKWNRTELSSNGIKRNNQRLESNGVIIEWNRKASSSNGLEWNHHRMYSKGIIIEWNQMESSLYGSEWNHHRMELNGIIIDWNGMVSASKGIEWNYHRIESNGIIIEWNQMESSLEGIERQHHPMDLNGIIIEWIRKESSSNGIKWNHH

SEQ ID NO: 933494 - protein, 275 aa, Homo sapiens
MEWTRMESLNEIGLNYHQMKSNGIIECGIERKHRMDLNGIIEWNRVESSSNGIEWNHQMYTNVIIVEWIRKKSSNDIEWNHLPMESNEIIEWTRKESSNGLEWNHHRMESNGIIEWTRMESSSNGIEYNHNQMESNGIFIYRIRLEQSLNRIEWNHRIESNGRIMKWNSNGIIIEWNRMQSLNGLEWNHHRMELNGIIEWTRMQSSLNGLEWNHQMESNVIIIEWNRMESSNRIEWNHHRMESNGIIEWTQMESSWNVIEWNLRMESNGIPIECN

SEQ ID NO: 933495 - protein, 263 aa, Homo sapiens
MHLSSSYGKIIPVPPQASKPSKYPLADSRKRVFQSFSLKRKVQLCELKANITKKFLSMLLFNFSVKIIPFPTKSSKRPKHPLADATKRVFGNCCLKRNLQLCELNAVITNKFLTMLLSSFYVTIIRFPTQARKLSKCPLADPTKSMFLICSMKSNVKLSELNTNITEKFMRMLLFSFYVKIFPFPKTSSKRTTYPLADSTKREIQNCSIHRRVQRFQLNAIVTEKFLRRLLSRFYLKMYPFRTKAKEWSKYPPAEPTKRVFQS

SEQ ID NO: 933496 - protein, 138 aa, Homo sapiens [sequence omitted]

SEQ ID NO: 933497 - protein, 482 aa, Homo sapiens
MESMESSSNGIEWKHHGIESNGIIMELIRMPDHRMELNGNVIEWNQMESSNIIEWNHHRMESNVSNERNRMEYNHHRMESDGIIEWNEMESSSSGIKWNHRMESNGIIRMESNGIIQWTRMESSSNGIKWNHRMESNGIIIKYKQKPSSRIIIEWNQMESSWNGIKKNHHKMEYNGIIIEWNQIESRMPWNGIIIKWNQMETSNGLVWNLHRMESNGLIEWTSMESLNGLKWNLRMDSIGIIIEWNGIIIEWNGMIHRMESDGIIIEWNRIESSNEIEWNHHQMDSNGTIIEWTQMESSSNGIKWNQHLMELNGNIEWNRMKSSPNGIEWNHRMDPNGIIIEWNQMESSNGLEWSHQMDSNGIIIEWNRMESLEASNRIECNHHQMESNGIFIKWDRMESSWIIIRWDHLMKEEGIIIKKNQNKTKNGIHRNHRMESYGTIIEWIRMESLPNGIKWNHLMDLKGIFGLEWDHRMESNGIIIE

SEQ ID NO: 933498 - protein, 184 aa, Homo sapiens
MQSSSNGIEWNLGMESNEIIEWNRIESSLNRIELDHHRMESNDIIIKWNLVESSSNGIEWIQQGMESNGEIKWNPLESSSNGTKCSHHRMELNGINEGTRIVSSFNGIGWNHRMDSNGNIINGIEWNPQMESNVIIEWTLMESSSNGIEWNHQMDSNGIIEWTRMESSLKGIEWNPRMESNGII

SEQ ID NO: 933499 - protein, 277 aa, Homo sapiens
MDSNGIIIEWNRMESSNAVEWNHHRVYSNGIIEWTQMESASNGIERNHQGDFNGIIQWTRMESSSNGIIEWSRMEESSNGIEWNHGMESNGIIIELNLMESSSYGIKWNHQRMELNGEIEWNLIEWNHQMEWNGIIIERIRRESSNGIKWNHQMELNGIIIESTRMALSSNGMQWNHPMDSNGIIECIPMESSNGIEWNHRMDSNGIIIKWKWMESTKGPKWNDQMDSNGIISNGIIIKWNRMESSNGLKWNHRMDSNDINEWTRMESSSNGIEWNP

SEQ ID NO: 933500 - protein, 160 aa, Homo sapiens
MTSNGIIIQWNRMESSNGLECNHQQDHRMKSNGIIFKWNQMESSSKGIVIEWNRTESSSNGIEWNHQRMESNGIIERTLEWNRHRMESSSNGIERNLHRMVSNGIINEWNRMESLNVIEWNHQRMESNGIIEWNQMESSSNGTEWNHHQMEPNGVIMEWN

SEQ ID NO: 933501 - protein, 186 aa, Homo sapiens
MESNGIIIEWNRMESSNGLEWYHHGMELSGIIIEWTRVESSSNRTEWNHRMDSTRIIIEWNRMESFNGLDWNNHRMDTNGIIIEWTLVESSSNGIEWRNIIESNRMKSSNGLEYNHRMHFNGIILEWNRIESSSNGIEWNHHGVDSIGISIKWKAMESLNGLEWNHHGMESNGIFEWNQKDSSNGH

SEQ ID NO: 933502 - protein, 182 aa, Homo sapiens
MNEIRDEDARGMPAMPTSKPLLSTYYMPHTGDTEALNTGSRTPYGAAVLCTKQMKKQDVGFKLRPPECVEAVSSQLLPHGHKMAAAPPGLTSMFQARGRRRSKRPKSKDPDSLEKGLQPLSFLDCTPPALAACPLVGTQQQATDGFWLSHGVASGHAADSDSHWHLFCLENALHIHHLWFFC

SEQ ID NO: 933503 - protein, 172 aa, Homo sapiens
MRALRAGLTLALGAGLGAVVEGWRRRREDARAAPGLLGRLPVLPVAAAAELPPVPGGPRGPGELAKYGLPGLAQLKSRESYVLCYDPRTRGALWVVEQLRPERLRGDGDRRECDFREDDSVHAYHRATNADYRGSGFDRGHLAAAANHRWSQKAMDDTFYLSNRPRPGPVAE

SEQ ID NO: 933504 - protein, 133 aa, Homo sapiens
MRVAVVPRPHQYLMCVLGRQASAEQGACPAPAYYFIASSQERLPTLFSGIIFRKEPLVGHFPVNSFPKNLRWLISGKFCDIITKTPGVLSRSCCWLHRKPVTETTSTARKESFNQVLQPWRWEISFKSISVTN

SEQ ID NO: 933505 - protein, 189 aa, Homo sapiens
MSRPSIFLRTMATPHTAGAQEGSRECPTCPQSTGPPLHLPLELWGAEVAAASPSSLHTGFHGSPSPFALAPFGASGEAPGSWAFLCPLHMLPPGQDPALSLKQPLYALTPPLDSRCVVSGSYWKIPPGFMHLHEFRVAKTDLLTPPGSSLPPCSPPGCSAYNFSSAKWLEKGLASEGDGGGADRMGRRR

SEQ ID NO: 933506 - protein, 332 aa, Homo sapiens
MPVPALPNTVEERHVCAPVDACVLLTGYAKAWKAMGILGVEVDTRARWPKAGLAKDMDTSLRGIGTPVGRTDGNFHLASIPSSRRASWNSFLTVQAMNSLNVPGAGGPYSRVTCWRVNSVLAETGLEEDELVVRGSADVPLESSWAVHGALGSAAPPHTVEPPLTAGKGAGRGPELWVLGSLLLLMASDATAESLCVAASYNVGINKGVNDKPLERRMEKKPWFPLGCRSPGGKPRPQLNSGKDSSQLTLALGAVGTASLLLDFGNQPLVRSSLAFNASSFSGLDQGVDVLIECLRNSFYAWTVPGTDALTCSVAPTVTVNHARRRTSPADT

SEQ ID NO: 933507 - protein, 138 aa, Homo sapiens
MASGRHVLAQGWPERLAGELDVRFKRKRVARHSSWNLGLGNRKGGTAVPWTGKVGQELAGSGVGYKEPCCRLARCTSTLDTKGHCQVVQYELGIQRRGYAEIQMKAGIATVAFDDEEVAGSFLILQTGTPWDEEKTSI

SEQ ID NO: 933508 - protein, 218 aa, Homo sapiens
MVGEKVGGSPRPQCCPGSAFWGVKRMSAAKILPILEDSSGPCILRLPPPGPVLRHQALDSKDFPRPSSNLEICSMPSGPGTTWAFGKAHSEVLDFKEWVGECRLVPWEAARAEMLAHEQDVGPPGMLQERAPAPQQPGDRQDEQNLPACASGASSVRPGVQAEALVLPLTLLFLHLVHEQALRASFHYQWFHAFCPAAAHTAGLASRPETWAAGLTLT

SEQ ID NO: 933509 - protein, 148 aa, Homo sapiens
MEPTLTLGVFQQRFWPPGVRAPNARFWKLPTPHKENGDKRMWRCGMTCSRDSPALLTLLQTTSSSQGSSGAVRSLLSAGVSGLWQLLPLNGHQAGSQCSRNIIVRNKLTSSNPKNGLRDTENSGRETCKIGCLMGRHTQHSFNKQFIP

SEQ ID NO: 933510 - protein, 169 aa, Homo sapiens
MSSSGIINTPIGTLCLAQEGRNSKHIRTSEGANSRRTTLRAVTLTARVRGFILEVSETKNPPIPNTASQRSLDFIKLEIPAREQETGDFALQTCLYTRHWDVEINVASLHRCPQGICRSSPRCAQAHPTLPAQFRFPAPPAKHSTVHLPTRGVDSGHLVLGLASPSAPS

SEQ ID NO: 933511 - protein, 206 aa, Homo sapiens
MGVPVAGASGDSLVPNEPAGAAWAVGAQVGHSECQMALFPGPHRPPPASPEGMAVSPMTFAVGQGWSWTNVDWRHVAQAPTLVVLAPAMKKGAPSTPLIQPPSAKGRGLFQEQHSMQTSNRQTDITKACLRKVSKWLLRYVSTFHLLVEDTHSPSQGRTARRFWTLRDCSVISGTLRSPGQHMVSSTGVIECMTVAGALGESVSQP

SEQ ID NO: 933512 - protein, 147 aa, Homo sapiens
MFLQLLLQGCPSAGPAFPAGSPCFPVCQRCVLFKPKLYPMAQLDRLLIHPSAGGHLGCFHLLAAVNDAAVTAPIPITDLTPIPITDQTPIPITDQAPIPVTDQALIPVTDQALIPITDQALIPITDQALIPLLRTASCGRPPHRNLF

SEQ ID NO: 933513 - protein, 176 aa, Homo sapiens
MRGHPGLAQSCVSSRVSGLQDDSLWLQLLFRLWELLATPLLSGPTVVPVASSPQCPPGAQGGSPHSPQAEPRKCLPRESCEPSPPKPAVAMPALELQWEPQEALAGQGGPPVTSELIVNSKAGEAAPGPVLNAQPGDTLSACEALPNRAAWADTWDVLSQLLSTCLAGMAQQGCRR

SEQ ID NO: 933514 - protein, 133 aa, Homo sapiens
MSRPGTPEGVAREAARADGVPGALRSSGRPRPRRPAQYPARPRRPASTAGSAPFPEGWMMGCFALQTVDTELTADSVEWCPLQGCRHLLACGTYQLRRPEDRPAGPQNKRAPATFSELRLCSSALTSSLPVLL

SEQ ID NO: 933515 - protein, 169 aa, Homo sapiens
MHHLLECRKDFELGKGAKPARVSWLGMAAHPANSGSLLPDNAAGGIASASGKWPTTVIVVTLLHERDEATPDAVPGKSPILAVGKSVCHLLRALTVRNIICNFKVISIPPVPFKEEDRGPQVIRGCPGWFKNFHNGNLGLERVDGESCRETEASDEGGCPGSSDLENVS

SEQ ID NO: 933516 - protein, 226 aa, Homo sapiens
MALPRQWVPKVECRRFRDRAPPSFLLQNSEMVLSISLNTVLFGQLRPGLSSASLSSTLREAQALLLIFSPYWALLLRPSSWYTEHLPTHTLNLSLSPSSPLNPALPPYHLAAPPRLNPVLTQHSEGPSGMQMTTWQCWASYSSIVSTPSAPAWEVSLDLVPGLLASWSPAHSFPTRSSGAPISPASSSCWGRLSPNLRGSVAVRKARNCQAVFWSGCTFYILTSNV

SEQ ID NO: 933517 - protein, 175 aa, Homo sapiens
MLFFLSVHPLNFVLCAIPSQKCLIRGFCCGSIIECVYTNLDGLAYYTPRIYGLFLGYKPVQHVTVLNTVGNWNTMLSTWVSKHRKASAVVLGETNRTLFGFGEVSRCAPVRPGRPPATAAPTCAQPPPLPPQPAGFTLGENLTEVVTTRQINPMQIGLRFHNHPSQTAPGVQGDC

SEQ ID NO: 933518 - protein, 163 aa, Homo sapiens
MCVCICVYECACVSIWVSDWVRVHTCEPSQWHQIAITGHLEKNGGRRKGDHGSHAPGVEHLFSVPSSSCTDQHRQRAAGSTEKRQPPGHVAHAWPKFCWQVPPPSKISLPPVEEPLGGTQEGVKTFFNYHSTRCPIKNMAQLQASTWLLPPETMPPAEVTGWL

SEQ ID NO: 933519 - protein, 146 aa, Homo sapiens
MGTSKTMGLNKQAHSFPFRGTKIEKLKADSGDMPAAAERCKGTDTQLSLPDKHNKETQKQSQNPPPTTGNGYSLPNPCSPLPLSLSFSLSLFLTWLQSGRPFANSNWNIQYRTRTQPAGKICLLLASSWYQRKSGLPSRSLEDQWD

SEQ ID NO: 933520 - protein, 138 aa, Homo sapiens [sequence omitted]

SEQ ID NO: 933521 - protein, 135 aa, Homo sapiens
MRKLRLGVECEQFRVKQLIRKTYEWRNLINIRGHAKKPGKPRKPCRCSREWSIACSWKLSGKSGKRRYCLCFNFLSDIFLQDAFSREPGRIRRRWENFLPAGHLGARMTFVTWTFPFLLLIIVPSPLRPSLFWKY

SEQ ID NO: 933522 - protein, 138 aa, Homo sapiens
MFLSEDTWQSKCWQPCVHCQSMPTLTFSWFFEIPESENLCSSRKWGQGDGAVKNEELLVKLQVEVEQKSPTSICYNSFRRTETKVCHCANSEAAVFDEDHSALADRPCSDLPNLLEVNEGLLTVVRKVPIMNDSLTKC

SEQ ID NO: 933523 - protein, 155 aa, Homo sapiens
MRFGQDIYPNYINCPFVWVLRVHSPLIQKRTMHTNTQEANIVRKINQKETLLSSPKGNLLPYPGFVTLMATNQWSISGSAIEAIRRKYFHNRLIIFKVSPPLGSQISHYYALSHIRFQIMLPQACQPKKGPVPEPAVSQTVAYLPRLEDYLCTGN

SEQ ID NO: 933524 - protein, 134 aa, Homo sapiens
MEPKAKECWQLPYVEGVTIFPHNLEEVAPCQHLDFRLLASRTVGGYLSVILRHTISHQECGKVELLPSGIVALWNPSSLFLLGATEFSGKAYTKSSNFRAICDTLWTPHEGFPPNSYAREVDHAPKPHRPDESP

SEQ ID NO: 933525 - protein, 149 aa, Homo sapiens
MHTETWFLYLFTRVLRPTSQLGKVDDVSQFLATQCGPRTGSIGVIWKPEGSAGQNELPKHVGRNQGSHSGLGTWACEHERSIGSGSLYISGLELADPFLLEPLCPPAAEKAEASSNLGMALAEQGLRAHLKKNRPLINLMVITLYAYLF

SEQ ID NO: 933526 - protein, 174 aa, Homo sapiens
MTDCPSVHIPHYPQIAKISQHPGIHFRRVEGKFCKRIAGLRRAYASMPVRRQHRSVSLICHLAASSGHPITARILETEKYKFKTPASGEGSSLLLRWHLECRVLQRGEMLHLHMAEFKRPKLGQIIPFIRPFYKGTQSHSRGRSPHGLITSYRPHSLIRSHWQNLNFGRDTFKP

SEQ ID NO: 933527 - protein, 136 aa, Homo sapiens
MLTYLGIELGPPPKEGPEIGPSSNIEPAGTLIWTSKIPELDLVQTVCDFHVGLSLETLPVEEDATFEDIWAAYGKARVKLGVGFAGGMIYRMPRKVIGKTRRKACDLTVTSCRPLGTLAVSPEGGDAGGLPFRGSL

SEQ ID NO: 933528 - protein, 133 aa, Homo sapiens
MSSDFLLANSSIAQVQDRHDIGMDEQLIWIMPDVFCSLFICWLRRSKLPWTQLKGVKCLQQSHKQGSGHFPGGASGENPALADALIAACETFSRSPPDPQKLPWYGAGGLGEVLGAVSQSPSEKHGIWSPDDM

SEQ ID NO: 933529 - protein, 168 aa, Homo sapiens
MKARRLSKSASSTFFCLLFLASLAADWMVPTHIMKEDRKMWKSLQLHRDLLNGFDQVDNELQAEVVSDGDKKLMGNWSKVDSHYALAKRGDCTLQSPGAELPKAVGTHFLHQHALDVRHGVKGDHFVALIFDCPSGFWTCIGPVASLFWPIYPIWSGCIYQCLYPHCI

SEQ ID NO: 933530 - protein, 234 aa, Homo sapiens
MKLSISFPATDSRKLIEEELKLRTFYEKPMATEVAADSLGEEWKDYVAQISGENYKQGFPMKKGVMTHGRVRLLLSKVLLQTKENWRKKERKSVCDCIVDANLSILNLVIVKKGEKDIPGQTDTTVPHCLGLQRASRILKLFNLSKENDVHQYVVRKPLNKEGKKPRTKAPKIQHLVTPHVLQHNRRCIALKKQRTKKNKEEAAEYTKLLAKSMKEAKEKPQKQIAKRCRLSSL

SEQ ID NO: 933531 - protein, 335 aa, Homo sapiens [sequence omitted]

SEQ ID NO: 933532 - protein, 136 aa, Homo sapiens
MTWLLRYTVFIFLHKKMQAVRLQMLAAQNIPFVCEETDWMAQFQSNYEMQAGMPGEKDHNRAPGTQAVAGQKEDGIGDFQHVVVATICPAQGKHKRIESKSLIVADGKTETYAGHMPLKLTQCLWQSKGLNLVVSY

SEQ ID NO: 933533 - protein, 221 aa, Homo sapiens
MCSAEAESALLLWILAVPALGKGPLATSGPSPSKCFCTGCLLLPLPPMSCWGLWHHFSWLCNSPWQVSKSRPRWFWRTTAAKESTWAWRTDKVCDMSVMLAEKSLDRLQNVVTEVEMPAIPVLRAIVEAESPKPTIKGIKGVKSGSLGIAPRAISCDGLKKQCKPAVNKSEFKGSGGEYLRLPGGRGGIRLAVRWPQLYSGKVNPVGRILQADSSWGTIDK

SEQ ID NO: 933534 - protein, 149 aa, Homo sapiens
MVTGMLQRVVVKVTEGEGTCPKLGLVDTGSWHIGPEVKEAKMKGIVESFKCENTFQLQDQRTFPTAHKCLQLYRICKSTKESTSYCSREGGKNKGAAISKEIVTDAVTAELRLKGGEGVPKEPVPRKPGGGAVQAGARAALKAETVLSS

SEQ ID NO: 933535 - protein, 157 aa, Homo sapiens
MERAEVVYTLNQRPIYGTESAIGRIHRSRNQGVEVEVAPLTNTPSDSLAKFLLPVPSTLRSAGLKVLVLEGGMLPPGDMTMPLNWKLRLPPGHCGLLLHLSQQAKKGVTALAVVIDLDCEDEISLLFHNGGKEEDMDEAVSHHPRKLTQEQKTKHCL

SEQ ID NO: 933536 - protein, 225 aa, Homo sapiens [sequence omitted]

SEQ ID NO: 933537 - protein, 148 aa, Homo sapiens
MKAFDNLGENFKGHDEDEIQAVVGGSREIRSTPWWASLPPGRGKQRAYSRCFGAERQVQNLSSPLAPQGEGKQSGQLALLSLSSFSPTDFREKWSFCSLQDMVMGWGWEKGRLSPWSVLQIPPGRGIGACHPALVEVKKLQKCQPNLS

SEQ ID NO: 933538 - protein, 142 aa, Homo sapiens
MTYHFFVEAFDSLISLTGKIQLTAADGKARYHVDHPDSLILLVLHSTQEDFRWTSNTKAHWETDLVFYLASWGKASLGQPLVLQMEGALSIPSTTENKFGEFYLQIVDKEGIIIQGSSPPSPGLAINPGMMRMMSQEEREHI

SEQ ID NO: 933539 - protein, 297 aa, Homo sapiens
MALLSLWVQVGCGHKQAICTASARAVQRGNAELEARHRVPIGSLSSGAVRRGPLSSRPQNGRSTNNLYYVPGKPSGTQCQLVKAAKGAVPGRATGVELAKALGAHSLHQCGLDVRYEIRGDYFRALRFTDCPARFQTCMRPPFDVRQSLLVMELMVVATGNYPIWASESAEQVGSARQSLREAGRKGSADIRLALCHGQDSPIMSRSGSQQRQEPPIGVWQALGYGHPWLYSPAAIPVPNPLGLYRVKSCLCELSEQLSQTAQMSLGVMGSPAAKILECSDLEKQHPKHNNDTRISR

SEQ ID NO: 933540 - protein, 147 aa, Homo sapiens
MVVVIEMECVAVKGQWRNPLAYVNVNILIVIYIHEALQDSLPRLLCKHLFGMQAQMKLLKMVGAPVMLGMPDAFEFSSLEQYYVKMPRKFQKRICLRGMKKYKTLEVRAPGSHYSHLSALTTAEMFLAPAHMASSVLASPVLFMSCL

SEQ ID NO: 933541 - protein, 142 aa, Homo sapiens
MLPNNEDEAEFKGDTKGPLTISLSWENSVVLRGISKNLADTCPNSMGQRNKGKGPSSAVLLEFAGGPLQTLFAWVSPAEAAEQQRLLPALSSGSFVPEGEPPDASWSSPRLIFIDSMKGPTCPLGSIWIWLLRSTYKYLENG

SEQ ID NO: 933542 - protein, 154 aa, Homo sapiens
MWLATCLDSYLNSLGPRFVLPQKDVKKIEKSLPDQHLLFLDTLPLKSQISAKSFPNGEIAQLKPYGSNGKDGERGGYIMSQKTVKGSNILCWIPGRVSEETLLLSSVLRSRMMPLRKSHLLKGTQIHKEFCCCLLDKNPLVDFSSYCKLEKSIQ

SEQ ID NO: 933543 - protein, 206 aa, Homo sapiens
MGLPSMAPPGRSCCGSRSRRESAACRGPPPAWLRAGTPPRARAPSPADRPSCPQFLPKLDSLSGCPKSLIPGPASPTPVTPPPAPGPSLHPRSPPSGAHPPPENSRRAARLWAESGFLSGARPVSLSPWDEQPQPKITLERRAKNGYLLPALKSEAGRCTSIQQDPLEPSTLSPASSKTAHFPAEEKKNGIHAVPILQMKTRGLFL

SEQ ID NO: 933544 - protein, 162 aa, Homo sapiens
MERNGMEWKGMESTPVEWNGKEWNGMEWNGMEWNVSEWNRLECNGMESNLVKWTGIEWNGMEWNQPEWNGMEWNGMEWNGMEWNGMEWNAMEWNLPDWNGREWNGMEWNGSKWNGMESTRLEWNGMEWNGMEWNRVEWIEREWNGIKPIGMEWNGMEWNGME

SEQ ID NO: 933545 - protein, 187 aa, Homo sapiens
MEGNGINPSGMERKGMEWNGMEWNISEWNRLECNGMESNLVKWTGIEWNGMEWNQPEWNGMEWNGMEWNGMEWNGMECNGMESTRLEWKGMEWNGMEWNGKDRNGMEWNQPDWNGMEWNGMEWNGMEWNGIEWNGSKGNGMESNRLEWNGMEWNGMEWNGIEWNGSKGNGMESTRLEWNGMEWNGIE

SEQ ID NO: 933546 - protein, 1641 aa, Homo sapiens
MDWNGINPSGTAWTGMEWNGIEWNGTKWKGMDSTRLEWNGMEWYGIECNGTKWNEMDRNGIILSGIEGNVFEWNGKECNQPDGMEGNEIERNGKEWNQPEWNGRECNGMEWNGIILNGMEWNGMEWNEMNGTKWNRMHSTHLEWNGMEWNCVEWNGMEWSVKELNRINPNGMEWNGMEWNGMEWNGMDSTRMQWNGMEWNGMVWIHPERNGMEWNQPDWNGMEWNRMERNGMEWYVIEWNGTKWNEIDSTQLEWNGKEWNGMEWNGMESTRMEWHRMEWNGMNQPEWNEKEWNAMEWNGMEWNQHEWNEMEWNGLEWNAMEWNGMEWNGIIPSGMEGNVFEWNGKEWNQPEWNGREWNRMERNRMESTGVEWNGKNGMEWNEWNVINPSAMERNGIEWNAKEYNGMEQNGTEWIHPNWNGMEWNGIVWNGMEFGMEGNAMEWKGIEWNQPECYGMEWNGKEWKGMVQNRMEWNEMSGMEWNGMDWNGMQLKGMDGNGMESNHSEWNGRECNRVEWKGIESTRVEWKGMEWNGKEWNGINTSGMEWKGMERNGMEWNRMEWNEINPGIEGNVFEWNGKEWNQPECNGMEWNGMEWNGMESTRIELNEMESTRVEWHGMERNGMELNGMERNGMEWNGMEWNGMVWNGINSSGMEWNGMDWNGMQWKGMEGNGTEWNHSEWNGREWNQVEWKGMESTRVERKGMEWKGMEWNQPEWNGMEMNGKERNGVESTRVEWNGNEWKGKECNGMEWNGMEWNQPESNGMEWNGMERNGMEGNGINPNGMEWKGINPSGMEWNGLEWNGMEWNGILSFRWNGMESTRVQWNGMERNGMEYNQPEWNGMERNQPEWNGMEGNGMEWNGMEWKRIEWNGTKWNGMDSTLLEWNGMEWIGMECNGMEWNGMVSFRVEWKGIGMEGKVIEWNGKEWNQPECNGMEWNGIYQNGMEWNGMEANGTEWVVPEWNNGMESNRVEWNGMELSQTEWNGMEWNGMEWNGMESPQMEWSGMEWNRLEWNAMEWNGMEWNGMEWNGINTSAIEWNRKNGMEWNGFNPNANGMERNGMEWIQPNLNGMEWNGMELCGMEWNAMECKELNRINPNGMEWNGMEWNGMECNGMEWNGISSSGMACYGMDWNGMQWNGMESFRVEWKGIVDWNGMEWNAMERNGMESSRMEWSGMEWNGMECSGMEWNQPECNGMEWNGMEWNIINPNGMEWKGINPSGMAWNGMEWNGMEKNRMEWNKIEWNGFNPIGMEWNGMEWIGMECNGMEWNGMVSFRVEWMGIGMEKNRINPSGMEVNGMERKVIEWNETEWNGMEWNGMELNGTESTRNGMEWNGMEWNEIVWNGMEWNGVKRIESNQPEYNGMERNAMEWNGMEWNGMEWNGINQPEWNGMEWNGMEWNAMEWNGMESARVEWHGMEWIGMECNGMEWNHSEWNGRELQWNGMERNGMEYNQPEWNGMERNQPEWNGMEWNGMEWNGMEKNRMEWNEIEWNGFNPIGMEWNGMEWIGMECNGMEWNGMVSFRVEWKGIGMEGNVIEWNGKEWNQPECNGKEWNGMEWNGIYQNGMEWNGMEWKRIERNGFGMAWNGKEWNGMECYVIEWNGTKWNGMDSTQLEWNGMEWNHSEWNRREYIRVEWKRIESTRVEWK

SEQ ID NO: 933547 - protein, 2483 aa, Homo sapiens
MKWHQPDCNGIKSRGMEWNGTESNRVEWNGMEWNGMEWNGMEWNHPEWNGVEWNGMEWNEMEWNGMESTRVQLNGIEWNAMESNGFNPNGVERNGINPSGMAWNGMECNGLECNGMVRNRVEWNEMEWNGMEWNGMELCGMEWNGMEWNGMEWSWNGMEWNGLEWNAMELNGIIPSGMEGNVIQWNGKEWNQPEWNGVEWNQPEWNGMEWNGMERSGMVRIRMEWNEMDWNGFNTIGMCNGSQCNRVEWKGIESTRVQWNGMEWNGMKWNGVYQKRMEWNGMERNGMECTRMERNGMESVEWNGMEWNGMEWNGVIPNGMESNGMEWNGINTCAMEWNRMEWNGMEWFQPECNGKEWNQPKWKGMEWNGMEWNGMECGIKGNVFEWNGKEWNHPEWNGREWNGMEKNRMESTRVEWNGKEWNGMEWNGMEWNGINSSAIEWNGMEWNGMEWNGMESTRIEWNEIESTRNQPERNGKEWNGTEWNGMEWKGMEWNGMEWNQLEWNGMEWNGLEWKAMEGNGREWNGMESFRVEWKGMESSGMERNGINPSGTEGNGMEWKGMEWNQPEWNGMEMNGKERNAMERNGMEWNGINPRAMVWNGMEWNGMEWNGMEWNQPEWNGMERNQPEWNGMEWNGMEWNGMIRNRMEWNEMEWNGFNPIGSGMEWKGNEWNGMEWNGMEWNGMKWNQLECNGMEWKRNGMEWNGMEWNGMEWIVSERNGMEWNGMEWNCMAWNGMKRNRMEWNQITWNGMELNQTEWTGMEWNGMQWNGMESSRMEWSGMEWNGMECSGMEWNQPECNGMEWNGMEWNIINPNGMEWKGINPSGMAWNGMEWNGMEKNRMEWNEMEWNAMNPIGMEWNAMEWNGMEWYHSEWNGRECNRVERKGMESTRVQCNVIEMERNGINPSAMEWNGLEWNGMEWNGIYQNGMEWNGMEWNGMESNGTEWVVPEWNNGMESNRVEWNGMELKQTEWNGMEWNQPECNGVEWNGMEWNGINSSAMEWNGIVKELKRINPNGMEWNGMQWNVMEWIGKEWYGIEWNRTKWNGMDSTQLVWNGMESNGMEWNGMECTELNSINLNAMEWNGMEWNGMEWNQLEWNGMVWNGLEWNAMESFRVEWKGIGMEGNVIECNGKEWNQPECNGMECNAMEWNRNYQNGMEWNGMEWNGMECTRMELNGMESYGNGMESNRVEWNQMELNQTEWNGMEWNGMERNGMEWNGMEWNNPEWNGAEWNGMEWNGMEWNGMESTRVQWNGIEWIGMEWNGFNPNGMERNGINPSGMAWNGIEWKGMEWNGMEYNGMERNGMEWNGMEWSGIIPSGIEGNVFEWNGKEWNQPKWNGRERNGMEKNRMESTRVEWNGMEWNGNNSSAMEWNGMQWNGMEWNGINSKWNGTKWNGMDSTQLEFNGMEWNCVEWNGMEWNVKDLNRINPNGMEWNAMQWNGIMERNGMEWIQPNWNGMEWNGIELCGMEWNGMQWNGTQLNGMEWNQLEWNGMVWNGLEWNAIEWNGIIPSGMEGNVIEWNGKEWNQREWNGREWNGMERNGMELTRVEWNGMEWNGMEWNEMESTRELNRINPSGMGWNGTERMGVEWNENEWNGMEWNGMEWNGINSSGMEWIGMECNGMECNGMESFRVEWKGMKSSGIKMNGINPSAMEWNAMEWNGMESTRMEWNGMEWNGIEWNGMEWNSGMEWNGMESSRMERSGMEWNGMEWNEMEWNEMESTRMQWNGMEWNGMECNGMESNRIESIRVEWNGMEWIGMEYNGMEWNHSEWNGRECNRVEWKGMESTESNERESNGMERNGLESTRVGMEWNGMEWNGMECSRMEWNQPEYNGMELNGMEWNGMNGMESTLVQWKRMEWNGIESTRVEWNGMEWIRMECRGLEWNHSEWNGRECNRVEWKAVELTRVEWKGLEWKGKEWNGINPSGTEWNGMEWNRMEWNGINPSRMAWKRMQCNGLECRGEWYGMEWNGMEWNGKEWNGMEWNQPENNGMEWNGMEWNGMESTRMEWSGLKSVRLERHGMEWNGKEWNVQWNGMEWNGLESTRMEWNGMEWNGVEWNGIKWNAFNPIGMEWNGMEWNGIAIEWSVKKLNRINPNGMEWNGMERNGMEWNGMESTRVEWNGMEWIGMECNGREWKGMEWNGIIPSGMERNVIEWNGNGINTSGMEGMEWNGKEWNGIYTSGMEWNGLEWNGMEWNQPESNGMEWIGMEWNGKKSSRVQWNGMEWNGMESTRIEWNEMESTREEWHGMEWNAMEWNESTRKEWNGTELNQTEWNGMEQNGMEYNHPEWNGVEWNGMEWKGMEWNGMEWNGINSNGMECNGMHWNGMQWKGMEGNGMEWNHSEWNGRECNRVEWKWNQHEWNGREWNGMERNRTESARVEWNGNEWNGMERNGMERNGINPRTMEWNGMEWNGMEWNGMEWNHPESYGVDWNQPEWNGMEWNGVEKSGMVRIRMEWNEIDWNGLNPIGMVWYGMDWNCVEWNGMEWNGV

SEQ ID NO: 933548 - protein, 152 aa, Homo sapiens
MLLCASTVSFYFFGWPERASGACRPMGHDQTYHVVTSPELLSKKGEGLGHGHTLSPSPRSSHSHVYLKPGHCQGIRPSCLGRGEHHPGTPRGPRLLGAVYVDGEGEKRQWRSNTNQLDIIVEKNFVSGIILYHGHYGIKKDNDPHTINTVDH

SEQ ID NO: 933549 - protein, 139 aa, Homo sapiens
MHANHSSHQNGYWYSHTVRTTVEVSSSNNISCGLNSTVELLLAGSDPGKEGPEALSTDTDVPECLRFLEQPRTARHKREKPRAGPVTTMASPVPLAASLHVLGISAALTPAVPHHEVRRAPRLSYPCVISLRRTLEAQT

SEQ ID NO: 933550 - protein, 204 aa, Homo sapiens
MKPFPPLTSSAVLMRKMRNLSAFDSCRNKNQGSEGAHPVSQEQSGVEPACGHKASSSCPLFLCCLSAPHRSQEPRRLSVVLLRTSCQDLTTAPTIASTEKISPLYQGRWSGTATKHSPTRAANTNSAHHAEIALACGSLVISFDAAGPRAELTLESATLALKVLGPFSKGSSRIFQTVVSTSVCGFKDKENKVNALKLCHCSIH

SEQ ID NO: 933551 - protein, 139 aa, Homo sapiens
MLPLLIPESSPAGREKLSAEEPVIKTVEAQTRGIQKVEALRRFSLTEQAHAAGPGGTLCQSHPSPSSHSNGESPLLLFGDEGFGLGGPQSGGPKIKVHVCLIVQTLRSSDYRKSQVVSLPMAKEGSFQYIPLLPQLQGE

SEQ ID NO: 933552 - protein, 193 aa, Homo sapiens
MRIPPEKCIVRQFCYRVNMVESMYTDLDGMVQAPLGCMARRQERSTGALEIHISNGKEERMLQAVSEAGMIRCQGHRNVLYFPLENVESMLPLNAHYFPKIWEVINGFDIGDWQDVFPGHSPADPSRVRSRQDKVKKAMGTSRCCSKQSLAALTAGWHKDASTSAMTVYQCHGNSPEVITAFSGNNLEGAALS

SEQ ID NO: 933553 - protein, 186 aa, Homo sapiens
MCRVPALCLLATAGPSAGGAVVFAESKQNYFNESCVKKIKINLCDVICVCQPALPKRRKMEAFSACPDHPATAAHKGNLSQEASDSICVLFCMLSPTKEACVAQSPQCHISEAVEGIALGDAGGRNCSPLTLAMDAEPGASENKVPRDQPEGMGNKLLSLQGGQSPIRLPCRVGLCVGEYLFSFAL

SEQ ID NO: 933554 - protein, 153 aa, Homo sapiens
MSHCLHLGVGTSVGEKGSYDEDQLLVDLQVSDHSTEFLKGYLPIAILVQDDDGFVDQLLELPVRQVVAHHHLQHLEELPVGNVAIFIHVVNAERKPQLLLLVALDAELGGPQDEFLEVHFSITVGVEDVDHSPHQRVVAQLRQGHELLHAQRP

SEQ ID NO: 933555 - protein, 162 aa, Homo sapiens
MTMVCGYAGSTVVVPGGCQHTAVIDIVQTSGVNGGMDETLVQSKFLRLLPFDKYGPRHSFPNPKPAKPRSLHRGPAQPPRSARSLSSSAAALGDTLNGSQVPGHSALAGQELLLCSETDPDSSVWCDCVWPWASYLSKFQSLPVSNVVDCSCVHHRDFVKIK

SEQ ID NO: 933556 - protein, 146 aa, Homo sapiens
MIPCIVATGPQSLLACKFSAEKSAVSVMGFLLVHVHNVQSNPSSPNLLQFAEVHSRHCSPGYHQCRLQNSQDCCLLLPLGDSSQRGTGLMPARAPLCEMSWAWCTVLGESPLPGSVALFRACKQERLSLLKLQLQPPLPRCSVPRR

SEQ ID NO: 933557 - protein, 144 aa, Homo sapiens
MVLGLTFKTLSCRSVGVCRWSTPDSFCLGISSRGCRTADIGEQQMLLPDRSSGSFVSEEYLAGEMNPVPPLEMRKSPTVCVTHAGSCRLELFLFGHLGSTPENWSFKLSPEVWEGSVGWVTSCPLSPGLRIFEQTKWNIYMQVW

SEQ ID NO: 933558 - protein, 134 aa, Homo sapiens
MLSQPSSPNPQQSMVCDVPFLCPCVLIVQFPPMRPSAAGLLEFTRGPFQTLFACISAVVTAEQWILVNRRCCCLIVPLEVLFQKSTRLFLSLLSCDTNLPHVQCPSEPFEIPLKNVVWTRRTNTNMRLLPPGRQ

SEQ ID NO: 933559 - protein, 469 aa, Homo sapiens
MERNGKEWNGIKWNGECNGMISNGMEFNGMDSKGMDWGGMDWNGMDSNGMDSNGMDWSGMDSNGMQTNGMECNGMEWKGIEWNGIGWNRMEWNGVKWNRIERNGIKWNGQEWNGIEWNGMDSNGIYGMESNGMESKGMDRKGVDWNRTDTNVMHCNVYDSNGMESNGITECNGMESSGIKWKGIEWNGLECNGLELNAVEWNGVDHNGIEWIGIQWNGMDSNGMESNGMESNGMEFNRIELNEMELNGIKRNKMEWSVTERYRMKWNGMEWTRMEWTGMQWTRKEWNGMERKRWNGIGWNGIEWNGEQNGIQWIGIEWNGMEWNGMHWNGMEWNGVERNGVEWNGIKWNGVEWNGMGLNGIERNTMEWSCNGKILNGMDSNGLDSNGMDWSGMDSNGMDRSGMESNRMETNGVEYNGMEWNGMERKGIEWNGFVWKVMEGNGVEWNRIERNGIKWNGLEWNGLEGNIIE

SEQ ID NO: 933560 - protein, 572 aa, Homo sapiens
MELSSNEIEWNHHRMESNGITIKWNGIESSSIGIEWNHRMESNEIIIEWNRMKMEWNRIIVEWNRVESTVNGIEWNPHQMELNGIMECNRMELSLVRIECNLESSGIIEWNRMESSLNGIKWNHRMESNEIMIGWTQMESSSNGQKCNHHQMDSKNGIEWNHPRMESNGIIKWNRMESSSNGIKWNHHRMESKESSNGIEWHHWMDTNGIIIGLTQMESRMESSNGIKWKHHQMESNGVIKWYQIESSSNGIPWNHQMESNGIIKWNQMETSSNGIKWKHHQMESNGVEWNHRMESNGNIIKWNRMDPMESSTGIEWNHRMDSNGIIEWNPMGSSLNGIKWNHHQMESNGIIEWNRMESSSDGHEWNYHQIDLNGINLLPMHMNGIIIGWTHMESASNGLKCNHHQMDSKVIIIGWNRMESSSNGIEWNHQRMELNGIIIRWNQRESSNGIIIEWTRMESSSDGPKWNHHWMDSNGIIIGWTRMESSSDGLKWNHHWMDSNGIIIGWTQMESPLDGHEWNHHWMKKNGIIIGWTQMESSSDGIEWNQHQMESNGIIKWNRMESSSNGNECNH

SEQ ID NO: 933561 - protein, 202 aa, Homo sapiens
MKLNGIIKWNLMESLSSGIKWNHRIESKGIIIKWTLMEPSSNGIKWNHHRMDPNGTIIEWTRMESPSNGVEWNQRNQMEISSNGIQRNHRMESNGITEWNRMKSSLNGIEWNHQMQSNEIIIKWNRMETSSNGIKWNYHRMELNGNIIELNRMESSSNGIERNHHILEPYKIIEWNRMELSSNGIKRDHHRMESNGIIIEWN

SEQ ID NO: 933562 - protein, 640 aa, Homo sapiens
MESSSNGLEWNHRQMDSDGIIFEWTRMESSSNGLEWSHHGMDSNGIIIKWTRMESSSNGLKWSHRGMDLNGNNHRMDSDGIVIQWTRMESSSNGLEWNHHQMDSNGVIIEWNRVESSSNGLEWNHHRMDLNRIIIEWTQMESSSNGLEWNHHRMESNGIIEWTRMESSSNGLEWNHHQMDSNGVIIEWNRVESSSNGLEWNHHRMGSNRIIIKWLEWNRHPMNSNGIIIEWNRMESSSNGPKRNHHGMDSNGIIIKWTRMESSSNGLKWSHHGMDLNGEWNGMHWNGMHWNGMEWNGVDWSEVEWSEVEWSGEEWNVVEWNWIKWNGMEWTRMEWTRMEWKGLEWNHHRTDSNRIIIEWTRMESSSNGLEWNHHRMDSNGIIFKWNRMESSSNGIEWNHQMELNGIIIEWNRMESSSNGVEWRMECNGVKWNGMEWSGVEWSGVEWNGMEWNGMEWNGMEWNGIEMNRIKSNRMESNQMELHGMERNGMGAEIVPLHSSLGDRVRNSRKKVMEWNGVEWNGTEWSEPEWSGVEWSGVEWSGMESDVMESSGMEWNRMDWNGLEWNGIEWNGLEWIGMDSNGMKWTRMESSSNRLKWKHHQMDSNGIIIKCTPKKSSSNELEWKCHQMDSNGIIIEWIRME

SEQ ID NO: 933563 - protein, 231 aa, Homo sapiens
MHTYVTNLQVQHMEAQHKGLENLQPDNAAEKKTPFSEEKFKLATDICVTNNEPKFNPQDNGKMFPRHITGLHGSPSHHRSRGLGGKIGFVGRVQGPLCVFSLVTWCPISQLPHPWLQRVQASRFGSFHVVLSLQVHKSQELRFGNLHLDFRRCMEIPRQKFAIGAGPSWRTSARAVQKSNMGWEPSRRVPTGAPPSGSVRRVPPSSRPQNDSSTNSLHRVLEKPQTLNASL

SEQ ID NO: 933564 - protein, 302 aa, Homo sapiens
MRKFELEGDDLGYLAEEIPQQQSIQKVTWVLLNAFHFKRETERKSSENLQPDDAVEKKNLFFEEKFKLAAEISISNKEPNVNPQDNGENVSRACHRSSWQPFPSQTQNPRRKYGFVGGTQGPHAVCLGTWCPASQLLQPLLKGVKVQLGSWFQGFQAPDLGSFNVVLILWVHRSQELRLGSLHPDFRRCMEMPGCPGDSFLQGQGPLGESLLGQCGREMWGQSPHRVSTGALPSGAVRKGPVSSRPHNGRFSDSLHCAPGKAADAQRHPMKAARGRLYPAKPQGRSCPRPWEPISYISITWM

SEQ ID NO: 933565 - protein, 154 aa, Homo sapiens
MFYKSPPDSGAQLASSSGSRTGAAGGAACQSLSMRPHSSALGSPRRVEAKEWRAAGPEPCPTGRQLRPGEKSSTAAAGPGVKPLTARACKAGRQLLVRGHQAHAHPELQPAGKQHACGLKGSSSAAKVGAQAKEALKVSEGCEGCQHAVTSHKE

SEQ ID NO: 933566 - protein, 172 aa, Homo sapiens
MGGGSRDVFGFHHGGASAWIIHPNKSGQRKTRFSEEGDIEPKELTKRLIVILSSRRVDLGTHQKGPMWSLTERRRKAHRMLKLYNGLWEGEAVGLPTGPDPLDPTDLNGAHFDPEVYLDKLPRECPLAQLMDSETDMVQQIRAIDSDVQTLVYENYDKFIPATEIDKQHKTV

SEQ ID NO: 933567 - protein, 181 aa, Homo sapiens
MMRGKVQPFRPAYELMEQPPLKVSRWTSQRCQSVEVTKDPELQPVLALLSLSLSMYLVTVMRNLLSILTVSSVSPLHTPMYFFLSNLCWADIGFTSATVPTMIVDMQSHSRVIPHAGCLTQMYFLVFFACIEGMLLTVMAYDCFVAICRPLHYPVIVNPHLCVFFVLVSFFLSLLDSQLHS

SEQ ID NO: 933568 - protein, 139 aa, Homo sapiens
MLMAIGGIEAWSQRRWLLALAGALYMDLRAAQVKDSVEIAEASQVEEVADVLEETWVEKVAEVPRPRVETIEVPEETHVKVVGEGPEATQLQEVDEVSEDRQLQEVDEVPEDRQLQEVDEVSEDKELREVVEVPEDREL

SEQ ID NO: 933569 - protein, 138 aa, Homo sapiens
MGVRDSQASDLARVFFRVGLALSPFQRTAVCIQSEETGAAAGPPYGKRRCPGPTFSLYFVSETLHKSLVPPEEKRPQNGFTTLKDSPLARCQLIDSVWIVFLGVRVLSWCPFMVLLKDVAGKEGPDTDHKVGFLDLVQ

SEQ ID NO: 933570 - protein, 168 aa, Homo sapiens
MWQALMTTLCDSQRPRFLQCLGWGPQISMAKQCSQKPADAINQFYILQALRISGHQKCPLLPELNSQVKTPEGPEMWAGSHYCLSGHKDTDSFHGCLLCYNCISGRQWIREAPAVEDRVENHCWPSIPNLTAEQEYSSAEVNLTENFETMKATNTSNSSQPASPIDLL

SEQ ID NO: 933571 - protein, 122 aa, Homo sapiens
MHLEPPGQVAAWILSMEAMAKVKCKKIILEAVPSGSCLSSQHLGRPSVGGEARWKCLGIMLKSRPSVGGEAGCMEVFESHAEIWSPVLVCWRWVWVRVFGPHAEIWSPVLVVKLDGGVRVSC

SEQ ID NO: 933572 - protein, 212 aa, Homo sapiens
MEISKSYKSRSSFSFIKHLPANHGLRYIKVYGNWASRLLNAKAGSPSCQHELGQKAEWCLENGDNRNQENDILKYVFRFDSILPISFSQEEQDQGPLKEAVWLLFDRAGVLHWDWGALPRLDHLDSPKLAGCVCITLAGAGVPETPTERSHPEPGPVSGRLQPVAVGWLEFQASMRCRGSGTCRMTLLGFLDSAPFLGVRTGHLLKVTEPSS

SEQ ID NO: 933573 - protein, 144 aa, Homo sapiens
MGRNQHKKAENSKNQNASSPPKDHNSSPARKQNWTENEFDKSTEVGFRRWIINSSKLKECVLTQCKEAKNLEKSLEKNLNDLMELQNTAPELREAYTSINSQIDQEEERISEIEDQLNEIKREDKIREKRMKGVNKASKKYGTM

SEQ ID NO: 933574 - protein, 217 aa, Homo sapiens
MSEIVDQMINGRKWVLEERKNMYEGPPGWKELCMFKEHTEEGPTYRDKGQVVLDEAGQVNKHSHTQLRRCWDRSVIHINSLALQFIVVSSHVMAPVTQWPDFLVVLVPMATVDSKAVVLKQECASESPCYNRVLDPITSVSDAAGLGWSLRSFISISSQDKKKGRRDDKNIENKKADRQLFQLASVDLGILSCKQQKLESEGICTPEPQKSSGFWNF

SEQ ID NO: 933575 - protein, 141 aa, Homo sapiens
MGAAPPAITIIFRCKEGQDQKPEGTFRFREVNHDLYSLNITYNSPGRTGSYNYFYFQGCWRVHVHVLSKELKPLLPLPRCLQSEVPSLPLSTQLFTQSSTWCSGRLAFPFSVVAYESVPPSHPHLVDYSHLLLTEIVSGAT

SEQ ID NO: 933576 - protein, 162 aa, Homo sapiens
MPCPTLTDDIPPQKKCKWPVLALSDDITLDWEKQNALPQPGLLISPVERIYGKLGMAPTLIGSEVKHGPIISTERSDELCAAGLKPKRASQARAVPTTLALEQDQCMNILPSLPLGANVSNEIGRPGPVYWRNGSQAFKLAAELTLHISDFPDLLEPADPGR

SEQ ID NO: 933577 - protein, 179 aa, Homo sapiens
MVHRLIGARGHEEASPSHIHTRAGLRCSKGPEYPLPPIDAAQGESNETGGKNLPKESLAAGSGGGCWRSTSCHDGGRHVCPLGPGKAAAIRHLERDCAQNCLRVRKPNGDSPCEVEGWIVGLRCGHKYTARGVLESEVIKLGGPAMMGLESQIPNNPRGTSQRKETVFEHLPHSLQCQL

SEQ ID NO: 933578 - protein, 172 aa, Homo sapiens
MLLTQSLFGGLFTRTHMKLTMPKGKLLNVNPDWMMANSVFFNSLQLETEAEKYCVSMRRQHFRCILKARYGLRVGIIEERAEAEEIPLIHASTVGPDSPQLTDYSSPTNLPTGFHSEMGFKPKPKAVNSQYRYRFNDWFRDYQLSSSWSPIMMEHRYRCPGACLGEEDFCIG

SEQ ID NO: 933579 - protein, 147 aa, Homo sapiens
MGKKQSRKSGNSKNQNASPPPKECSSSPAMEQSWMENDFDKMREEGFRQSNYSELQEEIRTNVKEVKSFEIKLDEWITRITKAEKSLKDLTELKTKAREPRDECRSLSSRCNQLEERKLYKPEESGGQYSTFLKKRIFNPEFHIQPN

SEQ ID NO: 933580 - protein, 635 aa, Homo sapiens
MSNIQRIIQVRVIKNIPLRLKVLPILSSQRYVEQSNLMMEKRNNSLQTATENTQARVLHAEQEKAKVTEELAAATAQVSHLQLKMTAHQKKETELQMQLTESLKETDLLRGQLTKVQAKLSELQETSEQAQSKFKSEKQNRKQLELKVTSLEEELTDLRVEKESLEKNLSERKKKSAQERSQAEEEIDEIRKSYQEELDKLRQLLKKTRVSTDQAAAEQLSLVQAELQTQWEAKCEHLLASAKDEHLQQYQEVCAQRDAYQQKLVQLQEKAQITALTKQNEQHIKELEKNKSQMSGVEAAASDPSEKVKKIMNQVFQSLRREFELEESYNGRTILGTIMNTIKLLNQQEQEKEESSSEEEEEKAEERPRRPSQEQSASASSGQPQAPLNRERPESPMVPSEQVVEEAVPLPPQALTTSQDGHRRKGDSEAEALSEIKDGSLPPELSCIPSHRVLGPPTSIPPEPLGPVSMDSECEESLAASPMAAKPDNPSGKVCVREVAPDGPLQESSTRLSLTSDPEEGDPLALGPESPGEPQPPQLKKDDVTSSTGPHKELSSTEAGSTVAGAALRPSHHSQRSSLSGDEEDELFKGATLKALRPKAQPEEEDEDEVSMKGRPPPTPLFGDDDDDDDIDWLG

SEQ ID NO: 933581 - protein, 153 aa, Homo sapiens
MAGGPSGATSLTQTFPDGLSGLAAIGLAASDSSHSESMDTGPRGSGGIEVGGPRTLWDGMQDRPEEATGQLPRPPALRAPWGTLASPYSGVLEAAQNWLRLTAPGKVFVAALLLFLLLLHCCSLPSLAPVGLTAEESPSIQKPRKRWSLKGTQ

SEQ ID NO: 933582 - protein, 147 aa, Homo sapiens
MCRSGVHNPRDLDWNWSVAYLELGHTAGSEQWATPYENLMPDDLRWNNFIPKSSPQPPVHGKIIFHKTGSWSQKGWGPLFYTVHSHVPNTSMTFHEEGNGRPFQTGRRTWVKVWISSTFLAICPSLTSPSPLLEWLRQDKVQILSLP

SEQ ID NO: 933583 - protein, 135 aa, Homo sapiens
MKQGLTPLYMSPETYILVPLYLINEMHGPETHKRGHVIPNNVVRFTQRRGRIPTWTTPPVSPASIASLTLSSTIFPVTCFPSATLTSLLFLGHCRHVLAVPSAWIVPTPIPCVHMTHLLPSFKSLLEGHLQQCLP

SEQ ID NO: 933584 - protein, 167 aa, Homo sapiens
MREVLFLLSQDIKACESCFLGPQCERFLEDLVAKAVPGKVQPLPNSLVQLSVSGANGPPCIFECQLCLWDQWSQGWAEQECNALVRQLEFHEPDFVAKFDQAVAATADYPTLVTGGSCVPLTYPIIGGHCFIVFIFVFQYLQDAPGHSRKVSSVSQKMGPDQTLNLP

SEQ ID NO: 933585 - protein, 142 aa, Homo sapiens
MAGAFCWAILCSFLFLLHDDHVTIRTHIQGQRGGTTLLSCKGILLSLCSELIPPSLPHPRDELKVIRTGFLSHETQRILMYTASKGQSVSFKSGLCDSKVVLTPRSLHDPFLVLALAGWMFERLQGISEACSRKIAAKPHGA

SEQ ID NO: 933586 - protein, 125 aa, Homo sapiens
MKITPEVVEKEDYSEIIGSMGEALEEELDSMAKHESREDKIFQKFKTQIALEPEQILRYGREKDIPENILCDAKKMFEFQVMPQLLNYLKADRLSESIDWGILAVFTWAESCIPAIQNNLCGSRM

SEQ ID NO: 933587 - protein, 157 aa, Homo sapiens
MPVKRLFLPILAKLKYIYVFLNKSLKNWSYSKTRGVKGVVSASLDTKSKWSAYHPLSAASTDWSLCAQSKLRIENGGEVGKELGSTSSNVLPQGGTLQVMVKSPEKQQMRGVRHRKVKWNVSFTSNWTNCQHVTLDGMHRQPTVLTQNSCQKCITQI

SEQ ID NO: 933588 - protein, 130 aa, Homo sapiens
MFTTLCGPDICLGSPGGLEKASGLRLTESPEQYVLNPSAQPLPCAGHRLQVIVRRSLSAGFLLVAGLPAFGSCRWTFYVSTTDGKLPGEGEMNFAMRTSTTMLVIQHPHASWVGWELKVGQRQDFNALNF

SEQ ID NO: 933589 - protein, 135 aa, Homo sapiens
MPQFIPGLRDGFLAGTWQSRDSRFPATVLSSSRKQPCPENCAGPPTSVVQEGNATGKDWQSGGSMSFPQIFCCCRKTSEGSSTTVGFHNPRMFEQHHPRSFNLNTNSLHSAVPKRHPRLPYDNRMMLKACILRRP

SEQ ID NO: 933590 - protein, 125 aa, Homo sapiens
MRVVGGQEGRRMIRLQSILRPRDCQEPYAINDSKVPSQTQEHKPSTQNLLLQKDELDRQNPKRINAVSHLPSRTPLIQTKKSTSSSSSEFEDLNAYASQRNFYKRNLNRYCQEHWPFQPCLTGRP

SEQ ID NO: 933591 - protein, 137 aa, Homo sapiens
MLPYPEAGITSFFLSTSSSVLSFFSRRLDDLFNLESGSSAIKTSQKRKKIISFSLSGQERSAFKLHNTVGAKIVAASLWEGGGLLAKEDIKVLPSEEILISKTFTLRSNGGRSTKRYLERNEDRIPRRLLGIHERQT

SEQ ID NO: 933592 - protein, 731 aa, Homo sapiens
MVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 933593 - protein, 155 aa, Homo sapiens
MQGFCWGENGISCFLPHGQGMHSAWISVLVRDTRRLPPPLPPYTKKRSHEHAGRLWPPTSQGQKPQNEIYLAGTLILDVQPLELWEIHCGVYATQSMVFCAGSLSLLTHCMSKHTSPLGVCSTSDNCKNLDSPCSNDLLSLDLPSSDDLLCAWPC

SEQ ID NO: 933594 - protein, 142 aa, Homo sapiens [sequence omitted]

SEQ ID NO: 933595 - protein, 139 aa, Homo sapiens
MIVLNADFITVHLSRLEEESHSQQLTELDLQVAASRHCALDPLAHWWKFNDLLSKQKRPGLKHLPNPVIQILQATNMTSLSRVREELDCACESESLAVEMEPLPKRHFDPALNVPPTLFWSGPSQDSWCSLHPGKLLCC

SEQ ID NO: 933596 - protein, 140 aa, Homo sapiens
MLLRAFEYLKGTSRLEEKEGGYGHITEFTCGKRKGAGRGIVHDILILGSVSGMLHHVDDRVQTGSAEAASHCPTSSSQSMGPSASLLWKSLAECSRPHENQAAAAIQKEEVVEFLNLLSQMPCSRGLEQSFTLVAQSGVQ

SEQ ID NO: 933597 - protein, 136 aa, Homo sapiens
MVLSHSFLRQKVSNLYRPTKSNRCLCIPPPGTSEDPERQLVLAGLFLSMCLVTVLGNLLIILAVSPDSHLHTPMYFFLSNLSLPDIGFTSTTVPKLIVDIQSYSRVISYAGCLTQTSLFAIFGGMEERHAPECDGL

SEQ ID NO: 933598 - protein, 140 aa, Homo sapiens
MKDESHSSNAFSFQNSCRLNLTFISIVLEMKHSFSNTAHNSFLIAPSKAILENIPTAKTKSLFFSFSEDGEGRSPLAEGTHSVSHVINQRVTHVVKIMLDWDSSYREHLNHMKRVSELIGSPVVWDLYQYPLQRYRILSR

SEQ ID NO: 933599 - protein, 159 aa, Homo sapiens
MNVVYKYPFESLFSDLLVILLGKELGRGDLLSEQATFSNSRSKTRMSCDLHEVAGKARDSDPITTAFSAVSPPIYLAACCLHGLLLLIVGNIGDLHLQEDRKRQRRHQERGAEWLGQCTADAWTKARSDTGMGCLIRDECEQQNEEHAFPEEERKPLER

SEQ ID NO: 933600 - protein, 143 aa, Homo sapiens
MPLFSSSWSKPSSESESGTPARSQRDPPPPPRACLWPVRNRAAQQEKTCGIISSQCALSGGGVIKMPSSLLAKGWVRPSDAEWIDTRTRGQCCVCISVMEVRGLFFKEATKPPMHSTPFQGLFFANGLCKAPNITTYTEKAQL

SEQ ID NO: 933601 - protein, 143 aa, Homo sapiens
MNDHTDCQQTAELLNQEIARLKQRLQSKKEKAERPEQGKAGIKQATNVAGSRDHVEDEDLAVEGNRKAEHTGSPASQPQVPLKSMDDNGDLGPSFKCPEGEIGTADVQLWEELTRSKERVTQDQSLTRAGLSAGQGHSHGGSS

SEQ ID NO: 933602 - protein, 145 aa, Homo sapiens
MLMLLRAGIQMSYATQVMQTPAANGSGLFNPQVEEVAVKRASSAEFLLCSHSLGLCKLTLGPCANEKMSPLLVDTTLPSAQTVRGLRGRRPFVQRTSWTGADTLDTQLALLPYQASMVCVMAHSSIYDLSPQSARHCQQRGRAKF

SEQ ID NO: 933603 - protein, 146 aa, Homo sapiens
MQSFATVTEARRLQGERGPLLEETVLWRTLVGVARDPDWKAPPSEKTLSALSTPPTSCSQPKERSLDSPKPEGCNSQVAKQQKWHPFHPSLEELHPREAKCCYRLLAEIPSHSYNGDIAEPRICNILQVQESLLIVFWLQIKKNFG

SEQ ID NO: 933604 - protein, 153 aa, Homo sapiens
MGLSQGLQIKSFSILTWGGPTAQEGGPPAVSVPAEAFLSLSNVPLVAFLSFLWPCHSYSVNLVGGARSSTERNCRLPPNPFCSAETAAVHHFLVCHSWRKPNCPKGHREPPAGFGILWGAQSTPVGFAHVSYREAWQGTCPPSSTGPWPAPHP

SEQ ID NO: 933605 - protein, 176 aa, Homo sapiens
MSSSPSLDIRNNITGYGKYKAFSTCGSHLAVVCLFYGTGIGMYLTSAVAPPPRNGVVASVMYAVVTPMLNPFIYSLRNRDIQSALWRLRSRTVESHDLFHPFSCVADVPAVALVGTCQKELEARSGREIRTPKFIAAVFTTAKMWKQPKASNVHHAGRTVDLFSVVMAQQRGRAVQ

SEQ ID NO: 933606 - protein, 200 aa, Homo sapiens
MRKNITGVLYNYFDIGSNIILYFPGYWAQKHRRDITISITGCAATVILGATSFYDITDNITGWILLSYYKIVPSILRISSSDGKYKAFSTCGSHLAVVCLFYGTGIGMYLTSAVAPPPRNGVVASVMYAVVTPMLNPFIYSLRNRDIQSALWRLRSRTVESQPSFYIHEVRTSFWNSLKIDFMEAMYSRSSNTIGAFKDV

SEQ ID NO: 933607 - protein, 624 aa, Homo sapiens
MGQASTKYSAYLNFIKTLLKEGGVKVSTDKLIAVFEVIDLLCPWFPTDGTLELKDWDEIGQQFKIAHKGGNIPPTIWSIWALVHSVLESLQTQENNMETDPCFLSSEEVEEVLSSLSPEETAQIEAVILQMNLHSDIPLTLPPTPEPTAPPLSLYDELLHDLNNLISPNQRNPTEIHSQQLPAVGPPTFHLRSPNLALNYLSMEPGNEALNSVPVQPCCRALNFPSIRPGNEALKPVPLQPDYPSLTFVSPSANQAPLKPQGPLKPVPQLPLQPGPQAPEGPAQQVISPQPGLQVLNSSSVQNPNFVSPSGLVTTAAHKQQVTYIPQDDTPLMRAITQAREYGAPEAWQFPVILQPPIPAVPAAQNQPQPADPAQQEADPAAPQDLQPENQVPQPENQAPQANNQPPQLPAAVAQPVPDFKASVKQYGTNSPFVHSTLKALAEDAWDNIQNDGKICPSFTAVTQGQQEPYPDFIAHLQDATEKTIPDSHGQRLVVELKAYEQTNADCQVAIRPIKGKIPPGGDILFYIKACEGVGELYIQQWSWHKPWPLLECLDDSLANAFNAANQGIVEKIVLGFQAAILFNANNKTLYSNKSCPPVCAHDAVREITGLLSAAQNLTLMVTL

SEQ ID NO: 933608 - protein, 144 aa, Homo sapiens
MWKVSLESPVGKVDLVSPVGEVDLVSPVGEVDLVSPVGKVDLDGEVGEVDLVSPVGEVDLVSPVGEVAWCLQWGRWTWMGKVSLESLVGKVDLVSPVRKMSLVSLVGKMNLVPLVRNVNLESPVGEVKVESLGFLLALVIRVRG

SEQ ID NO: 933609 - protein, 136 aa, Homo sapiens
MPAPIWPCDSLAVSPASVPYPRLYSCQWDISISLQDSTPITLQGNLTLIYITLIALLLCTHSWQGREEHPKVSPNVLTIHFLFSLDQTSTTFSPPSPTKIAVVGNVDGTVSNPVLGMAPGFIHSCTLGPISKEHQE

SEQ ID NO: 933610 - protein, 334 aa, Homo sapiens
MHPLCLLKADRALRIIPGCLVTRADHLQWRFCGQKSSSRGQGKAVICAPCRLGAAEILSGCPVCGPGPRWCAGCSTRWPCLLYTQCCHRASWNHQIREPFSAERKLEQRTELCGVSDDCPPVSWYERGVQRGVQDAAVAAGGEPWGGGNCVNRGYRRVVFSEAKRPSGSSGALPGVSCLHCPPWYKRCRVACVLWAPGYPNGGRGVHAASWCRVLPRGSCVWKDKCLTFAGSRGRPLAHIAHVYKPLKGLFPGDFPSAGHSQVSGAVSRTWLQASQLRKQADLHFLGCPAEPEAAIHLLQRVCGFSRLFWYVSAVVLGAKVYNVGLHTLPCPAK

SEQ ID NO: 933611 - protein, 127 aa, Homo sapiens
MVPQDYPSEGQSSPSHFKIHFASIHQLSERPLEVLHDLDQPFQRVEGAVWGWGMAVQELEAEIAQIASADSTVWCITGEHKNSCYLDEPKNSPITWENSGRLSVGIPGGPPGPCLSAHSSDLDQAVR

SEQ ID NO: 933612 - protein, 160 aa, Homo sapiens
MICEWGSFQNHSGFRDSRDASWSEHIYRQKKGSDIQKLQGCESMLYDITMVDTQHYTFVKHHTIYNTKREHQCKLQALGDYDVSNGLFLVLHLKGYLMHLQTFLPPYLIPTFFVDELDGLCEDVIPHTASINALHFQDVILLLLYCSDIKLFSLGYSIGS

SEQ ID NO: 933613 - protein, 225 aa, Homo sapiens
MASSGMADSANHLPFFFGNITREEAEDYLVQGGMSDGLYLLRQSRNYLGGFALSVAHGRKAHHYTIERELNGTYAIAGGRTHASPADLCHYHSQESDGLVCLLKKPFNRPQGVQPKTGPFEDLKENLIREYVKQTWNLQALEQAIISQKPQLEKLIATTAHEKMPWFHGKISREESEQIVLIGSKTNGKFLESLPAYWIQSKSTMLPARGRVCIPEYNVSQVQVA

SEQ ID NO: 933614 - protein, 161 aa, Homo sapiens
MLMLLVWGYVIFLSLCLIDINLRWLVKMPTKHPHPHSKLGGRAVHLGSNPNAGPGEERIRARDNNGSYALCLLHEGKVLHYRIDKDKTGKLSIPEGKKFDTLWQLVEHYSYKADGLLRVLTVPCQKIGTQGNVNFGGRPQLPGSHPAPSSPNDYKKLDILE

SEQ ID NO: 933615 - protein, 138 aa, Homo sapiens
MQKLPHCEFIFNSKFLHLYHNDLNSTLLTLLQEGKPCKGSCRLDQRTLSRLWQCQLYLKANLIPQSIKSMARICDVLLITNHIDFQLCGLCVHSSVPGSWRWRLGVTVLCTHKQAAEPGKTVLLIFSGNAFSFLAELP

SEQ ID NO: 933616 - protein, 648 aa, Homo sapiens
MGQASTKYSAYLNFIKTLLKEGGVKVSTDKLIAVFEVIDLLCPWFPTDGTLELKDWDEIGQQFKIAHKGGNIPPTIWSIWALVHSVLESLQTQENNMETDPCFLSSEEVEEVLSSLSPEETAQIEAVILQMNLHSDIPLTLPPTPEPTAPPLSLYDELLHDLNNLISPNQRNPTEIHSQQLPAVGPPTFHLRSPKMALNYLSMEPGNEALNSVPVQPCCRALKLPPVQPGNEALNSVPVQPCCRALNFPSIRPGNEALKPVPLQPDYPSLTFVSPSANQAPLKPQGPLKPVPQLPLQPGPQAPEGPAQQVISPQPGLQVLNSSSVQNPNFVSPSGLVTTAAHKQQVTYIPQDDTPLMRAITQAREYGAPEAWQFPVILQPPIPAVPAAQNQPQPADPAQQEADPAAPQDLQPENQVPQPENQAPQANNQPPQLPAAVAQPVPDFKASVKQYGTNSPFVHSTLKALAEDAWDNIQNDGKICPSFTAVTQGQQEPYPDFIAHLQDATEKTIPDSHGQRLVVELKAYEQTNADCQVAIRPIKGKIPPGGDILFYIKACEGVGELYIQQWSWHKPWPLLECLDDSLANAFNAANQGIVEKIVLGFQAAILFNANNKTLYSNKSCPPVCAHDAVREITGLLSAAQNLTLMVTL

SEQ ID NO: 933617 - protein, 245 aa, Homo sapiens
MLAMPPPPRAPEFCHDVDITGDAGAEVRATVVKGEMHRISAARKPACAHFSRHVLHVFDSSQGGCTGTFPCQASLLAWHGLPLSPCCSSESFLGPETLAHGSFPTYAQTRSTQSWPCPSTDTGNLSLESSPWRTSVLVHSPSSASWFFHGAQLWSSRAQGHCVPPVLTCCSPPPCQAVSGHVSGTWLGSSTGPASSVQTSSQETPWDFTMSLVCPVYPCPPAAVRCTFLWFPDQVKTWDEPAQKG

SEQ ID NO: 933618 - protein, 146 aa, Homo sapiens
MNVFVASPKPYSQKLLSPLADLKALHKEEVKAKAELPIACQCIEGMPQHREPFSKSWRFTGSRHLRKSESSQELNTKITKQRLQEPHTTKHTELVQEMIAIQVCYVNSFLQTTYQNLQDAAKAVLRGKCIAANVYIKRNKDLKSIT

SEQ ID NO: 933619 - protein, 142 aa, Homo sapiens
MTGYRVIFYIMVDAFFKLPDIEPSPLRTFKAFKVGTERWWLDGPLVHVKSLGEHIASHIQDEVDFLFSMAANQVFQNEFGVETLGPLVAQLHAWWYFRNTKNFPYERRPTSAACIPFGQGDFYYGNLMIQYVKVAHDSQRKL

SEQ ID NO: 933620 - protein, 191 aa, Homo sapiens
MSVTEPWGPATLSPFKVSPALAPKVSTLSFYTGADAACLVVALQGPGILSAFGIPSKGPCSSSEEPPAQAGPIRRGTMRVGPPRWSLHHLLTVWALPASSEQCPGVASCDTWLPGEGQGPRPPGNGSGGLDHQRPRPACPKGWAARSLLPCTWLRSQTPLGTSERLSVHFRRSILPATRTREPEAPMAFQT

SEQ ID NO: 933621 - protein, 178 aa, Homo sapiens
MGHGVGEEHTFKSIGSVQLSGPSAAGLLEFAGGPLQTLFAWVSPVEATEQQRLLPTPSSRSFVPEGHPQDASQSSPEAVYTLAELKCCAGRSTALFRASRQECLSLLKLHPHPPLPPGALSQGDEGFICKSLTGSAAFLSEMPCPERRNLDRRSGYSGFAELQWAPPSPNFRVALFTL

SEQ ID NO: 933622 - protein, 151 aa, Homo sapiens
MSYLLPTWKHAFPQESAGFHQWHCSLCLPPPYGPENLPSQPSPTEKGVSSGYSWSKGVTEDLERDKVYAGHNFGEDHPGQGRLNELKDSVQKINQEMAAVSQGEGVEPLQPKWYQNDERNVITYTFLQRGHPVLGQQNCLAEELHIRRYLA

SEQ ID NO: 933623 - protein, 158 aa, Homo sapiens
MMMLVTDSLRISETTGNGGDWGEMESSLFWTPEFIRVTFQSGPKYQNMWYSCLLDRFDFIVPETRGMPGSDHLRTCEILVTYPSLAQDLDLTASMPETGWENNPESASKQANWCLQGRNPDYRPQPNPANSQMEIRCRPQAPCSCIGTGLFKLHCFQS

SEQ ID NO: 933624 - protein, 266 aa, Homo sapiens
MVVVPRASCFLFISLNESLLQQVSFSSCTLSSFHRGSYAEDDICERCSSPCRTCEGNATNCHSCEGGHVLHHGVCQENCPERHVAVEGELPTGEQGSAEPPVGGRLSEGGWQRAVGTSLPTIPERYVSVPVIRETEECMPEFFLHDDMCHQSCPRGFYADSHHCVPCHKDCLECSGPKADDCELCLESSWVLYDGLCLEECPAGTYYEKQTKECRETQGLWIHSNHPDYPVIDSTDTSKSPIPFLKHWSRSSKAVAKVLGSTPDTN

SEQ ID NO: 933625 - protein, 174 aa, Homo sapiens
MLFWLLCARLGAAWEPRVGEIKLKEDFVASEVIGQCQSSAAKPRRSGKESVREPWARVPGVLGVAAGRVGQSDFQWGPAQMGHGLGGIPGCGHSLVWWPDFWHLWQAPGGGGPGGTPGHCSLGIWKFLCAGDVAGVSLTVEARNCNSEICCYLAASTLLLYTLKARLIKSCYGV

SEQ ID NO: 933626 - protein, 185 aa, Homo sapiens
MRSAYKSLEFKTQDMCFINGPKISKRKMRSRHGKGSLKESTCFPCQPMWLSEAECPLQLQERAWDPGLVSERNSWNFDWSDQEEALSSRLAKLEEFKLGAAGGHLVITNGEIIGGKEGGVKEDTEISGLGTFGQGPKVVLSRNHKRRKFSKEDEFSIGEFVFETFGIFEGKYGIGCGYSGLRSGK

SEQ ID NO: 933627 - protein, 313 aa, Homo sapiens
MASAGDHTNSPQSSSPSAGDHANSPQSSSPSAGDHANSPQSSSPSAGDHANSPQSSSPSAGDHANSPQSPSPSAGDHANSPQSPSPSAGDHANSPQSSSPSAGDHANSPQSSSPSAGDHANSPQSSSPSAGDHANSPQSSSPSAGDHANSPQPSTPSAGDHANSPQSSSPGAGDHANSPQSSSPSTGVHINSPQLSSLSAGVHTISPQSSNPSVGVTAHSHPDLVWVFTLTAHSRPVLVWVFTLTAHSRPVLVWVFTLKAHSCPVLVWVFTLKAHNAQNPRMYKNPSGHVIFTILDTEEKEVLSSQGLPRVNK

SEQ ID NO: 933628 - protein, 383 aa, Homo sapiens
MASAGDHTNSPQSSSPSAGDHANSPQSSSPSAGDHANSPQSSSPSAGDHANSPQSSSPSAGDHANSPQSSSPSAGDHANSPQSPSPSAGDHANSPQSSSPSAGDHANSPQSSSPSAGDHANSPQSSSPSAGDHANSPQSPSPSAGDHANSPQSSSPSAGDHANSPQSSSPSAGDHANSPQSSSPSAGDHANSPQSSSPSAGDHANSPQSSSPSAGDHANSPQPSTPSAGDHANSPQSSSPGAGDHANSPQSSSPSTGVHINSPQLSSLSAGVHTISPQSSNPSVGVTAHSHPDLVWVFTLTAHSRPVLVWVFTLTAHSRPVLVWVFTLKAHSCPVLVWVFTLKAHNAQNPRMYKNPSGHVIFTILDTEEKEVLSSQGLPRVNK

SEQ ID NO: 933629 - protein, 152 aa, Homo sapiens
MWLATCLDSYLNSLGPRFVLPQKDVKKIEKSLPDQHLLFLDTLPLKIQISAKSFANGEIAQLKPYGSNGKDGERGGYIMGTLGEQQITLNPQMEMMADAFLRARESPGEARVYQLLLFHAKDPQSLEAQRRLKGYSRLSGLPFIVTHATEKL

SEQ ID NO: 933630 - protein, 143 aa, Homo sapiens
MFWASLLLSAGACAFAGRRLIDIRATGRPRRTPALALLGAGFGAHATRHRGPHGASLLFSRQLGPSLAPTSAELSTCRLSPGKATKCHQLKAPTEGHQLKAGCRANLIVSCLGRTNQALSSLHALPFHLCFQKKTLPRSKVTL

SEQ ID NO: 933631 - protein, 249 aa, Homo sapiens
MGTEHQMPHVVTFSIFLGFGHCKQPGMPAVEAQSAPGAGMVASSLHGTATGVCGSIGSGHCAQPGMLAVEGRAVPGAGMGASSLQGCGWTRHTISSFHGWHLGMQWCLEAWRHQELQSPKEGVTALAQRAPRSGILKGPQLLLSFLLPAMWRARGSFSFICVTALSALPFGGFQVLVLPFRKNEPHSHAHRCPKSRRGQDGRRLACQHCSECVNTRPGCNSIQVWPQPHTKSGAGAESGERPGSRSRHL

SEQ ID NO: 933632 - protein, 172 aa, Homo sapiens
MAHVYICNNPACCAQHPVMIKTLSKISIQETYLNVIKATYDKPTANLIVNGERLKAFPLRTGTRQGCPFSPLLFNIVLEVLATAIRQEKEIKGIQIGQEEIKLSLFADNMIVCLENPKDSSRNLLELIKEFSKVSGYKINVNKSLALLYTNSDQEENQIKNSTPFIIAAKNK

SEQ ID NO: 933633 - protein, 143 aa, Homo sapiens
MVLDIRKYEKADLKGSMARKRVRPAHCDDRTVQQRSYYNDNISPRTAENWKQYHPGVASAKAHHKDSEYKYHYIHVIAENAKTWRYQVICTRLQTSGSLNLTMGTSALQPAVLLTVHCNKRSSQTPVLIFKLHNLRDSILLKS

SEQ ID NO: 933634 - protein, 188 aa, Homo sapiens
MTKKRRNNGRAKKGRGHVQPIRCTNCARCVPKDKAIKKLVIRNIVEATAVRDISEASVFDAYVLPKLYVKLHYCVSCAIHSKVVRNRSHEARKDRTPPPRFRPAGAAPRPPPKPLSHIQVTLMQEVGSHGLGQVQSCGSAGYSLPPGCFHGLALSVCGFSRHTVQAVSGSTIVGWNHPPLYEISYNEG

SEQ ID NO: 933635 - protein, 179 aa, Homo sapiens
MDNAHIVLQVDNAGLAADDFRVKYETGTVMRRSVEREIHGLHKIIDDTNVTWLQLKTQIEAFKEELLFMKKNHEEETSGPNNEELAQKNREDLEKYWSQQIEESTTVVTMQSAEVGAAEVTLMELTHTVQSLEIDLDLMRNNKANWENSPREKEQLNRILLHLESELAGTDPRRGRLSS

SEQ ID NO: 933636 - protein, 178 aa, Homo sapiens
MGLPPLPGPHRLEVERSPGCTSSAAAIVFAAASPDESSLPSLGHQTPVPKEETQKCRGFLNSCSNAVPKGKGEGLEWRLSKGDCFGGNGKGAHAQAHTNTYIHKHTRITMHLDFTPKAASSWFANCSLEYSVFPPNYFSENFCSPCDETSTRKNQGNKCIKGLLDRMFQSGGTPKIPN

SEQ ID NO: 933637 - protein, 141 aa, Homo sapiens
MMLASQNESGPSAATLLEFAGGPLQTLFAWVSPAEAAERQRFLPVPHCGSFIPEGHPPDASQSSPVPLGYGKQFLQLALCLPKWPPSFVLETQAPGGVGTRGNLLVCGLQRPWETCISGPGCTVPHSTVPQGFPWLEEGVP

SEQ ID NO: 933638 - protein, 137 aa, Homo sapiens
MAVKFRKPNLIQFVQRNTKLSTVGNQLPRPELKHRTLRKLHMCWFWSSLEHLFHLVHHLTGSKVDTADNKTVLNDVTKVPQRSPKELILYLRSFSIQCSDPANAYSTEFQNVKIKLPLYEEKSTPSSWQVTPYTKVC

SEQ ID NO: 933639 - protein, 116 aa, Homo sapiens
MAWPTVGPHSIGICPPPNPTISTALLGIMESEGPNWRAAGTASANVLSPVPAQHIQGRRHWSRARSDTSAGQVTHGFADGHGTSTLSALGQKVMAIRTRVEGKCQGVGHALQLEVL

SEQ ID NO: 933640 - protein, 203 aa, Homo sapiens
MGPLLGAVAATASPQSLMEYSSDADFIESLPLVVKYRVYTLKKLQAKCAVLEAKYLREFHSVEDYEYNEVAGDSNAQMYGAEENPEYEDLVEDREEDFEDVGEVFGEYEGIEGHNSPFFNALQWGLDANEDEEDFFIAHTLHTFVIPRAVLHFTGEALEAEQDTMIRECNNPVYDRMTQENWVTAVYGAKGQNRNSQAEVNDC

SEQ ID NO: 933641 - protein, 329 aa, Homo sapiens
MLRAVEVGRSVFRYAIAESNVPTSVILLLLERVSEVRNLKKELKPLLDDPYGVADQIDQFLRPDIGTWAELMSIRGILFSGEERSMIRRAAVAVWEREHPPGQNVPPVDHEFPAHDPQWDNNNANHWENMQDLREACPLAEDSRDTFAFESEDPYSGQRQQYRWTVLPQGFTDSPNLFGQILEQVLEKVTVPKQIRLLQCMDDLLISGKDIKGVGDFSTHILNHLQCESLRVSKGKLQYVEPEVKYLGHLISAEGHLVIDVTQASHPLTLQFDVCSATPCGDEQAQKKLFHVDKYRCPYHEESSRCPGTPQDQVLSVPAHILFLIWKED

SEQ ID NO: 933642 - protein, 158 aa, Homo sapiens
MCVQGWTIPLSLFHTLGTHRFLAVLQCLQEQSAFFKGFVDSLSFPGQLQFAGIVDNALNVFVPSSVREWQGQYHCSGSGRGLSVISGSSILEKNRDTATGNVQPPSGADSLVAQAGDQSRQEQNFGYGSGWWEWGALSVASGIPTSGKHRATTSGYAQ

SEQ ID NO: 933643 - protein, 188 aa, Homo sapiens
MGRNQYKKAENFKCQNISSPPKDHNSSATREQNWMENEFDELTEVGFRRWVITNSSELKEHVLTQCKEAKNFEKMLEELLIKVTSVKKNINDLMELKNTSQELPIGDQLNEIKREDKIREKRIRRNEQSLQEIWDYVKRPNLHLIGVPESDEKNGTKLENTLQDIIQENFPNLARWPIFKFRKYREHH

SEQ ID NO: 933644 - protein, 141 aa, Homo sapiens
MASNSIHVPAKDMIFFPSNSQTPKLQVYWSLLEVHSRISLPGYHHQRPQNSKDCCLLFPLEASSQRGTYQMPARALLYEVSVSFCCDLSQGDGGFIYKPLNGAAAFFQRCPAHRGGIRRGSLATLALLSCGGLHPVATSPQ

SEQ ID NO: 933645 - protein, 137 aa, Homo sapiens
MISSPNQPISSKHAFPTYHHPITQTAFEKPPTKRVFDEIDLNNNSISYMTWQYEVQRIWSSNVQEQEKKVVSTPEESEQICLSSVFLFYPGSQQIRCSCSHWMTVDSISSVYRFKYQSLLGTPSQTLPEIMLHQLSR

SEQ ID NO: 933646 - protein, 135 aa, Homo sapiens
MHDHTTLMVIREAGVRNHCAGTGRGTHGLDHVRTKQLGRWTRQFPGSSLMLASLRTCIYQGTLGLNPGRRFSQHIPELLTDKVQEVVALGLNPLPLIVAVLHPAAKPIKLEPLGKWGEFAGRSIFKPPKSPIQRI

SEQ ID NO: 933647 - protein, 172 aa, Homo sapiens
MITLTQKCGAVWGFCLGGGNKPAGFPDSIKELKLARSPQLDNEMPDPSGIDFAYTVTIRLSSHHHTHSDPSRGVYGKKTFILQLYKNLCQKTNPYMTVVFADTHIRKTCFHGVCEQIVPVVIAGGIEVAKMQSLPLGIPLSDKNTPQRLTSGQAASSLNGEREAVELCLHCL

SEQ ID NO: 933648 - protein, 142 aa, Homo sapiens
MMKFRYNRDSNWKESENLAPTHVGFSQNTLQEKKQNHQINTTQVPRNNGFNSGNSEEFHRQTVPHLPQVDKNMKMDLLLTSLELLCPSTTALMMFPGVIFQTTSKRDALTQDSFLGKLNYDFSTKFLLFYITIDENKHLSLI

SEQ ID NO: 933649 - protein, 155 aa, Homo sapiens
MPAFNCWVQLTSDDDGDNGDDGYDEDDDNGSDDDDEYDNDVGDEGVDHDDGEVMKIMMVMKKMMMIILHRTAHELQDLNRENCAEKEDGQRGEGAPGNTSEFVVMMYIAKCAMDVLSHNYVTRKGSWSRPQERVVECHARKNSGRVHSAKQKQVY

SEQ ID NO: 933650 - protein, 139 aa, Homo sapiens
MNCISHEEHLDKGKTHGPWHELSTMKVLPNNEITVYRFDFAKEKQTQRQRVVCRKLSGECFWEIQVQLKKKESQIGLKEKLSCNMVATETSAYLETWAVAFPLPDGLEQEVQQRKGVAIYFKIQNYNKLSITKWAGKTD

SEQ ID NO: 933651 - protein, 356 aa, Homo sapiens
MLEENRVSPNMQRHCRNKEKKGSSKLINEIQVLSDPGFFHFELCVERDGQKGVGNLGLFISDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNMKKESMRFCPAHGAVIQREGNVEIYY

SEQ ID NO: 933652 - protein, 305 aa, Homo sapiens
MLPQPDVHLNKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGRLRQRDHLSSGGQGCSGPCLHHCTPTWVTDRNLYL

SEQ ID NO: 933653 - protein, 192 aa, Homo sapiens
MLEDTRVESQLAATPHSSLHWSWHLSSPVFSDKKCGPSAAWQRVCLDYIQHLISCPSICACHLEVETEEKLKPGVAYLLRCHGHLKLNIVYSKANLSSSSSYLSLLCVSVSTAKFWAPSGRSPRHLPQSYKNPGSNMSLWSGKTNPGEQDRFHTNPNHHQCPSQLPITLRNRTEAQDGIFSITELCWKEDSR

SEQ ID NO: 933654 - protein, 184 aa, Homo sapiens
MAPPWAQLHLLPVPSLQQQWARVVTQDKVLEQQRLQTWKQVLPGHMRVGVVQSMLPSAFPPLSEEINPALPEATVMASSEAVARQDNVDSPQEPPPTALFASRPIARLKSLWTPRAIKWVMHSSIPSSNGSGVFINQDRMGPDGTNVQLYTDSWAVASGLAGWSGTCKKHDWKISDKEIRGRGA

SEQ ID NO: 933655 - protein, 139 aa, Homo sapiens
MFGCPEQATESLWTSAVTCSVGHQRISFSTAAAASCYPKAEHSEKSGTNVNAKPRQLFWALISPGVRSRETLAPTSGPDLPELFAPKLDTVLSLAITPPHPPAAGSLQSLKKAKIIVPNTFSRPRIFSSCGAPEFQSKS

SEQ ID NO: 933656 - protein, 157 aa, Homo sapiens
MQEVMNPGQVANTPNDVHAALAPTALFLLAQCSRRDSGSASGGIRDPHPKSTPSLRTSPGTDVSSHPCGRNCPSTAKLLGTKRELQGLCLKLSFEGGSRIGLSPVWQQACGFTRSCQACKRHPAAAPNPKHPRKRPGFKPQRAARFLTQQGNSARFP

SEQ ID NO: 933657 - protein, 158 aa, Homo sapiens
MESLRLFLLSFLSLLVVWDELSAAGVPGLGAAKLPAMAYGPKKHLKQEMKKSCMQQFIKIDGKVRTDKTYPAGFMDVISIDKMGENFCLIYDTKGHFALHCITPEEAKYKLCKVRKIFVGTKGIPHVVTHDAHTICYPDPLIKVNDTIRIDLETGKIT

SEQ ID NO: 933658 - protein, 133 aa, Homo sapiens
MKKSHSILPHGGSRCVAAGTGHSHCILPEFSPHRIHEHSRRVLLRGTKTGVACYVAIDNRAENLCNVCMCMHLGMHWNVGCEREIKEDSKIPGLRNGKERVMISQNGEGYGRIRFGIGIDQEIEEILVKRGDI

SEQ ID NO: 933659 - protein, 190 aa, Homo sapiens
MLFSLAKDVFSLKIWAPILAPSLICESSHRIHLAGLVREQCEMEARVGASGYPFPLLPQKPQPSAVPPLPRGSDGLHLVREVSSSCPSVPSLAPCCILLAFPRDLHSPGARLCAGTGALGWVQTVISALRSSQSSQSDGRSSHEGPASPCRGEAMLGRHTGSSRHPILSGGSDPQACLPTLTLSLARPHF

SEQ ID NO: 933660 - protein, 139 aa, Homo sapiens
MPDCSESPQNSRGAGIALTTKTPRLREGRQRGGQCGHPVEVTTQGGDTGRNEMPEASVKEPAPRTRGRWDAVDGMERAQGNTRDSAPSPGEDGGEQEEQAYGKTGGMDFGEDRRAKPPFRPIISWPHAVPVKAMPWAKA

SEQ ID NO: 933661 - protein, 134 aa, Homo sapiens
MGSRNWKAFRTGSCPAVCPSPTTTLLLPSRHGSFFFLSTYCSIILKETFTLNHFYCKPRKETGPGDEPSVDKKLDIKLNVNRPFLQGAQYIGYIHGSSIKRRSFTLVAQGAKKGFLKETLEQGENLYGGKGQKY

SEQ ID NO: 933662 - protein, 214 aa, Homo sapiens
MYMPEKGRKILPGSLPITQRTEGIGAGPCMLICSGLIYAPWPPQPLSTCQEEAILGSTLEANGPDAQLRANLHSWRRRSPLGAGGPAGTPAHRLLFLLSSTSCRQANTSSSSSGRAFSSRAAALLNERSPSPAGPVQSQGSGRRALELPLAPALSLEGALPLVLALAQQLALEIAVFLHLKQELQKERGHQYHSLSTGISKHENNLTEFKGISA

SEQ ID NO: 933663 - protein, 152 aa, Homo sapiens
MAELKEHCNMPTGASGITGTPPNPRGCYGAHMEFAPANTPKLSSWLLYLLTCMLSPARGGTQQCACPAGQRKAIPDPTSQGTSQKSASVDCLEPSCCEWEAAGARLALPSVWELSGANCCLLLPIPHTDASLQKRQLWYSLQHYSYSQRTTI

SEQ ID NO: 933664 - protein, 125 aa, Homo sapiens
MATIVKWQRPKESIINWLQGQAPKDIKQDEELQQGLLLTSLPGWLDQQTFGVLGLHSILSLRDAYKGSVLWYSDTRTHPQREDRGGKRRKEMFFQKSPSDSGGNQEKYGLQMIGYSPKKRGARHP

SEQ ID NO: 933665 - protein, 149 aa, Homo sapiens
MRRPEDSLAYEQMLWASSSSFPTPQRSPPEPSLGSFPCPWIDFLELHLLCLLAAFTCGHGGLPGPGLALGLTCPWRFILKLHQIQRLLDPSRLPHVLLQLSPEFRTDWKVLRQNGCQAFLGKVRSGDTKDVLRFLDPRGCFLNKGHSGC

SEQ ID NO: 933666 - protein, 172 aa, Homo sapiens
MLGIPMTYRNAATVCTEVEGPCLLYNLGPSGDIASKDAVILNSPGMAVYRCSLGMLHSAFSLEQHALRVRPSALLGPAGPMWVPQSQWVLRDVCRGFGDVETQELRFPGQDRVPKWVHTQCGARYHSSNLGVADSPVQCPQEIPKLPPTPMHKLVRAEELFNSLETSNLSQG

SEQ ID NO: 933667 - protein, 140 aa, Homo sapiens
MARSSTGSVEKFLCKNVSKDVETENKSSTPSTAVERGIPHKLTPPSHLIYPCFPFDQILRYSLTTFYTSQGCSFAPGVSFTNVHVSPIFTSLISQRKIYDHKQNTSDVVPMSVDWSELHLILVKDSSFCDSVRVEFEANN

SEQ ID NO: 933668 - protein, 163 aa, Homo sapiens
MCYKATAMYAGTCVGSYGQIDSWAFRWFSQMLVVTSVDQAGGKVPGPLGSQCGMGNGISVATAQVSVMPLFRHYWDPGQHAVCQRLGLKMVTCCRHLGLRKGVGPSASPIPGALLSHGSFLCYYEAKSTIHKRKKIDKWNFIKIKNFCSKKDYCRENFKKKLH

SEQ ID NO: 933669 - protein, 157 aa, Homo sapiens
MVNAVHLKRKKMTGACPVLFQTQKQVTPWNQIKEGSKCMLHRAGSDPGRFDVPGNIPTLSWTDLEAHLRQHLHVHVSLTCLSSCLFGKKDNQFPAGATVSVEFARSVHAFSRDSDKHLICKMCPEGKCSKYFDRRITNLPVGSRNRIIYYKVGNIGL

SEQ ID NO: 933670 - protein, 142 aa, Homo sapiens
MISLGIHMKETVGSRQWGANRRDASKGFKCAYALILCHGNSLSHVAATLLPGTQNELCMEYIFAICPTSLSRTQLTRADHQPICSQEAGSLRQVLIPVHRCLEMNSVLLAGAQWEWDSPFGLHGTWVRPVTAGFPPLPWQPS

SEQ ID NO: 933671 - protein, 136 aa, Homo sapiens
MASDKRKACAGKFPFIKSSDLIRLIHYHENSMVGLDVSSRSQELEPKTLEVCLVFYCTVHQLAVKPQDAVFSTLPSPFQRQRSLTLKPPPPQAMMSTARLPPITWVSLLLIWGPRALQLADNECCQDWVLSFKVAE

SEQ ID NO: 933672 - protein, 160 aa, Homo sapiens
MHHPSQHSPTWLPLAGKGVLRPLLLLSSPSVGCTHCLPSPSEMSRVPQLEMQKSPAFCVDFLGSCRPELFLFGHLDSHQRPLPPQDHGEYCQAFANVPLRPSPLQSACDEYFLLWDSQLREVGSLVVWGRSRNAIQEPKPGNGDPRSSLGALPNCGQAGN

SEQ ID NO: 933673 - protein, 332 aa, Homo sapiens [sequence omitted]

SEQ ID NO: 933674 - protein, 140 aa, Homo sapiens
MLPTFMPSCDSKREPGAFQRDDQGYRSQICMEGIFRHTNPGMTVAEKEQGGRKQLELHLSSILPLVHFTWVTNEYLKTAKEHQSSPEATGKPWKKFSSKSSGGTNPADTLKIIIATQCEDPMDFFIRGKLLCLATWGFWP

SEQ ID NO: 933675 - protein, 173 aa, Homo sapiens
MQTSLLRLWLWFLRNGKAQYSHKTEVWSLGTCGTAMAHWAGGAAAKIVGVKMGDMNNTGSHFILYRVTKFLRNSVDMDEAGNHHSQQTNTGTENQTLHVLTHKWELDNENTWTQGGEHHTQGLVGGPSSGQYVEVDMKGSDIDNPGLCRQAQRSFSKLCTAKTRFLHLFVLEL

SEQ ID NO: 933676 - protein, 146 aa, Homo sapiens
MDREFFSPGQLKHGLEVRGEPCHPLKGRFQGKGHSCQVLSAVLPEFKTVKSYDKPYLKSEVWPPHCAVEELDLWTVYLSYFQDGVTDVPRESPGLEGDGEITHKLPYQDFGLASNLEMLLGIDCGSGFRHFSLTKVEPCSPVQQRG

SEQ ID NO: 933677 - protein, 146 aa, Homo sapiens
MPHTLLLQSIRWSGKHIDQTLVAVEAPAVSWSDGFGEKHLGGDFGYSHRLSVEAESLDKLPTPQDRLSFGVDLTAAASDHGEDMGLSPGARQITSLSQAVSVRSWLRYRPLSPDTLQLPRRADFHDFLSLVRVESNISQVLEHLPG

SEQ ID NO: 933678 - protein, 168 aa, Homo sapiens
MPQVVTHPIPLPNFLSHLGGLLPPVEECDTLRGYGVFQESHLGIEFRQVPGLLTCWPTHFLPLLPALGVLRNEPLANHCCKPKSPKAEELGVRCSRAGSIQHGRKMKARRLSQSASSTFFCLLFLATLAVDWMVPTQIEDVNSPKIDLQIQYDSNKNNSRLCVCKLTS

SEQ ID NO: 933679 - protein, 168 aa, Homo sapiens
MAPASASHKGFRKFPLMVGWEREQASQSERKEAAHVWAKERKRDRKKKKEEEEEEEGEEEEEKEEKEEEEEEEEEMEEDSGQSDRRAPHFPEGAEAGQRRSLLSRQLGGQAEELSEDPVCVMYQMASLFKRVRMTTLFVRVQIGGHCLSARESENGLVFLEVKMRVLL

SEQ ID NO: 933680 - protein, 139 aa, Homo sapiens
MQCHWVNIPYPKGRNWSKERGYRLHAHLKLSREVIKSKNSKIISFDSMSHIQGILVQGVDSQSLGQFYPWSFPGFSPHSCFHRLVLSAYGITRLYRKHGCICFWEGLKEPFTHGERKSGSRHLIWQEQDQEREGRCYTL

SEQ ID NO: 933681 - protein, 163 aa, Homo sapiens
MQESFSCVGTQVFQTSNPGSYSHVIRSGLSSVLSYSCLKKTITINITIKMINNSDVTSELKVPFPPQNNDQQDSCKTHSGPLSPCSDSIPVNTQSNLLYVSLFSNLSKNRKHQKLPRAILLIFLKKYCCNLYAHNQMKKTSFAQLPNFTFCDAHTHKVHEILL

SEQ ID NO: 933682 - protein, 190 aa, Homo sapiens
MRKNQCKKAENAKNQKASSPPEDNSLPAREKNWTENEFDKLTEVGFRSWVITNSSKLKEHVLTQCKEAKNLDKRVEELLTRITSLEKNINDLMELKNTARELREGHTSINNQIDQVEERISEIEDQLNEIKCEDKIREKRMKRNKQSLQEIWDYVNRQNLCLIGVPESDGENGTKLEKMLRILSKRTSPT

SEQ ID NO: 933683 - protein, 141 aa, Homo sapiens
MSMMSGNDCGSLLYLIPAQPLSRFRRVLNLLQYWIPNLPWAHQLPQNLGSDWALKFIYQTLIADSPPSLTVVSGPPERAYWIQNPEFNDIVAYKLQIDGRFGSKSFSSFFTVIVFNIGYIQNFVKHVHCSNVKDTVLVSGI

SEQ ID NO: 933684 - protein, 947 aa, Homo sapiens
MPHMYSSPHYSSPLARVATAHAKYARGQRWVLRNAPVSRPHSWHVAKLLEGCPEAATTMHFPSEAFSLSWHSGCNTSDVCVQWCPLSRHCSTEKSSSIGSMESLEQPGQATYESHLLPIDQNMYPNQRDSAYSSFSASSNASDCALSLRPEEPASTDCIMQGPGPTKAPSGRPNVAETSGGSRRTNGGHLTPSSQMSSRPQEGYQSGPAKAVRGPPQPPVRRDSLQASRAQLLNGEQRRASEPVVPLPQKEKLSLEPVLPARNPNRFCCLSGHDQVTSEGHQNCEFSQPPESSQQGSEHLLMQASTKAVGSPKACDRASSVDSNPLNEASAELAKASFGRPPHLIGPTGHRHSAPEQLLASHLQHVHLDTRGSKGMELPPVQDGHQWTLSPLHSSHKGKKSPCPPTGGTHDQSSKERKTRQVDDRSLVLGHQSQSSPPHGEADGHPSEKGFLDPNRTSRAASELANQQPSASGSLVQQATDCSSTTKAASGTEAGEEGDSEPKECSRMGGRRSGGTRGRSIQNRRKSERFATNLRNEIQRRKAQLQKSKGPLSQLCDTKEPVEETQEPPESPPLTASNTSLLSSCKKPPSPRDKLFNKSMMLRARSSECLSQAPESHESRTGLEGRISPGQRPGQSSLGLNTWWKAPDPSSSDPEKAHAHCGVRGGHWRWSPEHNSQPLVAAAMEGPSNPGDNKELKASTAQAGEDAILLPFADRRKFFEESSKSLSTSHLPGLTTHSNKTFTQRPKPIDQNFQPMSSSCRELRRHPMDQSYHSADQPYHATDQSYHSMSPLQSETPTYSECFASKGLENSMCCKPLHCGDFDYHRTCSYSCSVQGALVHDPCIYCSGEICPALLKRNMMPNCYNCRCHHHQCIRCSVCYHNPQHSALEDSSLAPGNTWKPRKLTVQWGGGSEEMTAAAVSAQDQQLYKRWRYDLQVAAIGSSNACG

SEQ ID NO: 933685 - protein, 267 aa, Homo sapiens [sequence omitted]

SEQ ID NO: 933686 - protein, 168 aa, Homo sapiens
MGCLGTQRAPGAFLLLPLPLYVTRFSKLTQLQRVCGSFRHCWFVLAVDLEKASSDHSAGEGWCRLITSKESGTPCYFWVESWRGCDLNFHWPLILPGIGLPPWKSWQDWSYHLTVNTMKLLSHNTEMCGKSRLFFSPATLSESSLQSGNWGWKTGGSGLLPQLYIGFT

SEQ ID NO: 933687 - protein, 139 aa, Homo sapiens
MAAATAISSYTRTCDIQVQSFRNGAVPITSKVRDVVTVEAEKRRSSQLNKARNYCECDKTRDCVLVTVVSPVSCTMPDTEQDLSTSGFLDMGMGDCIWLGCLFVPILLSPGPTQMAPANNCLGMSKSSELTVLYHFHWE

SEQ ID NO: 933688 - protein, 165 aa, Homo sapiens
MLKLVPDLVPPDWERPPNGSPVTSYRHVQAGKSAPVPPNDHNTSPARAQNWAEADIAEMTEVGFRRWVIMKFAELKEHVVTQCQEAKNHDKTIQELTAKIASLERKITDMLDLKNIQELHNRITSINGKVDQTKERMSQLEDYLSEISQADNNTDKRMKRNEQNL

SEQ ID NO: 933689 - protein, 269 aa, Homo sapiens
MGRIACANVLSDLYAMGVTECDNMLMLLGVSNKMTDRERDKVMPLIIQSFKDAAEEAGMSVMVSQTVLNPWIVLGGVTTTVFQPNEFIMPDNAVPGDKWNKIKLVVTEDVELANQEAMMNMVRLNRTAAGLMHTFNAHMATDITGFGILGHVQNLAKQQRNEVSFVIHNLLVLAKMAAVSKACGNMFSLMHGTCPETSGGLLICLPCQQAARFCAEIKSPKYSEGHQAWIIGIVEKGNHTARIIDKPQIIKVAPQVATQNVNLTPGATS

SEQ ID NO: 933690 - protein, 150 aa, Homo sapiens
MGLNLADLLLRGPYPGPRLAGLLPKTWCRHDSSWVSWHMDWVADPRLNRTVAESTGGNNVSRSVARTVVPIVGEGETSHSNSDTDNVKVTICSIKKCFSVFMRVTLNLLKKARGHPKRRKTVQKEFELPVCYLCLKCYPWYQMERNIGRQ

SEQ ID NO: 933691 - protein, 153 aa, Homo sapiens
MGQFYRIWVGSGKLQSKGVVLWQAGVVVTRCSVGELLSQEKEFHKVMSSVKAGIGHFHFFCDSSVASGHLDVYVQAWAQRPDTQQLLPPLAPLAPLPPPHCTPVASLSITEAFSATANICTLTKPSDFPNHKAFTTIFSSFTSVTYSPSPRCQ

SEQ ID NO: 933692 - protein, 160 aa, Homo sapiens
MVPIVSLVNFSMLSYMIHSKLNMKNAEAHIYLSGYPLVKDTQSHILDDIVLAQNLTYGDDIASEDIAPTQNFTAGSGLHCCQSQTLAVCHIYIAEDPNSPHNLCETPTALDTKDHAVANVVGMPELTRLGPYLPPHHQTQSHTMPLHLVSYGLDPVPQCT

SEQ ID NO: 933693 - protein, 176 aa, Homo sapiens
MIVSFLRPSAGANDDTMLYVQPAELTAKQTSFLYKLPSFRAGRQERLSLLKLLPQLLLPTGALSQGDGSFIYKPLTEAAVFLSEMPCPERRHLERQSGYSGFAELWWAPPSLNFLVALFTPGVNGSVSLAFQMPLGYEKNLLKLARCLLKRPPSFVLETQDPGGIGTGGNLLVSGL

SEQ ID NO: 933694 - protein, 366 aa, Homo sapiens
MALMGDTGFIHHNCTPELQAKELRKVKKFEQGFITDPTVLSPSHTVGDVLEAKMRHGFSGIPITETGTMGSKLVGIVTSRDINFLAEKDHTTLLSEVMTPRLELVVAPACVTLKEANEILQRSKKGKLPIINDRNELVAIITGSDLKKNQDYPLASKDSQQAAAVGVDIIVLDSSQGNLVYQIAMVHYIKQKYPHLQVIGRNVVTAAQAKNLIDAGVDGLCVGMGCGSICVTREVMACGQPQGTAVYKEAKYARRFGVPIIANGSIQTMGHIVKALALGVSTVMMGSLLAITMEAPGEYFSDEVRLKKYWGMGSLDAMEKSSSSQKRYFSKGDKVKIVQGVLGSIQDKGSIQKFVPYLIVGIQHGC

SEQ ID NO: 933695 - protein, 165 aa, Homo sapiens
MACPEKPVPQVISRWQAQGNYVCRPQLLGANPTLPQPGLTADVSSVQAVRSSGAKPGPAPCFSGKLEMLRGGSSIRARVSWDPGLHHSVPPSPGEQAPSCACSSLVTHNTTDLQDLNLIVPGSEEGGQTVVCFDVSYADVLRLFGMLVPGLGCSRQHQRRGGRGH

SEQ ID NO: 933696 - protein, 466 aa, Homo sapiens
MAIPKSQQGACVVEAWVQGPRDGAAAKPPCSPWLYGTQKIVQAGDKDLDGQLDFEEFVHYLQDHEKKLRLVFKSLDKKNDGRIDAQEIMQSLRDLGVKISEQQAEKILKRIRTGHFWGPVTYMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 933697 - protein, 129 aa, Homo sapiens
METAWDLHLTSSSCVNLISHQAPDTIWHHEGQIEGFCSCSCTSVFQAFVRLAALPTLTMISWLFSIWSSTHSSLDASVFLKSRLSETELFDISCQMFECGEKGQRDVTELKKEVPRCSLHVDVWYDKDM

SEQ ID NO: 933698 - protein, 155 aa, Homo sapiens
MWVSFLQRVCFLFAFCHDCKFPEASLVMLPVQPSELAGEHMENFLNEQCIKGWEGFWSKALPSSADNYCPFERYLLACYWALVETERLTMGTTRKWIAAAPQPLSRKFLKDGGEKESFQWAELQEVHLVVHFAWKEKWTDVRLYTDSWAVANNHQ

SEQ ID NO: 933699 - protein, 170 aa, Homo sapiens
MICQEKQRKVSKGLKELTISNPATAFPQRCTEKMSYSFYFCPVLDTSCPETSDSNFFSFWTLGPAQVVRQGVSGLRPQTEGCTVGFPTYEVLGLGLASLLLCLQMAYCFARGYPLVPAPFVKKTSFSSLYCLWPFVKYQLTMQAYLRDIVGLVLEHSNKVNTAINYCKRG

SEQ ID NO: 933700 - protein, 192 aa, Homo sapiens
MNNRHYIITCNGGKIYDINCQSVFVARKFGVNEGERKKRHKGNKHFFPVPFLTLKFYHKNTMSNSSYTFVRFCEVRCNGSKDPGMASCHCGLGPRGRKQHSADSTTWRGKMYQHLRLHRTSPIPGRWNTVAVRPGGQSSQGSDLLGHEELHLIDPRKCAYTEISWFPSDPENKLQVSLGMYCGKGRSWWDKR

SEQ ID NO: 933701 - protein, 155 aa, Homo sapiens
MCLSLNHRHGLQVKGKHHEPIFQEKKPGSPGRWISQREIQVEETDPCGTTLDTKFRSVACPLNLARARGPRELVEKLQQEPNPFGASSLNYKEKTSLCLKIQQLQLKIVELGCSNELLPDLQCNRHSQSGLRTGVYTAVNHWSCQMKVDDVVIPL

SEQ ID NO: 933702 - protein, 150 aa, Homo sapiens
MSHQRHSGLITSRHRGTTCQMFSSSKVNIITIISLCMLETQASFLIFFSSFSNLLHPNHNQYNRYIRYVSSLPKYIFFPLLSIVTASTLSGLPSSLARLTIVTPDSLEKFSPRNSDLTQKNLKRQDTLDPKACLQECNWKSYTVERPPIK

SEQ ID NO: 933703 - protein, 147 aa, Homo sapiens
MKPRTLAAARLELFVLSSGFVVLLASGVKLQTFTDPFSRRCTVGAPLWAGRGQIWLPLLAGRCGGRGAGRNWGCTQQLRPARVPGGRGLSGPRTQSLWPVPPAPGSEGLSTRPAAAEGAPGPPALLACPHPTRILTGPQPPPRGAGL

SEQ ID NO: 933704 - protein, 170 aa, Homo sapiens
MLVQCGLAPVSSDWTGKRHLTQAGQLDHLSQEFFTGEKGCKSHDSSLSQEQPRGDSAKAFRGRIPNGADTRWCNPYQPVSMNVCVEPNAHSPTLAMIRKLNWIKCYHLGGAKANKEKEVIEEHFRKLGTFKSAGLDYSHPRTLKELANIIARPPAFILENEGWTEEGPDK

SEQ ID NO: 933705 - protein, 130 aa, Homo sapiens
MWVHVLLCYMGILLDAEVWGINDPVTQRVNIVTNRKFFSPFPIPSTLLVESPVSIAPILMSMSTQCSAPSYREMMYELLKKKQKCNGLNSERRQCMQKMQRGNVKRFEEHDIGWNSKSLGATMTQCVEWV

SEQ ID NO: 933706 - protein, 149 aa, Homo sapiens
MSVLLLEDFQEQASKKAILFTDVCYQKENKKAEYSNQKDICLYTKKHFSEKAKDFNDLRRNVKSFIKEVLITKPNPKSQITTLLNTNKKYLPKRERLSLREDSPGQKNEPWKQRGQSVQVFTAYQFQVLGAGPPKSSHKLAINKISAAL

SEQ ID NO: 933707 - protein, 203 aa, Homo sapiens
MPKRGQHTALAVASETGSPIPWHLPRGVEHGGIQKSRIEVWEPPPRFQKTYENTWMPRQKFAAVMGPSWRTSAKAVSKGNVGSEPSHRVPTGEPPSGTMRRGPWSFRPQNGRPTDSLHHVPGKAADTQCQPMKAARREAVHCKAATAELPKTMGNHLLHQHILDVRHGVKGDYFGALKFDCPTGFQTCMGPVDDTPCSYPSCF

SEQ ID NO: 933708 - protein, 144 aa, Homo sapiens
MHLTSLLLCLTPSGASNSEFFLLSSAQMLCSPQISTFGAIIEKFLFFHNKSDKEKKDANIHGETIVHNSRVGFIIINSPKQTVKVHFCDPENCYMIKTVKQKENSDILVMALLGKLDIASVTPITGCIMKAGTTPCEKRLKEER

SEQ ID NO: 933709 - protein, 138 aa, Homo sapiens
MQRRNVVLEAPHRIPTGAWPSGAVRRGPLCCRPCNSRSIDSLHCALGKVAGIQCHHIKAAAGAVPCRAIGLELTKALGVHILHQCALDQAASFAVDQIFLLEALEGAAKPQISIMPSLILPNTSFYYLGIWEDRLTWL

SEQ ID NO: 933710 - protein, 135 aa, Homo sapiens
MKVALSRMGSCKGNGAVRAYLADNHDIRAAQSKAIPKGNVELESLHKVPICALPRGAMGRQLPPYRHQKGRFSSSLFPASDKAAGTQLKLVTAAMGAVPCKSTEAELLKILGAHPLHQCALDEGHNEYFGAFIFN

SEQ ID NO: 933711 - protein, 138 aa, Homo sapiens
MPRYSSETKLPEERSGSNICCSPISAVLQPLLLIPRQTGSGVDLQQTPTDLQLRVLTVRRKTNKEKGHPHQNPIYEWLTRITNAEKSFKDLMELKTMARGLRDECTSLSSQKKKRKLMAVQPLRIAMTSGIFIRGFFG

SEQ ID NO: 933712 - protein, 142 aa, Homo sapiens
MVIDRKGGIYYRKVGDPVADTHWGAGRDEKWPDVRERQDFRRERKRGSLTSGESDLPFSSPFQLPYPLRETFITNKILCIHHPSIHPCDLIPLGHQTRIQDAQCTSNQKGCHPGPLPLLVEVVEDLHFRGVGKIFSTESHRK

SEQ ID NO: 933713 - protein, 192 aa, Homo sapiens
MEGQDILTKLSTSLTIPGMQPHLIATPLSNSNPPLQPPLSSPHLNPKVWDTFTPSLATDHSPLIIPLKHNHPYPAQRQYPIPQQALRGLKPVITHLVQHGLLVSTNSLYNSPILPVQKPDKSYRLVQDLHLINQIVLPIHPVVPSPCTLLSSILPSTTHYSVIDLKDAFFTIPLHPSQTTSLLPRKIQQKLP

SEQ ID NO: 933714 - protein, 125 aa, Homo sapiens
MGECSLKSLLVPRRKRKRVGMLKAVNSQTSKMNSGYLLHLLGQLGMSHFCVLGAIRNSLAGCRLHTSIEHHFHRAPFSQLQHGGPVCASPTFPMCNYNKCLILKIWVCGLHFQNFANVYEFKPFR

SEQ ID NO: 933715 - protein, 187 aa, Homo sapiens
MHIRVTWGVGKKLHGQVAPIKSESQQLIFKALQVITIWFETLRGREPLRDSKDIMVDGRGKVGKDQLMEGYRHNQRSFDLSMSEISGFWQSFSLVGMGILKPFHYWLFPLPHKSLGSIRQPYVSLDDSLADNNFMSFRLKNRSFGDQGIFDSTRKSLKCSLEAGPITGFLANDLLRKESWETGLQQH

SEQ ID NO: 933716 - protein, 340 aa, Homo sapiens
MGGWSSSGKCQCKVGVIGSICDRCQDGYYGFSKNGCLPCQCNNRSASCDALTGACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFNIIILTVIIIVVVLLMGFVGAVYMYREYQNRKLNAPFWTIELKEDNISFSSYHDSIPNADVSGLLEDDGNEVAPNGQLTLTTPIHNYKA

SEQ ID NO: 933717 - protein, 220 aa, Homo sapiens
MNHLDDHGSKSMRRGGRGRGRGGGGGGGGGGGGEEEGEEGEEGEEGGGEEERRKKKEKKKKKKKKKKKKKKQKKKQKQQKKQQKKKQQKKQQKKQQQKKQQQKKKEEEGRRRKKKEEKKKKKQKQKQQKKQQKQQKKQQKQQQQKKQQQKKEEDGRRRKKKEEEKKEKEKRRRRRRRRRRRRRRRRRRRRRRRRRRISLVGSPWWWGRQLASDCQCGNPD

SEQ ID NO: 933718 - protein, 275 aa, Homo sapiens
MSLFCRAAVVCWEFTSGPIHLFCSQAWRCHSRRLENSKDECLLLLLGSLTSRGTNFMLVGSVLSRASYNPVGGSHPVWWQGNRTCLIKHFDCLFVEGVCFTQGEPTSLGCLAFSELPGEKAKSASQQRLWPPLPLGDQAQGDQGPVPEPLAGVVGVPAGRPCLAVMCSSAGCCSSRKELKWLRQQAESVENLRGSRVGNLGPGGMEADFSWASGTRSICLLLMLVTKSTAIRVHRHFGNKRSPSRSDQDTFEMSLSCALENQRQQPQIYLSVLRC

SEQ ID NO: 933719 - protein, 152 aa, Homo sapiens
MTVLKTFYTYCQITFQEYCLFISGIFDPPITGRISALGTCYYWSIHSFPTDLKCHFYRLVFITLRSGCCHSYTTNLFTTVFYKVVSELEQWPLTHGQVKERADNCRGGWHGASGIPMTAREVNCSDCTSKETKKQNLAVRSTINWQLFQGSP

SEQ ID NO: 933720 - protein, 136 aa, Homo sapiens
MEAETKVLQLQATERQGSLEKHQKLERDEEEFSQISEGIQPYQHLDFEFQATRNVKMGQSEEQLPESPGEKPPFRSNDPVSSALPNSKRNKFPNFTLLPQTYLLQRCPRKPIAVVLQISLLGANFWVKKETKIILG

SEQ ID NO: 933721 - protein, 171 aa, Homo sapiens
MAGPHDIGPVTLTADPTVFQRELRELYVQGGGDCPEMSVGAIKAAVEVANPGSFIYVFSDARAKDYHKKEELLRLLQLKQSQGLEDLSDPLLLAFAVVFVLTGDCGDRTHPGYLAYEEIAATSSGQVFHLDKQQVTENILEQACNSSYDTVAGVTPLGNCRLVLCSVMLPS

SEQ ID NO: 933722 - protein, 188 aa, Homo sapiens
MSSECLQLHGWLTACNWGFYEQMHVKCLEQNLVLSKHQNNGNITITTIIITTTTIIITTTTTIIITTTTIIIITTTIIITTTIIITTTTIIIITTTIIIITTTTTIIIITTTIIITTTIIITTTTIIIITTTIIIITTTTTIIITTTTIITTTTIIITTTTIITTTIIITTTTTTIIIITTTTIIIAV

SEQ ID NO: 933723 - protein, 164 aa, Homo sapiens
MVEMTRLGRPAGGPAARPYPSRTGRGPTEQGTACSRRVHRGGRLAPTCASTAAPAARAALGMMPGAPLLRLLTAVSAAVAVAVAGAPGTVMPPTTGDATLAFVFDVTGSMWDELMQVIDGASRILERSLSRRSQAIANYALVPFHDPGSAPAPPPAGRPLRGSS

SEQ ID NO: 933724 - protein, 139 aa, Homo sapiens
MVLLHSPGMRDPMGHMPCVAEKQWSPLKERDMKTVQTGGCEDALQSASRSLRSRPSAGAAGADFKARRPQPDPPGADLGEARRVPAGQVPAGQRPGTEGWGRHEAAPQGGGGLNPDWGLRTRLRWEVSPGWEFGKQTLT

SEQ ID NO: 933725 - protein, 175 aa, Homo sapiens
MPGPPSSSDRLPRSWQPRAASRRRRGPRRGYICTKCLGAAGPEGSDVGFGWGKIGGPGGGARAAGEPGGEREERLRRRRGPGPGNIPPRGAPARASGNEPAWSGRVGSDTGRRAATCAHPLLPSRSAGSAQLSWDWAGVFCTQSGGVGTALRHSPAPGPSAAPYYHLYILVYSLE

SEQ ID NO: 933726 - protein, 131 aa, Homo sapiens
MADVSFQFFVQFPGGPGMGKGRQHSPRTCRATAERRCFTSPWASVALALHTARLPPPSDLFPVTWLQSTGYPDGLGQVEGTAIASNQPPEPCCLRPQLAQPARVPAAWCPPHPPGSSDFQLGAFYALSLKG

SEQ ID NO: 933727 - protein, 179 aa, Homo sapiens
MTTFTINEQTKCAMGQAQAEPVSLAASFLHIPSLSTPTSQREGDFQAGDKVQGAQLALVRLSGEEETHNTGPSPLFWPPPHSSLGAFPPQQTGRRLRAVGVISWYKGTQLARSQTLALPLCPADPQGWLRFTETLLSTTYAGKGIPQGLGHLDKHQALGAKSQHVEPLSCGRRSCVCPL

SEQ ID NO: 933728 - protein, 145 aa, Homo sapiens
MLKTMDIDKITKEEYTELEWKSKEPYLDALEMPIYRFRGQVVKAKRKSLKEIQSVTLGNTEMIRKQNSLNADMEKFSVVWGEDQTSHNIPSGSNLIKNKVLTLFNSVKAEKVQGEATNSDVEAAANYPEDLVKIIAKECREVKST

SEQ ID NO: 933729 - protein, 148 aa, Homo sapiens
MPAGTPVWTAGLVVSLPLYTCPGHPRTRYWTTKDNPYVPEFTKIIQINQPMKNLQNLASPTPLAIHKWLITVSACCFPALRCNTAQLCLTYFSGLELKVTKNSTFNTSECDCIVSHHQNTFKSYKIIDDILIPSCHTTLVNQVHLYAF

SEQ ID NO: 933730 - protein, 156 aa, Homo sapiens
MSYPDIIHLQEAAVCTPKTGGREGEGNDYTRVQKPGSPGGTKTPVKEIPRRPPDEPHRRDHQELCGTQSKLHLWNSVITWTPSSFLYQFQKTQGLRGPPMAIIAGVHGYKPHVSPKPNRALITSQSFKVISFDSMSHIQATLMQGVGFQGLGQVCP

SEQ ID NO: 933731 - protein, 166 aa, Homo sapiens
MADRAEKQLHAAQLWMKKRRFPVCNVLYVNKTLERALSLHATQTAACNGPSWALLRKQRRLHAHRDSRERTSRRLSLHPSLGLEPRKGSQDGGLLSQAWLPVDNSGALPSTCLAWGRVASGAGLEGGLGGVLGLKGRTLVRRSPASIDITAGEVSPNSQTSQHQKG

SEQ ID NO: 933732 - protein, 141 aa, Homo sapiens
MMFDQMPGHTVTHSGCHPGPPVAEPLLDQCAWEMLSQFQPSTQSTDGPLCSSDSGRELLEPGTPGGPGGRPWVQGAMPGPPVSGGDREINAEGEEVSPREDFSQFYREEMEARERGHFPRLYGQEGAKRGSHWGQGVGGLP

SEQ ID NO: 933733 - protein, 537 aa, Homo sapiens
MDHKRRTALGEMAGSEGTGLVPHSEGDCHEGDDDGDDDHGGDDGGDDGAGKEDGGNDVDGGDHHVGGDDDVDGDDSGDDVDGSDDGDDGGNDVDGGGDDGGNDVYGGDDGGNDVDGGDGDGGGNDVDGGGDDGGGNDVDGGDGGDGDGDDDRCDDGGNDVDAGGGDGDDVDGSDDGDDGDDVNGGGDDDGDDGDDVNGGGDDDVNGSGDDDVDGDDVNGGGDDDGDDGDDVNGGGDDDVNGSGDDDVDGDDVNGGDDDDDVDGDDDGAPAPRMAAPRHLHHRDTCHRSRHHKSRHHRSRHHGNPHHGSRYRGNPHHGNRHHGSPHHGTDTTGANAMGADTTGAHTMEQTPWEPMPREQTPQEPTPWEQTPREPTPWNRHHWNQCHGSRHHGSPHHGSRHHGSPHHGTDTMGANATGEDTTGAHTMGADTTGANATGADTIVGTHTMGADTMGAETKGADTTGADTMGTHTMGADTTGADTMGTHTMGADTMGADTTGADTKGADTTGADTMGAETMSAHTSGVQCGSPLPILGAAAH

SEQ ID NO: 933734 - protein, 134 aa, Homo sapiens
MLKLVKAGAWPRASLPFAQLLDSLLSMTTGHGAEMAGGTWGMLASFPERVQPSAVPTALSFSIAGQRHGAGALGLLPGLGGLCHSRAGGDSDDGKESSGSKTPADDGGSGWPSEDLTFLFPCTALGLGCAGPAS

SEQ ID NO: 933735 - protein, 151 aa, Homo sapiens
MSLRPKKHPPQVDLGEPSALKEPLWSSGSIPHNRGWQQLQNIAPPEVGSAELRLMANSDRADHRDSTTSSSWWNKSWYPDVGSERSSTVFIFTTNTVAVGEDGPRHHTFSWRQRLNYKFFHLDFQLWELQVSEVTSKTHERELMHFLGTTG

SEQ ID NO: 933736 - protein, 488 aa, Homo sapiens
MDPHWDLDSDHGDWSRKHLLTCVLEELRRIRKKSMNYSMMRKLQKQALGPEQNLEALLNLATLVFYNTDEEEQAQKEKQDQRKAAALLMALRQTNLGSSERTENGAGQSPGRACYQCGLQGHFKKDCPMRNKLPPRSWQVPGHVITLTEPQVRLTIEGQEIDFLLDTGVAFSVLISCPGRLSSRSVTIREILGQPVTRCFSHLLSCNCETLLFSRAFLVMPESPTPLLGRDVLAKTGAIIYMNMGNKLPICCPLLEEGINPEVWALEGQFGRAKNACPVQIRLKDPTTFPYQRQYLLRPEAHKGLQDIVKHLKVQGLVRKCSSPCNTPILEVQKLNGHWSLVQDLRLINEAIIPLYPVVPNPYTLLSQLPEEAEWFTLLDLKDASFCIPLHSDSQFLFAFEDPRDHTSQLTWMVLPQAFRDSPHLFGQALARDLGHFSCPGTLVLQYVDDLLLATSLEASYQPATLDLLSFLANQRYKVSRWKAQLCL

SEQ ID NO: 933737 - protein, 154 aa, Homo sapiens
MVLAVGWCLGCVSEAVLQVDVARQEPWEKSADRGDAQIGLVPPHRQDSFVLPGYNCQQRPKLPRGVLTWKCRTRNKNQQKKGKGECRNPCFLIVENSFSNQDLGSSICRVGPGGLGEGNHSCEALLLLLAQMPKQMEGQGSSAERLQISNMSKE

SEQ ID NO: 933738 - protein, 152 aa, Homo sapiens
MRGLASFGFPPCGNIREKQPSANQEASLHQTLDLLTPSSWTSQPPELCGHISYPMYGVSVLAAQSNTHGGKRTGHKPSHISFYKGMNLIPRVPPSCPNYLPKAPPINTIILMIKLQHTNLIWGVLLTCENNEKFEKARLDGIYGKEYEVIQK

SEQ ID NO: 933739 - protein, 159 aa, Homo sapiens
MVHICLNMRGLASFGFPPCGNIREKQPSANQEASLHQTLDLLTPSSWTSQPPELCGHISYPMYGVSVLAAQSNTHGGKRTGHKPSHISFYKGMNLIPRVPPSCPNYLPKAPPINTIILMIKLQHTNLIWGVLLTCENNEKFEKARLDGIYGKEYEVIQK

SEQ ID NO: 933740 - protein, 203 aa, Homo sapiens
MVFDQNDDSDMGNTINAEMVSDGDENLVSCVPASPAIAKKGPRYSSCHGFRGVSPKPLQLPCDIETSGALKSRIEVWEPLPRFQRLYGNPWISKQKFAAGVGPSWRTSARAVKKENVGLEPTHRVPNEALPSGAVRRGPFSSRPQNGRSTNSLYCAPKKAADNQCQLMKATRRGGLYPAKTQGQSCLWPWELTSGISEIEDTN

SEQ ID NO: 933741 - protein, 149 aa, Homo sapiens
MVLDWKSVPPAAPVCKHTNQHPVSSSRFVNAPISTLYLANPVGTWRTFVSSSGIVNTPISTLSKRTNQLSVKQTNQLSVKWTNQQDVGDIPAEGIIIIEGESSMHGFAPEELLVGQDVDVEDSDTDDPDPLTVTFSRSLHGVRKPQQQV

SEQ ID NO: 933742 - protein, 150 aa, Homo sapiens
MLSLPLPPPHDGPWCVMFPFLCPNVLILQFPPMRPSAAGLLEFAGGPLQTLFAWVSAAEAAEQRILLNSKCCCLIVPLEASSQSSTRPCGASNLQIYPKKSSISSHWPMNQSTTSSFLAIYQKYRNSLESDTSKSKSTYSPSLNSIAYGK

SEQ ID NO: 933743 - protein, 137 aa, Homo sapiens
MFGMFYIPFGHLFQMYGKAWMPRQKPAVGVKPSQKTSIKAVQRENLGLEAPRRVPTGVLPSGVLRRGPPFSRPQNGRATSSLHPESAKAASTQHKPTRAVTGVELCKATGAELPEPIACTHVPWMGDMDSSEIILER

SEQ ID NO: 933744 - protein, 137 aa, Homo sapiens
MPFIYFSYLFALARISNALPNRSTKNRHSFLSFRSFTIENYVNYGVFIYGFYYVEVVSSIPSLLSIFYLKECRILLKAVSASIEQIMWLFPFILLIYLFKVMNHKEQNIKSDTLRSLCPVFTQSINRVVISAKVKAN

SEQ ID NO: 933745 - protein, 135 aa, Homo sapiens
MSFFTTKHCEWSPGLSLVKEEKVLLSINDHSGKFTISPPPWEGKHHFIDIYQGTSTGDKEDGHHYARYGHSRKVATEGTCKAQAALQRFLPRVQILTNILLKQLSIKPALRVFLPPLAFLLSSACLPFISDLELH

SEQ ID NO: 933746 - protein, 135 aa, Homo sapiens
MELASERTLMVAVGKHLGWSAEPVLQVGGTRQGLEMGWQTGGYSHQTGCIPQAKMALFCPGFQRVTVRVSHFTRFIYTFVRAAWGQKCALVLGNPMLPSLATPCFLPFQSSFCTLPLSILNDFFPKDMFIMCQFT

SEQ ID NO: 933747 - protein, 147 aa, Homo sapiens
MGKPSGSCFIRGKVFFNIYSDYETTLVPSYPGLQLESQAQLLSLVSLRLSFLSAVSCTQGTHKFVVAPMLGAAGLLPVVGTSALVLAASSGKGFYNCSLQLSPYQKEETPIFSKYIHVDWYLVVIVNHNRRCYIMLRVTKARDLERV

SEQ ID NO: 933748 - protein, 139 aa, Homo sapiens
MPHPALPHPPVGFTHSPTSPNEINQVAAIGFWDERNLVSNQSYKERQLMARDQLQTRTKLSMEIFNKWDQDPEVFLQGIVTGDETWLYQYNPEGKAQSNTPSALTCVLFFTPFPQPPYSVPLKPKNPSEKMMILTEGQG

SEQ ID NO: 933749 - protein, 278 aa, Homo sapiens
MVRGQGDHTLIEWLIAAIRTVWNDAKKIPETVSKRQSYTDLVQILQEMGMWQAMFDLNTRRPNDERFTSHMRDLVLGSVPQRAFGSLAAVLTPYVRRHIHEVTNAMAALGETERHWQDLGTHAIKKGKVPPLWVTTPQDEKEPQQRRVPDNWRLYVELAIHWSPTNVQQVLALVDTGADCSIVYGNPDKFLGKAAFIDGYGGQSVKVKPVSLHLGVGHLAPCLYTVYVSPIPEYILGVDILHSLDLHTAVGEFRLRIHVLKLVLCGHSHHQSQVLPQP

SEQ ID NO: 933750 - protein, 142 aa, Homo sapiens
MSLKNMYPTYMTAHPYSPTQTQICWAKCRLWPQTRGFAVVYMTGPCGIKLAKIIAFFCKAWCHQETSPKSFGWWNSSTEAHEDMLWKRLYGALQESVFPSVKKFSIVHIHCPTTFLIVCDFSKMTNSGPTITLDNSFTPYRG

SEQ ID NO: 933751 - protein, 173 aa, Homo sapiens
MVFPHLPGFIYLWSLMLVTFRWGSRVDVLFVDVDAIPFCLLVFLLTVRPLCYRAGRQEHLSLLKLHPQLPLPPDALSQGDGSFIYKLLTGAAAFLSVMPCPERRNLEMQSGYSSFAELREAGGWYGKKYVVGRSVVVLEPKNNVTNMGRDNSSTVFNVKDGKVTPEDFSVTHV

SEQ ID NO: 933752 - protein, 139 aa, Homo sapiens
MMCEVTTLTHKTWNNFVKAGTLISKSFLSSAQSMKVSCCLWKLVCKQLQGDAVQGPAIHGDVEEHGGMPFIYLTCLMAVARTSSTLLNVKGVKIIPSTFLDHSAIQIEINTEISQNYTTARKLNNLSLNNSWVNIKVKE

SEQ ID NO: 933753 - protein, 144 aa, Homo sapiens
MGFYFARGEKILARRQVRQLKFSERSRPIGKSSEQPLGSHTPALSCGCSSIECGGLLFHRDSQMQEGGRPPIALPHPGDQQSRAATQRSPCVSDADERPVTRERKHWKGIRSCPQLLPYLVLLLCSSDGAHCSMKCKDQKKSSV

SEQ ID NO: 933754 - protein, 149 aa, Homo sapiens
MGPAEPGTRGNLLVCPLQRPWEKSNIWAAVYCSSRNSEPVNQAQRPHSQEVNPDAGSLTGILLLLLLKAQLLPAILSGKVDAECDLLRHGAHLTGGNWITCLALVFRLAWNLGTKVQISKRKNHQNISWEPKRRRVSMIMTNDHCTSAD

SEQ ID NO: 933755 - protein, 139 aa, Homo sapiens
MTSARSTQSGYQTKLLVTVICFCLYFLPAHFLLNSLRLCFSSYYSIQTTLVKSSMPNLDQHSPLDGTNFVHILLSSSPSSECETRGAKFKQTGHPQTLPVYKELDSKPFRLCRPTVSVQAVQLCHFCTKAAIDSTFTYC

SEQ ID NO: 933756 - protein, 147 aa, Homo sapiens
MAVQWGEGEAGCTHSGSTGMVGGMCMCVLVEKGRLGPLVHTYTGKVMGGEGMVVGKYLRARQMAEAAVRGGPKWAAVCLWAALLEHSASQDWSASAEATIQTSRGTWGLPCKQAQPGWSPRRGQQSKSCPGPTDLISWVRPPFRVQV

SEQ ID NO: 933757 - protein, 144 aa, Homo sapiens
MVSASICLASVEGLMLPPFLMEGGGQDGLENCPNAIHLPAEKEKGFSSSPVCEVCTLDSCPPLSSGQEASHPIQIVIKATRQNPSSLPGVCSLAWETKSLIWFPLCVYITLAAYLLDISPKNTSRDGWIWEVKTKLFGYILFKK

SEQ ID NO: 933758 - protein, 152 aa, Homo sapiens
MGRNQSRKAENSKNQSASSLPKERSSLPGMEQSWIENDFDELREEGFRRSVITNFSELKEDVRTHRKEAKNLEKRLDEWLTRINSIENTLNDLVELKTMARELCDTCTSFSSRFDQLEERVSVIEDQMNEMKQEEKFREKRNFISCQTKLHK

SEQ ID NO: 933759 - protein, 169 aa, Homo sapiens
MAAAVLAPVITSKQEEGKIVSDEKSDDILIEDLLEYVSSGQLSSCFCYPAHAHCWCKWPCALALSLRRKELFISLSFQVPGRIFHWELRLLNCDESFLPMKEASSPPEDVASPTPVVSAFPPIFPPPSKGINPAFPEKIVMACPEAVAMQDNTVSPQNPPHHPSLLLEL

SEQ ID NO: 933760 - protein, 135 aa, Homo sapiens
MPLTQIMFQKNLKPPYYTTVGEFGHISHVGPRLEISAVQPTEKCWEDSELTWMIQAQGVEIYKKTESSKVPGHNSNILGVPLHKLSLPCLHVRCDLLLLVFPHDCEAFATCRTVSQLNLFSKINYLILDMSLLAP

SEQ ID NO: 933761 - protein, 144 aa, Homo sapiens
MVGLVTSMSMRPLLHFFSQKVSALVRGNAMWNTMMVDKAFHESTDGSLSRSIACKIGNPISRFLTTQRGPSTYLFPRCLRHQFSNHAASKSLTIQPNHWLWSMNQYIITYLAISSSMQSAKPGALLEILPTGKISLHCCPSEMS

SEQ ID NO: 933762 - protein, 166 aa, Homo sapiens
MAPPATRLPWTKCLPIALLRIQTAPWRDIGLSPYEMLYGLPYLHSAADIPTFETKDHFLKIYTLCLSSIFSCLKTKGLLAQAPPLEFPAHQHQPGDYVLIKGWKEGKLEPAWEGPYLVLLITETTVRTAERGWTYHTQVKKTLPPSESCTVTPGLTPTKLTLKRDY

SEQ ID NO: 933763 - protein, 152 aa, Homo sapiens
MRALSIFFIVVLNSWPHNVLNSWPDNVPGPLPEGHVTSSNCEARFSATIFPPDWLVAFGTKQVTFLSRELVCSPKRLRSATVTRWQNCKVSDAHLPYPLAAQGRPLGSLLYNSTSSQPCKDGRGLPLPPRPTKTRQWLWASPPSWPHLLKKK

SEQ ID NO: 933764 - protein, 176 aa, Homo sapiens
MALQNTAPEAAFMGWCWVPAAFPGLWCKLLMDLPFWHLEKGGPLLTAALDSVLVGILCGGFNPTSQYQLLLDIEDPPLSFPAEDLKATHNCGAAPPSYVFGTAVIAPFLAGRFSGGLRTAPQTPLGPVLMPASRGPECGLTWPTSTSFALPTSEAECRPLRVPQPIPSPRTPTCFS

SEQ ID NO: 933765 - protein, 146 aa, Homo sapiens
MFEVYKELSSKPNVVQWSLTRYKTKKGGEKGTKSLSDYIWQEKPFTCPSIQRFWAGHLMKSMGMLLAGVCMWADLILGDYFITIIPFELYLESWGLSTKASKLSGPIVLNGSYCNTLRAGLHGPLICGLSLLLVAGEFCQKLPSIL

SEQ ID NO: 933766 - protein, 265 aa, Homo sapiens
MPSKHFHKTQCPILEHLTNSMKMHGHNNGKKPMTMHIVKHAFEIIHLLMNENTLRVLVNAIINSGPWEDSTCIGGTCEASFQNIKTIAECLEDELINATRGSSNSYVIKKDELEHVAKTLPQAEALDRAYQIDTVINLNVPFEVIKQRLTARWIHPASGRVYNIEFNPPKTVGIDDLTGEPLIQREDDKPETVIKRLKAYEDQTKPVLEYYHSPSAFQFTSYQPETPAAKSLFCQQKSWGRHRLALIMSILEDGEWGQSLLNLVD

SEQ ID NO: 933767 - protein, 138 aa, Homo sapiens
MSNILTNSDGQRGVLGVGNCLSRDRGQKKAPLHVWETENKQFNVAECEIKEERRVGKYHRCASVEACLVFTFALGLQATLLGSPEQVVLEARKAEAKYDLVHNSEHLLAGKPNVKCVVMSIWKNNVEVPDVFTLPGLR

SEQ ID NO: 933768 - protein, 170 aa, Homo sapiens
MNTESSESHQLATEINFCPSVKRCQAKDKGTPGGKARSVKKRVYSKGPNIRDPGRKTCILPNYFGSFCGKSIESRGERKVVCVFPSHNSYEFQSETAAGRHPVKFSTWVFAYFSGLCFQGQWFSKPLLFLVGSVYWMLLGLPLVPAGTARGGKRASQSGRQMTFSGGGLW

SEQ ID NO: 933769 - protein, 156 aa, Homo sapiens
MGPPNLTPTPLPAPTHMHYLGAWGLSCPAHRAITNTNIHFSGPRGSSATTNCHHTHHTFFPGTEEPAHMPNPLPPILASEQATLEAQESACLDLLTLVTVDTILGETTLQYAPKIKAKGPYLTNTINASSEKFLSCESKYKKLEEVTIIANMKVSM

SEQ ID NO: 933770 - protein, 172 aa, Homo sapiens
MMLASQNDFPSNSQAPVPQVCKSLLEVHSRPCLPGYYQQRLQNSKSCCLLLPLEVSSQRDTCQMPAGTLLYEVRARELCWDIRCSLQSQQAGTFKFAEAAPTAAPSPRCSVQGDGFIYKPLTAAAASLSEMPCLLPLAGGERSLDACSPPLRGHPTLLLLALHGLHALSNHS

SEQ ID NO: 933771 - protein, 142 aa, Homo sapiens
MVYHLQTSLALPIFSIFDKMVEILGRSKSQGAKQIDEMHQKLQCLQLALVNRKGLILLHTSAQPHLAQPTLQKVNELGYKVLLHSTYSPDLSPTDYHFFKHLDNFLQGKCFHNEQNAENAFQECNVLSSTMNVASNSHGCTL

SEQ ID NO: 933772 - protein, 138 aa, Homo sapiens
METSKCPHMAEGVNTLPENSFIKVAGHREEHISGGTHGLLDMERNAPTGTGSGEATDRQNNAEFGWGNWRRAWNTEWPNSRGKPVSLLASSSTESYFYSIKPCTHSPSPRVIRFFQYTKARTPGYRKPPVLVISQGSN

SEQ ID NO: 933773 - protein, 135 aa, Homo sapiens
MSPPAGTNNSRHAALRAVTLTAKVCSFTPEPARPRTHQKEETPNTSEHQKGQTPDLLQLEGASGIYCIEARDAAKHPTMYRIAHDNNDLAENICSQQARDPGELVACPSLTASRLKTQEVLMVQFESKGMGKMMS

SEQ ID NO: 933774 - protein, 155 aa, Homo sapiens
MLMQEVGSHGLVQLHPCDFSGYSPPPGCFHGLVLSVAFPGAQCKLSMDLPLWVLEDGGPLLTAPLGSAPVGSLCGGSNPTFRFCTPLAEVLHEGSTPAANFSLDIQNIDRGHAKPLRQPDQEDADSATSACSQVAAVRFSPFLKIPFLVQLNQIM

SEQ ID NO: 933775 - protein, 146 aa, Homo sapiens
MHDTCYHLPLTGWCGGQDGENDITTSFNLHFQIDCDKIRAKPGLHKLSVASVECVTTIPLMDSSYRRRKRRRRGRRRRRRRGGGGGGEGKGKEKEKEKKKKRKKERKKKRERKKKEKERKRERKKKERKERKRKEEIRNEENRTYG

SEQ ID NO: 933776 - protein, 133 aa, Homo sapiens
MNITVHVSNNIHRLKFSPNPAGIFIYLSFTKNCECLFCLRHCSRSSGYYKTVVPNLFGTRDQFHGRRFFHGPGNIVNECGCVFLHTHAYTEMDEKKTGHSNIENSCGKTFCFRYKIHMSDFGACKNGLIIDMF

SEQ ID NO: 933777 - protein, 133 aa, Homo sapiens
MGELQGKIIFLLNYPSSSFSRVGARGCHADSPLSYLTLKPSTDSKAKGAHCNTCSLGLQGSRRTPRCCHGAANASCNQLFNQSIDQSIISQSYDANIGNPIYRSFVDADGFDVFSDQELLYLVNGNTITTNEC

SEQ ID NO: 933778 - protein, 134 aa, Homo sapiens
MYPQCSQRLTGLRLEACQGPRSHPASALAACCLGTGDHTGGGDETGQAQPWDTPVPTAPVTGCFPQPCRAACPTADSAGPGRSSQDNQSCDAGDDQKLSEICKAGRLEIQKEWGSANTDQPSDTDFGLLASRTV

SEQ ID NO: 933779 - protein, 144 aa, Homo sapiens
MVSEGAPIPMVRDSTSLVEVHPANWLLGPVAVREVLATAPPKTPAVTPQSDMVASEWGWGGTARTWPVAEESLIVRKSSWENVLRWSYFCMLEPHKVCTFCPMKAPQRVKGEAVCFHNHLYFKHFPFPVNPIVTQRIPLLIFST

SEQ ID NO: 933780 - protein, 142 aa, Homo sapiens
MAMTLKSLPPPASTFKEPCNDIGFTSIIQMISSYKVAEEEESFLLCKANPPLCPWALPHSEALFNQRLEDVLLLALEMEEEAMASRNAGGHEKLEKARRRILPLSYQKEHSLANILILTEIGPQVSAGADENPGFHTSHPGF

SEQ ID NO: 933781 - protein, 167 aa, Homo sapiens
MLNACRLYGTQPLPGPGLRMPRPLPSFPSTMKIPVDTTRGPSSRVPALLSRKWALKQTKRQVVQVTCSTQIALVEVVNAEELLDLALPPPEGPLAASSWPLPVSSPQADKSLLWDPFTTRHGSQPSDGKKNKGLVPRIHKGLLQLNNKITNNPVQKQAKNLNGQFSK

SEQ ID NO: 933782 - protein, 151 aa, Homo sapiens
MATAGHGLHTDTIGIASEADEQEVEGEGTPKGWTATGYPVGVQKVEELVGVGKIPTYSASEVLLISSSDLGTHSQRIYDLNSCSIVSGRERKETVTELETKLRQAVINFEVTDLLPSQYILTWQKEDYSQDVNGICHPLKACLELKDILPR

SEQ ID NO: 933783 - protein, 142 aa, Homo sapiens
MPVSTFGHLNPRLINPIAVEKLYLVKVMEKQRNQDHEETGVDMDRQKNTQTERDRTALIPDEETEDPQKSAIQQNMVSNEVCLMEAVQHWATSRTSSDLCLKMPEPDICIPASLANRLQAYDLEPTEPNRDLEENSIWKSMP

SEQ ID NO: 933784 - protein, 137 aa, Homo sapiens
MACHSFCLHSSGRLLGGDISQPQKHFWNWHPLGPQLCSGWGKPAWKRGRIREEDQSCKRGYKACTLRPLCQAQEYTRAEGQPYLRTINKLTPHPIIPPHSLQPVSFPNLPHSLSPGALVHQMTLLAPWYTGMINREG

SEQ ID NO: 933785 - protein, 138 aa, Homo sapiens
MCRVWASMYAWSIPGLTPREANCPNTSSSGYLYPLQFPLSLRLMRRQGHHISIPGTWMKLEAVILSRLTREQKIKHRMFSLNVRSLNSGESQLMFESKVSGDMCSECEASELFEGVSQGSEISEVFEGLFPTARVYCF

SEQ ID NO: 933786 - protein, 168 aa, Homo sapiens
MLKKNDESGHPYLVPVLREQLSTFLSSSPLQYQPPHGASLYHLLQEVCPDWSLREQTLCTKERPEKHLNKYMNLFIIEHPQCAGIIPGAEDTKMNKARPHLLRNRVWYQGSLKHIFMTVVLLWDCKGGADQQFPGKVLKGHSRREKSEILGSPEQESLLFCTRSHGLT

SEQ ID NO: 933787 - protein, 147 aa, Homo sapiens
MAAAAHLEWLLQSYGLQWGGTPQHEQPGHHEQQQKADRFQGGKARVPSEAPTSSRTGGWDASPVDQSGILWCFFCAHPWPPMDQSACTSSPLKPKKPCAQQDSRRQQGDQLWGVAAHSRVSSLLRAEHSTRPPAHGEELPSPWSSLC

SEQ ID NO: 933788 - protein, 178 aa, Homo sapiens
MFCLDDLSNIDSVVLKDPLTEAVWLLLAEKVCCTGGDPSLSRAPILSRASRLEELSPLTTVTAAAPPPGCSIPGRGQSSVHIGMAGVTKGLLSKEEEWKEVLLKEQAQSVAVGWLEFQASRSCEVLWKWDAQNDAFWPSLNSAPFFGESMDGSATLLGILGPENKTFSKQAITKGICY

SEQ ID NO: 933789 - protein, 197 aa, Homo sapiens
MGETRWVLIESGGQLPLCVSPVNEREENVGRFGTSRDLEGSDDRKMWESLELPRNLLNGFDQNANSDMHNGVQVEVVSDGDEELLGNWRTESSWRNSVRAVWKGNVRLEPPHRVPPTGTLPSGAVRRGPPSSRPQNGRSTNCLHYVPGKTTDTQCQPVKAARSGAVPCKATGAELPKAMGAHHFYQHALDGCETNGK

SEQ ID NO: 933790 - protein, 413 aa, Homo sapiens [sequence omitted]

SEQ ID NO: 933791 - protein, 141 aa, Homo sapiens
MVLHLWVQRSQELRFGNIRLDFRGCMEMPGCPGRSLLQGQSPQAEPLLGQCGRKMWSWSPHTDFPLPSGAVRRGPPSSRPQNGRSTDSLHHASGTATDTQCQPVKAARRRDVPCKATEVELTKAVGTHLLHQHALDMRKII

SEQ ID NO: 933792 - protein, 136 aa, Homo sapiens
MARKGNSLTPCASQNGRSTNSLHHLPGKAAGSQHQSVKASRRESVPCKATGAGPPKTMGTRLLHQHDLDVRPGIKGDHFAALKFDCPAIFWTCMGPVTFLFWPMSLIWNGCIYPIPGPPMYLGMFFSSPCRPVSTL

SEQ ID NO: 933793 - protein, 164 aa, Homo sapiens
MGFSFLSYCPPEAIFLQLAKPQYTFTVLLQGYIHYPALCHNRIQRDLDRFSLLQDITLAHYIDYITLLRSSEQKVANTLDLLLICFCARGWEINLTKIQGPSTSVKFVGVQWCQTCQDIPSMVKEKLLHLALPTIKKEAPCLVGLFGFWRQHITHLGVLLWPID

SEQ ID NO: 933794 - protein, 135 aa, Homo sapiens
MSLGKGTLQMELRKQGPHSYIHKKLSSTNYLSEQGNGFFLRVSRKVYGPENPLEFSLKEWYQFLLVPLVEFGCESIWSWTLFGCSSKSFSVQLCSVAARLRGRRTLRARKGNSLTPCASRVRQCLTLLPHGARTH

SEQ ID NO: 933795 - protein, 150 aa, Homo sapiens
MDGIGGHYAVQKGNVGSEPLHRVPTRAPTSGAVRRRPPPSRPQNGSSTNSLHSEPGKATDTQCQPMKAPRRGAISCKATGAELPKTMGTYLLHQRDLDQKKYLLMVTTAENALSHTKASTVLGLAQGWQQVSFRHRSFLEILSKIWSLES

SEQ ID NO: 933796 - protein, 140 aa, Homo sapiens
MLIAKKIEKLFPGHVRDLHGSFHHRPRGLGGKNGFVVCGPGPHSLVQPQDFVPTPAMAKMGQGTAQAIVSERVSPKPWQLPCGVGPAGTQKSKIEKSCCEAEQREEELARCVVKGKLILGCEIPGHADMKRLVMHDRNDN

SEQ ID NO: 933797 - protein, 146 aa, Homo sapiens
MEHEGSSCFNASQLLCSPPQSTGMPTVACHCCQRMGRSGVLFKSVSSILYRAFFSDKKLNPAMAKMGQGTAQAIVSERVSPKPWQLPCGVGPAGTQKSKIEKSCCEAEQREEELARCVVKGKLILGCEIPGHADMKRLVMHDRNDN

SEQ ID NO: 933798 - protein, 151 aa, Homo sapiens
MSSLKTKHWSRDLNEEQAMQRPERNVFEAEMWTPSQLAVSLAAAGKPRTPRKCELSGVISIEIKYRAAAGTELGTFQHESAPADPGHQCLPSRAAHLPLRGSAPSYLLRRKQGLLLPQDWSTYVLQVCLPASPSQDPCLVTSYYLIGLSIQ

SEQ ID NO: 933799 - protein, 163 aa, Homo sapiens
MFLGSPHTVKGIMYRVTKLLASHKWLTRIYLYIYIYIFIYLSIYLSIYLSIYLSIYIWHWRNDHRMSPGTHWAPCKSDLRAVHSSLSQGRSRNDIQEPSPGLGDPRTLLNSLPQCGPAGTQAARQSPVTFPSVFLKQKESLYSFCTKSSVSSSEYVGLHLKPA

SEQ ID NO: 933800 - protein, 170 aa, Homo sapiens
MSLLLGFNLILCLDGACILYRILLIACFLMYFLHTNLQLLEGLKEEEAGNPARGCQAPRLVPGPNQLLGKGPKIADGELLQAGSCQCAPAQTPSPTRVHLPTASPYCFTGKCTCVGPSTALLLPCQSVNAGTPYQEYCCKQTKNTLAPPGQQVLNLKQSQEKAMGLVPCP

SEQ ID NO: 933801 - protein, 137 aa, Homo sapiens
MVRAANEEKPSIQLHTSRPKVQAHSTDPGTESSPMNPGSRPTPTDCSTKLAPMDPGSRSRLQDKVDLGSGKLWNLGNFNKQVLGTCCTGWPEVFLVHWPQHFNGGFWPNLFFGEQLTASSGVHEVRGVYCCSDSEDT

SEQ ID NO: 933802 - protein, 145 aa, Homo sapiens
MVLAGAIDPDCFRPVRKVSISKNEMWLKQKGYLQVHLCSALMGEAPAGSVVVDEGQRKSLSKSLHKLQDCLTAEVMLHTYLTEHSFAPVPLLKKISQKKKFGGLKACHLNFLAHGKRYFSSTFVVIDTVSELFLNLCSIKEDSYI

SEQ ID NO: 933803 - protein, 145 aa, Homo sapiens
MPVSPVSGPSSAGLLKFAGGPLQPLFTWILPVEAEEQQRLLPACSSGSFIPEGHRDALPSDEESREAVWPQMLCHAVVNSAQSKPSSLLSTVRGKLPTNVSVMGDAPPPTKLNHFRSTSDCCAGSENLKPVVLSLLGSVGVGPAE

SEQ ID NO: 933804 - protein, 166 aa, Homo sapiens
MLGNCLYGDYYHSIRQKWKGQYHYEWGQCYYWEIERLLPPAKQQNKTKQQQKNTSLKFKSSMSLASEQFDLLKPSSLNSSKSFTIQPCSVAVRTLSCKSFEFCWRSNPDPVCLGISSGGCRTVDIGELQIFPLKVLSPRSTWSCEVSVHPYWGVPPSLATRGQGPT

SEQ ID NO: 933805 - protein, 220 aa, Homo sapiens
MVPTVAQFIDAMPTEMEFKGAVGLAELCWAPPSSNFLAAARLLEFAGGLLQTLFAWLSPAEPAEQQILQNSKYCCLILPVEALSQNGTRMYGVAEIPCWENHCSLQSCQTGMFKSAEVSAALCSAMPYPPEVESTEAADLAELCRAVRISPSSGTQNKRFNNSLHHAAGKAMDAYRQFINATAKAIPCRARKAELSKALGAHFLHQCGVDEQKSAQLAEL

SEQ ID NO: 933806 - protein, 161 aa, Homo sapiens [sequence omitted]

SEQ ID NO: 933807 - protein, 156 aa, Homo sapiens
MKLQEERTGSNLCCSALLLVIPRKTGSGVDLQQTPADLQQRGKTVRRKTNTQKGIARPLKDPIQRSPTSKTKAKEQNWMENEFDELTEVRFRRWVITNSSELKENVLTQWKEAKNLEKRLDELLTRITSLEKNLNDLMELKNTAQELHEVYTSINS

SEQ ID NO: 933808 - protein, 145 aa, Homo sapiens
MAPSFTARIQLFLLRALGFLIGLVGRAALVLGGPKFASKTPRPVTEPLLLLSGMQLAKLIRQRKVKCIDVVQAYINRIKDVNPMINGIVKYRGSVVAELVFVYEDIDKDLRENQNFDLVENNEFGLLLGDWRGCLWVNGGSMAGQ

SEQ ID NO: 933809 - protein, 148 aa, Homo sapiens
MLKVDPQYLLIVKVSAERSTACLMEYSLNGKTWGLVPMATLSWSCPEHQKLPGSKPSEGPSLPALHQIFLPAHTPTGDKGSPIARIPKIPGEGPSAAGLLEFAGGPLQTLFAWVSAAEAAKQRILVNSKCCCLIVPPEVLSQRSTWPC

SEQ ID NO: 933810 - protein, 169 aa, Homo sapiens
MLRGPLLSSELSDKDVWGKVTEAPLWSPLLEMHWVSPETSKTLSFNQCPQRLLPGYHLWFTPAPQNSTTSMWQIQLDCVIPPSPGWGHRCCQGPGPRFGNLRNLPGAFRSAFLHGHQCPRPVVVIACDHHQHLLKSQELLSQLVANAASHESSSGQWTPLWPMNVVYDN

SEQ ID NO: 933811 - protein, 164 aa, Homo sapiens
MNVCESFSPFLLARISQLSTQYASQNQKTLRMSAKGFSPLATGQTILQIRGGFNYKGGRTIKKSKCPTLTSFQSQGPEKENGSIWLNLKPKNFVLADFPEPSRLGEIAHLLLGKTRCLSFPGEQAKISPELHVLQDYACHLQILLTSFIASRLVTKFGSNYSWS

SEQ ID NO: 933812 - protein, 150 aa, Homo sapiens
MNTSTYSGEEEMTPDRKFMEKVCNYKCGLRRLSHKKEQNNDLHNNLDEIADHYFELSNSGMENQTLYVLTHNSLFGATPSYKFHLPQQSYTLFIPSHIIRSLKPKHALLKFHQRQKSTSYELNVCIHLKVHMLKVLPLKVMVLGGTTFER

SEQ ID NO: 933813 - protein, 212 aa, Homo sapiens
MGFAGYSPPGIQASPDLLEIRRSLALKRQFVTYSSQEVGACHTMQKGHMEKYQSWGRKQEEYEKNEGPVGPAKKTGLLGFYPSFNQSTNTCFHFTCWNQGFLSEVILGLWIEEEKITRAGADGQSKGDLAVTLSSFVYNSCSPWSQRSLIVDFDHIHTSSSQDTILQSSLELQMATEPNDDDNYLSDDSVNDDNDDTVADGDYDDDSKTCQL

SEQ ID NO: 933814 - protein, 160 aa, Homo sapiens
MPLSPIPSSEEAGIEIAVGLLQICTDWTPVTPGKEGRGEEGMSANGYEVSFKSDENHLKLHITDVCTTIDHGPTDVAKHLIMHKTVPIAKSYQALNINTAMAERHCLSLGYRENISGRGKTLYRELTLLENPKQIIETEVWTIGVKQSFENTSSLLTPPL

SEQ ID NO: 933815 - protein, 168 aa, Homo sapiens
MKWNTLHNHYLLMAERLSQIQLQVQDPFPSYVGVAFESLRTYGLQGGEKVTILVKDINKTFSDKMSNYWKPTVQHEDKREVHKSQCDTTQAKCEMLTKMIKESELGLELLGHNSETKSINTILLSENEIPFVKETIFVEEITGNTTSSRSDSFLEYVMALKEREKRTY

SEQ ID NO: 933816 - protein, 181 aa, Homo sapiens
MKKETQELKKNLKERLKKKEQVKSQWCQVPDTRRINGIASVKGFRLLTGSSPASLKDFSSEASDNGPFTSLVMWLLELLTYSHWQLCGLPCGEIKAEGEQKKIVVRSKHRENLADMHGPKSSRLQGSVGVLNMDPGDRKILALQKRDVEDLYGQKCVCISHIKQEVDRSLGRHLEVEEEYI

SEQ ID NO: 933817 - protein, 148 aa, Homo sapiens
MEKPQTSDSNPQELMCWLSPGKPWEWHFSRLWGPNPHTSVPKITTLLFDSSSAYLSSFPIFSDTHYPCKHAQVTKRRPVWLEYNGNGEKIRSDESSSKKLRSSSIFIPVQVGAKTIQEAEQERKNTQGERIASASLCLHVSHLFEDLF

SEQ ID NO: 933818 - protein, 241 aa, Homo sapiens
MGRAQGTIHSEIFFSSCKPGKSNYVLPKFDGGTGITLAFLFQKGEIGKKEGTSLITLLQRESVSCIPPQPATGCASFPAEAQLLGYFSGAAVRQSGGQGSDALPWGRAAYGGRKQRQWRHSEVLDGGSSEEYQGGKRHDQKSPSLVPPPLEVSKVKALVICPGLEAPESVRVTDEKVETPGHWDHPCESCLPQEEMSHDLTAWPTFVLLKYIPLLTPRMILRSRGEIKVKEFKAVKQSVWK

SEQ ID NO: 933819 - protein, 134 aa, Homo sapiens
MFLLYSNTITINTDFSVTKYAEKFSPRSKQQTPDYLFPTSCKSEPMNGISALANQAPESCLALFSCKTSEKVSSMSQKMDPHQIPNLPMTWCLTSQPQNNKKVSKIYSVLECNDLKKALNFAATRFSKVLKKDI

SEQ ID NO: 933820 - protein, 136 aa, Homo sapiens
MCPTSAFRLGSKLRDVAWKRIWWSVENQCIWFTWNLELHIFSIRKACIASITGEKADNPTTSSSQGGGQRAQRSRRLKFIFCIQIILAFDHLNSPEDGANNILPITNPSATITAITATSRIFFYMWTLNKSNLWKQ

SEQ ID NO: 933821 - protein, 184 aa, Homo sapiens
MQCIEKPGSGLLDTKIFPLSCYRYCLHFAETQGRSKIWKPTNECCWSRRGWVRVKAEGHDAGDGVILDLYAKQYCAYSSYWCMLYLTHQIKTYYCASSFRFSEKVPSMKNRLSPDTESMDTLILDFSVSELKQENGHTLACKLYSFIASDKEQTLEEVKPVIDRALPLTVPMSPKECSTSLKAY

SEQ ID NO: 933822 - protein, 153 aa, Homo sapiens
MEYHAAIKRNKTMSFSGTWMEPEVIILSKLTQEQKTKHHMFSLINGSQPLEGKIQWRESHESDIQGPKCHAEGSEFIQWTKRNGEVLSKTGTDCALSVREHYAGYWQCYRELVGRTVTEARRPWRETSVVSREIETTATDSEDHLVLETSGLE

SEQ ID NO: 933823 - protein, 148 aa, Homo sapiens
MGLCSGSDSFLCPERPFSLSFTTCLYCPDLYPIPYSWLMVWFSRTVVLSHSYFCPHPRGLWQCLETFLVVTTKVMVLLAFNRWRLQMLLNILQCVGQSRQQRVIWVKMSIVQKSRNPALPLLLLVCSADQQHLHHLFVKDQIVVDICN

SEQ ID NO: 933824 - protein, 160 aa, Homo sapiens
MEMSTGNSPGYSSAGGKNWMDPGYIWDLGFTGDFVDSIKSNTSKWAATSFEELLLGFLALSHIQQVLADPTNIHEHQPCAGLKVGTRGMGAVLHGDCHPGSRGGNAGRKGDILHACPQNTSWSKCCDNSTTKANRKLKGAIEFLRRIETDLGRLPGGGGI

SEQ ID NO: 933825 - protein, 135 aa, Homo sapiens
MRFVGTCCEQRSRRGLRALELFHLQNGAEAAGDCPGGRDPALGTLPHDAGNICERVQRSWPAAASISETYSKAQAPPLDFTKKSGRWRSVGSQMQSRQYSKYTVRCSAFVSGLCEIVRRSSISAKCQHVLNTEAR

SEQ ID NO: 933826 - protein, 192 aa, Homo sapiens
MWEKILETMAGYSSYPEEPNGYEEGVGEEGVANQKCFSKIPEQEQKLWVSCTELLVNRISESQIIHIFDLIDILKSFYNVSNLQSDYSCMRGPDFKGLFVELPSSSLLFIELPSSSLVPSNSLLYIAQVTTKIHSRSNHILALNLSMDFHCDFQQDRNDSLGPEFAPEPQLLLSLHLTRPTLNITTNASESS

SEQ ID NO: 933827 - protein, 275 aa, Homo sapiens
MTWQLAVRGEWLQQRRKMGWFSSEEKLNLKNVQRNLILLHPQLLLLVDQIHLGEESPLETAASFFHNVDVPFEETVVDGVHGAFIRVTIDVQSFTIHRDSQQLDVFIATREHAYAMYLWTGEAAGQSAFAQVIADHHKILFDQNSAIKSSIVPEVKDYAAIVEQNLQHFKPVKTADRLLRFSDKRQAEEAIDRIFAVTQQQQQQSKSKKNRRAGECYKSVDAVPDIFAQIEVNEKKIRQKAQIQAQKELPINEDEEMKNLLDFADITYEKHKNGA

SEQ ID NO: 933828 - protein, 151 aa, Homo sapiens
MLNAAGKRKHGKSLNHRQSFCLKVTQATPFHVQLPKPCDMGTHNFKGSGSISMREFLPGSFLDLNVILFEYNPVMLTGVFQFLNIPSRLQFFVNILTEEMQGADDMNVVEDSDRKSETVQKPELAKAISISMAKSKPELADKKSKYFYFHY

SEQ ID NO: 933829 - protein, 159 aa, Homo sapiens
MACFSDLIFLAFLPVVNHFLLLSPQCSAAVHYHISFSFLAFRVQEPLYPHPHPAQYKVNMVDEAKLLSPIHSTFEALVVGHAVTCCREELGPFCRPMRAAGIAVFGHEDVSSFQCSETDQQIKKRKPDCGNMEDYGTVGECHDPCEPTAGPEVEPQSLH

SEQ ID NO: 933830 - protein, 129 aa, Homo sapiens
MWAFHRGEEQFPDQYKARKFTHATFIQCSTRSPTREIRSKKKEEEEEEEEEEEEEEEEEEEEEEEEEEEEEEEEKEEEEEEEEDEDEDEEEEEEEEEEEEEEEEEEEEEEEEEIKGIQRGKEEVISNCR

SEQ ID NO: 933831 - protein, 155 aa, Homo sapiens
MGMGSRKSHHSWSRGWLSDLIILGFRVKKDITKSQEFIYRKEYEGPPVTHAVGLRQITAQRQMDLQLSTIIAISKLKGKSIGDVSDATGLAERPSGSIHLAQRFLLLFSPDFNRSSSLSAGADMQGGISTKCLIQSSNGILCTEEIKDLLQHLKE

SEQ ID NO: 933832 - protein, 189 aa, Homo sapiens
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 933833 - protein, 189 aa, Homo sapiens
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 933834 - protein, 189 aa, Homo sapiens
MASPFALLMALVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 933835 - protein, 188 aa, Homo sapiens; identical to SEQ ID NO: 881233

SEQ ID NO: 933836 - protein, 269 aa, Homo sapiens
MLMLCPLRDIWTNQPYRLMPSDSYVTEDFGEVTITSLHSIYLHPCRQTGLTIFLALCLLDTYYQQNVCKLHPELSHDDLANVTHALVTTRPDNCNFLCFSSELFCCLQQAQHARVQLLPDAQDTCPPSFTTNDIIGPYPDSPNDSLEVSPCAFILSELMGIPFKERCVASSAKRRHTCGLVQGELSQESGEQSFIPIIATRDLGSTMAHALLSCFPPCFSAAYSSKKTKPLPESGYLLHIFWTSSPNWLGIGNSGEVVETLRYVQILIH

SEQ ID NO: 933837 - protein, 236 aa, Homo sapiens
MFSRLLPIVACFSASSLFMRIFLDNEGKGVLAKYAQILMIIPNPAEYDALAPPQPRRVATLEEPYSPLLHCGSPSLGWLRPEMAPFVGRCGGRGTGGNRGCALYSRASVSSGWVRAPQALCPALLALGSEGLSTWASSCRGYAGSPSTGDPPTPRLNSHRASAASPTGQGSGHAACHAQTPTTPPHPHCGISCGWSLPAAHYSARLGPIDHPRAGECRRAAQDWRAALPTARCGIH

SEQ ID NO: 933838 - protein, 140 aa, Homo sapiens
MMFLAAQSVVHRPVALAASGCLLEKLVLDPTPGLLYQKLHFSKVPRHGNHPISQSFPHLSRLSIPQNRHCHHSRFSMSCWAHLPDGVVAGQRGSSHPSRGGRAEAPLTSRTGRLAGRGADPPTSLSDGAAGRAEGLLTSQ

SEQ ID NO: 933839 - protein, 150 aa, Homo sapiens
MGEGIGMVYKSRTRLGICVGAFFTHTDENYTHLNAKKPLRISCAIGHILLLLKCFIQLIHFDHNTTLKDFQLPDLEDGMGGMWPNKEELPVIVFEGMVNRRIDDVFWSLPYASLALTLFRIPRADSFWMSKLCVLSSINSNLGLEELELI

SEQ ID NO: 933840 - protein, 138 aa, Homo sapiens
MRRINFPNFKLVGLGLGSGEGNPEAQHTSKRATSRVIIRGSTSIIALNWLLSTSNGSHYTPHLQGSRLPWASHFAQHSFAFLPSCEEETFAIIVSSLRPLQPRRTFHSIVIPCKTVVQYHNLDIDLDTVKTQNISINM

SEQ ID NO: 933841 - protein, 149 aa, Homo sapiens
MQRWPLFPQCSRHLHSGYARWAATAIKRTYNITKAPALYSQNLGSTIIDLLNGFGQNADSDMDSEIQVEVFSVGDKELVWNWSKGDPSTPAAAKRDQGAAQAVASMGAILKHCQLPHGVGLFAFSGMSHNWHHGERDFSDLLLSLRNMR

SEQ ID NO: 933842 - protein, 153 aa, Homo sapiens
MSALMVTPPNLEAQPATLSNCRTQKAVPHGLEIYSVAWPEQRQSQCPASSLARLQNTSSILIRQWKPANNAIQTQSQGSGPVIQRIRKQTLLAWDWYQLVHLEPQARLCKRRSNPAQEQEKVEKVAVCSNVWRATKRHKDYEESGNNDTSKRN

SEQ ID NO: 933843 - protein, 151 aa, Homo sapiens
MFPSLCPRVLIVRLILCPHKVANPPGTRSIPSGLWTPFLPRMGLETPSRGKNLESGSSGICLLLYFTVAEHVPKLQDKILCTSLFLTSKRSLPLRCTAWRAEDSCLAQAVLKAPSMGISRIVSCVVFGCDSTALSSNTRFHACFSLPPPST

SEQ ID NO: 933844 - protein, 148 aa, Homo sapiens
MVNKLFDVLLDLVCQCFIEDFHIDAPFLQVCCSSLEVHPRPCLAWVSPAEAAEQQRQLPAPSPGSFVPEVHWPDASHRSPMRCLDALPNEEKCREAVWPQPLSRTLLISTQSQLPGLFSMNKCIDTPDSPLMRGKEFSDSTHSTFNHM

SEQ ID NO: 933845 - protein, 184 aa, Homo sapiens
MVELVYSPTNSVPAQRFWADCLEESVGRLAAEVLGQCGLVPEYTRMDVHPGSAKAGGRGNYLGGRGWCGNGMGLEPGSVRASRKPESKCQHSWCFSASADLEVCHPAELPGFGLVLESVCKESCDVIHLQILQPWLPAPAPVEGACWDDPGPSKGLWMILASWYVPVVVLEAKIHDDFQYHAEQ

SEQ ID NO: 933846 - protein, 206 aa, Homo sapiens
MRAFGGPSAAGLLDFAGGPLQIVFAWVSAAEAAEQRILLNSKCCCLIVMPMQEVDSHSLGQLHPCDFAGYSPLTAVFMGWCLVFAAFPGAQCKLSVDLEFWVLEDGGLLLTAPLGSSPVGTLCGGSNPTFPFHTALAEEVPNFPTSSCLPRPPSLYGKLQIFSHFPVFWALQIVPTSASHPVPKLLPHFQNSAVNPSGPGLFLVGS

SEQ ID NO: 933847 - protein, 150 aa, Homo sapiens
MSLVVSLISPNASTWIFQLKVLYGGLPLVRVSQPLCLPTQASVMAVAPLPARLLSHISISDCCASSVQGSMGMGATKPGTGENHLVYWFIRPWEKHSIWAAVPVFPGSLSLFPLARKGKSPTPCTSKLPPTPKQKYEVCVLGEHVRYQTC

SEQ ID NO: 933848 - protein, 130 aa, Homo sapiens
MEIILDYPVGTNLILFIFKSREPFQAVIREGTTEEGSGRWRLLALKTKEREVNNRAKDYTDPLEVEKGGNEFTFRAYRKECRSADILILAQHNIKVKDNRNNEVEISMKSQFKSESDRMDKAPKDSKKFK

SEQ ID NO: 933849 - protein, 159 aa, Homo sapiens
MGVVMYQGGFGKGNICAGKQECMFSLRAMGPGINKILKDKDIGLELVQQHDESMDSSVDKVGVIMPSLVTQGLGLIQQTQRPAPPQSITVDPSTRPILVPVQSQKTHAQGSPQSQASLCEPGSKPATRDTGSGSVHLLTQGLLKDISSKHSLGWCQMAC

SEQ ID NO: 933850 - protein, 165 aa, Homo sapiens
MLFYVCSTIVFSEQVSCFISQVPKASLTPNLDDIDNEFWNCCLDDLVLHQVDAVIGGEFQEPRVEIDCKNKLPILRGPTGPLKEADCSCRTQETPQIPGEAESVRLQETFPTLPGAESRWRAELSKIQGVEEAAGRPWKLAESPGSPFLPGTTGIHQEGGQRSIR

SEQ ID NO: 933851 - protein, 183 aa, Homo sapiens
MMIKGVGCGLENSHVKTHHLKVLSAQSQGSRPFASAAKASKIAEAGREPAGKHIPWLEDIPLKFEKEAVRVRHSSHVRLQHFLFTEDYKTPVPSSVGADAILGFSRPAPRRSLKRHVAPHCLVLSLGVLPGFKLIKEPFTSYMYCFMYQRVTSFSLKCIKSSCNPTTSGTCSQSLWRLCFWPW

SEQ ID NO: 933852 - protein, 152 aa, Homo sapiens
MIPISFLYTLLRFQDQLNHTSISDPIHISPFPPPPEQAWCEIGRQGWEGRLGLILLLMLSLRSSSSTILWWVLAYQASSYVGKPEGGSDNAISMSLAIAQAKQVVQQIGHNVGVRKDSAKTKTKTKTTQPPENIVYKAIYRQSTINRQIDNR

SEQ ID NO: 933853 - protein, 182 aa, Homo sapiens
MMKAFKKKSNQTDQIDSRENIAFSDTEEFKKFNCQVIGASVDSHFCQLAWIHTPKKQGGLGPRNIPLASDPKCTIAQDYGILKAEEGISFRGLFIVDDMGILRQITVNDLPVDCSVDETLRLVQAFQFTDKHREVCPAGWKPGSDTIKTDVQKSKEYLSKQDQNSCLGHVVTSQVYINSYQM

SEQ ID NO: 933854 - protein, 147 aa, Homo sapiens
MQKSAVLCVTHAGSSRLELFLFGHLGSTPIRIAPIITTKIIYGRIQSIQGKIPKEIAIRCSPKPKPKPTKKEEKVIAEAGEISSSVLKGELDSTCQITPHVNPTLVHVHKFPIGYLVSVSGRKGYAAVKNAMFWLSQFQFETKASWQ

SEQ ID NO: 933855 - protein, 185 aa, Homo sapiens
MRCYQKIEESGRISHTRERTFQKWKKEQFEQRLEDRIVPKVPPVRLCPQETVEGDSKNEGERRDLFLPVCFLWASAAIKLHSLPLPAAVCIQDWLADLYLRERKEREGKIETEGYQGQEFYTGLNNWPPHGFHLANTCSVALMPTTGPYGSIQWPKKSLYRSATEDGGFEMASEWLSDNFSSTDQ

SEQ ID NO: 933856 - protein, 140 aa, Homo sapiens
MDNEEIGHHGGPFDALSKDLGAEADAPGFGRKAALIGVQPSSRQSTALERDKQKRVSYSSAPAPAFIFGFLALMFTETSAGSGKPLKAPLQCSSANASHLSTGACQLNPCYIEETQEARAGARAGGNCYKHFTSNAKSSK

SEQ ID NO: 933857 - protein, 147 aa, Homo sapiens
MGFSSGDDRDWFATCVHSFLQGILMRKVKASCLEAANFQRSLRSLESEKSSLTIPFKFFITFTAMIPVLIAGPKYLLLVSGMHIWRQISSQIVFIKLYGKNPGMEISDCVPLTQNGTKFNIGLTGHLLFNDVKVPVKIMAHETLKYT

SEQ ID NO: 933858 - protein, 146 aa, Homo sapiens
MSVGSPVSCQVSAGGCERGDDPCRRCSSNTEAMQEMGSGRIAAAAELPPTGKISTTQGSTWQREHSCDSAGYGSPRWHFLPIEGCFIYIKNLLSVTSFINNVSKIFWITCCSFYTSTCCFTLYFYVMKIASFLKPASFVKPHEPIC

SEQ ID NO: 933859 - protein, 144 aa, Homo sapiens
MGVGMAKDSMSPLVDCVLDPEHMVFICPLDTNKHRAPYQEDRHNSRISRAAPLKETERGRGVIFWEEKIVKCCDQNTDRNADSEVQANEISDGIEEVIGSWSKGHPCYALAKNLATFCPHPTTLWKAELKNDDLGYLVGEISKQ

SEQ ID NO: 933860 - protein, 158 aa, Homo sapiens
MLKSEGPEKVEGRKMLPRARSIKQWENVFAFYSMETENLVTQRKEMVRTKAEELKTVRATGPPLPGRFACQPPDVTSLGYILHTITQGIGEKVFLPRPHDWHSLPWPFYLSPVLALPHPALALSRAEVCLRALLFLLLCEGISGYKLYTDEVNIVLLL

SEQ ID NO: 933861 - protein, 133 aa, Homo sapiens
MSMQRHKNDIMDFGDSVERTGWGQKAYKLEAPDTIGIMYGSSSKFKNMEAVGRRGKKDPRTDQSPHAIASLHLVLRLSSITTMPKRKPEGDATGDKAKLQRRSARLSAKPAPSKPERKPKKPSLPLQRREKRC

SEQ ID NO: 933862 - protein, 152 aa, Homo sapiens [sequence omitted]

SEQ ID NO: 933863 - protein, 170 aa, Homo sapiens
MQNLAPPHRTPSIPPPPATSVAKECSKIIEFGSPIAGPLGDSQVGGMVRRAQVHSAACGACPPCRWLFLHISSRGSQMTVIENPRGSQEISLHFSCSVVSLVIRVFFCISVAFSLALSKLAISSRSSLCAIFLPTFPFALRILSSGACGCSHSYMGCEHRSQTVVARRLI

SEQ ID NO: 933864 - protein, 337 aa, Homo sapiens
MELNLAQARTIEGVEEKQQQLPAAKRKLIYEKVKHYHKEYRQMYRTEIRMVRMARKAGNVYVPAEPKLVFVIRFRGIKGVSTKVRKVLQLLCLHQIFNGTFVKLNRASTNMLWIVEPYIAWRYPNLKSVNELIYQRGYGKISKKQIALIENALIAQSLGKYGTICLEDLIHETYTVGKCFKEANSFLWPFKLSSPRSGMKKLTIYFVENVQMCPEFLPSGGFVVSLTSGVKLQTFAVSVTALKGSASGVVFSFPWVHGLASLRSEAADLRGSCWFLPSGVVRPSQWVRGLAGFKSKAADLHRKVLHLIKAAWTQRVSSSKIYCERPKNKPSTAWEKT

SEQ ID NO: 933865 - protein, 136 aa, Homo sapiens
MPLHSSLGDRAFTELGEAHSHWGDQSSLLRLQIQLLIFIRKHSHRHIQRNYDKYLDLTKLDGPGAFSWESNLSVEGVILTKEQGRSVWASHTQRLQGGWQVMLRESRRCTCRCTEWGLAGLRGGAGSHHPGACRPH

SEQ ID NO: 933866 - protein, 157 aa, Homo sapiens
MGVGCYLSSSRLYPQHPEQCLAHLSQQRDLSGNTFKSWKVDTRLMGLTCGLRVSDLAQQLLLGSEECHFCMDDLFYYFLSTFTTILDTDNKVQAEVVSDGDEELFGKWSKGHSCYAKRLAAFCPYPRDLWNFELGRDNLGYLAEEMFKQQTPTGSRA

SEQ ID NO: 933867 - protein, 159 aa, Homo sapiens
MRGEGGKCEKTVDVKKSKFCEADVSSDLRKEVENHYTLSLPEDFYHFWKFCEELDSEKPAGKWMPYPLPLSPCNAKNQVLGSQLQLLQNYQMPLQQCSLMEIVEAQPPPGISSASEISNYCSCLEEARSHVEPGLKSSMGNAANFHGVRGVFCKGANTS

SEQ ID NO: 933868 - protein, 380 aa, Homo sapiens
MCTPRFHLGCQCILPGFIWAVSVYSLVSFGLTMCTPWFHWAKRRTLHKKSRDMEIKNYSSSTSGFILLGLSSNPQLQKPLFAIFLIMYLLAAVGNVLIIPAIYSDPRLHTPMYFFLSNLSFMDICFTTVIVPKMLVNFLSETKVISYVGCLAQMYFFMAFGNTDSYLLASMAIDRLVAICNPLHYDVVMKPRHCLLMLLGSCSISHLHSLFRVLLMSRLSFCASHIIKHFFCDTQPVLKLSCSDTSSSQMVVMTETLAVIVTPFLCIIFSYLRIMVTVLRIPSAAGKWKAFSTCGSHLTAVALFYGSIIYVYFRPLSMYSVVRDRVATVMYTVVTPMLNPFIYSLRNKDMKRGLKKLQDRIYRNGILKDGLNFERGSFKR

SEQ ID NO: 933869 - protein, 135 aa, Homo sapiens
MAMYRWGLGHRKIDQKVQGVPIPLAPTHAVSPTINARHQSDAFVTIDELILTHHYHRSLHQDLLLNVNKVATWRRLPDRSCGLHQMDTGVKYSILKNIGFYPTRQLENVHILTNLNKLQETYLWDHLAGKNFLEM

SEQ ID NO: 933870 - protein, 514 aa, Homo sapiens
MIGLLLGRSSLNLKGVQVQTGVIDSDYNAEIQIVLSTSLPWKAEPGEHIGQLLIVPYVEMGKSEIKQEDLEAQIKQSSLLGHQHQRPKVDKTTKLGKKQSRKAENSKNQSTSSPPKDHSSSPAREQNWMENEFDKLTEVSFRRQANAERFYYHQPCLTRAPQGSTKHGSSYPISPDFYKLIENKSTNIALLVFLAARGCVGDQILDQSDAPPYFESRHSSEKNKKGTVLSGSGNNQFIDLQELCPVTTAGSIGGGDPEDHQDDAGIGGSNEGQSSTDYNSTFCVNHKGVEKLLKAYTGIVGGVQKLLCSGVQAPKSRYLPFSCTGPGSPNPPQAASVIMSCFDSSVELTTQRRQRKFPRIEERKASGRGCRGRATRLLVVLLLFRGRRTCLGKVLAADDGQCNVKVGHKDADKGRNQQCSCHKDEHQIIDTSTGAGQLQEWDQITEEEKPKQKSLLLLVFREAHEKKFIDAGAPHRIGGPHRCSSQMLLTQRCSSLTGASPVSLASPGPLDLKT

SEQ ID NO: 933871 - protein, 209 aa, Homo sapiens
MLFWLFSEFNFLKIPQITTTVIAQWAHEQNGHGGRDGGYVWVQQHVLPLTRADLATATFECPVCQQQRPTLSPPMAPFPRVISQLLGGNIHGERIRLKQFLENEKVEKINLSKKEETQTGNDCDLRDTGRIVGSSSMDEVHQHLGDNACCKANISERQKTQEEIHRGLKMGVEANGQDDEQVPCYGDQGFAALKACGVEGLQIKLNESK

SEQ ID NO: 933872 - protein, 280 aa, Homo sapiens [sequence omitted]

SEQ ID NO: 933873 - protein, 311 aa, Homo sapiens
MENQSSISEFFLRGISAPPEQQQSLFGIFLCMYLVTLTGNLLIILAIGSDLHLHTPMYFFLANLSFVDMGLTSSTVTKMLVNIQTRHHTISYTGCLTQMYFFLMFGDLDSFFLAAMAYDRYVAICHPLCYSTVMRPQVCALMLALCWVLTNIVALTHTFLMARLSFCVTGEIAHFFCDITPVLKLSCSDTHINEMMVFVLGGTVLIVPFLCIVTSYIHIVPAILRVRTRGGVGKAFSTCSSHLCVVCVFYGTLFSAYLCPPSIASEEKDIAAAAMYTIVTPMLNPFIYSLRNKDMKGALKRLFSHRSIVSS

SEQ ID NO: 933874 - protein, 173 aa, Homo sapiens
MRQVDITDNCDSVWMEGKAKYILPTETIYVGEMKDGMFHGEGTLYFPSGSQYDAIWENGLAIKGTYTFSDGLHYDEKNWHYCDGYDRRFYTEILNGLKPAGMAQLTNMDPPRKIPKGYYDCGDGFYNPVTRVVKDYRNRFLRNAGRFLPTLQHVFSSPTYEYVHLYVQMYAHT

SEQ ID NO: 933875 - protein, 144 aa, Homo sapiens
MSGEDVWRGISLEPESQGDVWRGIQEAVEIRPGDIHLGVGRLRLVLSLPAVWILACLWDLEEPGAWSCQLVWALQAPGSLEAMGGAGAGLVGVAPAGVVVPSGICAFHGRGAAGMLLNTLPCTGHPCSTDVSNPECPGVDVEKP

SEQ ID NO: 933876 - protein, 147 aa, Homo sapiens; identical to SEQ ID NO: 744833

SEQ ID NO: 933877 - protein, 155 aa, Homo sapiens
MVPSGGAGGPENPNILEKLRDEGGGHWVRGSWIGPFRSAPVSRGALENALAGSQGLSNALLWLVSPAGERYPASGQIPGAPGGRLRASQALPAAAARAQFRKSQVSSGAQAEASSKRSGDHAGFLPFSADLRSQVAEEHGGGRQLKRAVGRLGKV

SEQ ID NO: 933878 - protein, 138 aa, Homo sapiens
MWLAVKVTLARHMWYQKEERRVAGNKEKLHGLEPSLSLSFCSDKDVDKNQNWSQGRRPGCRDMDRGVTSEGVEGINGDASAMVAIIYSEENRGYGETPDLVTLGPAGALPQAASGAWESFFTSLASISLSVGRKSWAR

SEQ ID NO: 933879 - protein, 175 aa, Homo sapiens
MSAHHNSYVPGSIADLVKPDIPEAVEHQDVLSGLNPSVFLDGESQDVKSIPGKDGKQPQDGVELGLQVPTGSIGLRKEGERRPRRTTEDFACKGSTVSDMKALESDLFQNLVFLDVIMVTQKNTDVCIPFTLSYQLAEFLEKSDNNDIVVLYLTLEFHKHYILSSHQLCEVWLNR

SEQ ID NO: 933880 - protein, 141 aa, Homo sapiens
MKGPPLTHYLDNVEKENLIKCGPRKKLSPGKSSWFFDVYQEWTRSLEKCTCAHQQSDRSFLFLLGAEMQDFLLMIINVECTISGSQPLQLALLGSSWYDPKLLGRTGASGPSEATDFYALPWKTPSVCAVVYRQFPAYCWR

SEQ ID NO: 933881 - protein, 184 aa, Homo sapiens
MGAAHQHNTSLPTLAIFRLISDSHSDREPNTHGPGVGEIEEQDPAIANRATWLVSGPCQQSEAADQQQISSKLCELQQCLVYHSVLLSTREYGCLTSAFQICNTPQGPFDCPLWLLHLASSMNRQQATLTAKQKGGFMAMSSFSGTSDAAAKQVGCKGEAAVGSHAPSKLRRIQSQEMDQKDLW

SEQ ID NO: 933882 - protein, 186 aa, Homo sapiens
MHKPAGDSPATPAPCSENLQRNDAVEKKNPFFEEKFKPAAEICISNRSPMLIPKTMGKMSPGHVRGLHGSPSHHRPKNLGGENGFAGKAQGPHAVVVRKGNVGLEPPHRVPARAPPSGAVRRGPPSSRTQNGRSADKLAPCAWKSHGHSTPACESSWEGGCTLQNHRVELPKTMGTHLLHQCDLDV

SEQ ID NO: 933883 - protein, 143 aa, Homo sapiens
MVSTHVAEATIDILHRTRKRFLNSYGIKKAKAILSKKNKAGVINAKGFQTILQGYSNPNSMVEDIGTGKDFMTKTPKTIATKANIDKWDLIKLKSFCTAKETINRVNRQPTEWEKTFANYASDKSLISSINKELKFTRKEQPY

SEQ ID NO: 933884 - protein, 178 aa, Homo sapiens
MIFFFRWLQKGLINCQTLFYHREGAADLVAGTLEPLQQQRPCQSNLLAALRDQLFQRQSWDTPLERALRSPGWQGAGRNSLVISDDFTFEPSRSWSYVCKLPKHEDQVLGLPQLMFFADCCLQAIELSLKNGELKSWTMKSKTPARIISRIYSRSLLNHRMETSMQEKEGQIIGRWET

SEQ ID NO: 933885 - protein, 159 aa, Homo sapiens
MRNLKASLGNSLREVEACYTVKMEQLDGIVPHLESELAQTWAEEQCQAQQYEALMNIKVKLEAEITTYCCLLKDGEDVNLGDTLDSSNSMQTIQKTTTCQTVDGKVVSETKDTKVLRHYTSRNYNCMAQERRNGKETGSDSYSGEPLEAEDAKALALNI

SEQ ID NO: 933886 - protein, 160 aa, Homo sapiens
MNMRSDLDNSKFSRILGMDDQVAQRHIINSLVHRAVHETQSGQCVKSRNKKEIVGRTPTVRIEYKELLSDVKLKRASEEMSCKTYSQEGRVKGVTIPKNPDSCPQEKDAIPKMVPIKAIYYTNYTHNPVRERRERDMKMASGQASQTSSAVNSPYAIPNP

SEQ ID NO: 933887 - protein, 141 aa, Homo sapiens
MVLGDVTLGHMITLSQFSLPDWYQEVLCSPFVSPTLTLCSFHPDAPPWMRSQILSKYSDHCRGAVTQLDQFLLCQHPSAFAWGFVEASHEKHVGFILFPISEDDKSEGIPLIILGLRTFLVCLLGSQCGSLYQNMKIAHKL

SEQ ID NO: 933888 - protein, 159 aa, Homo sapiens
MPGINIKINYKEILIGQNRRNGKQEEEGKMSLKTLCQAHYRDAVTHNLLSYDHPLTFSSEDTTILMIEEYKSVSSSEFHNQLPEGNIISGIGEGKGRTATGIFLSKYNIDKWQFSYQNGAAFIAHHLSHVTKAWEVQAISECSEFFGDSTDYIIQYLWK

SEQ ID NO: 933889 - protein, 124 aa, Homo sapiens
MVGASGFVTVNPGEDKGKELYFLVCRGHGGLMTLTGQSRKGLKFWLQLKECLGSRAQMGKLERRRDMPKRLRGKLRTGIDVIKLKEIQFRVDHRFSALFNTLSYQDFDSKFRDVWSCTELLNFL

SEQ ID NO: 933890 - protein, 193 aa, Homo sapiens
MAADLTSVTLPYFAFDLPINVQPECLALETVTASVDNSTLGPGGIMRPGAPKHGENIGVSMSLQFHIKNTENYTRMEGNNQHQPVPPFGQVAWGSPAHTTLVVATNTSTILACSTFMPNTWHAPLQNPGVALGRGNHIPIVGAPRGSFFHQSMVGPPGQNTGSASTVNSTIAIMRGLHVPSQQPSSQGHLDND

SEQ ID NO: 933891 - protein, 153 aa, Homo sapiens
MPVPWEEATGWGGKETELPTADQTRASGWDTGILSESQQEIRAGAEEVGEAAEKVAAFGEDLFCLLIGICMGLLACVHHSHNPLGFGEQTFLQLCELEVIFVESGWEIEENNLWGAFSGSRSSALVTRMHFFAVVTASINVLLILKRGKINFK

SEQ ID NO: 933892 - protein, 144 aa, Homo sapiens
MLIGTQSPEEAKQQGAAMSTLAQVHTHPARLQQCLGLTSTLLCTRVGLEQGETREWKHALLSSQRQGGILGPQELGDAQVPSCGCTAEAVPGSAELLSHQLSRGCSAASSWSHQFHRAHSPGNTSPAAAGIFAAATPDGQLLPS

SEQ ID NO: 933893 - protein, 159 aa, Homo sapiens
MWVLWELEFKMGFGWKHSQTISEYPFLNARRRPLESRFSELYQLQAYDWRMSGGGALSQLEQHKWVAERSPVCLCLGSTEAHSNSSGICTYVSDSKQRFEFGAPHAECPPSPPSYPQHGSPDKVAQLSRPTKYQKMCQGSHSHRPGVGGPKVEASVYLQ

SEQ ID NO: 933894 - protein, 155 aa, Homo sapiens
MASDGASPKPWQLPRGVEPGGTQNSRTKVWEPLSRFQKMYENTWMPRQKFASGVGPSWRTSAREMQKGKVGLESLHRVPTGASPSGAVRRGPPSSRPQNGRSTDSLHCVSGKATAADMKIFYVKNRNIKEPIHPPANIHYFMLALLWILAIPINV

SEQ ID NO: 933895 - protein, 125 aa, Homo sapiens
MFKVAHSPGWQLIRSVGWELSWGFEVVSEGMWSLLVVWASCDLTEKEKDELAYYVDKPKNYGCSKSSPNRDSFERQQIGKITDMGKVSGRVGREVANGIQNQPRLLEAERLGVVINSVYHWRLYE

SEQ ID NO: 933896 - protein, 142 aa, Homo sapiens
MKNLGECCKVSYDVTSEVLRTSLPLYFTSQEPHKGLHRFDGKKIDSGKEIASAAHWEVYQSVATERTVYMNLLAAVLRIDLQGGRAEVAHKEGGISFGVNHGEDGVDSNKTVEDCTGVGLGGEGLGIPFQTTKWRNKEISWS

SEQ ID NO: 933897 - protein, 190 aa, Homo sapiens
MNSDFGVNAEIEELPLAFLVGQADEPLPVGTTTTDPWRVLPGHCLCSHKAQGLFGQVVVNAARPETHPLGQWAFLWSREGPEMLFKSKSLGLDRGTPRACLALYPTVAELVPKEQQQNCQDKSEELKQDTEICERIKGKRARRKRKSAGPPDVLDSPAPWVMVGERRNKRRPLTEHFPEKISPKEKQVAT

SEQ ID NO: 933898 - protein, 221 aa, Homo sapiens
MSHFSSRTCEGNATNCHSCEGGHVLHHGVCQENCPERHVAVKGELPTGEQGSAEPPVGGRLSEGGWQRAVGTSLPTIPERYVSVPVIRETEECTPEFFLHDDMCHQSCPRGFYADSRHCVPCHKDCLECSGPKADDCELCLESSWVLYDGLCLEECPAGTYYEKETKECRETQGLWIHSNHPDYPVIDSTDTSKSPIPFLKHWSRSSKAVAKVLGSTPDTT

SEQ ID NO: 933899 - protein, 152 aa, Homo sapiens
MNLMSKVKRLKSLSLYYADNSTGRCERCNRSCKGCQGPRPTDCLSCDRFFFLLRSKGECHRSCPDHYYVEQSTQTCERCHPTCDQCKVSSITPFEAASRSPQLSILPPHQVIWYTNARTEAHEETPEVALHLLNSSHGVQSEGEQMVNCSEF

SEQ ID NO: 933900 - protein, 167 aa, Homo sapiens
MCPEFLPSGGLLVLLTSGVKLQTFAVSGRRIWSCSQREKFSRSPPNPKAQLASPLNGTGRQDFWAPTPGIPATQRELVPGSSPAGAECGTRSQPAPTWNPCWPTSATAPAAALASASTPPCEQREPAPASASPREGPPQHSCGLKGSWSVARADAEAKEAPGVSKGC

SEQ ID NO: 933901 - protein, 146 aa, Homo sapiens
MRRPGPPGWEEKGFGEPWGSIGYSIHQAIMTNLEAEERGLKTNSLLLNVAKGCPVQNGSHWSQQAQWFSDATGAAVNSSGFPWHIHDHKGEINLEPIKSLLIIKEAQEGATKTQQAWQEAEAQDLVFIFGAVCFIVHQKDLFQSLR

SEQ ID NO: 933902 - protein, 139 aa, Homo sapiens
MQYIRKKKQIIDKTCSLKDRRVDSSAQMERLAINRKDDASSLREVEEIATDARNEESDVKNSEEGYEERRSYGYLFLQHTLICHRRYTSLTPQKLKITLTLMNEVLTEDEFQEEFLLLFIPMRAIYYIEFCLSIPITSE

SEQ ID NO: 933903 - protein, 140 aa, Homo sapiens
MGKKGSLPQLSVQENQPPGLLIHLPGLDSRTGLQDVSLEELNGPKEYIYRLRHLGPPQVSPTCTEIPVSMLVPHSEISMHSHKPLDLGHSSIGLLWFAGGPLQIRVTSVPPWTYHQRRLRNSKDGSLLLPLGAPSQGAPT

SEQ ID NO: 933904 - protein, 138 aa, Homo sapiens
MEAAKAYGLHILELEQKLELYLGPFEPQQELELEQLGCGEQCPKAAQGSRALSLAHKTVLPSLASGPMLGGPAVKPSNTSNLYPLPSSKAASKFSAMSNCFTDEKLMSRETGLPNIMEYVCLYIISVDNKEKIPTLEN

SEQ ID NO: 933905 - protein, 148 aa, Homo sapiens
MCTLVTWVYFVMLSNLINCLSTSNQLPLYLTSPPHLAIMDFSFKQHPEFILEPLHAAFALSNSGDVIHILVLRVPQLSLAMSYVASQGLDQGRPHDPKIVPPNCSGPILNSREVWQWVSNAPQGIFGNTWRHFWFLQLGKRVLLAFKE

SEQ ID NO: 933906 - protein, 142 aa, Homo sapiens
MVNAPPRTKLKHPRLTSDCCAGSDNVVKKQLCMSVHISAKGNMLQAAEYSRMFAALMTFESCNGEEIIQKQNTKQREELTLWDGSGGSSAMSVPCPCSLKLNSSVHADPTSYCQHLHFFAWEISLAMIVYSCIPQNIPVYFS

SEQ ID NO: 933907 - protein, 530 aa, Homo sapiens
MCHLPLRPLGLTTEHGHRQLLLCPLGLTTERGHHHLPLRPLRLTTEWGHRQLLLCPLGLTTERGHHHLPLRPLGLTTEHGHRQLLLCPLRLTTEWGHHHLPLRPLRLTTEWGHRQLLLCPLGLTTERGHHHLPLRPLRLTTEHGHRQLLLCPLRLTTEWGHHHLPLRPLGLTTEHGHRQLPLRPLGLTTEHGHHHLPLRPLRLTTEWGHHQLLLCPLGLTTEHGHHHLPLRPLRLTTEHGHRQLLLCPLRLTTEHGHRQLPLRPLGLTTEHGHHHLPLRPLGLTTEHGHHHLPLRPLGLTTEWGHHHLPLRPLRLTTEWGHRQLLLCPLGLTTERGHHHLPLRPLGLTTEWGHHHLPLRPLRLTTERGHRQLLLCPLGLTTERGHHHLPLRPLGLTTDHGHHHLPLRPLGLTTEHGHHHLPLRPLGLTTEHGHHHLPLRPLGLTTDHGHRQLPLRPLGLTTEWGHHHLPLRPLGLTTEHGHRRHAATFLDTQQCCPLQPAQADPSLAFHTLHNSSCWDSAPVFSKLLLGC

SEQ ID NO: 933908 - protein, 145 aa, Homo sapiens
MCTCVHRVYMYIVCMCALCVHVCIVCECACVGRVYMYIVCVCVVCARVRVADGAKDRSFLHFLEKPPLKILIGIPGIEASGVGHQEARTTPDKDFGFFFSLVYAFAVLSLLTHRIPRGRLGVIPGASWFEFHGTLEDMNSEIRGF

SEQ ID NO: 933909 - protein, 958 aa, Homo sapiens
MYRSPEAAVFRSPEAAVYRSPEAAVFRSPEAAVYRSPEAAVFRSPEAAVYRSPEAAVYRSPEAAVFHSPEAAVFHCPEAAVYRSPEAAVYRSPEAAVFHCPEAAVYHSPEAAVYHSPEASVFHSPGAAVFHSPGAAVYHSPGAAVYHSPGAAVYHSPGAAVYHSPGAAVYHSPGAAVFHSPGAAVFHSPGAAVFHSPGAAVFHSPGAAVYHSPGAAVYHSPGAAVFRSPGAAVFRSPGAAVYRSPEAAVFRSPEAAVYRSPEAAVYRSPEAAVFHCPEAAVYHSPEAAVYHSPEASVFHSPGAAVFHSPGAAVYHSPGAAVFHSPGAAVYHSPGAAVYHSPGAAVFHSPGAAVYHSPGAAVFHSPGAAVYHSPGAAVFHSPGAAVYRSPGAAVFRSPGAAVYRSPGAAVFRSPGAAVYRSPGAAVFRSPGAAVYRSPGAAVYRSPGAAVYRSPGAAVYRSPGAAVYRSPGAAVYRSPGAAVYRSPGAAVFRSPGAAVYRSPGAAVFRSPGAAVYRSPGAAVYRSPGAAVYRSPGAAVFRSPGAAVYRSPGAAVYRSPGAAVYRSPGAAVYRSRGAAVYRSRGAAVYRSRGAAVYRSPGAAVYRSREAAVFRSPEAAVYRSPEAAVYRSRGVAAVYRSPGAAVYRSPGAAVYRSPGAAVYRSRGAAVYRSRGAAVYRSRGAAVYRSPGAAVYRSREAAVFRSPEAAVYRSPEAAVYRSPEAAVFHCPEAAVYHSPEAAVYHSPEASVFHSPEAAVYHSPEAAVFHSPGAAVFHSPGAAVFHSPGAAVYRSPGAAVYRSPGAAVYRSPGAAVYRSPGAASRGRGPGAAVFLSPGAAVYRSPGAAVYRSPGAAVYRSPGAAVYRSPGAAVYRSPGAAVYRSPGAAVFRSPGAAVFRSPGAAVYRSPGAAVFRSPGAAVYRSPGAAVFRSPGAAVYRSPGAAVFRSPGAAVYRSPGAASLQP

SEQ ID NO: 933910 - protein, 153 aa, Homo sapiens
MGPVYLGTAQIEARRNQNGTYKRGGEGATAPRATTCADPSWNGSRSWRSGVGPNPMTESLEEKGNLDTGEHPWEDRDTQGDPHLMTQTKVVTMQLQAKECQELMATTRSQEFCYGNTEWMKAETNATAMADYLGEPLTSSSPSPPLHYHFVLP

SEQ ID NO: 933911 - protein, 137 aa, Homo sapiens
MTSEGGSLRLWQLPRGVEPVNAQKSRTEVWEPPPRFQKTYENAWMSRQKFAVGQGPYGELLLGQCRREIWGGNPIQSFPGECFQLLPIQYDVGYRIAIDGSYYFEILDIWILDVFQMYNLQIYSQLLDIDGAGGYYS

SEQ ID NO: 933912 - protein, 177 aa, Homo sapiens
MQDKVLPTLSSSLLECRVGVYFGVKSCTSWSYGRASPFSSFRSQFTASYSENVSLTTRFKEVSMDENQLQLRHVGTCNNTMVDKSPIFDRSGCGGFQWNTLCDLDIPIRQAPLSICRNANILCKEAVRLSTLHASLSPEDTSPMKMQLPQSAPRKAVNRCNNADLPWGSPSCDCSGK

SEQ ID NO: 933913 - protein, 152 aa, Homo sapiens
MRTRGHREGNITHQGLLGVGELGGLPRLPLARKGKCPGPLCFQGEKMPRPASASPPWAAPTVQPVPVRRTRCLSWKCRNHPSSVSITLGAADRSCSYSAILEESAPRINFKCLLNWRSKPSVLPSKSNSTNYEFLFGVKSFGINGNDGFTVL

SEQ ID NO: 933914 - protein, 166 aa, Homo sapiens
MTPCEAKKDNSATNKDAAQSCGPLKISRKEVNRLYSNYTTVKGTSVHTDEKKQCNNSGNPKSQSVLFLPDNRTTSSARVLTKADMAEMSEIELRIWRGMKRSLTFRRKKKQTDQIQLKNTLKEFHNKITNINSRLQQAEKRIAELEDWFSELTQSDKGKEKRIKND

SEQ ID NO: 933915 - protein, 159 aa, Homo sapiens
MTETWKKVHRHQIQKSHWCSSSPKAGKQRPWRVDVQVCCSFLEVRSRPCSPGYHQRKLQNSKDFCLLLPLEASSQRGTGLMPAGALLYETFQKIEEKGLFPNSFYEASISLMPKSERDAITKKENFRPISLMNIDANCKNLQQNTSKPNTTANQKANPM

SEQ ID NO: 933916 - protein, 159 aa, Homo sapiens
MRTLFWFYMNFKVVFSNSVKKVIAAGLLEFTGGPLQTLFAWVSQRRLQNSKYCCLILPLEASYALPTDVETTEAAGLALLWWALPSSSFPGRFVYLLKTQHWWMPLPLPGCCLAGTVCHGFPWLGKGNTPTPCAFWVRRCPTLLRLTLHGLHPLPNQSQ

SEQ ID NO: 933917 - protein, 158 aa, Homo sapiens
MAKVSSGIKWNLGVWACLALLHYRYSLTKPVSWFAAPTTALSSCPCQFKCLWWSRGHLLESQRPMICHLCPLEGQPKWPTLYLDTVESHLELLRRYAPEYEQQKLEAVPGSECSGSENIEGYSFGNSYVPHFFILFTCDGSGNSNDLGNDISFIFLFS

SEQ ID NO: 933918 - protein, 273 aa, Homo sapiens
MPFSASLYILTLNSCLPLKILQTQRLNSPGLFYPKGLKLSKGTTALSEECIQPKLAYPHPRTLKQLRAFLGITGFCQMWIPRYSKIARPLYTLIKETQKANTHLVRWTPEAEAAFHTLKKALTQAPVLSLPTGQDFSLYVTEEKGIALGVLIQVRGTSLQPVAYLNKENDVVAKGDLTLWTSHDVNSILTAKGDLWMSDNRLLKYQALLLEGPVLQLRTCATLNPATFLPDNEEKKEHNCQQVHDYKPYAETLQDRTLENNTESGTGKKTSSE

SEQ ID NO: 933919 - protein, 148 aa, Homo sapiens
MYSMLVYIKKSSIAGCDEKEWTGPQITSRNLRMEQAEHLSRRSLWEDHRGRSSGSDNCQKLVAASGNWSLRGTVLWPSCPSGSGAAALWARRWQAPIWQGAAEVGSCGACSLPTTIRYLSCGICAGGMRKCSHLLVLSLAWQQQGIGQ

SEQ ID NO: 933920 - protein, 138 aa, Homo sapiens
MAYKAIYDLTIIYLIPSALLLFIHSASDTLYYCVNDTCLHKLPFFALFLPAVLNIHMTRFLSSFSREKTIFLSGIYLDVTFTAIQKGNKEAARIHAENAIHQKNQAIDFLRMSARVGAVAVRGQNAVTMGRVTSPCEA

SEQ ID NO: 933921 - protein, 355 aa, Homo sapiens
MSEIRFTNLTWDQVITLDQVLDEVIPIHGKGNFPTMEVKPKDIIHVVKDQLIGQGIIVKDARLNGSVASYILASHNGISYKDLDVIFGVELPGNEEFQVVKDAVLDCLLDFLPKDVKKEKLSPDIMKDAYVQKLVKVCNGHDCWSLISLSNNTGKNLELKFVSSLRRQFEFSVDSFQIVLDPMLDFYSDKNAKLTKESYPVVVAESMYGDFQEAMTHLQHKLICTRKPEEIRGGGLLKYCSLLVHGFKPACMSEIKNLERYMCSRFFIDFPHIEEQQKKIESYLHNHFIGEGMTKYDYLMTLHGVVNESTVCLMSYERRQILHLITMMALKVLGELNILPNTQKDSGSCAFDCAS

SEQ ID NO: 933922 - protein, 166 aa, Homo sapiens
MGKNQCKKAEKSKNQNTSSPPKDDNSSPAGEQNWMENEFDELTEVGFRRWVITNSSELKELLKKKREKNQIDAIKNDKRDITTDPTDIRTTLREYYKHLYASHRINVHHQMFWYQDDVGLIENHQASDGALNGSKNETTLLPGTFKLIRGGALAAIPHTTPLSSRK

SEQ ID NO: 933923 - protein, 303 aa, Homo sapiens
MVPAPPQLNEKVLKDKRKKLRETFGILRLYEKENPNIYKELRKLEVEYKQKRAQLSQYFDAVKNALHVEMESIPLSDMPHIPSNILIQDIPLPGAHPPSILKKTSAYGRPTRAVSILALLGHGVPRSPHGRKPLCPLSGPPPSQVVQMYGRKVCFALDLPPCRRDEDIFYSPALAQRGHDDDVSSTSEDDGYPEDMDQDKHDESTDDSDTNGSDGESEEDEFVHHDDGERDNNEEKKSGPSIQAPPMPGPPPLGPPPALPLRPPGPPTGLPPGPPPGAPPLLRPSEMPGLQGPLPQLLPPGPP

SEQ ID NO: 933924 - protein, 785 aa, Homo sapiens
MVASHLLAYFFKELNHDQVQKVDQYLYHMHLSDETLLEISKRFRKEIEKGLGSTTHPTAAVKMLPTFVRSTSDGTEHGEFLALDLGGTNFRMLWVKLFDHIVEWLANFMDKLQIKDKKLPLGFTFSFPCRQTKLDESFLVSWTKGFKSSGVEGRDVVALIRKAIQRRGDFDIDIVAVVNDTVGTMMTCGYDDHNCEIGLIVGTGSNACYMEEMRHIEMVEGDEGQMCINMEWGAFGDDGSLNDIRTEFDQEIDMGSLNLGKQLFEKVISGMYMGELMRFILVKMAKEELLFRGKLSPELLNTGHFETKDISDTEGEKDGIRKAREVLMRLGMDPTQEDCVATHRICQIVSTHSASLCTATLAPVLQRIKENKGEEQLRSTIGVDGSVYKKHPHFAKRLHKTVWRLVPDCYVCFLRSEDGSGKGAAMVTAVAYRLADQHRARQKTLEPLQLSHDQLLEVKRRMKVEMERGLSKETHASAPVKMLPTYVCATPDGTEKGDFLALDLGGTNFRVLLVCIRNGKWSGVEMHNKIYGIPQEVMHGTGDELFDHIVQCIEDFLEYMGMKGWTKGFKESGCEGEDVVTLLKEAIHWREEFDLDVIAVVNDTVRTMMTCGFEDPHCEVGLIDDFHTEFDVAVDELSLNPGKQRFEKMINGMYLGEIIESDCLALLQHLGLESTCDDSIIVKEVCTVVARRAAQLCGAGMAAVVDKIRENRGLDALKVTVGVDGTLYKLHPHFAKVMHETVKDLAPKCDVSFLQSEDGSGKGVALITAVFCRIQIFLGQHSMGC

SEQ ID NO: 933925 - protein, 169 aa, Homo sapiens
MWAFSAINFPLNTALAVSQRFWLSSASLLEFAGGPLQVIFAWVSPVEAAEQQRLLLASSSGSFIPEGHLHDASQSSPVLSVCRPLLGRVSQSGGMGVRDPLEEEVCPLAELECCAGRSAALFRAGRQECLSVLKLCPQPPLPPGALSQGDGSFMYKPLTGAAAFLSEMP

SEQ ID NO: 933926 - protein, 151 aa, Homo sapiens
MLDLFTSAYGECCQAWAPFWPREAPEMLSKSQHLELGTPNACLVLYPTVAELVPKLQDKVPFYSSLFISQAEIIPAATATRAGNVLGHIWSQHVSESHSKPTLATPTRMHRAACGDSHHELLLQELLQENTRKAKRIHRPFEGTGSLLQAP

SEQ ID NO: 933927 - protein, 341 aa, Homo sapiens
MQNEYLCYPDSLLLKVKEFSDSIHNTFDHMWRNKEYNEVGLLLLSSLDKVTKEKDELRDSNSWLWKHILSLKSSKIALKETASPPPVVSTTSPPPMLPSAFPPLSEEINPALPEATVTTSPEHIARKNNADSLQDLPSTPLLPPRPVTRLKSQQTPRGDLQKSVYALSQRPLYGTVSPIVRIHGSRNQGVEVEVVPFTITPSDPLVKFLLPFPATLSSAGLGILVPERGMLPPEDTTMIPLNWKLRLPPGNFGVLLPLSQQAKKGVTVFVGVTDWDYQDEISLLLHNRGKDGMCGIQDPLGHLLVLPCPVIKVNGKLQLNPVRAMGIRIAIKQSHDRCDND

SEQ ID NO: 933928 - protein, 145 aa, Homo sapiens
MGYYICLCLQGYLSDRDQNTDRNMDTKVPFDEDLHGREKYLIRNWKEGHTCYKVAKNLAEVSTPTVAKVGPCTAQSVALKGTSHKPWQLPCVAKSEGAQSCGDMATPPEFQRMPPRALGLRQRNAAKVGPSQRIFSGAMPSGLTA

SEQ ID NO: 933929 - protein, 143 aa, Homo sapiens
MARTKQAEDEITLLAEFFGFLLFPVLDAPPALGYKTPGSLAFGLWELHQWLSRASWAFGHRLKDALSASLVLPQNKSGTMGLPRFEGFRLRLSHYRLLSSPDCGTLLANHRNCQYDSSIPMRTGKNIHLLHDQYYSDPVGTPF

SEQ ID NO: 933930 - protein, 169 aa, Homo sapiens
MGRFFFGLKFCFPVLHYLTFLTLGVPEKQPKMDDFDDCVTDEETVGMAAKFTTHAPPEEFNEAFNDKEASDPQPEEVDGGLKSWRESCHCALRAYVKDYYSNSFSQTAKEFIKIIENAENEYQTAISENYQTLSDTTFKALCRQLPVTCTKIDWNKIVSYKIGKDMQNA

SEQ ID NO: 933931 - protein, 150 aa, Homo sapiens
MGQKTKYRGRKVGPEDRRLAYGGPAPAPVSEFPQLWVGPQSSQHFLSFVLNYRGKWRGRVRSGLSQVGQCSGSPHAEPSSAPVGYEGWFSGYWGNIPEGTVNAYAAQKSLHRECGLAGGSKPHLDPMHLARQISLPQCFASSSKLSSSSI

SEQ ID NO: 933932 - protein, 135 aa, Homo sapiens
MRAAPLELFTGQPQSTNVEAMVQTTRATATTLHAGMARSDSSPRAKVSYGSKLSLGGWLYLAMLCYRCSSTKPSGLHISWLAAPTTSLSSSPCQPVCLWWSRSHPLIGLQMPVATAICSLPDQLTHSPGAVEGQE

SEQ ID NO: 933933 - protein, 135 aa, Homo sapiens
MPLPPTKLEHPRLTSDCCAGSENFKPVDLSLLCSIGVGFTELDHLVLWLQPPFQGSEQTVSLEFQAPLRYEKKLLLLAGCLPKWLPSFVLETQGAGGVGTQGNLLDVFYNQVRVIIFYFLTIAKTPQSDITCYKP

SEQ ID NO: 933934 - protein, 295 aa, Homo sapiens
MSGALDVLQMKEEDVLKFLAAGTHLGGTNLDFQMEQYIYKRKSDGIYIINLKRTWEKLLLTARAIVAIENPADVSVISSRNTGQRAVLKFAAATGATPIAGRFTPGTFTNQIQAAFREPRLLVVSDPRADHQPLTEASYVNLPTIALCNTDSPLHYVDIAIPCNNKGTHSVGLMWWMLAREVLRMRGTISREHPWEVMPDLYFYRDPEEIEKEEQAAAEKAMTREELQGEWTAPAPEFTATQPEVADWSEGVQVPSVPIQQFPTEDWSTQRATEDWSAAPTAQATEWVGATTDWS

SEQ ID NO: 933935 - protein, 170 aa, Homo sapiens
MHLTCFSCLIVIAVTSSTMWNNSGDSGYPFYVPDLRGKAFIFSLFSMILAVGLSYMADMIWLCPYPNLILNFNPHNSPIPHVSLGGTQWEVTGSRGPFPACSSRDSERVLMRSDGFISLWHFPCSHLLSLLPPCKEAACFCFAFCHYCKFPEASPAIQNYVGTYSYKIPS

SEQ ID NO: 933936 - protein, 328 aa, Homo sapiens
MIAAGKFLNLAAEAVLQAGAARQGPCDRATDWGVLRSGSPHRMEVHGKSGLLHAYLLTPSPGAAQGQEWVLGLGSSMKGFQLPPFLAQDLCPPSIHYQRLLFDDLFGVDQVHLNSSNAVVLADSEQYHLDDLGQYLSKVFVMVNIECQLDRIEGCKVLFLAFGPLDLHWWFSKGSHVFSHRLKAAPDRAEIVKNQTQTPMMQVADLQGNVYAQPCPLSTVKVRALIGKEWDPATWNGDMWKDPDETGGIELLNSDEPFLPEEIATPLPEVAASPPPPMLPSAFPPLSEEVSHSLPEATVVASPESVARQDNADSPRDSPSIPRLLLDL

SEQ ID NO: 933937 - protein, 169 aa, Homo sapiens
MGSSPVLLLSALHESCCFLDESQCILLDDPDEELVFTCHSISSVNTKFNNYLHQKRHLRKNQKPGPVPRRKATCTGSVHQQDNRSKKRAGRKTPTLAGRHIPRKMEKEAVWDSNQYKNLTDGISELTLGQRRSHFPEGSQHLSPFEYLENIPNKDVSKQAHTDKTTIST

SEQ ID NO: 933938 - protein, 159 aa, Homo sapiens
MGSSPVLLLSALHESCCFLDESQCILLDDPDEELVFTCHSISSVNTKFNNYLHQKRHLRKNQKPGPVPRRKATCTGSVHQQDNRSKKRAGRKTPTLAGRHIPRKMEKEAVWDSNQYKNLTDGISELTLGQRRSHFPEGFPTTEPESLTTYLDLPEKQGN

SEQ ID NO: 933939 - protein, 165 aa, Homo sapiens
MKSIYYFTTESCFFQVPDHPAKPLATAYESVYNLKSCNFSFNVKCSTRSSSHWEDFSSLLSFRDVLESGYSAAAVHFRVMPEYHSGGKADGSVGRGGDVATNGDGEIVSSGTKRFIRVYKLSVPSFIKVFPHVPIPSCRVQFFSNQCPHFNSRHLVRLCLHLSLQ

SEQ ID NO: 933940 - protein, 173 aa, Homo sapiens
METECKSLENLQPGIVIEKQRAFSVEELKWAVEQPLARDICMTKRDPSANIQDNSIKTSKTSQRSLRQTLLSKAQRTKDKRMVLWARFKAPLPCADLEHCSMHPCCSSSSHGSEGLGITQAAALQSSSHKPWQLPCGIYPAGAQNEKVKEAWHLQPRFQRTCRKASGPGRNLS

SEQ ID NO: 933941 - protein, 149 aa, Homo sapiens
MIDPPTACTVCLEKTQTLNTTCKSSWEGTVPCKATRAELPKAMEAHLWHQHDLVGRDSHSPKVVPEVPRTRVKNIKIYLVFYCTIPELALRPDDAVLLTLPSPFQRKRSLTPWLLPQQVPKEPSALQSACDEYCLAYDSTSGQWTPLWP

SEQ ID NO: 933942 - protein, 143 aa, Homo sapiens
MLPALEHWTPSSSVLGLGLAFLAAQLGTLEFSVDKVIKENDELRDAVSRLQKQTLSLKSAKIALSENRERAEIAVKQTQTIIMQVADLQRNVHAQNHQVSTVKVKALIGKEWDPATWKGDIPITGQKSRRAPRCEVESVTHDS

SEQ ID NO: 933943 - protein, 139 aa, Homo sapiens
MWEDPDEAGDTEFVNSDEPFLSEETASPSPVVATSFPRPMLRSAFPPLSEKINPALPEATVMASPEAVARQDNVDSPQDTPPTTLFASRSITRQKFQQAPVEENIQMLREIGKVEWIHHFRSTHPSCEGPEDIPLTNAL

SEQ ID NO: 933944 - protein, 134 aa, Homo sapiens
MRKGLRALRPQNGRSPGSLQLQYGKATDAQQPERIPESPSPAPSLEENHRPGSQTSSHTSSSVSSSPSQMDHHLERMVSFSPFFSKPRCTQNSFIRTVFEHNITEKEMSPISNDICIFPRKHQGRRVPTRNAGW

SEQ ID NO: 933945 - protein, 151 aa, Homo sapiens
MTKSDQHTAQAVASEDASPKPLWLPHDVKPLGAQKSRTEVWEPPPRFQRMYRSSWMSRQKLAAGAGLSWRTCTTRAVQKGNGGWDPPHRVPTSALPSGTLSREPLSSSLQNSSSTDSLHHVPGKATDTQHQPMKVARSGAIPSRLLEELPE

SEQ ID NO: 933946 - protein, 146 aa, Homo sapiens
MAKNMILFFFMAVQYSMVYRHINIRSLCMHSPGLISGCHSHFYWLIVLTASFFPKLSCTFQFFGCPLFSLLAGCLRLSYPTISCTSTPVCAFKFKWWEVREQKQNKTKNQCAWPHFLYAIAPVVREGDSCAPVSTLEITWNLGHRQ

SEQ ID NO: 933947 - protein, 145 aa, Homo sapiens
MGSRRSERIDDKKAKQAFADVKKVCVVWLDQISHNIPLSQSLNQSKALPLFNSMKAERGVTSNGSSKTCSSDLGELLSTDLPDLIAKRAEVEGKTVGVPPPTVLPPWSLGPSTIIATLWLQMTINLKVQVEVDKSKHRQKVPLKT

SEQ ID NO: 933948 - protein, 151 aa, Homo sapiens
MFHRIYVYHIVFIHSLIDGHLGWFHIFAVANCAAINMRVQVSFSYNDLFSSGWVPSSGIAGSNGSSTFSSLRNLRTVLHNDFTSLHSHQQHRSVSFSLRPCQYLFIIYFFIVATLAGVRWYHIVVLICISLIISDVDHFFHMFVGHLYIFF

SEQ ID NO: 933949 - protein, 139 aa, Homo sapiens
MAVGEGNGGGLHSCCGSGRAECMHTLFWLAGKETKTRLYTHMLAKRCAGLLWAQGKLQCGEGAGGLVHGHGGPSAGALHQSGMICNTEAQLPCLPSVRSQCPPSEDLLVRQLSHSLGGSCFNWLHLVGHLAPNIQFKFI

SEQ ID NO: 933950 - protein, 201 aa, Homo sapiens
MSFPIEKASRLTVFCHLMELAVVIQFLQRVCGFSWLSWYISVTVLGAKIHSVVPLQVQWHQGCGLTLGFSPRRNTGMPLIEVVRWGQGGCAGVPGWAALASEENRGLGPAWRKAQRLFLEVGAWCWESRPAPGPCRLSRAWRQQGQGLRDSKYGNPRLPLGPLTQGLAELLLDQPWWETAGDPGEVICEKLTVLGIQIWKE

SEQ ID NO: 933951 - protein, 127 aa, Homo sapiens
MALKSSGVTIPLKLKEQIEPREMGFPGLTPLQMLPHKTLWAPPQLACCPYHFSKHLSLPTQVFMVVEGSPTAEIPEAHGKIGLLLASSTHPFPGVTGGQKQVLTQSFRNKMICLWDSLFCMFTIIEK

SEQ ID NO: 933952 - protein, 136 aa, Homo sapiens
MLLILSRIYTQHVSPEGLNIQTGNGQTIYNNRILTYNLYSNKHGKPNHNLSSNQPRWPNDLEKKTTWVMCPSREQSFVIEKALSVFQNGNLNPLTLLPSSCQKREGIVFRSSSEDLLGFLEQASTDSISSFICSLY

SEQ ID NO: 933953 - protein, 449 aa, Homo sapiens
MRDQHHPGKCHPTAGQPDSLAERVDGLQVKVTQLDPKEEEVSLQVINTRKAFRSSTIQDQKLFDRNSLPVPVLETYNTCDTPPPLNNLTPYRDDGTEALKFYTDPSYFFDLWKKKMLQDTRDIMKEKRKHRKEKKDNPNRGNVNPRKIKTRKEEWEKIKMGQEFVESKEKLGPFGYPPTLVYQNGSIGCVENVDASSYPPPSQSDSASSPSPSFSEDNLPPPPAEFSYPVDNQRGSGLAGPKRSSVVSPSHPPPAPPLGSPPSSKPGFAPPPAPPPPPPPMIGIPPPPPPIGFGSPGTPPPPSSPSFPPHPDFAAPPPLPPPPAADYPTLPPPPLSQPTRGAPPPPPPPPPGPPPPPFTGADGQPAVPPPLSDTTKPKSSLPAISDAHSDLLSAICQGFQLRRVEEQQEQEKWDVVGNDVATILSRRIAVEYSDSEDDSSEFDGDDWSN

SEQ ID NO: 933954 - protein, 163 aa, Homo sapiens
MHNSFICACPKYCPGHAFLSRGGSRHNPKVLRGPRENEMLALAASKPHAHSSSSIPSMCLPHAGEAPTAGMPLGEAKEQTCRNSSAEAPGQSSGAENSTSQSFHRNLHVTCEMQTFQGELGVTRTLWLLSWNTSAPECLPAQVQRWWPWMWPRQTSASPSATL

SEQ ID NO: 933955 - protein, 146 aa, Homo sapiens
MTTCRYFTYMIFFKETIILTEALWGRVRVSAVGPRMLVGAMWVMMTQRDKSSQRPPETPLERPNTNMCSKGRRQDQYFFAKLRVNTQRETKLRQKNRTGTNEKDPGPSSWLDSGICLYKGSTVVKSMDSGTGPLTFKFWLIRFPAV

SEQ ID NO: 933956 - protein, 151 aa, Homo sapiens
MRECRGNVRRVEEELGTLEVLVLGPLGSRPWDLCQWHPSSQALGLRLVDTPGRRGKAPIYDQSQSEEEFNGKECFHHDWYWLDREQMAFKRDISHARQYNIPDLLLAKLNQPSFSAIGKSVIQQFVSNALKVPGPLSLPLTSVAWGPPPFS

SEQ ID NO: 933957 - protein, 150 aa, Homo sapiens
MICPTWENCCRGMAVQELGQGTLTTKKKENKPPIKYITFGLSRDVNFAKLHRNPTAPYGNTFRNACSLPKQLKNTDTPFFPLDKAVVFVPQVATMWECCGVRKYQHPKCRSHLLSISYEGAINHSPPSYLSPVFVTDKLFLQILRSISGW

SEQ ID NO: 933958 - protein, 176 aa, Homo sapiens
MWENYTHHSLVDKDKSKAVCSPFSGPFSLVSELPDLKLKAGPGPSWSFTPDSDYPCPAGCRRKLSLSLAPQLGADALTPNVTAFGDSAFEEVMEVKQGHKGGAITTGVLIRKGRDTRALSPLSSMHRGKAICKGEAVELSDSCWYCAVVPSWALFIVGLQMVNTEKGVMGLETGNG

SEQ ID NO: 933959 - protein, 169 aa, Homo sapiens
MVSLLSSLCILHKRTSADARGLSPRSERGPSRGDLGEYWKDGAKETHALPIRQHAFHGSLNALLLLKACSESFSFGKGLRDFMLLSPQKAGNKDPTLHNPNHTGKRQSRAFTKNSDVQCGGQTSLYRLQIPNELCLIPPVLSHHLGPAQKRISFGFFADHTIALHNLSL

SEQ ID NO: 933960 - protein, 148 aa, Homo sapiens
MTVKHTFLFGVEGGCGQSGATRVCPNPWRALYKPLNYLVGWDTCANCGMSVGEILAHHRPGVGEFRDDPAQPSLRMQNMRLRDVCIEELDTHTQTHAHKHMHACTHARVHALTCTQARTCTTLRTLYYFLLASTVSDENPIVIQIGVP

SEQ ID NO: 933961 - protein, 183 aa, Homo sapiens
MPIVIPVEDASHKVVLGMQNQQGLMMEETGVRVTDTWFSDLGDRVGGGVVTEIEVPRKRSRFGAGNDKCLNYLVGWDTCANCGMSVGEILAHHRPGVGEFRDDPAQPSLRMQNMRLRDVCIEELDTHTQTHAHKHMHACTHARVHALTCTQARTCTTLRTLYYFLLASTVSDENPIVIQIGVP

SEQ ID NO: 933962 - protein, 193 aa, Homo sapiens
MSIMQKGIGRGRSCVGVNVKKTVRYGQRQIRKTEFVAKNQIFCGNGSQEDKVKTSEKSYQRMEQRKYEKDGDSQVIDGKTVRDEQSQIMCEYELQKDSKDRGKSCAGRNVKQTVKDGERQIICEDICQEDWKRWAKLIMCKYECHEHSEAATGRLCDQGCGWPHAPHPDHEQGKEGVSLIHWEIKVFASGHGG

SEQ ID NO: 933963 - protein, 177 aa, Homo sapiens
MDRDRSCVSMSLTKPVRDGQRQVMCGMNVRMTVTDGQRQINVVSMSGSKKTEFVAKNQIFCGNGSQEDKVKTSEKSYQRMEQRKYEKDGDSQVIDGKTVRDEQSQIMCEYELQKDSKDRGKSCAGRNVKQTVKDGERQIICEDICQEDWKRWAKLIMCKYECHEHSKRWAEADHVCV

SEQ ID NO: 933964 - protein, 141 aa, Homo sapiens
MSDGPVQDRYAEEGKQVQKSRTARVTEKLPCPQWSQLPARLKWVSLKVISRGCWQTPHLPPADAQKPVLCSHQKEAASPHLPPPQIRAQGLLGQNLRIQVYWQRSVASVASRLYASKDREEPRRAGMVASTNNVQPFRTHQ

SEQ ID NO: 933965 - protein, 178 aa, Homo sapiens
MPPFFSGTRGGLERGQHIEWGKENGASIGQACQKQVTGPRKAHGSKGTHHSPFEIQRNVIHSNFKRLDFNGSINSLSVTQQTCDVNTPNMSYFQNTGAGAIAESKEQLPPFPLQLLHCQPTLQLTARGGKAFIMRLTYSLLQLCRLLYCTLVINGMDHEAKLPDFEYQLYHLRASLYL

SEQ ID NO: 933966 - protein, 160 aa, Homo sapiens
MMVHSVLPYCAACEQGKDNEHLKIALQLEVQLGLTPLLEGWGLRYQLPEEQFTFRSQGKAGMLSAGPCEKGSSSEKPHPFPGEAQSHWAARLEDGSLDRGPSFAPSHGYPSLALHPLVETPGQLGEEPLPGQQEGGASLSEGGRLQLMVKRPPGMEIGRD

SEQ ID NO: 933967 - protein, 157 aa, Homo sapiens
MQVRIASICPSVYYVYSVGKFVKKSFIWLMVLQPYKKHGANHLLLVRASGCLQSWQKTKGSQNVQRSSGEKTREKEGREIVEKYVNGHTVVIELHWKTRVKSWPGEGLVISWRRKLKALLYSLCYVLSGFSYLLLPTPPHPTPSFAYFLCTYCVLFA

SEQ ID NO: 933968 - protein, 141 aa, Homo sapiens
MRKNQCKKAENCKNQNTSSPPKDHNSLPAREQNWMENKFDKLTEVGFRSHVQEITQSCSICHSVSPPGSLWPPPFPTHQAQGQVPRQYWQVDFTHMPPNKRICYLLAFVCTFSWWVEAFPATSGGANVVTQTLIMHIISHF

SEQ ID NO: 933969 - protein, 213 aa, Homo sapiens
MISCMVVVLRVDVAEVALQASPSGPWCHAGPSKPEFQACTSGPRHQATCADKSSSYTPRPGQLPLIQVPGLLWQHFYPNGPGLHAQPSDKPVQADLSSKFAPVVPNTSLPSADRDHRPTSDAGWSPQTQALDTFQCQNGPCGPILQAQFCPSIREATTDPGLPLWIHAPSLPQWTPVPCWPHRPRHQFYPGLTVCRQTLAAGPSTVPTYYVCP

SEQ ID NO: 933970 - protein, 148 aa, Homo sapiens
MGWALFWKACPKGAWSQLCYGHTVLDSYAPPGNIRSHCDREASPDAVGGTIQGFLRRGHLSRDSQVTWELCEVVGEVFKGPANSVHGSRGQREGNLESGRGRRRVQGSEGRECFMEEDTAACRYKASPEWSLVRVLKPAALQGLSVKQ

SEQ ID NO: 933971 - protein, 164 aa, Homo sapiens
MPVAEQTVVGTGATSHAFPPEPAMSFPLEPGLLVLLHGAEHLFLEHFISKNSGLPLPPGWLTKYILPNILTVEGVQVLGVLEKVLDKMHKQSKEGTKGLIESESALHSVGVGLSIVAQRPCYRVLLANKPPGRENKKGCYQKNWSPIMGSIPVWYHEANTQNRK

SEQ ID NO: 933972 - protein, 166 aa, Homo sapiens
MKLLPGLTAKSLSTRSCAGISADQSRYSFLALWYCLVDLLLPPFHPAGFSLPDPEDLPLTFQEFCELDDVTLGACSWPWWEYLYDGNQQTLEIRFFVVVKSCLLNIYQCTTSHTIPSSMNSKKDKLKDIHTNTYHNQIVQSQRQNIESSKEKQLIMHKRSSIKINS

SEQ ID NO: 933973 - protein, 154 aa, Homo sapiens
MLNKLPADSYYQPALGPTALHYGLTEGTIEREWELAIGHGARAVVDKEIALEEDVAVRGVRQDGCVIKKVSHLLHVGCLQWFTLQGGRPPWYQPGYRLLQRFVKNRLRRQPSEMMTFKGESDNGAGEVYLGIMGFMVLEKADIYGVLTNCRPVY

SEQ ID NO: 933974 - protein, 152 aa, Homo sapiens
MEGLMDMDMSPLRPQNYLFNCELKADKDDHFKVDNDENETSGSKFPRKKVKLAAGGEEEDDDNEDDDDDFDDQKTEEKAPVKKSNPLPSVAPGESWPKEKFVQDLEDRNEVAISLSEGRCYMQRELDIEVPADSSLFLLFSIQNSALLPNCQ

SEQ ID NO: 933975 - protein, 714 aa, Homo sapiens
MAMNFGDHASGFRHNDVIRFINNEVLMDGSGPAFYVAFRSRPWNEVEDSLQAIVADSQVPRAIKRACTWSALALSVRVATRQREELLHHVRRLQRHAEERQATSWALTSQLQQLRLEHEVAATQLHLAQAALQQALNERDGLYGRLLQIERFPQAAPLAHEIMSGPQAEQNGAAACPLATEQQSDMVAMGTHANAQMPTPTDVLYVPGPLSPWAQGMQPPLPVPHPFPHPPPFPMKFPSLPPLPPAVVTGAEAAAVPLQMPPTEIHPPCPWPAVGFQEEMAPLWYQRSYIQEEDSKILQGSFPLGDSRSHSQGEGSERSQRMPLPGDSGCHNPLSESPQGTAPLGSSGCHSQEEGTEGPQGMDPLGNRERQNQKEGPKRARRMHTLVFRRSHKSEGPEGPQGTVPQGDSRSYSQEGCSDRAQEMATLVFIRRCKPEGPKRPQWTVPLGDSRSHIKEEGPEGPQRIVLQGDNRSYSQEGSPERAQGMATLVFSRSCKPEEGPERPQDTPLGDSRSHIKEEGPEGPQRIVLQGDNRSYSQEGSPERAQGMATLVFSRSCKPEEGPERPQDTPLGDSRSHIKEEGPEGPQRIVLQGDNRSYSQEGSRERAQGMATLVFSRSCKPEEGPERPQGTPLGDSRSHGVRESPKKWQPQRQKAKKPKVNKVSGSQQQEKPASFPVPVNWKCPWCKAINFSWRTACYKCKKACVPFESGGQTQ

SEQ ID NO: 933976 - protein, 158 aa, Homo sapiens
MVWLLLIVLMADTLSKVCLWKLASVKENCLFQGDGISLPQEGIFPIGPDVRPINTDCTQSDEVLDPTLSGNHCGMNYFGECESQGCFHLYADSVEQGSPTPEPQTGTGPWPVKNLAAQQEVGNRRMSEVSPVFTATLHPLHYHLSSASCQIRGCIRFS

SEQ ID NO: 933977 - protein, 140 aa, Homo sapiens
MCSLMREHVSEQVQDPASHSGHRHRSKLCAGPVARPGIWLPPVTITKTARPTPLLPPPPQPQCEDDEDEDLYVDPLHSMNISYHYAKMSIIDFPREDSDFLPPRQFEMFYVRNSGQNFIVFDRTSNCFLYHDGSSPAFVF

SEQ ID NO: 933978 - protein, 175 aa, Homo sapiens
MAGICTVCSWNVGKGVGKDSGTHVQACHMVDILLHGKESRKYFYGNLTLKLRPDGRIQLNLEKKKGEISEEGIVLTKRFVQRKHDVLRKLKMSALLLRQKDEEISSSGKTQNIKYSPPLNNTSLNFTGPLIHGFSSASATPETARPSPALPPPPQPQQEDDEDEDLSDDPLPLNE

SEQ ID NO: 933979 - protein, 163 aa, Homo sapiens
MGTARFSSPKHNTEYNFDATQNVSVEENNIGLWSKLKDYKENGDKYKFSFKIPTDWFISGDANSQSPCFPVMTAKNVSKYYQMSTGDTIAPGESPHLPCELDTNTSILERRKLSMLTKNKIRSVQCGKLHTGLPNVTGLSDLGCPETDINQSRRNVEKPRSPV

SEQ ID NO: 933980 - protein, 273 aa, Homo sapiens
MGVRASRTQGMKIQKSLIQFSLRGHGGFHGVRGLTPLIFSWLLDVLEESTAATLVLHLQETLVALALFLSQFAEEVAHAFQSHMIAVEIEAQREVGVGGLQVQIDQAVDGCVHVSGIILTNLGAHEGANHKNGAGRSQKQEMAKKMVLEVASGEEIGGRSEAGRKSPRNCSVQTLLKQETDPWDRRAAIQDNFPIRAPEEQDVRFWFMDHIMDPSLTLLNAKIPPFRFRHQMGFRDQLGYVLGQHDIFNGHSPVKSSSRVFHIAEASSIPPGS

SEQ ID NO: 933981 - protein, 157 aa, Homo sapiens
MAVSAKQHQQPASHSLENAVPPPCDASAPPSPSTMIVSVRPLSPSQAIASPVTCTYTSRWPKVTEDPQKKESANSVPHVHKLCSRVSPVCGNIGCQHTQGAIDEPQSRKTTFVLMVSPLTGAQTQNCYLLIINSLSCHYDMVFFINGNILCSEVYCV

SEQ ID NO: 933982 - protein, 137 aa, Homo sapiens
MEYYSAIKTNRLTFANKKKKRKKMKEEEEESAAKVKKKRKPARKFGLEGNISRLISESDLFEEDVAAKRTCSLPVVSKLTRECGPLLVCRRDHQGRKVVGGGGAWEGWSCSEATDSGEIMVWRCSWSLSALVSDLLQ

SEQ ID NO: 933983 - protein, 135 aa, Homo sapiens
MVNAIATQRRDTGGEIHMQATLWSLLPMRGHTGYTFFPAIKTQQHVCDYFCSGKPFLDSMLRAFIESWSHRYPPPSMFRNSKHTKRKYVLSVSYVVCTNCPGRVIRPYELGNIENTLRIEVPRCQPKTNLPSRPF

SEQ ID NO: 933984 - protein, 137 aa, Homo sapiens
MGKKIIGLAKSEKSPLETFWLLYKQSPIYKELFFYTFSYEVGCLEFQVLSPNWNEMIKDVLSQELDQQFSKVEQEKKNSKIKRVQDLVVPFHLLNLTNILQIEEWAYRRGHLDQKGRHTENIKTWRKNTVVVYITRA

SEQ ID NO: 933985 - protein, 133 aa, Homo sapiens
MSQGFQLLPRRCSVEALCWLLVEVLFNPCGPGKPKDWTSLKGYILEVYLSKVGSCRWVLGLTNFKNEAADFHGHPNCCWELGNDRSNYFLLDRGKEGALQLKPAGLRIFDRKATGCQWPQCFRATLLFTLTVR

SEQ ID NO: 933986 - protein, 254 aa, Homo sapiens
MKSTVEVGKILEWGRRGGKVSAQGLWYSLATTPAHSSCAGSSRRDVSHQRSLQGMSALFQADTRRAKLLSNHSLRCPAASSLYCPEFISKLLSDRSFHYPAASFPLNVQLLLSSMCCPATPHQSAALPVELGVFTGTGWEHGGPKGNIQLSGLVWGTSWTKSLSNFSFSFSLWLDESLALWFWTADFPAGHSCCGTWKIEVVRDQPKLCLDKKQLLSKNQCETGNEDECVTVNSLLAVAVPKWLSVNHLSGESG

SEQ ID NO: 933987 - protein, 155 aa, Homo sapiens
MSCSVPANNSDIFRWPWVLVEVSLRRKGLCTLEELIYQSIQNQVFLLEKYWQAASFWKLSYCPHPFIATPIIHQTGDDPFRTNPEMKTCGAEPQPKCNMSERRLRKLVTVDTSDISAMKKVCKLLMKPGLILSTSGYLAISGEIFDIQIFWYNKG

SEQ ID NO: 933988 - protein, 137 aa, Homo sapiens
MLVKTKNPDFRAEAELWGHLEHSSHPEDTATRSHLGSRDSSLHQTTKPASALILGFLTVRNKTVLYQLLGVSQSVNLSSKSGHRNLPQPLRKHKVNTFCEVRDGLSSGDSHRRSLLSRRFLSHARGRHIHHFLKMVN

SEQ ID NO: 933989 - protein, 138 aa, Homo sapiens
MSSVKAGTGHLDVNTVKEMKNAFNELITRLDMMEKRISEPDSIGIETSLTEKQREKRLKKSSRVVKNCWTIAKEVKDLYNENYKTLIKEIKQHTKKWKDISCSWIRSINIIKMSILPKALEGFNAIPIKILNTFFTKI

SEQ ID NO: 933990 - protein, 138 aa, Homo sapiens
MVAAAASPRAQFEAAAAISTRTWPNGRVQPSIKLSKSHLGPATRECGASPRQASLARSCEECCPLESQLSLTAARGRVVGIVLNTHRISRFPCPSLGGWQLQLCQSELKVRCISALNSQNDTLGLGPEDTWESKYQGD

SEQ ID NO: 933991 - protein, 170 aa, Homo sapiens
MIWAYCVGKVCFIDLSIMLKAIGGMWANAAVQLQKCVYSVSREGPHEALILLMESTSSSDMSAQFRTSAIHNLGYGPKTRPSNLNTQRQGAWKCVQLVNCTVKYGGIPRSHSRNYLMIPQVPFKCTPGYGCIPFLSMILPNLFSQKTWKFPARTLRLCFMFGFLDCIQSD

SEQ ID NO: 933992 - protein, 134 aa, Homo sapiens [sequence omitted]

SEQ ID NO: 933993 - protein, 139 aa, Homo sapiens
MLMLIMLMRATPLRVEVESQARPQTHWKEETPDTSEHLKEQTPDTSSLRTVTLTARDVHFLIPVICEYVISHCKGDFANVTEVKDWRRRDYLGLSNKFQPNYEPLKAENPSWLWSKDMMAKGLETCNDTHFEDGGKGHE

SEQ ID NO: 933994 - protein, 172 aa, Homo sapiens
MPKPVQLFLYLTSVFWWRDHPIKLVEKTEKERRRRRRRRKEEEKEEEEEEEGEGGGGGKKKKNKKEEEEEEEKIRRRRVTRDLSLFMQLKRQGQIQEVHVQICYTGILHDAQVWNTDSYPTEEHNTAKLKMPSNPLIQQVLLHLSRNNEKVTSSHMRVELLESKDREKFKNS

SEQ ID NO: 933995 - protein, 138 aa, Homo sapiens
MERSCPLSVSSELLWVTRKREERMREELWPFREPRPMSSPNQGCDTFFRTFQFLVSPSFWVPHCDPHHQLWKLLIVCLVSHSLAGSQRPCPCLDLPALLRLACLAVCSAWTPHLFTHPLPLCTWLALVRHGIQASSGS

SEQ ID NO: 933996 - protein, 162 aa, Homo sapiens
MIVRPLQPYETVSQLNLFPLKITQSQGSEEGRKMWESLELSRDLLNGFDQKLDSNMDNKIQVEVVSDRDEELVGNWNTVDSCYVLAKRLVAFYPCPRDLWNFELKRGDLGYLAEDSSKQQSIQEVTWLLSKAFSFIRETEHKSLENMQPDNLIEKKNPFSEE

SEQ ID NO: 933997 - protein, 152 aa, Homo sapiens
MNYSKINLAALLVTYEVLWITNCLHNTNLCQISSVSPSTITFHPAFCPRGFLSPLASDWVQPVGSPSRIPEEGTRVGLGYLFSWLFLYEVTSAEIYTRNHMSKHKASWAKQITRQVNNGRSLGMKLSKCSNPFLLPPVATRRSYNGYSEIEK

SEQ ID NO: 933998 - protein, 180 aa, Homo sapiens
MPEPPTHSMGSCAAPASPRSTTPCSTAPSPIDHPRAEECERTAQDWQAAPPAAPVPDPLGGASWAPESGGDVETVTLTAKICSFTPEASETMSPPGGTNNSRRAALRAVTLTARVCSFTPEPARPRTHQKEETPDTSETSEGTNSRCATLRAVALTARVHGLILEVSETKNPPIPDTLGL

SEQ ID NO: 933999 - protein, 164 aa, Homo sapiens
MNQGDSNPAATPHAAEDIQGDDRWMCQHNRFVLDCKDKQPDVPFAGGSVVQLLQPYEIWRELFSPLHALNFGTGGDTTRHVLWRLKSGELGNTKPKVIVFWLGRNNHENMAEEVAGGMAAIVQLINTRQPQAKIIVFDLLPQVMNVLCSTGKANGSAFVCWRRG

SEQ ID NO: 934000 - protein, 136 aa, Homo sapiens
MRNGIDSYPVCSLLPCEDSEFGKSFEGETSCAFSILQDSNFVITVCQKFCQGPSVDSYLSAGSRSAKGGWKMWLCVAVKKSISSSSPPRPSSNSQAQIHVQNQDIFSETAVEPQFTSERLSSFWNCIPSSLAYFYT

SEQ ID NO: 934001 - protein, 264 aa, Homo sapiens
MQLPDLLFIQLPEEVDLVSQPVQARLQLYLVHVSFIHILLEEDKCICHRFTHIDLILILVLEVLHQPMNVANLRLQLQLLLAQSLQLPPKVVDVTLEHVVHVALSHLLLLQEAPLGLQHLVLLLQERYLVDEGDKFAYERLDMLLLLGAHGLDVGVHLQVKAAQQTLVDHDGGDASDAAGPTIASAQATPEAAAAHSGEAGEADAGTGPTRVEAAAEGPCARGGHLVRLLGHPDGHGGGRSGGSSVEVFPNRRIHVNVYCFLIL

SEQ ID NO: 934002 - protein, 183 aa, Homo sapiens
MDLCPFKQGLHQRTGLLQAGRPRGPSAAGLLEFARGPLQTLFAWVSPAEAAEQQILQNSRCCCLILPLEALSQRGTWLYEVSVGPYWEVSPRQQLQGLCVCMPAAEGQPPFSRQTLCAPQRQKSCPCQLPMKLSLPAQMSVGVMGSPPVRIPEVYGESGLLHAYLTHPFSMSYSGPGMSPGAQ

SEQ ID NO: 934003 - protein, 147 aa, Homo sapiens
MQSFINRKMWGSFELPRDSLNGFDQNADSNMYNKVQAEVVSDGNKELVGNWSKDDFCYALAKRPVKFCPCPSDLWNFEFERDDLGYLVEEISKWQSIQEVTEHKSLENLHTGNVMEKKKPFSGKKFRLAAEICISNKEQNVIYQDNG

SEQ ID NO: 934004 - protein, 157 aa, Homo sapiens
MLRGQESGKSRSEDTREEAVAEVQGTLTFGQTSRRRRSSSKREEATNRLKTGRGLWNQLTKIGATPFHIQGWSCEHEDLYRSWKIVGFGPGLGIELPPTWSPEPGQITQQAHLLMNAREKEEQSYFVSWPSREYDCRGTYRVENEIFVMLSLSHTTP

SEQ ID NO: 934005 - protein, 745 aa, Homo sapiens
MSSSGGSSVTFFLALFLADKCSGCTWRMTEKTNGVKSSPANNHNHHAPPAIKANGKDDHRTSSRPHSAADDDTSSELQRLADVDAPQQGRSGFRRWVPPLPCCFPFLCMEPVRVATTALLFTVPPVLSTKTSKEHCHWIVRLVGIIREWANKNFREEEPRPDSFLERFRGPELQTVTTQEGDGKGDKDGEDKGTKKKFELFVLDPAGDWYYCWLFVIAMPVLYNWCLLVARACFSDLQKGYYLVWLVLDYVSDVVYIADLFIRLRTGFLEQGLLVKDTKKLRDNYIHTLQFKLDVASIIPTDLIYFAVDIHSPEVRFNRLLHFARMFEFFDRTETRTNYPNIFRISNLVLYILVIIHWNACIYYAISKSIGFGVDTWVYPNITDPEYGYLAREYIYCLYWSTLTLTTIGETPPPVKDEEYLFVIFDFLIGVLIFATIVGNVGSMISNMNATRAEFQAKIDAVKHYMQFRKVSKGMEAKVIRWFDYLWTNKKTVDEREILKNLPAKLRAEIAINVHLSTLKKVRIFHDCEAGLLVELVLKLRPQVFSPGDYICRKGDIGKEMYIIKEGKLAVVADDGVTQYALLSAGSCFGEISILNIKGSKMGNRRTANIRSLGYSDLFCLSKDDLMEAVTEYPDAKKVLEERGREILMKEGLLDENEVATSMEPTLLPPSSQHPKQQTPGTSLWIQWYMKREKGRQQQFDQWKGKLDWDKAAQGRWLELFSFCPCYKLGSTELFPIRQPTRSSQ

SEQ ID NO: 934006 - protein, 136 aa, Homo sapiens
MKLSQAPIFTSHENSNLFPNFCDFLGGWKERYLLIEALYSGFLLPHTHPRICNESQPLLQLSSKHTTLMQPSQCSITNTAKYSGVPRVYFSHLYVCEYTMFSSHLELTHYQKVIIKPLMNDLPHDPNTFHQAHYRH

SEQ ID NO: 934007 - protein, 225 aa, Homo sapiens
MASISFHVAAKDIISFFFMESYFPFTAICGEAATKLQIFVKTLRGKTITLEVEPSDAIENVKAKIQDKEGIPPDQQRLIFAGKQLEDGRTLSDCNIQKEPTLHLLLRLCGVAKKRKKSYPTPKKNKHKRKKVKLDVLKCYKVDENDKISALLTNVELECFCMEVKTNLEFLQRKFQAPGWPREVNEQLAYVPELFFRNPDPTNRICWHGPQTVSVSQENVFKLPS

SEQ ID NO: 934008 - protein, 179 aa, Homo sapiens
MCAGISTPSHLQKPIATLTLSLAKENRLKIKVKDDEGIQPAGPNLITWCEELFLAVRLDCTGNGDNGNDGDGGDADDGDDDGDGDDGNDGYGNDGNNDSNDGDNSDDNGDDGNNVDDGGDDDVGDDGDDDRDDGDNDNDDGDGDDDDGDDSDGVGDDGGNDDKDDDDDFISVLLIYFKF

SEQ ID NO: 934009 - protein, 744 aa, Homo sapiens
MALVSQSTEDIRRKLQKQPEFVEKAVRKANARPGENADLLATAIRGIPPKGVGKGGSGKNTQSNRPRLQRNQCTYCKEIGHWKDKCPQLKEKQGTKDYRSVQDLRLVNQATVNVHPTVPNPYTLLGLLLPAEDSWFTCLDFKDAFFSIRIAPESQKLFAFQWEDPESGVTTQYTWTQLPQGFQDSPASFGEALARDLQKFPAKDLGCVLLLYVDNLLLGHSTAVGCAKRTDALLQHLKDCGYKVSKKKAQICRQQYQSLLCENPHITIEVCNTLNPATLLPVSESPVEHNCVEVLDSVYSSSPDLRDQPWASVDWELYVDGSSFINPQGERCAGYAVVTLDAVIEAKPLPQGTSAQKAELIALTRALELSEGQYFYISHLPALAKAVAQQCVTCQQHNERQGPSVPPGIQAYGVAPFEDLQVDFTEMPKCGGNKYLLVRVCTYSGWVEAYPTPTEKAYELPMSTVFEMRLRTEGWWGLINDTSKVLVRTEEKGVPKHITLKFDACAVINSSELLGFPVYASHEKRSIAVGNWKDDEWPTQRIIHYYGPATWTQDGSWGYWIPIYMINQIIRLQAVLEIITNKTVRALTILARQETQMRNSIYQNRLAFDYLLAAEGGICGKFNLSNCCLHIDYQGQVVEDIVRDMTKLAHVPMQVWHGFDPGAMFGKWFPVLGGFKTVIIGVIIVIGTCLLLPCLLTVLLQMIKSFIAILVHQNASAQVYYMNHYRRVLQEDMGSENESENSHY

SEQ ID NO: 934010 - protein, 167 aa, Homo sapiens
MRAAMGATPYIATGLELPKALGAHFLQDALDTGLGTCCIGKIKVFRTNGHNTLKRGVSQSAFLGNESGICDHSHMIAGAAIQQGACLSIGILDTLIKMLPWQHSFILLDDPDLLENALHSLGGFQENETLIEMFLMGEIYEKNLVVRDMLSSNVVPQQGVLVIRRTI

SEQ ID NO: 934011 - protein, 264 aa, Homo sapiens
MAKVGGGVSELKVSLLQSLPFGLDQQGLAEGEHLLLGSHHIAFQHDKVIGHFATVDKATQRVDALVRQVIVNGGIVLDQFAVHDRVALADLIDLLVDLTFALGHPDDFDHLILPKHLVDRYLLLEPLLGPVQLLSHSASVHLDLHQVGFLVQRKQAYLGVGNDADDLAVLLHAAEVLLHLLFAILFLPFLAVLGKGLLLRFMSVLIETPFALTADVLSKDGLESPDASKGFPISHNAHNHHGWLSPQWPQPLPPPSYSPWILAY

SEQ ID NO: 934012 - protein, 178 aa, Homo sapiens
MTQAAPHHLFCSHLYSFVSLSSCGTRKTGSRAVQKGIVGREHHTESHTGALPSGAVRREPPSSRPQNSGFTNRLHRAPGKATDTQRQPMKAARSGAVPCKAIGVELPKAVGAHLLHQHDLDVRLGVRSDHFGTLWFKDCPAGFRNCTGPVAPLFWPISLIWNECVYPMPVPSLYLGSN

SEQ ID NO: 934013 - protein, 319 aa, Homo sapiens
MAHVYKNLTKKKQTHRHINILFNYSHSYLEDVNMLEILQHLALKPTGNEDEREKTHFGSLSGVTVHWGKGNDQTFQGLVDTGSELTLIPGDSKRHCGPPVKVGAYGGQPFVHKIGHAQQHSIIRWKRYICDQARAVLEGTTVHLVVHFARKEKWPVVRSYTDSWAIDNDWLDSQGLGRSIIGKLVTKKFGEEAKKGVTVLVGVTDPDYQNEISLLLRNGSKEELCPGNFAFSQNCYEVHLEVSFSLWSFPNSTGIPSQGALQDKVRNGFPGERECQQGSSCCFLYPCISLGSLNSSQLQELKIKSHIKDIMNEGMNGTK

SEQ ID NO: 934014 - protein, 213 aa, Homo sapiens
MQDCPCRLMFQAYPNGPRAPGQPPWLWASGQPAAVTSSSIPVLQTQALHLPQHQASQRLQVDPHGPRCQWACFSKPKVQANFNRPWSQSCPKHLGSRYTQEDPGFRPHGLRLQVNLNARLILADSGLRPTQVPGQPMPDRFKDSPHEYRLQALPCKPVPPQWIQAPDPILWNTHQAHQAAALGTRSTCLNSSSKPIHGPGQMAAPEFPDSLTN

SEQ ID NO: 934015 - protein, 292 aa, Homo sapiens
MLVSFDLHDSFASVPSAAGLLEFFGGPCETCLPGYHQWNLQISKHCCLFLPLEALSQRGTRQMPSGALLYEVSVDTCWQVTPSQEAWGACRQERLSLLKLRPQPPLPPGALSQGDGSFIYKPLNGAAFFLLEKLCPERRNLERQSSYSGYAESCGSISLPSPPEQVFYNTVLYGKMVLHSSPADLSRAVHKGNGGWVPPNRVHTGAVPIGAMGREPPSSRSQNGRSTNSLHNAPGKTTDTQCQPMKAATKSKGQNFPRPWEPNSCISMTQMLDLGSKKIRYFLTSSSLIKDE

SEQ ID NO: 934016 - protein, 158 aa, Homo sapiens
MQFFALYSHIITRKPFCFGARIHGFRNQGVEVEVAPLTIIPSDPLAKFLLPIPTTFHSAGLEVLVPEGRTLPPGDIMIPQITRVCEGEREEHTLSLFSPCTPLIPLTLAGTAMGTKAACTNEARGPRGQELSTLARVHPISPAVSSLEFPRLHLCHGY

SEQ ID NO: 934017 - protein, 165 aa, Homo sapiens
MNFCGSTPVHIPSAQAGWNYARDPLPPGCLISNLEGSADRKMWEELPRDLLNGFDQNADTEMHNTIQAEVVSDGDEELVGNWSKCHSCYAKILVAFCPWSSDLWNFELERDDLGYLVEHISMQQSIQEVREHKRLKNLQLDDAVEKKNQFSGRKFKPAAEICLSN

SEQ ID NO: 934018 - protein, 148 aa, Homo sapiens
MKIRKNQHKKVENAENQNASSSPKDHNSLPAREQNWMEKEFDKLTEVGFRRWVITNSSELKEHVLTQYKEAKNLDKRLEELLTRITSLEKNINDLMELKNTAQELREAYTSINSRMDQAEERISESEDQLNEINVLYSGDPSHMQRHT

SEQ ID NO: 934019 - protein, 126 aa, Homo sapiens
MVSVSLSHFIPFLSVIYYLLIWTSCTNNCKVSGSYYFYLERSYFSSCRRTEYGQITWILLKLVCLHFVLSLRCIPFRVLPAGFCHLPGCFFLLTEQNGKRIMFQTTKVKTMKNNGQLSNPCIITEC

SEQ ID NO: 934020 - protein, 151 aa, Homo sapiens
MGQELGTRQTNGRTKRAGCNPHPNTTGHIVGDEKERSREELQFFGDCKPRSSLSQGCETFFRALHFRASSPSFQVPPHSLVPEAEATCDTLGLATALQGAGACASAWSCPPHHSQRAWPCAVAGPHFCFFTHPSPLCAWPNLGRHGIRVFN

SEQ ID NO: 934021 - protein, 161 aa, Homo sapiens
MGPLLSDWAPLLFLTLTFLLWAWECGSQSSGVIFPGGLWLPLLSHTCRHGSGGKLAVTGFTLLPQSPQSQRPVSLPPCPINSTKSISRQPVARAENLPQTISLPVEKANRLRVFRHLREPARVIQVLQSVCGFSQLSWNKMNILALTTGIHHCTGGASHGN

SEQ ID NO: 934022 - protein, 143 aa, Homo sapiens
MNILYKNPYELGVSPEDIRNHYNPWVWLFYTNTCFLETVISFNSFYLFLSGWVHLKALSSSSKIISSPWSNLLLKLSTAFYSSLNVSFISIRFDCFFFKISISRKCLIYILDLKNSLGCFSCFYCISLSSLIINILNSLSGLP

SEQ ID NO: 934023 - protein, 164 aa, Homo sapiens
MWNFELESDDLGYVAGEICKQQSIQEVKECKSLENLQPDNAMEKKNPFSRDKFKPAAEICRSYKEPNINHQDNGKISPRNVRNLHGSPTHHRPEGLERKMVSWARTRAPPDVSSLKTRCPASQLLQLQPWLKEAKGSRLPSGPGQDQKCCPGTKAWNWESQEPT

SEQ ID NO: 934024 - protein, 141 aa, Homo sapiens
MAGCGSLEAGLSEWYQLYFPLGHLWGIAPGSLEVYREKLAIGKALGNLVPKLSGGERLTCILVGQIKVATREEMSVSVAMEHRNQTKNKPQGWFCRYFLYKRCENAQMKGQNLIHCLRCFSLLVYEKGINEFYVKCLRTKR

SEQ ID NO: 934025 - protein, 146 aa, Homo sapiens
MLRGCCGPGGSCSVRREWVGLCMAAGATLLEFSTSQAWSASTRARHGQFFLPTLVSLVIEEPPPAGTPEAHGKSKLLLSSSTHPLHRSHWGQEQVLVQGSPVQGCQLPFPSAQLLCLSSFHPWCLPSEDQLGVFQSSQPLSGSSST

SEQ ID NO: 934026 - protein, 155 aa, Homo sapiens
MDHKVQAEVVSDGDKELVGNWSKGDSCYVLTMRLVAFCPCPRDLWNFELERDDLGYLVEEISKQQSIEEVTWVLLKLFSLKRETEHQSLEILQPDDTLEQKNPFPEEKFKPAAEICISNEVPNINPQDNGENVSRACQRSSWQPLPSQAWRPRRK

SEQ ID NO: 934027 - protein, 225 aa, Homo sapiens
MGFRDLKSPAGLQVLNDYLADKSYIEGYVPSQADVAVFEAVSSPLPADLCHALRWYNHIKSYEKEKASLPGVKKALGKYGPADVEDTTGSGATDSKDDDDIDLFGSDDEEESEEAKRLREERLAQYESKKAKKPALVAKSSILLDVKPWDDETDMAKLEERVRSIQADGLVWGSSKLVPVGYGIKKLQIQCVVEDDKVGTDMLEEQITAFEDYVQSMDVAAFNKI

SEQ ID NO: 934028 - protein, 252 aa, Homo sapiens
MGISQPMPVALCWGPEERIKRALSPPAQSFDLKYATALHFSLVIKEDEQDHALGKAIQGNEAGMQSESRRKCSQQQGGGKEWPGTRRGLSQQETTKADCGSKPSPLFVKRIHNKAWTPTDKLWFSVTQALRVQELCDMAVPIHGHGFLLDDLTRAELQPLRIHMTSLTLYLPQNEGLYFPKMVTIMSLVPQSSVSAEPLTLLEPSHHAVKKLKLVHMERPHGKMEKPCLQVVAFCGPKVLGELDPKVQVTEA

SEQ ID NO: 934029 - protein, 154 aa, Homo sapiens
MNRNDDRGLISHGHVTITRLVAELKKKSYNRRRPFSRHVKLESGNVCMECGKWTWPKCQTILDHEDKDSIRYHRRNLGFCNGKLSGSSDFSLSILPIYCTTQDLVPPYCKEALDWFWEARCKGTKLLSGALEKHKKEFIRILQCKRTDLYRTRC

SEQ ID NO: 934030 - protein, 155 aa, Homo sapiens
MPISHPTACFERTKACYHSPHNSRKNTRALPADRVRLISQTSIPYKTTTPFLPRHGKVEWTKSLSKTHLTKLSHQLKKDWTILLPLCLLRSQTCPQNATRDAFTMKPLKLKLQGPSIAEASSMPLAEHEQCALIFEGIEKTNNNCNPVVLDAKLS

SEQ ID NO: 934031 - protein, 188 aa, Homo sapiens
MTRYYPIEGVPRKLLSHGFSQHGRKLRASITPWTILIILTGCHRGKRVVFLKQLGSGLLPVTGPLVFNRVPLRRTHQKFVIATSTKIHISNVKIPKHLTGIYFKKQQLQKPRHQASEIFDTEKEKYEITEQCKINQKAVDSQSLPKIKAIPQLQGYLRSVFAPMNGIYPHNIFHLLYSAVISFCLELP

SEQ ID NO: 934032 - protein, 156 aa, Homo sapiens
MAICSHHGHSGLYVFCGFSAGLLLLGSSVEDGHTKKLLGATIYIVVYANGIPGILERTAPVIYGNGPPKACFIQNNTYSYWMTLLILNLQVETVLRLCADQYKHLLEFCENQRSLGKELREISGNQGLTLIGHEKLNSANNHLTHLTELGSRSIPS

SEQ ID NO: 934033 - protein, 207 aa, Homo sapiens
MSSDRQRSDDESPSTSSGSSDADQRDPAAPEPEEQEERKPSATQQKKNTKLSSKTTAKLSTSAKKIQKELAEITLDPPPNCSAGPKGDNICEWRSTILGPLGSVYEGGVFFLDITFSSDYPFKPPKVTFRTRIDHCNINSQGVICLDILKDNWSPALTVSKVLLSICSLLMDCNPVDPLVGSIATQYLTNRAEHDRIARQRTKRYAT

SEQ ID NO: 934034 - protein, 140 aa, Homo sapiens [sequence omitted]

SEQ ID NO: 934035 - protein, 152 aa, Homo sapiens
MVDAPLPAKLLCPRSISDCCTSSEQGSVGNEEKNLLKCDINGLQEALVCKDRKKKNPLLQVYCREEHFILAKMGIAKGEAEFCFLSGSIDGLFSWDGWDGWDGWDGWDGWDGWDGWDGWDGWDDWGLSPYSFSSSIWLTCTVYEAAEYESLN

SEQ ID NO: 934036 - protein, 152 aa, Homo sapiens
MQASWWKCGLLWVTHLPFPHISKRNNMSHINLYRNVHNSIIYKSPKWKQSKCSSIEGLHASLKKMTYLNGFDKHRAEADFQIKLLKSSQGQFKGEFKLSYVINNKGNHSEDTEAQLSSIHIEKAAICKPRKEASGKPNSAGTLTLDFQSPEL

SEQ ID NO: 934037 - protein, 179 aa, Homo sapiens
MGAEVVKGPERPHLIGTHVPLISSGCGKHLSLTLYQEGLSAAGLLEFAGGPLQTLFAWVSAAEACRTTDIGEQQMLLPDRSSGSFVSEEYPATLQVATPSCPPQFWGDLRVYVSSSTKTAEEGTLAVIVAQGPFTCHLGLHPRQTQAISRKQQPVEHITKEQQAAKFFITGLLAANLKL

SEQ ID NO: 934038 - protein, 134 aa, Homo sapiens
MIRMKSQCKCVLSRECMASSGIGDQEEAKAQWDELGKNAEPREKTLRKAQPIKTHQSWHPLGRIPENWNKKEVQLTSQQERSSLLIGLNLITTKLMDPGHCAKETNFCLIYRTLEHSFKRYFNWFVKRNTRKNP

SEQ ID NO: 934039 - protein, 138 aa, Homo sapiens
MAATTKDPCWQAGTLSLLKLRSQLPLPPGALSQGDGSFIYKPLTGAAAFLSEMPCPEMKNLDRQSGYSSFSQLQWAPSISNFPASLFTQCGKNCLLKPQWELNNEITWTQEGEHHTLGTVVGWGEGGGIALGDIPNAR

SEQ ID NO: 934040 - protein, 137 aa, Homo sapiens
MALVAPPEDQQQCGLMGGLKELPIILEIEGKIKHFTKPEKEEKRERRGATHFYMTRSNKNSLTIATKGNSAKPFMRNSSHDPITSHQDLPPTLGITTRHEIWVYGFTGPAIGVLPGTTEGYILQLSSGRRGIPEVEV

SEQ ID NO: 934041 - protein, 135 aa, Homo sapiens
MPLILQLLLEMVSIVVSRCFSLIAVKRDKEHIRVQLKAAVWLCFGRTAVLWWGIPSIPEYFDLDSPKPTSCNSCHPNRKDGSQALSQGTLSHPSSTVVKDADDACSKENEEDSKKVAVLLAFEDEGAICQVKSKV

SEQ ID NO: 934042 - protein, 140 aa, Homo sapiens
MFRCVWSFFLPVGLWSHLTSGVKPQTFSVSVTALKGGASRVVCSSLWVRGLADFRGEAADLHRMVAGESFSAILFCLSSLASPTDFSRLRPWIKFSGRQTAAAVCLRMSSSITKLKGKVKLETAYGQPDSYSVQSRPSAH

SEQ ID NO: 934043 - protein, 149 aa, Homo sapiens
MNLKPEGKEERVTSYVDGNRQNENLCKETTVFKTIGSHQTRSLSQEQCGKVLPPFTGYMRSFVIWACSSDMSQSQEEAVPYFSLEVSLDQSLSEGDEHPWGVSPYCWALLELSHAQMSLALCLLQLHLCLISEEIPLPAKMSVDAAGIL

SEQ ID NO: 934044 - protein, 196 aa, Homo sapiens
MPQCLLFLSLYPVVISPRSVADLQMPSGNKGHESETLGIYLVHYASVAELSPKPQVKVFPIFSPVSSSIEVYSLSHHHPWLTASTAWLPLMVKQSPRVLLSERQNVTLFGNLIFTEIIKLRLWWALIHYDLHYKKGNLDTEAHTGKCHVTIKAEIRVTLLHTKEHQRLPANHQKLVEKHATDASSHPPEGTNLPTP

SEQ ID NO: 934045 - protein, 323 aa, Homo sapiens
MGHKSKLSSGFTHFHFQKQILSLTSAKIALSESLISCRESTEVVEKQTQALIMRVADLQRKVHAQPCQVPTVKVKDKLLHLAPPTTKKEAQHLVGLFGFWREHIPHLGVLLQPMYQVTRKAASFEWGLEQEKALQQVQAAVQAALPFGPYDSADPTVLEMSVADRVAVWSLWQAPIGESQWRPLGLWSKALPFSADNYSPFERRLLACYWALMETEGLTMGHQVTMQPELPIMNWVLSDPSRHKVGHAQQHSIIKLKWYICDQARAVPEGTSVKGNLPSGQNFKQCTWLCTLHGRRNGQVCDYILINGHSQWFGWMVRNLEEA

SEQ ID NO: 934046 - protein, 147 aa, Homo sapiens
MGMSESIKGLMSLEICIMIFIILETIKLRIREVRWLSQGHMARRWQIWALSNACLSGFQAGALFAMEYSLPLWQSFLLLTPLSSRLTDLCPWDFISAIKTGFCGRRDLEKKETQRQSIEKEKWAQGTGVQHMEDPRRHRPLSSLSIC

SEQ ID NO: 934047 - protein, 147 aa, Homo sapiens
MVAAEGEMGSQNKNTEAGPPFARGSQNKHLPIVDISSEDLTATAKALAIACKSLLALKLIASSLCLYLVEYMRDEDRLEQQAPHLEISLPIFFKRDPLLGTYSMPSFKPITFTQIIDLSQPLCEKSIVIIPILVMREPRLGEAELLS

SEQ ID NO: 934048 - protein, 238 aa, Homo sapiens
MLEKKVDELVKFLSVKYTTKQPITEAEMLKGVIKEHKDHFPPIFMQAHECMEIVFGTDMKEVDPISHSCVLLKSLDLTYDRRLSDDQGMPKTGLLILTFGVILMEANCASEEKIWEVLNIIRVYAGWKDFIYGEPRKLITRDLVQEKYLECCQVSNSDPPRYKFPWGPRAHAETTKMKVLEFFSRVSGSDASSFPLLYEEALRDEKEKAQAIIATMGGTTLMASAHSWAKSSSFSCPE

SEQ ID NO: 934049 - protein, 146 aa, Homo sapiens
MRNMRGSKCPCQYFGCCKDGEHNVWVCGSILPELSCHNGSIKEPLREGESQNFMESQIRFPCKGQWSLREKEHNSNYNTYPPTLSPSSTPTFSRVYFCASNSGHVPKPLEFGIRYKAREHKNYRNTSSTMQGAFLLSKSCDSKLPA

SEQ ID NO: 934050 - protein, 152 aa, Homo sapiens
MAELCICDLTPLVFEHGLGCICKLNNPCSLAFEEDRDWNSLEDSGDDRKMWKGLELPTRDLLNAFDQNADSDMDNEVQAEVVSDVNVELIGNWSKDESYYALAKRLVAFFPCPRDLWIFELERDDLGYLAEEISKQQNFQELKLESHDPFFL

SEQ ID NO: 934051 - protein, 146 aa, Homo sapiens
MRDQMMSQEGVSAEGIPGWLAICMCGGVAQMLNRFEPPSETSNEHETIPPAKGILLNHPNNAEITQFTSIQAGQDPHNSTVLPVKKPDGIWTITVDYCKRNKVMIPVHAIVHNIVQLLGKVVLKLGSVHAIIDLVNTFFSIPLSGD

SEQ ID NO: 934052 - protein, 188 aa, Homo sapiens
MLNSMSVISTLSAWFRTIAWGTSMVIRSDSRIHAPTCVPIAVMMQQGAHALAGMGQQQGDKALVNPYLIVVDKLLDVLQDSVCQYFVEDFCIDVHQSNMTLKQGTAEHWPVFVVVVVVVVVVIVVVSPEDDCADHTACTHPIGSPSGVCSRSRPNQLGFFPSLPCPDCWAFSSVPGHGLSKAEAVPGQ

SEQ ID NO: 934053 - protein, 161 aa, Homo sapiens
MRQGVKGDHFEALRFDCPAGFQTCMGPGIGKKDVKKEMLQLGFEGRGDVTLPISFKLSYLQWVWQGYSESSDRGEKGSDPTYIYNHRSLSVSMIVKTLAPSSIGGLGISISSDHFMSKSFTFQTQADGPTKPQEATEKNNLRGPKVLDQLCFPLLEDRQEH

SEQ ID NO: 934054 - protein, 132 aa, Homo sapiens
MPSDFPRESKPPKYYKTKLERFYSKLLMKSRNGVSSAILEEVRGLPSVHYYPSNFISIHEENGVNRSGNLETVSVAPTLCLCAYSKTTKADIFVVVVLAFLSWTYKDSNCLLAKVSSKGEDFSSRKKAGNRR

SEQ ID NO: 934055 - protein, 166 aa, Homo sapiens
MKDFTITRGKAHAEDPQEHIHTQWVDDDKNVSKGVVSPIDGKSMETITNVKIFYGSECKANGKVIRWTEVFFPENPDQHNCLSDPADHSRLTEHVTKAFCLALCPHLKLLKEDGMTKLGLRVTLDSDQVGYQAGRNGQPLPSQCMNDLDSALVPVIHGGACQLSGN

SEQ ID NO: 934056 - protein, 213 aa, Homo sapiens
MKLEMERCFISLSRNPGCVTRPSQASNYQSSTSRDGYSSILWQYNSEMKDFTITRGKAHAEDPQEHIHTQWVDDDKNVSKGVVSPIDGKSMETITNVKIFYGSECKANGKVIRWTEVFFPENPDQHNCLSDPADHSRLTEHVTKAFCLALCPHLKLLKEDGMTKLGLRVTLDSDQVGYQAGRNGQPLPSQCMNDLDSALVPVIHGGACQLSGN

SEQ ID NO: 934057 - protein, 155 aa, Homo sapiens [sequence omitted]

SEQ ID NO: 934058 - protein, 145 aa, Homo sapiens
MVPAHIGEGRSLLSPLIQMPISSGTTFTDISRNNALSGYLNPVKLTPKINHHNYHLDADNCNNPPALGFASSDRQMITNGLKPNQLHLKRLQPKWLVENEFNEPTAVFISLDALLTLFKIADLRTIQQFLPKSSVQETAPQFQLS

SEQ ID NO: 934059 - protein, 136 aa, Homo sapiens
MVLPTAGPIAIACGYVFPWTIVCPPLLPVVPPFQTEPMFILHMLIDVSCFLKMYKTQLCSDHLRHMSSDPPEVVSLDSPEALVGPLRSCLTVLTLNRFIQLLSAKPYRKAQWLLIGLLWFIGNWWSALQLCLSENY

SEQ ID NO: 934060 - protein, 145 aa, Homo sapiens
MRSFPSNSQAPLLQVCWSLLEVHSRPCLPEYHQQRLRNSKDCCLLLPLEASPRGSPTRCQPKLSCMRCLSTPAGRCLPLRRMGVRDPLEEAVCPLAELECCAGKSAALFRASRQERLSPLKLHPQPLLPPGALSQGDGSLNIKTL

SEQ ID NO: 934061 - protein, 139 aa, Homo sapiens
MQYPNWLLLSWSINIISLIVPLLLLNYEESEPAGLEAKSTFPKAPPHTSSWGTDIWMSLKSKNTYSAHIWREREDTGGLTTLKHLPIQKNSWYLFPSTSLAFFLSPAGRLVSVAEASSHPTPSTPYYPPSCPKVQLQTP

SEQ ID NO: 934062 - protein, 185 aa, Homo sapiens
MRSDGFIRGFCFCFLLILLLLLCKKCLSPPAVILRPPQPCGTNEKELNKNTAEGENATNYDAKKWFCKEVLWRNLTGDLDVISTAYSSLHLQSLAEGVLNWLLKINRPTSKSTGYITRQAELLCPYLFGTPDKFDQSYKWRWIGSGKKLYNVVMVKMKRDGYKRHEELRIPMKQMCTCTPECKIK

SEQ ID NO: 934063 - protein, 151 aa, Homo sapiens
MTCYKPQKEDLPGSISPIKLRAERLVRKCILIISFNVSCIVGYRNKPFEKYYQWRFAGLPLNGHLLVNMATEEAEASEHADHFPKKLHHFTSPLAVYEGSDFSTSSPTLVIVYLFDHSHPIGNEVILHCGFDVHFPMTIKHFFMCKNRHFV

SEQ ID NO: 934064 - protein, 127 aa, Homo sapiens [sequence omitted]

SEQ ID NO: 934065 - protein, 144 aa, Homo sapiens
MEFSGQIANLTVAGLALAVLRGDHTFDGMAFSIHSYEEGTDPELLLLLLPPPPPLLLLLLLPLLLPPPPPPPPPLLLLLLLLLLLLLLLPPPPPPLPPPPPPSSSPSPSSSFSSSFKMRNCLLLVIFQCLQVVVTLYCCYMQES

SEQ ID NO: 934066 - protein, 150 aa, Homo sapiens
MRSYWIRVSPNPMIGALIRREKFRHRHTGRRPRDKRGRVMHLQPRNAKYCHQRPKVSTGGSWNVFPMDKEVLHKNVREFIIACSCIFMICVLKRLSDNSNIWVISVSAFVDCSHSSVIVLTFGVMSDFLLYPGHLGYCVRRIWFLFNPPY

SEQ ID NO: 934067 - protein, 146 aa, Homo sapiens
MNNKKASPLPLTGQAGPVKEALKGLLANHQASLNTTIYHILTRNKPFKQKSADKGPGAKFNPTSPDKTAPPPQTRQPHLPRQDNSTSPDSSLIKAQQGQFLVRTLLLAYERERENELSDVSSYKDTNPIRKHINISAVKCVYLHIK

SEQ ID NO: 934068 - protein, 141 aa, Homo sapiens
MPGLHPKLIKSEYPAHSNAHLISGAFMLYTSPPYLNLESQLHFDHLVAMDCPTTPSVKPTGSQEPISEKGISFPANCLPNVRPQTWPLDETFTFTHHPLTDSTRATSTIASSIRGLTELILIIPPLFATEPETYPYLQFAI

SEQ ID NO: 934069 - protein, 216 aa, Homo sapiens
MQARESSHGGCILQSHRGELPKAVGAHLLHQCGLDYPWKLSICLLDDPAVLPLQAEEQGSQSESQNLKSREADSRLWSVAEGLRAPGKPLKSYSAFGLLVALKIEGFKGKGPERWRGPGHLWDLGAHCLGSLQVSVPHILAQCSPAALVVTQAGPGASQAALPEARREHPAVHLKTLELISHKTEGVWVFEGNHIPRNIVFRSLFVTVAGVADPNW

SEQ ID NO: 934070 - protein, 139 aa, Homo sapiens
MQPGLRTTALLISVCNFMWMKSPLCEVWWEERERQEVEGSENWEPQEEQRCEESCEMEKMGKLTILHTMQLCPGLSWRASTSEDLERSDHDTVSMTVNSQVMLMLLDQRSHSEKEWTSVVLEQVYRHSSIALPRTDLAI

SEQ ID NO: 934071 - protein, 209 aa, Homo sapiens
MTSPPQPWMATLPWAVGLPSGTLLVTSPLQPWMAALPFQPWAVGPPSGALVVISLQQLWVATSPSQPWAVALCSKILVMTLPPQPWMAALHSQPCLGWQHPPPPLLSPGQQHHLWNLGSVSTHWNPAIIPTPSGLGSGPGIPGGRPVPFGPGERSHPLRPGQWPCSLEYSRSKWLSYLHKTIQPNPLTFYNEDHLSSNAQYQEAHQKYL

SEQ ID NO: 934072 - protein, 357 aa, Homo sapiens
MAAAELADTQLMLGVGLIEKDTNGEVLWVWCYPSTTATLRNLLLRKCCLTDENKLLHPFVFGQYRRTWFYITIIEVPDSSILKKVTHFSIVLTAKDFNPEKYAAFTRILCRMYLKHGSPVKMMESYIAVLTKGICQSEENGSFLSKDFDARKAYPAGSIKDIVSQFGMETVILHTALMLKKRIVVYHPKIEAVQEFTRTLPALVWHRQDWTILHSYVHLNADELEALQMCTGYVAGFVDLEVSNRPDLYDVFVNLAESEITIAPLAKEAMAMGKLHKEMGQLIVQSAEDPEKSESQVIQDIALKTREIFTNLAPFSEVSADGEKRVLNLEALKQKRFPPATENFLYHLAAAEQMLKI

SEQ ID NO: 934073 - protein, 147 aa, Homo sapiens
MEVDPRGCRCWLGPHLVYLGVPCNTLSSDFLPEAPGTELIGGGGDCVKMLRGNRGLLCTWTRTMTQLKGEDFDEGVFGPQEPAPVEEIWPQEGVNKGELLEAPHSTPHKRFPLFYIGNQAISFRAPLHCTEGPAEKTYLHGACILWI

SEQ ID NO: 934074 - protein, 335 aa, Homo sapiens
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 934075 - protein, 161 aa, Homo sapiens
MLTRPAPNAFPSGAALGQVESVTVRHSVNKHILNAFLLVPGFLLGPGTTEMKKPSLLLIHPSPLQPQVSWHLSPFKARLDVHFILLSEGRANGFESSLVIRSLMEQQGTLLERATLRTSNGALSHGLWVSQNSRGNASLFRLLFVHTFENSGDKIMQSALC

SEQ ID NO: 934076 - protein, 152 aa, Homo sapiens
MIPFHPHCSPMSEALLLSYRSLHPQHSSPERLHGTDSFCESRGEPLGIDPGPVTATNSHEPSWQGSGGFPTSEFPDMGEAIWPLLLPTNPIPTHTYAHTCPQQYLQRPLLLRSPCPEASPLEQDKISPGELHAWYHNNVCTCICYPRVGTLP

SEQ ID NO: 934077 - protein, 196 aa, Homo sapiens
MCQRTRPHLPVDISAQKTGHDTSLSGVTASQKEPPNAPSCIPSTLEPVYGKRLQACAMRTGDTSGCSAEAEAVTDPLLVPPFDFQCPLAADVATATIRKRSLLFKARATVRGRGNSMLHGAASEVHSQDGTFAAQLCQQLEDRCLRVRGRGQACDVRELRFKTNPLAYLSMVSKPSYVDILKPRLPMMPPSRGDCY

SEQ ID NO: 934078 - protein, 134 aa, Homo sapiens
MGKKTKQEESGGSARRGGKGICGGKISRPWSDEDNTWEPEENLDCLDLIAEFLQSQKTAHETDKSEGGKHKADSDSEDKGEESKPKGKKEESEKPRGFARGLEPERIIGATDSSGEVLEPRWPNRNNSSLQLPT

SEQ ID NO: 934079 - protein, 243 aa, Homo sapiens
MAKEVQQWAPPHEIHWPYHVPHHENGLVEWWNGLLKSQLQCQLDDNTFQGWGKVLQKAMYALNKRPIYGTVSPIARIHGSKNQGMEVEVAPLTIIPSDLLAKFLLPIPVTLLSAGLEVLVPEGGRLPPGDTMIPLNWKPRLPHGHFGLLLPLSQQAKKGVKVLTGVIDRDYQDETSLLFHNRGKKEYAWNAGDSLGCLLVLPFRVTKVNGKLQQAQSNRTTNGPYPSGIKAWVTPPGEKNMTC

SEQ ID NO: 934080 - protein, 159 aa, Homo sapiens
MHTSITSLQRQLDFLVGVILQNWRVLDLLTTEKGGTCIYLQEECCFCVNESGIVHIAMINDALFPFYTKVRNKNVSPNCTILQTPTILQTGQSGKFHQGLSCEKHPVRQVPGLTPGCTKFLHYQQPNTPPPPHFHNNPRPLLPGTVTGPAYQTTSFNSD

SEQ ID NO: 934081 - protein, 134 aa, Homo sapiens
MGKKQSRKAENSKNQSTSPPPKKCSSSTATEQSWRENDFDKWREEGFRRSNFSELKEEVQTHHKEAKNLEKKIKRMANYNNQKYRERHKDNPREEQLQEHTCQIHESRNEGTNVKGSQRQRSGYPQREAHQTNS

SEQ ID NO: 934082 - protein, 138 aa, Homo sapiens
MTVLTQTSSQHSTGCHAKPAITTPWLLAVFFQGPGVLQSVGGKASQADIILGLSPVSAIFQLYDVSFPPGKQGRPGLGTALSSMPHNCCVLSPRPQEALCTMQLLLGGRGGWASVIQGCFFYLFSASFSNMKLTPDGC

SEQ ID NO: 934083 - protein, 181 aa, Homo sapiens
MKLPEERSGSSICCSAIFAALQPLLLIPRQTGSGVDLQQTPTDLQLGVLTVRRKTNKQKGHPHQNPTSTEQSWMQNDLDELREEGFRRSNFFKLKAEVRTQCKETKNLEKTLDKWLTRKTSVEKSLNDLMELKTMVQGLRDKCTNFSNGFDQLEERVSVIEEQMNEMKQEKKYREKKGNKK

SEQ ID NO: 934084 - protein, 155 aa, Homo sapiens
MADGLLPTKLECPRSTSDCCAGSKNFKPVDLGLLGSVWVGPTESDHLAPWFQPPLQGSELFSVAGVPSATGALGGIFFHSIYSGGSIPDVLDFVFPRVLGAARAWEPVMWLHYWVQWVPQHSGPLSRYSEFYVFHFSSFSLVKSHCWGASVVIWR

SEQ ID NO: 934085 - protein, 174 aa, Homo sapiens
MGLELPARVPTGALPSGAVRRGTLSSRSQNGRSTNSLFHAPGKATSTQCQPLKEASEGVPPCKATGAELPKALRANPLHQPALDACCNHFLATQPMFTQGPGAIQLLCGKAIFDCVFSFKVGSSPRLRVGPEVLQRSQELGLKILEVYLGSQGSFLELGAFQPGVEGGVMPVLP

SEQ ID NO: 934086 - protein, 150 aa, Homo sapiens
MKAIQTPTHDTLKQRRHGGKKGRWRSRSFGFVLFKESESADKVMDQKEHKLNGKVIDPKRAKVMKTKEPSKKIFVGDLSPDTPEEKIREYYDGFSEVESIELPMDNKTNKRLGLSFIIFKEEEPVKKIMKRKYYNVGLGKCELKVAMSKE

SEQ ID NO: 934087 - protein, 144 aa, Homo sapiens
MWQLLQSASKCKDACFPVDVHHSGRGKAAWQVEPNGIAVPGCGPLQTLQHQTLWDPYLLACCATMLLVSWVFYPGEMQAINCSWQSAQDGDSVLWAQARGSFSGYEHWSVYGTHRRWTVLLSLGRLQLIRDVDKAFKFLAPSLV

SEQ ID NO: 934088 - protein, 172 aa, Homo sapiens
MTHSLAITQPLSPANHVIAKWDHEKSGHGGRRGGYTWVQKHGLPLTKADLATVNFPGAETNSKPSIWHHSLGIDIYSRYWFAYPDCNASAKTTIRGLTECLIHRYDIPYSIASHQGTHFMAKEVQQWAHAHEFTGLTIFPITLKQLDWPDIFKYDPAELCTMMSAVVKGRAV

SEQ ID NO: 934089 - protein, 134 aa, Homo sapiens
MVELVYSPTNNSCFHLSVRSQTAVLATSEAPWAWDPPRQVWDIISWYHLSRLLLARKGNSPTPCTSWVRRYPALLCGLHPLSDKPQPLFCMSAAVCWRFTPETVCLGNTSGGYRIAKIVACSILWNLHPRGAPA

SEQ ID NO: 934090 - protein, 149 aa, Homo sapiens
MTSSVWLLPMFTQGPSALQSAFVESCQALNFLFRADLGPGMGASSLYLLPYPTVAELVSKLQDKVLFTVPSPPLKQKEGLPPGAAYCTAWSCGIGVASTVLVTLASVLLGHMPCKCAGTKPSTAPGLAQEFQSLWSRLPFTYVEDHRAL

SEQ ID NO: 934091 - protein, 142 aa, Homo sapiens
MAASPPGGFIPGRDQSSVCIILAGVAEIPTGRSPLSRLPGPTGFSRLEWLIQPNHRNGSRPSHQKFICFKNIFEKGPFLQYMFLGNLDVHMQKKENSLPSLAIYENQITMDKRLKCKTRNYKTRRKHWGNSPVCQSGQRCFE

SEQ ID NO: 934092 - protein, 156 aa, Homo sapiens
MLTGPSEEEVATTLDLLVDYIGLLLPGKEQNFVLTGIITNRFAFPTLNATAKTTIHGLTECLVSTIMVFHTALLLIKELTSQQKKCSNGPGHSSVVLLQFAGVPLQTLVASVFFLPGGITSEGCEIAKMAACSFLWKFHPRRLLPYCQPEHAYRSG

SEQ ID NO: 934093 - protein, 168 aa, Homo sapiens
MKEGPPIPPKPGSMTSIKTSLFKELDKILQEYTTQQSNKLQRGKSKVPLTINNAVSWCSERIKYKKNEVFIDVIESANLLVNAKGSILLSEIFGTIKLKVFLSGMPELRLGLNDSMLFELTGCHKNKLKQSVANSVEMSVPIPNDADSPHLKTSVCSAKYVLEKNIVI

SEQ ID NO: 934094 - protein, 155 aa, Homo sapiens
MVTPTESLEPQPFQDCLIFFPFQVLYGQTAKVLDQVLQSFLPENPDSSEEVPGSTCETCTPTSEGPRAGKALLSGAQLICDKTEPLLPGGQAGTREAKHPHQSPFQVSSRKERLSRVAQAFPGTHRPPEEAMVPPGKERAPEVTQGTSWRCPGTT

SEQ ID NO: 934095 - protein, 148 aa, Homo sapiens
MPNNADIKIGTDGPSAAGLLEFAGGPLQTLFAWVSPVEAAEQQRLLPVPSSGSFVPEGHLPDTSRSSPGSEEGKCGVDPPHRVSTGALPSGAVRRQPPSSRPQNGRSTDSLHHALGKAAGTQCQSMKAAEGAFPEASSAMLPVQPVEP

SEQ ID NO: 934096 - protein, 186 aa, Homo sapiens
MPKDLALESNPSDHPRASTIFLRKSQTDVREKRKSNHLNHVSPGQLTKNAAQLTAECAIVTLVYLEKLLTYAETNICPTNWKRIGLRAILASKVWNHQAVWNMDYCQIFKDITGEDMNEMERHFLMLLQFNLNVPASVYAKYYFDLRSLADDNNLNFLFAPLSKKRAQNLEAISRLCEDKDLWRAL

SEQ ID NO: 934097 - protein, 154 aa, Homo sapiens
MGRESPNLLVAKTPGKSAVFVQECTIPPGLWPQIESYAISSLGSQAFRLGLRSLTCCVTSGITFFIFETAMDTCTCSSGGIRAVKRTLCGTLVVVLFTVLVFSSAGCAGSKIVMSIDSGPLGLYPVSGSLHPIAIIWLSQWSYLVRSCGSGPAD

SEQ ID NO: 934098 - protein, 144 aa, Homo sapiens
MAGEISGNLQSWRKGKQTHPSSQGGRKRYESQVKGEAPLKPSDLKRSHSLAQEQHDQHGKLLEGLYFLEVEAVHVYHFQMTGLPSSSAPVVAAGSEDRTAKLLALLCNLNSHFNGHSEKSLSKLNYENICFRITLVGYSWAISH

SEQ ID NO: 934099 - protein, 178 aa, Homo sapiens
MFYLGRCTSRGINPLETPRGPWSPKGAFQLEGEKCPFSLEAKFQPDAESCKELIANYQVNGENCLQEVGVPENQTTVHAAAPLGLAAQWGCHTPEVYLRVPGRGDHHPRLRLHDHLESDGLNARREKLGYLKTYQNETKGRHNTLAVLKQLFLYQQDQHQCNLGIVKNANSQTRFHIY

SEQ ID NO: 934100 - protein, 166 aa, Homo sapiens
MCLIECHLRECCLTQNLSSTIYSSPVDHVPRETRHHADAHFEYVTAKLLDSGNHAVFPLVHSVSQSLDFRVYIAGKKCNPVGKQELGKDKKEELVNSKQMVTQAIMMAEGSGISFSRFSDLESQMGLLRNKGEIREFVVGNLGRYHWPFWQEKHQLGTFLYWLYHL

SEQ ID NO: 934101 - protein, 140 aa, Homo sapiens
MGIHLLHQHDLDVRHGAKGNHFGALRFDCPAGFWTCLGPVAPSFLPIYHIRNGYIYPTPIPPLYLGIPTGALPSGAVRRKPPSFRPQNGRSTDSLHCTPGKAAGTQLWKQLGMFCVNFTIVCILLFLYGIFHNCQVDQAD

SEQ ID NO: 934102 - protein, 161 aa, Homo sapiens
MVPGAEKLQEVWEVWGATNFKCSSHASQLCAPGSAVCFQVCVCRNASGNRGSDSIGPGRDQEKRYTFVSLKNCLQEHKKEVESELVSSEKNEKNNSFLEHSAPYSPTDSPHASLAVPTSTLITVKKITCIIGQIPFTRGRNYLIWQSYYISTKGSYFSFAY

SEQ ID NO: 934103 - protein, 158 aa, Homo sapiens
MGSSGHQTTCRDLLRAQNTYLVQLSSSGLWQSLVLLPEDDEQLLRNYFPSSLGTLFYIADLTPCTGETMDTLIEMQNALQSLSNRIEQSKERTSVLEDKVVKLTQSNKDKEKRIRKYEQSLQEVWDYVKQPNLRIIGTLVEEEISSIRFQPICTDINI

SEQ ID NO: 934104 - protein, 196 aa, Homo sapiens
MSETFTAAPPITGPEAYEGKMVSWERWFPGLGPGPSCCVQPRDLITCVLSTPAMAKRGQGIARAMASEGASPNLGSFHVVLNLAVWQGNVELEPPHRVPTGMLPSGAVRRGPPSSRPQNGRSTYSLHCTPRKAANTQNQLMKAARRRAVPCKATGVGLLKAMGSHLFHQCTLDVRHGVKGDYFRTLRFDCFAGFQT

SEQ ID NO: 934105 - protein, 143 aa, Homo sapiens
MKFNLLIFTFMDDTFGVVSISSLPNPKSPRFYLILSSKRFIVLHFTVRAMIHFELIFVKGDFLGCHFPHRPKVPRLGEQKDVKRDASQEHRTSELTAHYCLKSLLPAFQCSAPWLSQLWLKRIQVQLRLPLWKGVNNVNMAHY

SEQ ID NO: 934106 - protein, 149 aa, Homo sapiens
MGAFTHCLYLYCILEVVSAKTHCTALTITSIFVCICKPQKQRQHGGPMLLHFGRVLAGAEMPGSKQAFTTVAEVTRLWDQGIPAVDGCDDDDICTGTGRPESLHSFGLVLGLVCTESYNVNRLCVSQLWISTPVPVEVVGGVGGVQWTL

SEQ ID NO: 934107 - protein, 187 aa, Homo sapiens
MNIIECALTNLDGIAYYNCIATIAYSIQYGKHSKEGEEEDEDEDLSKYKLDEDEDEDDADLSKYNIDVSEEGDSNKKKSNRKSHSISQSSHSLSSSCSFSLSNSRSRSRFPSRSSSSQSRSCFSSREHLRSSGLKSRSSSRSHRGSLNNPEPRANPYRTHYFTQAPQVIFWIIPFWFPFKFKKEIRH

SEQ ID NO: 934108 - protein, 160 aa, Homo sapiens
MPPDRETPPSMCQKTPYTGELQLASGRCSSETKLPEEGIGSNICCSVASAGDSQAIGININKKDIHTKTPCELHQHQRPKVDKSTKMRKNLKAKNFKKQNASSLPKVHNSSPAREQNWMKNEFDELTEVGYRKWVITNSSKLKEHVLTQCEKAKNLENRL

SEQ ID NO: 934109 - protein, 144 aa, Homo sapiens
MPHLAAAHAWCTAPTVLHPLSCTHYQTNPSEMNPVPQLEMQKSSVFCITHAGSCRLELSDYGGSSSTRDWITNLIRRTLDGMPNYRRDGIMSVKLSTGLLGSGGGCDRKGQAGPRPPMEYSGRAIMVAFWAFHKEEQAPLRTNI

SEQ ID NO: 934110 - protein, 160 aa, Homo sapiens
MCVCTQQLLRGASGWLGACFHAGIRHSGGGNASHGWEYGGVPANDCAVPLVVAFAQGLGVGRPRLVHDHGGHLTGALHWISTVHQHRSYYVIPQGTQNCPTSSCGQPATPVEASRPSSAQVRLATSDGNKDTRQRDRRKDSWAWGTTTTKTRRPVVAPNA

SEQ ID NO: 934111 - protein, 145 aa, Homo sapiens
MAWPSWTAHHSSGAISGFMFPSQLKGSRGRDFSSGCGRGSFTYFLELDPREMCSNDQQQGQDHRCSSGSGGCQLHLGALPQEIQSHDQYICSAIGFTFVNITTTVFPMSLKSYYLIKLHNGLSSQQSSLLDIVGKILEEPYLLYC

SEQ ID NO: 934112 - protein, 182 aa, Homo sapiens
MECYEDNHTQEEEGEGEGEGEEEEEEEEEEEEEEEEEEGRRRRRRKKKKKKKKKKKKKKRKKKESSLAVGSLLIQGRSKNAVQEPNPGIRDLKSPLGAIPNSGRAGTYTQDKTGPSAVGLLEFAGVPLQILFAWVSAVVAGEQQILVNCRCCCLIIPLEVLSQRSTRPCEVSVHPYWKVPPS

SEQ ID NO: 934113 - protein, 154 aa, Homo sapiens
MNAFGVFFHSIRVYHNGRGNVVQQVWDPLLVTVCTDALLVVLAQGGALADAGSCTLCALQKESFLVATTAVNLLGYPESQYVSQPKAHGVQPMYHYRVVGGANLPRGWVRRVHTLALLVCSKAAAPMGIRKWFSGPRGNVPERSAAASAVQKSL

SEQ ID NO: 934114 - protein, 148 aa, Homo sapiens
MGRNQSRKTENFKNQNSSSPTKEHNSSLAREQNWKENEFNELTEVGFRKSVITNFPELKEHVLTHRKEAKNLEKREKSVKRNEQSLQELWNYVKRPNLHLAGVPESDGENGIKLENILQDIIQENFPNLARKANIQIQEYRIFNLYLL

SEQ ID NO: 934115 - protein, 182 aa, Homo sapiens
MAIMLGKAKWKPLELPLPRKVIHQRQYHIPGGNAEVSAAIKDLKDIEVLIPITSQFNSPTWPVQKTDGYWRMTVNYHKLNQVVTPIAAAVPDVVSLLEQINASPGTWYAAIDLANAFSPFLSISPTRNILPSAGKASNIPLLSYLRDILTLQLCVIILLGETLDTFRFHKISHWSITLMTIC

SEQ ID NO: 934116 - protein, 171 aa, Homo sapiens
MAHVYLRNKHACPAHLLMSFVPFFVAMCIRCLAPPALKEDSCFMNTHFRTERSRGAPRDAWVWVIEPKRTGMPDIPGLTAGWPPKGCRFPGKEKENIYKAAFCCKDNLHLADATYLMVTTAVPMQDPGWDYTTQRGIQARNNMLLCLAEAKPQSSNGFELKWSSSPAVSEI

SEQ ID NO: 934117 - protein, 164 aa, Homo sapiens
MYMLSKVSRGRTAVAVVAVAKGLLVASGSTSPGKHRTLAVEMLSLGEVAIRKITRSMQYHGAQEKKIIKIWLSFKNEYINFPYVVSETTLHKVSEIKGTRYNKDPSILIYISKVPKSNNEIRHILGTMAVEKTIFGGEYANIHTFEWHKEKSTVKSLKYFRVKN

SEQ ID NO: 934118 - protein, 141 aa, Homo sapiens
MAGPSHWLQLIIQSYNESVSLQIIANAAEMRFEDYSVVGLRQRAKALPKAKLAPKVMVTVGSAPNLTHYSFLNPGETIKSEKYTQQIRENYEHLYEHKLVNLEKIVKYLETYHCQRLNKKEIKTLNRLIMSSKNELLIKKI

SEQ ID NO: 934119 - protein, 137 aa, Homo sapiens
MLLLSQTLTAAEKQAVLQTAENFRHEQYVSYSRPKRKSENKEGDKIGEQSFPTGRDRVLLHNPDSTEKEREHKRKTEALMAALRACKVQDPQGAFTNCYQCGKSGHFKKDCSGSKKKPPRPSPTCGRDYWRSDCLQR

SEQ ID NO: 934120 - protein, 187 aa, Homo sapiens
MKEGKGVNSRQKYLQAGTQFYFPFSPWRFQRMYGNAWMSRQKSAARAEPSWRTSTRAVQRGNVGLEPVHRVLNGALPNGAMRIGPPFSRPQNNRSTKSLYCVPGKAKGTQCQPLRAGMGAETCKATRAELPKSLGAHPLNQCALDLGHGCCYLAIMQTSLCGYFSVSVSYAFNCVLAVAGLFSSVYS

SEQ ID NO: 934121 - protein, 135 aa, Homo sapiens
MESVNYLSSPARSAGKLFTSQPHSCSSVSAIQIRQEPLFLYKNVDVPSREESSLCLSCGLNLKCVPPVGLHSPWIVPEKLSLLTHCYTSLIPLSVLTKGPNERVRDGFPRLELENESANKALSAAASTFIFYAVL

SEQ ID NO: 934122 - protein, 135 aa, Homo sapiens
MTALNCLIQTVGVLLGKIGVISSLRSLCGRLGGGFLKLSIGWKLVDEVCHPPIAAILRTEEYITKRSPTKLFLGSLIIAPSLADCACPLESSSRVASTDTSPSVPSKHRSHPYAMNIWASSQRLRFRACSTGVLS

SEQ ID NO: 934123 - protein, 160 aa, Homo sapiens
MRTHQISRGQYQGDSIKSFMRNLLQDSISFYQASPPTLAIMLLCFNISFLAIQILNCMSVISVIPDWIKAIAGELLDEFGGNTLWDKRNPMRGPEHQILPLEESLLQQRHSLSAKLTKECLQLSSSRQTALVHVKGLGKEEVFPYLSTKISTAVASPMGV

SEQ ID NO: 934124 - protein, 145 aa, Homo sapiens
MIVVQNDGYPKSPDLIIAYPMNISKYHSLQVYLASIFDAADVWMEFLWGLFVDAVVAFCLFVFLLTGPSSLGLLQFAGGPLQIQFAWIPPAPGGLLPLHLPPRVKASRGPHQEGLFSLQNCEPNKPFFLINYPILGIPLQQCKMD

SEQ ID NO: 934125 - protein, 154 aa, Homo sapiens
MNLYDLPALILIHCDSIIITDSSTGLCISVSGVNSILLEKMVIVYPEAVAKQNNTDFPQNPPPPSLFAYRPIARLKSQQAFKDEVKSVTHEGMCYSMKEILEFSKNKCEGNTCGNKYHGGRNGFTRRHNNNFIELEIETATLPLWAFHASEPTG

SEQ ID NO: 934126 - protein, 168 aa, Homo sapiens
MHQSSRHTPSWLFLARGGRCCPGHQKPSIKHIHNLKIKFELFLKVFRVQDGNKSPRKPPKSQNIGFMIELFMLKEKLKLGGFLLNSNELEGGRKNVKVYGQVLRGKEREKRQDLSKHPWEETVMQRKKEAKVWLKSTPKELKAQWKGNLLPLSHCTTTPPAAIPHNPL

SEQ ID NO: 934127 - protein, 134 aa, Homo sapiens
MVRLWTTEGLFTSPFPAVGNLLRLLLILDKLVTHFLLPLFISLQTISAGAGLWAESMSTSLVAESVISSWEDLNILWVISYTVNLTTLSRESLREYECSPVGDSSGEAVIRSLTVTGPYHWLVPTVHLISVLPE

SEQ ID NO: 934128 - protein, 144 aa, Homo sapiens
MLLYKLVILASSAGLLQLAGVPIQTLFTWVSPVEAAEQQRLLPAPFSGRFVPQGHQPDASQTSSFDYPRSTSDCYTGSENFKPVVLRLLGSVGVGPAWRDLLALWLQPPCQRNKQFCLSGVPGTTGKILPHYDQDNITYVLQQQ

SEQ ID NO: 934129 - protein, 134 aa, Homo sapiens
MYYLYAFLSKNHFVEIKGCDAFRDFIYILVVDDTREYEEDLECQRNESIDIMFRQKRGTEWEGGLPRGWAAKWLGSPPSALSGIPLGIHVVLPLMACRHLLVCSAGVFLSTSSCWCVCVRLRSLAYMGTGWGVW

SEQ ID NO: 934130 - protein, 135 aa, Homo sapiens
MHSPTICHGLAATDLAAWKCPKEVHLFHYIDDIMLTSNSLADLEVTAPLLRQHLATCDGLSMNPRSKGLDCLPNSWELTGQKPPPPLPLSPLFQLGTLRGQCLNMEETSGFSPRPVKLKVFQWLFPSSSLEIKGN

SEQ ID NO: 934131 - protein, 207 aa, Homo sapiens
MKWGNNSLFIKPIFYNTPLGTCKLHGSPAMRSSGVSANGLPFALVAAASGSTQPWAKDLKGSEDRKMWEGLELPRDLMKGFDQDADSDMDNKVQAEEVSDGDEELTGNMSKAPAMAERSQCTVKGVAAESASPKSWQLSLDVGPVVEQKSRFKGSAKDKYGVEPPHRVPTGVLPSEAVRRRSPSSRLQNGRSTKSLHYAPGKASDAI

SEQ ID NO: 934132 - protein, 146 aa, Homo sapiens
MSSQKFAAGVEPPWRTSAQAVQKGNVVLDPHTGLQNSRSTNNLLRAPGKATDTQCQSMKADRRGAVPCKAATAELPNAMGAHIWHQCDMDVRHRVKRYYFRALRFDCPAQFWTCMGPVAPLFWPVCLIWNGCIYPMPLLPLYVECN

SEQ ID NO: 934133 - protein, 198 aa, Homo sapiens
MNYIYIRFIVQTAFYIFIKNSDDKKDTSEKGMKPVRRVSKLTKAEQRQFISDRFYNSGMSCDLCHTAQLENRNLQNPYKLAEIVMRGEKRNNGVGKEFQREPLRDLLNGFDKNADSDMNNKVQAEEVSNGEELGESDDYVSWGRLSCAVPFRGSLYFLNLNIGLSNYKPVVLEKLKCPQSTGHNTLMGDSSQATSSGQ

SEQ ID NO: 934134 - protein, 150 aa, Homo sapiens
MLLAEAELVSSMPANALMTMVMEQGKWMSYDAGSQKVPRGCTVSRHGEAGALREASLPKGAQVGPAPLMGKTSLQGSGAQFKLSMYLPVWGLEESGPLLTAPLGSDPVGNMCGGSNPTFVLHTALVEVIHEGSDSAADFFLDIQAFLYIL

SEQ ID NO: 934135 - protein, 124 aa, Homo sapiens
MMQDFSQPLHWTHGRDILSTWPTLFNLLQKLCVGTTARPCVSPQEEWSDANVRMPMTLNPQRVCDIASLVPLSTDKIVLAAQLAPCLIALGSLPSPTRAKGWCDSISGYPHSVGPELLSGIQEE

SEQ ID NO: 934136 - protein, 142 aa, Homo sapiens
MAFCETSPCDRTAAAAAAAAAAAEEEEEEEEEEEEEEEEEEEEEEEEKEEKQQQHGIVPGFMPVEVLPQGRGAVGLCAHQCSNGSGGAVGKRDALCTHASSSDTAGYTHTWTWAVLLQRQWQRLSVVPEGSAQGVAELLLAR

SEQ ID NO: 934137 - protein, 163 aa, Homo sapiens
MEYQTSYGSGSGEFDVLKGELRQEVEVAAFWSKPFNKSAGSFKLSHIFLSSEPSKSLGSSKISHIFLSSSEPSKLFQPLPITQFQSHFHIFGYPYSSTPVYHYPVYGILLQQPQRTKIKFLCEAIYNVIRNCCIARYSSASSGTYITNSLSEWDLRTKSLFIS

SEQ ID NO: 934138 - protein, 214 aa, Homo sapiens
MSGTEWTMNPIDEWTVEYEKQCCVILSAYQEAACPIIDDATLNYLVKERLVVSPGVSNHKKPWLPEGCLDLVSEGSRSEVASNWSGSSGSSKLQHSPLASIPGGYNTDISRVFNGNNSTSCQQKLLPGPLQIYDIDAITFPFIDDIKGSGHCESFPLSYDGNPEQRHMDPSVGGKQVTPDSNPNPQTQKPKSTGEGSRGNTIGHESLAYFQGAR

SEQ ID NO: 934139 - protein, 133 aa, Homo sapiens [sequence omitted]

SEQ ID NO: 934140 - protein, 171 aa, Homo sapiens
MAALIYILTNSIQEFPFLYTFANTYLFVLIIAILTGGTSGPQCQLLQDNLEGYKPVQHVTLLNTVDNCHTMDFASWHHRELEMIDLHRIKERRGFLFGWERQQTRVLRAELPEKEIPSPFKGLQLLRGLRERVIIDRVSNRENERLPNLPLDMTTINNLVHILFNIKQNHY

SEQ ID NO: 934141 - protein, 147 aa, Homo sapiens
MGSVTKLVVICYGSPGKPIQTASKGRELNRENSRCKGSEADLLPACLGKSKEVCVFGMEGVMGFLQLKQKLKELTGGSSLLTALSTAGQHVLPGRGGIVWFGSVSSTKSHLELCSLVLEERPGNRDLDGSENCDTGRIVECVYPFTS

SEQ ID NO: 934142 - protein, 162 aa, Homo sapiens
MTCRGRFFPAHWILVSFTTKLLIKSGITESEERNTFKTADKYCQIAFIKGILIFLSIDSIGTQKHPIINKVKFTMSSNQYKMIRHAKMQDIVTQNEEKNKFIKTYPRMAEKIELVDKDIKTIINARDKTAIFEMKKTLDGINSTLNFVEEKIGELEDIAVER

SEQ ID NO: 934143 - protein, 139 aa, Homo sapiens
MGHPKPSNTVVLADSWRYTLMVLDKIQKNSPDYQAETFVLFPYALPNKQNLFLFGATWKWECCDTSIPVAITPRTTLEVYLVFYYTVTELTLKPQDAVPSHSSLPFSKAEEPHPMATITRSPYRRERVAFGATSCTFWG

SEQ ID NO: 934144 - protein, 240 aa, Homo sapiens
MLSTEVIGKVAYLVEYLWNKGCLGDKSETPSEEEEEEEEEEEGEGEGEGEGEGEEEERRRRRRGRRRRKKKKKKKEEEERRRRRRKKKKKKEEEEEEEEEEEEEEEEEEEEEEERKKERKKERKKERRQIHSSFMPFRLGLTLERKVGAAPFKQKGQHIHGQGNYSTEVLQSPSTVLLVSITDGLNVTVHYSQKDVISSLLISDSFFSFLSMLQSTCSIYQVHKVDDFYHSIMVSVQVLW

SEQ ID NO: 934145 - protein, 159 aa, Homo sapiens
MAAYMLISCGRALAVVGLPASVQVFTAVAVPALAEGQGHSSLFTRLHWQWCQCRVKALVCARLAAPYAHIHASSSVNAGPLASVHAFTPAAMTAQDWSVGPLASVCAFALAMVAWLSRGWEDSHNDGTFNNRQKKPIGFSIWIITKGKDLEMTVHQSYD

SEQ ID NO: 934146 - protein, 162 aa, Homo sapiens
MDVWYSLKSGNAGLIYSDRNEKGDTTVNWEDNSTGDWEAASTGCGESSSTGKEALSEYRGSKSPALSGSSQTSSFQLTGSHSLPFNALTLTVDILRGWELNLHCNSANLRMKSCILFPAISALQLQEIRFSLGAYLKALKLESQFQKPQNQFRKLIFKIIFL

SEQ ID NO: 934147 - protein, 124 aa, Homo sapiens
MWLYFRVLYSVPLVYVFIFVPNSHAGCDREEWDGSWVTSRTLRQGQEECSGSSRMLRWWEPQKRSQAYGARLSEGLQTTAEMVSTLDARWDGYSHQTSPLPSPAQINAEVPPASQLQLKGTHST

SEQ ID NO: 934148 - protein, 137 aa, Homo sapiens
MVCWRLRMSVSMLFCWCVPLNIQPLVCFSASVFLRQCVPLNIQSLVCSSTGVFLSISSHLCLCPLGSQGFYRHRMGSWRASMVFGNATFRHENRSVCPHLGPWKSQKHHIVLHFIHKKQVSQATPYSSRRRFDFASE

SEQ ID NO: 934149 - protein, 173 aa, Homo sapiens
MLQFPTSSSSPPENTSAWISLPISLSAFWSKPFNKSLGSSKLSHIFLSSSEPSKLFQPLPVTQFQSHFHIFGYLSSSTPLYWYQFTVLICFHAADKDIPETGQFTKERGLLDLQFHVAREASQSWRKARRRKMLSTFPVQYNVVCESVIDGFYYHENGSDLDIVMWDITLMQQ

SEQ ID NO: 934150 - protein, 138 aa, Homo sapiens
MGRNQSRKAENSKNQKASSPPKHHNSLPAREQNWTENEFDEKVGNNKLLRAKGACSNPSQEAKGLEKRLEEWLTRITSVEKNINDLMELKNTARELHEAYTSFNSQFDQAEERISVTENQLNEIKREDKIREKKSENK

SEQ ID NO: 934151 - protein, 166 aa, Homo sapiens
MAYLDVYEDKGLREAGLKFEATGGNSGILHKDRKCDSCRGTWLQMTADSGSINGIVAPRVPLSSSSSSLRGGWDDKLRRRPPWALDEYQTNDSPHYEKQKFKTLEDIQKISSPPSALWLLFFFAAKEAAHVFFPLHIAVDISHTLSMTLYTEATAKVVYKRCQKLF

SEQ ID NO: 934152 - protein, 137 aa, Homo sapiens
MKDVYTNTPSVGHQHQRPKVDKTTRMGRNQRRKTENSKTQSTSSPPKDRSSLPATEQSWTENNFDEPTDIDFRRSVITNFSELKEHVQTDHKEAKNHEKWLDEWLTRINSVEKTLNDLMELKTMAQELRDACTSFNS

SEQ ID NO: 934153 - protein, 141 aa, Homo sapiens
MFHLPSPVPMGLHLLVDFQYYVEEEWNGLLGDPASSQGLSAASSTPVFHSALQIDSAPGKVGNFSRKQTFSFSSGGVCSGEEGLPFLLPQLGHSKFLGVVLGPAVTVHLLQRVCVSSQDCCPFRFLMILLFTDCSDCRFSI

SEQ ID NO: 934154 - protein, 197 aa, Homo sapiens
MARRDVLRRESSRFPASTVLGRNPALVPHPGRPPIASPPSPFHRALGLPQGPRRRSRAAQPPPPPLLSRRLDDRVHLAGAPELPPGLRGGHQPPDQPGALRLLRLPVHTVMTGSGLNEMECALHLEKNVNQSPLELHKLATDKNDPHLCDFIETHYLNEQVKAIKELGDHVTNLHKMGAPESGLAEYLFDKHTPGRQ

SEQ ID NO: 934155 - protein, 151 aa, Homo sapiens
MRKKQCKNAENSKNQNASSPPNDHNSSPARAENWIENGFDKVGFRSLEKNINELMELKNTARELREAYTSINSQINQEEERILGIEDQLNEIRREDKIREKRLKRNEKSLQEIWDYVKRQNLRLIEVPESDGENGTKLENTLQDVIQENFP

SEQ ID NO: 934156 - protein, 136 aa, Homo sapiens
MPKCHILENHVLQPNILFPETSLDKSRTSFFTVNPGTLKKKRKCHRTKLCNTSTGYLTAPHGKGGRFRDTRGLTNEVLGCWGDDGTQRDPTGTMLESMAVPERRGKYLKELGCCDLSSIYFRGHPKPSNAVVVSDL

SEQ ID NO: 934157 - protein, 149 aa, Homo sapiens
MRKKQCKKAENSKNQNASSPPNEELRDAYTSINNQLNRVEERISEIEDQHNEIKHEDKMREKRMKRKEQSLQEIWHFVKRPNLHLIGVRESDRENGSRFTKVEMKDKMLRAAREKGRVSDKEKPMRLTADPSAETLQAIREWEGNIQNS

SEQ ID NO: 934158 - protein, 183 aa, Homo sapiens
MGATIQNKIWGTAPLVAAFMGWHCLRLMVQALGGSIILGLEDGGPLLTTPLVSAPVGTLCLTWKIDTKKRLKNPFWQAQNGCAGSLISCPAPVMSRSSSGGSNVFQYFCGVALMPLCMVLQPSWNLPWQIPGGSPKIRKLKKLVSDVRGQEASSMGGKMKAGRLSKSPHSTLFCLLYSSHAGS

SEQ ID NO: 934159 - protein, 196 aa, Homo sapiens
MVPKCFIGQWQQDPCPFTCGSRSSSTAGCTLVSWSKALASLGLLASIWALETVDSVPGWKGVGAQVHLYSCVLLDEYILWIHAGSSGGVVKGMGLLVSPSMFLPSMGMGISGHAPLQTFLYQTLWAPHRLESCPYHLSKQLSLTVKVSVGVVGYPAARMIEVHGKSELFLACSTHPFTGRLNGQLSHSVEEVPILY

SEQ ID NO: 934160 - protein, 150 aa, Homo sapiens
MLAIAPAEKPGSGSRLSAQGASAMCWGSTSAPSCLGNSEARRLLWLSRANSQDGSPPLPLGALSQGILKPLSTGEHWHVQRCCLGASDWSRKTTAVYLMFYSTVAKLTLTLQYKVLPALPSTFHRQKNLSLWQLPPPVHRFSAGPLLMFT

SEQ ID NO: 934161 - protein, 138 aa, Homo sapiens
MLHLPLDTHRENSQTESPSVVCCLPTCSPFVLPNPQLQASPHSLVLASHKLEIRWNCGSREWEGERFQRQGWMVSLIQPILNALFSLEKGPLGKTYILREQTAKRKKEVPFDKCIGKGKILKKEKFRIMLAKYKQKNK

SEQ ID NO: 934162 - protein, 154 aa, Homo sapiens
MALLGIPWARRETTTLKGESQARQHSPQADIRDLGPYRNISGNLAVLLVAGVGSDYGDSYPGHTDTKKEGLPTALGSSAPVALQGDIPEEGIVITGEDSSMYVNTPKELPVEEDVKVEEIRIDGPDPVCTDTYHCVIVAYNIQYSNRLQVITFP

SEQ ID NO: 934163 - protein, 280 aa, Homo sapiens
MIKAAATFNYLSKRQFAEEIGMDISKPGGILQEIGRITLKVFQRFFRLQCTSQALRKEGFQREPQCAHETLDLAAQGTSSLYSLNSCAVLLTHFSCDTDGPRAHQGQDIWQTRNFNQALNVCQRYGQRLVLVAFPASQCKLLLDLPFWSLEDGGPLLRAPLDSVTVGTLCGGSNPTFPFYIALAKFVHKGSAPAADFYLDFQAFPFIFQNLGGGSQTSILDFCAPVGPTPCGSHQDLGLSPLRQWPELYLDAFSPQLELEWLRCRAASPKATHSSKALGP

SEQ ID NO: 934164 - protein, 149 aa, Homo sapiens
MVLVPPSPKLLGLQDLLRAVSQAMVTYILARNKSLQIFYSLTLFINSHLLKLSFRLPSTTAVCRCCRPAADSHPAADSHPSRSGRVSAVLLIQAITLTAWPKIPFLGIREAKNPRSENMRLATILEAARHHLGSGSPPSWELCEQGTPR

SEQ ID NO: 934165 - protein, 135 aa, Homo sapiens
MWYSATFTKEDEKQNKSLVLKFQSWVSTYPGVGAPPETNRKVVETVLKSSHELDVNWSCSRGVPGERTENEQQTATVKNSKRIQVQYKHGSRATNNSCLFNVNNGGQRPPIREAIFEVWGEMNLESISSKNMLNN

SEQ ID NO: 934166 - protein, 198 aa, Homo sapiens
MDFGDLGGKSGKGQGIKDYKYGASVDNAPSTYTVDNTLSTYTVNNTLNAYTVDNTPGTYTASNVNIYTDNTPSTYTAHSPPSTNIADKAPSSSSIDHVPSISISDTTLSPATSDGILNPSSTNHTPKTATSDRTPRSSDSTRRPSSFDSTPSSSASHSAPNTSISENAPNTSDIGNALSTPTLPVLRLRLDIERNRVL

SEQ ID NO: 934167 - protein, 145 aa, Homo sapiens
MHPCGQHYFDCFGSDLRSAQHCVFPKACCDHSVATAYVRRYCLCSLQALGLYNQQVAKQGMSRNVIEELSPGIRAPSACLVLYYPPVAVLVPKPPYFSFCFSQAEGIFPGNHHSWMVLSPVPHNCCALPPPPPRDALHTMLLLPG

SEQ ID NO: 934168 - protein, 139 aa, Homo sapiens
MHQSALCKMDQSVLCKMDQSAGSVASLLKSARPQTHQEEQTTPDTPTLRAVTLTAKVCGFTPEVSKTTNPLEGRNSGHIQTLRTVTFTVRVRGFILEVIKTKNPPEGTNSGQNSTMRYARICGDAEVNKPTVLPVGIEQ

SEQ ID NO: 934169 - protein, 157 aa, Homo sapiens
MPWWFVAPINPSSTLGISPNAILPLAPHPPTGPGPADKMQHLGRDALNNQWVNEEIKREIKTFLEINENENTTYQNLWDTAKAVLRKKFITINTYIKKEERSQINNLTLNLKELERQEETKPKISRRKEIIKIRAGINEIETRKTIEKINGTKSCCF

SEQ ID NO: 934170 - protein, 194 aa, Homo sapiens
MKCDVDICKDLYANTVLSGGTTMYPGIADRMQKEITVLTSSTVKIKIIAPPVHKYSVWQQEGDVLSKSEKAPYKIIRSRENSLSREQHGGNRPHDSITSHQVPPTTHGDYGNYKMRFGWGHSQTISLKYAFFKRKHTNDQQVYEKMLNITNHQENENQIHNEISSHPLEWLFSKGQLLERMWRKRNPCMLLVGI

SEQ ID NO: 934171 - protein, 164 aa, Homo sapiens
MSAASLLTSARPQTHQKEETPDTSEHQKEQTPDTPSLRTVTLSKRVHGFILEVSETKDLPILDTKGISRIRFRDNTDVGTVWHEIQIAISNMLKAPMEKVDDMHNQRDQNYKKELNEKHSNRDEECVWLISRLDIAKGRSSELEDKSIEMITIEAQSEKKKRKA

SEQ ID NO: 934172 - protein, 148 aa, Homo sapiens
MPGATAAPEGLIAPAAGSAASKQPPAASAYRGCLSFRESPPQRLRPCSRWKKKKEEEEEKRRRRKKKKKEEKEKKEKKEKKEKKGDEKGRGAFDVISIGAWASRPVQGMSLPNKGVGLSGIIKKTCEKSKVPQSQLSGWEKLSSDCLS

SEQ ID NO: 934173 - protein, 154 aa, Homo sapiens
MPTSQLCSLDPQGLESIVMQGAKVWQLQQSASRFRGACPLANVHHSGEGKATGRGNGGATAGDCVHSCTGGGVGLGRGAAQCRSGCLLCAPQAGVITQEHCYTNSGTGASQPSKEPPGRPRTIFAKEVYSASSVLELAMQASIVKATAELRKKG

SEQ ID NO: 934174 - protein, 167 aa, Homo sapiens
MGVNLTIMSKILKCAGNEDIVTLRIEDNVNTLVLVFEASNQEKVSDYEIKLMDLDVEQLGIAEQEYHYVVKMLSGEFAMETLEIENKLSQTSTVDKEEEAVTMEMNEPVQLTFALRYLNFLTKATPLSSMVTLNMSADIHLVVDYKIADVGHLKYYLAPKMEDEEGP

SEQ ID NO: 934175 - protein, 134 aa, Homo sapiens [sequence omitted]

SEQ ID NO: 934176 - protein, 163 aa, Homo sapiens
MVICDQQSLMLQPCPYKTVNLNLVQIGDQTSHTIPLSQSQIKSKALTLFHSMRAKRGEKGSEASRGWFIWFKERSCLSNIKVQGADAEAVASYPEDLAKIINEGDYTKHQIFNVGKTAFCWKKMPCWKKMPSRTFIAEEEKPMLAFKTSKDRHLLLGRGQCSW

SEQ ID NO: 934177 - protein, 148 aa, Homo sapiens
MNRWSIFVSARCSLTAVSTSTTISLHLMAKGRCHHGFRACIQYFHKRNRGDSVYQEMSHALFEILKTFTSRIRATIIITIKHSRTHKTSLTDDMQVDVIAQSLACKVDINTYSAFPSVSNWAICKIGWEVRGLCSQKDLDAYPDITIF

SEQ ID NO: 934178 - protein, 189 aa, Homo sapiens
MSAKYNNPYFHGMTWQRDFPQLCQEAPLPRLQVSSSLVILLPPLALAGPRKQQQEATKTEGEGEEPMTQALRSRSQPVKAGTRTGLSFKGKDIAPVGEAIQGREGWSSFPLRTIPSIGCTQAADTGAYSENWPAGVNPPALQSGTGKRHKNKLRARSGVHVQVCYAESQVGCLRRSLQGDECKLLKNSI

SEQ ID NO: 934179 - protein, 409 aa, Homo sapiens
MGEGYGGVSGMGGITTIMVKQSLLSPLHLEVDPNIQAVHTQEKKQIKTLNKFASFIDKVQFLEQQTKMLETKWSLLQQQKMAQSNMDNMFESYINNLRRQLETLGQEKLKPEAELGNMQACRGWQLYEEGIRELQSQISNTSVVLSMDNSRSLDMDSITTEIKEQYKEIANRSWAEAERMYQIKYEELQTLAGKPGDDLGHTKTEFSEMNISRNISWLQAEIEGGLPWRPPSQMPSSDAKAKLSELEAVLQRAKQDMARPLREYQELMNVKLALDVEIATYRKLLEGEESRLESGMQNMSTHRKTTRGYAGGLSSAYEGLTNPSLSYGLGSSFGSGVGSSSFSRTSFTRAMVVKKIETRDGKLVFQSSDILPKGTAAAAPPSLPLLRLPQSLGGRLLCRGAQGTGGRLT

SEQ ID NO: 934180 - protein, 132 aa, Homo sapiens
MDNEVHAEMISDGDEELVGNWSKGHFCYAKRLAAFCPCCRDLWNFELERDYLGYLAEKISKWQSVQEEAERKSLENLQPDDAVEKKNPFSGEKFRLTAEICISNEEPNVNHQDNGENVRDLHGSPSHHRPEA

SEQ ID NO: 934181 - protein, 186 aa, Homo sapiens
MVAEEVAHSVGDHHQTRKERGSRTLVIRLRALQGRQVNCRRAGDEGEGEEDDCHQPEEDRYEHHPAIGRVQVVRGVCNQGPHQQPQHQLQQHERPRRERTKPRSVRSAYTKAPASCAGLLVARAAVAAPPVVGASSRAALPRGSLSRCGPEHSRRPGCGPWSYGFLASCEGHTGGDIVQGLLNFRV

SEQ ID NO: 934182 - protein, 170 aa, Homo sapiens
MNLFLSHKKSNADFPGLWFSSEQRLGDPSSFSLLGLQRSLMPWLVPPQAFREYCQATANVPLRPKGPSVSLWHMLPGLELILHDKGLPSGPGQFQKCCPRAKSWNWAEGVLPHRHHSWEYAKSHLNPRSLRVSPTTHDILSGYYSLLFRAQGLFSQQVKGPARTGSLPSR

SEQ ID NO: 934183 - protein, 143 aa, Homo sapiens
MTARTLQNVKTRKRRRIQQLRGAASEVDSNLLLWLAGIPSQRVLTCEVPWKWGPQNNTAWLPGFKPLPRDMYRWISCLARDPGARVCETAELGSPRSRCQQDWCLVRAALCFQDGALLQHPLEEMNVVSSQDRRDRRGNVELA

SEQ ID NO: 934184 - protein, 144 aa, Homo sapiens
MLRAPRGTAAGHKNHFAAVWNGPLSDRVSHHFCCSHLALCFSVALLKGHGELAPLATLPFTVFVGRKAKNLREERVWKSFPGANQSVSSNFQNQSTLIFFPKTYLHSQQRRLTPWPPPSQAHREYCQATADASLRPKGSSVNSW

SEQ ID NO: 934185 - protein, 222 aa, Homo sapiens
MGAADWLGMKSQGCGKWSLFTGSASGQGPEDQTPLSWPLAPRSLHEGGHSRMECKILLVKESGTCDSMCLTFENQESIEGGAKNAERQHSLCPTQQTIVPEPVSSPADPSGSIPEEGIVIIGEESSMYIIAFEDLPLGQDAEMEGSDIDDPDPDPVCEEAAEEKLEAGRDWVMRFKKISHLHDIKVQGEAANADGEEATASYPEDLAKIIDEGGYDNNRYSM

SEQ ID NO: 934186 - protein, 137 aa, Homo sapiens
MESYHKAVKVVPWLRYSMKAEWVCMFSCSLVPNDTTLAKVGTDSFSLLPGEDGGSVCCWTPLTLHCGAISKLPAFVWQGVEGQLSAQLYQYLCMGIRAPAAFAWWALEDPTAGKGTDFLLVFGWSRAGYLVLLSHRS

SEQ ID NO: 934187 - protein, 202 aa, Homo sapiens
MGKLLSYQPNRGIKRPRDGKEEEQKMHQKQTSTQDWEEEMIVVEEAEDDKHLLLQIIDTEGEEEEKEEEPLDESSIKFPDNPEKFMESQLDLHDIIQKMHLVATMPDLYLLLELNAVQSLLGLLGHNNTDVSIAGVDLSQELTDIDIFYESGEGAEVLIDALVDGHVIALLVQNVERLDESVKEQVNGVHNTLVIVENMAEF

SEQ ID NO: 934188 - protein, 170 aa, Homo sapiens
MIKPEDVIEDSQNSSIILVHHPFNRHVFRTCCLQAPWGYSNEEDTVLLSSWNLVENTPKPVRVPCDKLYDKVNMGRSPEFWGPGEAPMGSTLFRDSIAAWNDTLSSISSFKNGGTQAWGNEDLKGFVPLKGECEKECENISKSRAWPPAENQGGNRLQSNSCEDLNSANS

SEQ ID NO: 934189 - protein, 255 aa, Homo sapiens
MDTEKQATLQAAERFGNEFCITYSIREGGDYYPSGREGVPVSNSKRDPNDEMEDWKRRHFQVCIMEGLCRTKTKPLNYAKLSIIDQGFDDNSTAYLESLREDLVKRTSLSPDSVKGHLILKEKFITRAAPDIRKKLQKLALGPDSTLEDAPESEHRDPSRQRHKQLEVERNTSVEEDTVAGHQEDTCGRAHRQAIDRRNDMEFGWGRRRRDWTTEQPDSKRIAPSRSISLLAPPSAESYLHSIKPCTHSPSPLVL

SEQ ID NO: 934190 - protein, 134 aa, Homo sapiens
MEDYFVCVVEIYLILFCNTAKLALNLQDIVLPTILPPSQRQIDLILWLPPPPPPNDWDSPFSSLGFPLTQGRSRNAVQEPCPGPQKPIWFSTTLWLRWYLRCKKKIPFTFPITFPKQKTSFLIATTADKVLSLT

SEQ ID NO: 934191 - protein, 348 aa, Homo sapiens
MFCVPPIFVSGTGGFLVSLTSRMKPRTLAAARPELFVPPGGFVVSLASGVKLQTFAGSVTAHKGSVDPKSEQHQDLLQRAKEQSYHSVEGDPSGLPLLARAACFSRYRVPTGVFTIPELDIKVLHVPTRLRSPAGFTQWIPHRGCRWSCLPVPRRAPALLSPWVVDGTGHRGTGGGTRRGGWGSTGAHGEGGEAEAWRAAGPEPCPAGRQLRPSEKLSTAAAGPGAKPLTAWGRWGWLAAPSSGSAEPTPTRNSRWPASNARGPGSRPHFSLHTSRQAEGAGSGLDQPRKGFPQCSGGLKGSSSAAKVGAQAEEAPRASEGCEDCQHTVTSHTVSAVKSTVSSMGFSL

SEQ ID NO: 934192 - protein, 134 aa, Homo sapiens
MTFVFSFQSRYRKTTRPGASPLREEAYSQFFGIWESLQHGSSSFKRSVDSLGFPDKTEPNQNAHHHVSSRENKESWRSYICSCLHHQKSGRLDSKVEDTFFYADSRITLSFSDLRGKDLWTIQTNKNTVDESVL

SEQ ID NO: 934193 - protein, 124 aa, Homo sapiens
MLSRNVFGDYHPSAINIAADEAMMLILNKDTKDSTECNMSQLLDSPSPNSQTCSPHHAVAAEIDVSPSDMMLKPVTMRAHLIFGSYDGVFTSSPSGYSNNRMVQILLWHLRHHDKRMHLCYAQH

SEQ ID NO: 934194 - protein, 220 aa, Homo sapiens
MQPHKERLKASKKKTFWIYYERWKNIPDDHDSVGTQGYDIYQRNKNSSCEGVTSTTLKFRIQLTREVKDLFKENYKPLLNEIKEDRNKWKNTAILPKDTGMGKDFMSKTPKAMATKAKIDKWDLIKLKSFCTAKETTIRVNRQPTEWEKIFATYSSDKGLISRIYKELKQIYKKKTNNPIKKWAKDMNRHFSKEDIYAANRHMKNAHHHWPSEKCKSKPQ

SEQ ID NO: 934195 - protein, 164 aa, Homo sapiens
MRLPQPCGTVLMAELPHRIIKETQRLLAEPVPGIKAEPDESNARYFHVVIAGESKDSPFEGGTFKRELLLAEEYPMAAPKVRFMTKIYHPNVDKLERISLDILKDKWSPALQIRTVLLSIQALLNAPNPDDPLANDVVEQWKTNEAQAIETARAWTRLYAMNSI

SEQ ID NO: 934196 - protein, 160 aa, Homo sapiens
MCGSLIFGCLCAIGVLGWSPTPHTQKCLLPLPGFSPLLTPAPITEVWLRMHTPQSLQELGTSGSPTPFKLYWWEVPGCSCSHPNLAADPGFSVLLGTWVGPRTSRGSEVPVPVAWPLPTTRAHSDLGTKLGLSSGATAAQLGSQLSICISVFSHGYKDTT

SEQ ID NO: 934197 - protein, 140 aa, Homo sapiens
MCASPSNAHVSRGDREKDFPPGTQTCATTYGPCQCDHVTSYVRTGQEIRKVGINKCRNLINYIMEQYAYESHLPLTVLSSQKMNPDYQEEFLLLLHNVNKIEYVRNCLLSTSTLPLNLFIIKRKDYLPYRVIKEKFCASY

SEQ ID NO: 934198 - protein, 141 aa, Homo sapiens
MNQRPEHQKSTEPYAYETIHSSTAVERGQVGLDSPHRVPTGALPSGALRRRPLSSGPQNGRSTDSLHCALRKATGTQHQSMKAVIGPVPCRAIEVELSKALGAYPLSQCGLDVSREAIHFSDILLFQCSSYSDHTGTSFHL

SEQ ID NO: 934199 - protein, 136 aa, Homo sapiens
MPYFTLFSTGNPHTLGQKATCCLERNDQALAAFITGHLNSPWFLNRQQRYPGTASRTLGEPLRHTGFRYQYGLNSWTAFLDLPVTRQVPTALKGGKCGKNGFLWFELWFECRLSCSTVEHQNGYKQAQTVKTTIDT

SEQ ID NO: 934200 - protein, 152 aa, Homo sapiens
MKVQRNKNKPNQNSAAEKKITKIKTELNEIETQKIKKKNKTKSWFFERVNKIDRPLASLTKKKRQKIQTSSTRNETGDITTDTPEIQKIIQGYYEHINVHKLENLAQMDKFLKKYNPPSLNQEESETLNRPITSSKIRMVIQNFRQKNSWAR

SEQ ID NO: 934201 - protein, 139 aa, Homo sapiens
MHHADPAGALGVGGIFSFWLLVITPFSHLFRRREHWKVREGNMVRKVKIGVMEPQAKECWQLPYTGSDKKQILPRCPQKEFALPNIFIQSLLGFIYHMQCKFEMSSRGFIKIICNCFLNLFVEICTTFQSSLGLAKIAK

SEQ ID NO: 934202 - protein, 148 aa, Homo sapiens
MGGTLLVQLVTGTTCTNPTADAKTDICCSTSPMDQGIRGSLIYPGISSNPIKLQFQIKFHQPKDSTREILCLLKPVCKDWKQCLLLQMYRHKLKVTWIMKNQTNRSPSRETNKSPVTDLQEIEIYKFPNKIQMISLKKLNEMEGNTDN

SEQ ID NO: 934203 - protein, 161 aa, Homo sapiens
MDSWARTGVGCTSLHRAGPERLEEVPRHRNDKRQTNSQTVQYGAEVAARVTLEKPARRNEDYLTSFVYISDCLSGWLAQGNGCTTLHSPTPFSVNSLVLCVTPEGLRYKVGEMGRKKSCNDSDSVLPLPGRCGPTKIRCRARKREKERGERLKQDSGQSLR

SEQ ID NO: 934204 - protein, 140 aa, Homo sapiens
MGANPYGSTATSIPACSEEKIRLSGIRPKKTPRKWNNLKHKKFKFPNITRVVCAVNCEGYCQCSLKAQGLFSQLVVNNARRAVGSSVPHGKSKNVVQEPWPGIRDPKSPPRSLAPVAGWHLRCKTKSPLLFLLLFSSRMI

SEQ ID NO: 934205 - protein, 197 aa, Homo sapiens
MALTKMLRWSQMEMRNLLGTGTKVTLVILQQRDWQHFCPCPRDLWNFELDRDDLRHLAEKISKQQSIEDVSRMLIKSFSFMHSQIYGLEFELTFKREAEHKSLKNLQPDNAIKRKNPFSEEKFKLAAEICKSHEEPNVNCQDNGENDMVPCIPAASAPAVAKRDQCTAQSVASECVQAPSLGGFRVLLFLSGERRHP

SEQ ID NO: 934206 - protein, 125 aa, Homo sapiens
MGTRQSPFYFSLYFSQAEEALPHSHHSWECVNSHLKPASLRISPNTQCSTWISLLVIQGPKALYLPSDECCQDWVLPFKAEGSFLAQNVSRNVVQNAFQVYLRPDSILTHGGKAFGNSCLDYWDQ

SEQ ID NO: 934207 - protein, 150 aa, Homo sapiens
MAKAAKGHCTRIMEAETQDVQMCPEFLPSSGFMVSLTSGVKPQTFAVSVTALKGVTSGVVCSSWWVRGLNDFRSEATDLHMSLGEQFSAEIIRALLCGMLNPNCIKDNATNFEGIIKFSVRVSSTFITPCLQCQVVKIMLKPERLWERYK

SEQ ID NO: 934208 - protein, 264 aa, Homo sapiens
MHSYSLLPPCEEGACFPFLHDFLIQEEKWEYNRREKDTRIPGKSIPANSSHGSIQLIKVSEAPVRIWVQGVPPLLYTQANLQTVGVPAHLDQQPEPPHLFCAEIVAKGAVPSSCAENLGLKRFPSPMPGHTNGHLMGALWKPLNTGGWAELLRDMWVCLLSLATPPILDRYPGLSRELRTLCTPQISPLPETTESFFQQIRIRNTTIRFGHSWLVPKSVIYQPGLQMRRSQGKNYGNIKDLNVLTPLKDHASSPAIIPNQNRNS

SEQ ID NO: 934209 - protein, 138 aa, Homo sapiens
MPEPPTHSVGSCAAPASPTSATPCSTAPSPIDLPRAEECGCTAQDWQAAPPAAPVRDPLGEASWAPESASETTNPPEGRNSEHIRTSEGTNSRRATLRAVTLTARVRGFILEVSETKNPPIPDTGEIKIIKIMFRNSI

SEQ ID NO: 934210 - protein, 313 aa, Homo sapiens
MHGRSMRKIVVGLIFLITWTCVVKASTASSHTEDCFQCIHEVTDVGQQVKAIFLFYSYYECLGFPKGACLYDNTQYKVCNPGVTSPMCAMTPLNLPFPVFEIRLRTEDWWGLINDTSKVLARTEEKGVPKRIILKFDACAATLKKVEKDPVWLQKGKGSPSCTSGSCNPLELVITNPSDPKWKKGEYISLGIDGKGLDPKDGLVVLDDNCIMVPQKQLHGGVPVTQKEIHSANFQNCRLFRPTQNSTGTGLSPQGYTGYVDVEPMLSYLISGQKGNIVTMVFQMSTVFSMCVGAIGTCDKSASNSTNSHGTLH

SEQ ID NO: 934211 - protein, 144 aa, Homo sapiens
MQFSLQSSKCYLEASRCSECREICQGMFQRRPPTPGSLHRKGGMAPATDADKLLLPMPGDVLGLGAERPPCAPPSMYKKGEAAQVADTDEWILRMPDDMSGCEAEMACLHQYLCTGGVNEELHPSAFLVSVVLSHPMVALESLR

SEQ ID NO: 934212 - protein, 143 aa, Homo sapiens
MQGSFIINTSLIKTLLKAALLPKEAGVIHCKGHQKASDPITQGNAYADKNLGLSSECYKEWGAAVKIPKNVDMTLELGSKQRWNRFEGSEEDRKMWESLELPRELEGSEDRKMWESLELPRDLWNFELERDNLGCLVEEVSNL

SEQ ID NO: 934213 - protein, 138 aa, Homo sapiens
MLTTVIKKYKDCFPVIFRKAHEFMELMFGIALTEMDTNNHSYVFENTVELCDQGRLSDGQGMSKNHLLILILSVVFIKGSCASEKVIWEVLNSIGVYAGREPFIYGKPRELLTIDWVQRKYLEYREVPYNARPEYELL

SEQ ID NO: 934214 - protein, 270 aa, Homo sapiens
MHTYKVTAFGHRAFEEFNGIIVVSPGGSVSPSGNKTSRPPECNVMGIGSKSVASGSLGVMKIEGPCSKILEPPAVIHQWGPAKRFKQHPYPPLIPQAALDLLDHMAQVAGQLAQQPGPVAEPSPLLNLTQNWQPFGRPVILCKGKSIKVSPNKIMTQSRRVDVPLRYDGKGILLALPAEGNLLLVGLMDRNGEKGICQINGCIPALHNSLSLHNSPHPPSQGANVGVLQAAKYVYANYTFWHWENGHRMSPGTHWIILHLGATNQLHYVP

SEQ ID NO: 934215 - protein, 162 aa, Homo sapiens
MCCRCTKIGKLKADSGSMPAAAGRGHERSLVYIPNMTGCYRNLMRKCGKYRGLWRTEGTQLSWKLGKNSKGNATPSQGCAPLSSITVCILLRLVFRFLSYEKPKPTNKDGFIQPHVHKMMGTCLRNIRSRNLLTGTFITILIRFLAADKDILKTGQFTKDKV

SEQ ID NO: 934216 - protein, 182 aa, Homo sapiens
MRERPGVGYCCSRVAGVREKSGEAVGYCSSRMAEFSEEEEDTVRYCCSTIEDVPEEIKEAIAYFCSKMAEINKEPEGNIGHHCYIIPKVTEEVGEASSDMPEPSTSTSQENPSMKWRKKTTCEAKEGETDELLKAAKKIRSFVQQNSERRKAGKKSTVLIFYYHSNKKRDENQPNEDEDSHE

SEQ ID NO: 934217 - protein, 145 aa, Homo sapiens
MMPPLTIMGNSTRIRHKALDICQDCRIPAPLFKRLNNSKSRIITFVLDPTGSEEDRKMWESLELPRDLLNGFAQNADGEMDDKVQAEVVSDGYEEFVGNWSKGDSCYVLAKRRQHFVPAIEICRTLNFIGGTHPQYFHVGSSYFP

SEQ ID NO: 934218 - protein, 140 aa, Homo sapiens
MATYLFYQCDLDVRHGVKGDNSGILKFDCPAGFQTCMVSIVLTFYDPDRALRDNHIRNLDLGPSFVGCQWVAIVFRLSQLTKQENIEVGAPCSWAFRLRLNYTTGFPGSPTFGHQMVKLRLHKCMTEPMDFLLISRIRHE

SEQ ID NO: 934219 - protein, 243 aa, Homo sapiens
MAEGEEEGGVSSHGRQENKRQGEVLHTFTTTRSCENSLTITRTAKRKLAPMIKSPSTWPLLQLCELQFVMGFGWQHRAKPYHLSNFLMNYCGTSTTTLQYFCQDWTKGNMSEDQPRHLAAQEQWRAPLGASLIRRAEDTLLDLEEWKSMAAVVDGRPSAVVDGRPSAVVDGRPSALVDGRPSAVVDGRPSAVVDGRPSALVDGRLSAVVNGMHLLIRDRGKLNQQLLGMRSVGGTRSPCIISL

SEQ ID NO: 934220 - protein, 269 aa, Homo sapiens
MRIQFQSSTCGLPVFPGPFIEYSVLSPLYVFVSFVEDQLAAFSTDYHQGVGLVGLDPANSVFQYWEVDVGVKGTQTLKKLHRFFPQAALAARIYEVTLVLREVVQKTNVELEPSHRIPTQALPSGAVRRGSPSSRPQNGRSTDSLHHVPGKATETQHQPVKEARRGDIPCKATGADLPKAVEAHFLHQRILNDDNGNIYTVIGDYINQINTSRGKFNSGVLYKFGEDFEAASIQCEVLKYIHQTANNMLYLKLIMNKCSGSNVNFSHNT

SEQ ID NO: 934221 - protein, 187 aa, Homo sapiens
MCLCSSSAFWHDWYPADKISKQQSTQEEAEYKSLENLQPDNGIEKKNPFSGEKLKPAAEICIKSASPKPWQLPHGVEPAGAQKPRIEVWEPPPRLQMMCGNAWMFRQKFAPGAGPSWRTSARAVQKGNLGMVDPLTACTVFLEKPQTLNASHDSSHRGGGGLYPAKPQKQSSPREPTSCISVTWIYY

SEQ ID NO: 934222 - protein, 166 aa, Homo sapiens
MLGCPGRSLLEGQGPHGEPLLGQCRRETWGHDPHTGSLLKHHLGIAGKRGPLSSRPQNGSSSDHLHHIPGKTADTQHQPMRAARREAVPCKATGMKLPKTMATYLFYQCDLDVRHGVKGDNSGILKFDCPAGFQTCMRCLRLPWCSWLIFDFTLPRGKEEALITQR

SEQ ID NO: 934223 - protein, 180 aa, Homo sapiens
MRMFLTALFTIAKILNQPKGPSAADWIKTMWYINSTEYYAAIKKRDHVFCSNMDGAGGHYSKRTHVGTENGIPPFSIYKQELNIGIHGHKEGNNRHPCLLGGKGWGGGNPALTYKANKALEKLASYFVYTDHGHFTDNYPKTSTDGIAPTVNPKNSPSPRQQEMRHELFAGVPLFQCRHL

SEQ ID NO: 934224 - protein, 159 aa, Homo sapiens
MRMFLTALFTIAKILNQPKGPSAADWIKTMWYINSTEYYAAIKKRDHVFCSNMDGAGGHYSKRTHVGTENGIPPFSIYKQELNIGIHGHKEGNNRHPCLLGGKGWGGGSLVRSHFIGKAILHLMVKTLNGTCTSFQKNDTFISYFTTVPGTCKLASNIW

SEQ ID NO: 934225 - protein, 147 aa, Homo sapiens
MDLMPAGTLLYKVSGDPSAVLWGIPPGSKSSRFPGTGRGKMADWSHSDGSHTSLQEFSRRRQLAATVMTATPPPGGSASLAVWPPRICTALCLGPKALVVWAHEGDPLIHRLCRSMAKAWLPDKGSTIAHRLPLLEMVVPLAPCDSQ

SEQ ID NO: 934226 - protein, 143 aa, Homo sapiens [sequence omitted]

SEQ ID NO: 934227 - protein, 136 aa, Homo sapiens
MPFLITTLSAGHFSLDLGPTWVIQDDLISRSLITSAKKTLSQYGAGPLWSEGLMTYSQTRRYPEEGIVIIGDDSSMPVTSPEDLPVGQAVEVEDSEIDNPEPVNLTSMTKMFLELSFPTSSLLQFFRLPDVEDKSL

SEQ ID NO: 934228 - protein, 142 aa, Homo sapiens
MAVSEKGMPVGRRKCESGAQDSAFLMGSQVVLKLLAQGAQSEHSLPRSVSEKLATAGLASSLKQLGKCLTCDITGKLPMNQYPGMTVPETHPPFLPPGNKEEARRAGPKNTNKANLGLVCTSDFAKILMPALGIAKSSHPVA

SEQ ID NO: 934229 - protein, 178 aa, Homo sapiens
MSPCFWLLTGGTGEGQLDGREGFISIGLLLRQDAGALHSGCSGWWQPPTSFRTSRSILLGPVGHTGNSWEAPLPQRPELSLASPPLNPCSQQQPGSPPSSAEGYPATWTQSPTADYGELHSCGDRTQVSWQQICPVEGNPSLIFPPGSKPEVSDEGADFSILASRKECSPADTLILAQ

SEQ ID NO: 934230 - protein, 272 aa, Homo sapiens
MRKSQRQKAENSKNQNASSPPKDHNSSPAREQNWMENEFDKLTEVCFRRCIITNSSQLKEHVLTQCKEAKNLEKRLEELLTRVTSLEKNINDLMELKNIARELCEAYTNINSRTNQVEERISEIEDQLNEIKDEDKIKKNEKEKQSLQEIWDYVKRPNLHLIGVPEIDGENGTKLGNTLQDILQENFLNLARQANIQIQEIQRIPQRYSLRRATPRYIIVRFAKVEMKEKNVKGSQRERSGYPQREAHQTNSGSLGINPTSQKRVGANIQHS

SEQ ID NO: 934231 - protein, 164 aa, Homo sapiens
MSQGHRVNFKSLSKSFMEKFLNLSTTDLLDGMTAVCGCAVHQNATNIPGPYSLDASSIHYPSCDSQNCLQTLANVPCGVNSPWVEKHCPNSTVCFQDERLSVCPFPKNKHLFLFWVWWTLDLQLLRGPGDLTVSSINIPLTLLLLDPHLHSPTPHHEVPGPINS

SEQ ID NO: 934232 - protein, 150 aa, Homo sapiens
MMYDFETFSFGSSILEEANCQIAIWKDLCFEELMPPVNSQTGTEVSCRQQCNMEMQKRRRKKKEREEEGEGEEERKKEEEKKKEKEKEKEREREEEEDRRRRRRRGGGEEGEEEEEEEELLSFSGLSAEFHENFSSTKSKLVDSRLSVRS

SEQ ID NO: 934233 - protein, 128 aa, Homo sapiens
MGIAQRTGVIGRYFKSVRDSHSSITRGKEKVNKLFSVLFMTLYLPSSSCNLGRAPKIHCRRKGLYFLVPLTQRVPEACLAFSDIRLLQHRQFLQYLALAVYSASRIQHKNTFFDFYIQVLANYAVLEM

SEQ ID NO: 934234 - protein, 144 aa, Homo sapiens
MSIFYVNYSLWEHLISNMVIFNKAGEFKIKASGEGCSLFLRWCLEHCLLQKVGMLCPHMAKVSALRVFTLSLAAPCQWSGPGGKPQQLCSSFELKAAPGTVLTELKVLTIPLLNGLRPHSTSRIKVDTGIHFANSLKVIGNKTL

SEQ ID NO: 934235 - protein, 324 aa, Homo sapiens
MSQDQESPRCTHDQHLQTFSETQSLEVAQVSKALEKTLLSSSHPLVPGKLKEAPAAKAESPLEVPQSFCSSSIAVTTTSSSESDEASSNQEEEDSPSSSEDTSDPRNVPADALDQKVAFLVNFMLHKCQMKKPITKADMLKIIIKDDESHFSEILLRASEHLEMIFGLDVVEVDPTTHCYGLFIKLGLTYDGMLSGEKGVPKTGLLIIVLGVIFMKGNRATEEEVWEVLNLTGVYSGKKHFIFGEPRMLITKDFVKEKYLEYQQVANSDPARYEFLWGPRAKAETSKMKVLEFVAKVHGSYPHSFPSQYAEALKEEEERARARI

SEQ ID NO: 934236 - protein, 139 aa, Homo sapiens
MQLLCKDSTPLCVSHPRLWWHGLTRGSPDLWVAKIHGRSVVSWGHAVTNHFSWLGVGVPLALCHSLLGCHPTLPFFFVCLVVFLISPSSIQAAVTKCLRPVTYKPWNLISHSLEGWQVQDQGTSNIWDSKFDRASQTVT

SEQ ID NO: 934237 - protein, 183 aa, Homo sapiens
MSLRHHLSIQSVYSDNALTRRLEETCWCHGPDILRWSDNQMTRKVSVWKLFSVWGIFPSFFIIAFILATLYDKNPQQIGIEEIHLQLIKAIYDELTASIILNGEMLAFPLRTGTKQECPLSPLLFNIVLEVLARAIRQEKVIKGIQIGKEEVKLLLFANDMIIELENPKDLSEKLLDLINEIQ

SEQ ID NO: 934238 - protein, 194 aa, Homo sapiens
MIPRQTGFGVDLQQTPADLQQRGLTVRRKTNKHKGIGATSTKRMSIQTPSKSHQHQRPKIDKSTKIRKNQSKKAENSENQNTSSPPKDHNSLPAREQNWTENEFDKLTEVGFRRWVIINSSELKEHVLTQYKEAKNLEKRLEELLTRITSLEKDINDPMELKNTAQELCEAYTSINSLINQVEGCQRLKINLME

SEQ ID NO: 934239 - protein, 143 aa, Homo sapiens
MCLWCPTSAYLPVTSLLPCRCALTCSFPAHNPCHLWPPPYPLPPCLCALVHGHPAAVHSPVDTLLPCQSAFSGSPHQTVITRDWKHLSPSSTSMQPRSTELSLGPLKESRNKANLLNLTYATIKPTRASNNVKTKLPIERSGT

SEQ ID NO: 934240 - protein, 155 aa, Homo sapiens
MQEALVISSFVFSPQRQSPSQGKLNEKTVKSEWSTANLLQWLKSGTLTTSNVDEVKEQQELSFIAEEFGGFGRRQEDEGKFGISYRLVNGCDQTADRNMDSEGNADEVPDGNEEAIGVKNGRISSSVQPQHGKPVGIRVQPMRAAMWAMSSKSTT

SEQ ID NO: 934241 - protein, 165 aa, Homo sapiens
MQFLLQKYQTKELITKADMLDIVINEYKDEFLEIFKRASECMELVFAVDVKEVDPTSHSYSLVNKLGLTYDARLSGDEDMPKIGLLIITPSVIFMKGNCASEEEIWEVLNMVNLYSKGRYLIFGEPRKSITKDLVQEKYLEYCQVPNSDPPCYEFLWAYLRMYKT

SEQ ID NO: 934242 - protein, 134 aa, Homo sapiens
MLEDPFYPWLAWTLQNLKAGMGKVPKQQRWQPTPPTGISFLGKFNATTSGIPSQWVLSCEVFRNFQYSHENGEVGLSWMRASLDLISLVLSGQVIEEKKVGWWCEYHQVGSYQNTSHSFTESFSIKNECMGFKC

SEQ ID NO: 934243 - protein, 146 aa, Homo sapiens
MLGLLHSHNSASGRGCYSFFTPVVWQVPSPCLMIKSNEIHGHQRVMEIEPAMNGISGLIKGAQRDPHPSTYGYSRRCIYEQKWASQTSTYWCLMLTLISEGLLNLQKPVIPNIFDTRDRFCERQHFHGHVGKWFQDETVPPQIIKH

SEQ ID NO: 934244 - protein, 203 aa, Homo sapiens
MIQPCSSLAHTPSSTCIPSHKAPLAIQSLSYSPKIMSFWPLPVFLTDAGDTKQGLSPRTEFEKDENNSINPVQEEEDEGLDSAEGSSKQDEDLDLPEGLDSAEGSSKQDEDLDLPEGSSKQNEDLGLPEGSSKQDEDLDLPEGSSQEDKDVELPEGSSQEDEDLEKKRSSRSRNEIEISEITEILQGRSQINKYSDFIFLLLQ

SEQ ID NO: 934245 - protein, 140 aa, Homo sapiens
MCVVPPHVSMCSCHSGLLHRSLLNVWSPHGGPLLGQRGGEMWSWSLHRVSTWALPSGAVRRQPLSSRPQNNKSTDSLCCSLAKGTGTYRPPLRAATGTDPCKATRVELPKVLGSHPLHLVVKAAKPRTHPQGSGLPCVTG

SEQ ID NO: 934246 - protein, 146 aa, Homo sapiens
MLTSENMLTVGHQSLQTCKISDEKYAVNLMTFPFNEDPNVTHQENGKNVSRACLRPSWQSLPSQPQRPRRDKWFCGPGPGPPCCLQPLALVPCIQAAPAMAKRGQGTAQAIASEGASPKPWQLPRCVEPVGAQKSRIEIRPWTVDL

SEQ ID NO: 934247 - protein, 165 aa, Homo sapiens
MSHGNVNFCLGLKDCIKLDKKNLKVQRSGGRIVEINLAEEVLCVNLLTKFKKGHSMVFLIRLNNKESTQPPPPDTFLSQTQFQASSQSPRKENWIGGIQRQMTKVVKRHSKGPLCFLDASHFSTHGGTCQGYWDSEMQGWKRKGTLTSSLATGVYRTKETGSFIT

SEQ ID NO: 934248 - protein, 147 aa, Homo sapiens
MRKLRHSKMKLFDQSHVAICMLSGAQCKLFGDLPFWGLEDSGLLLTAPPGSAPVGTLCRGSNPTFPFHTALADFKVPQISKVGAKRHQSLCQNIKRVTFAPVLNKFLISIREHLNLDFIVHIIISILVKAIQQVFRKFQTFPHFPVF

SEQ ID NO: 934249 - protein, 181 aa, Homo sapiens
MADVWIPGDSHSIIISTEWGLHLSPVLDASCPQTSDSKFFGFLTLGLTTVVCQGLSGLQPQTEGCTVSFPTFEVLGLGLSHYWLPISSTCRCSIMGVHLVILGEEKEVCFRRSITAGFLERRPASRTCKCGGMQLPPEKQYRRSFSFKSFIYLDMTPVQGEIQGPSFVLSHVACQFSQHHL

SEQ ID NO: 934250 - protein, 143 aa, Homo sapiens
MLVQSRILSPSLTFGSLVVKCLEKISFSYFCIIEKSSPHPSHEMEGVRGQKFLTKEPRKILNFSRILSRGVALKDMKDNRLWAVFHGGGLESASAKTAVVLVPIVTSGEVFFTLIMGRRSSERGHAYVVLGCKGNDSSFSQSV

SEQ ID NO: 934251 - protein, 380 aa, Homo sapiens
MWRKNVDLEPPHRVSTGALHSGAMRTRGPPSSRPQNGRSTNSLHHAPGKAASTQCQPLKTAAGAVPSKASGMELHKSFGTPAPCTTAAWKQEMEALGGAWSAQGMPRFGTKCEGRECPAERSQPFGMRGQGEEVTKGFPEVVTPQKKLRERRFYANGSKDERGTEHWQHSESESLIPNVPKAQLPLIFPPFLSRLNSSRAFRGAENGSVEHGHREHSSRQTPNLRLAQVPDATQKGHFEEKSPVLSNNGLDGFLCDKSKQRENHCCNGHNYGQTNYTLQDEKRNKRVILANEFVPIFMSYDIGQEGIQNTMMQDAPSVYGFVSYHMLPPLSKNAGEVEAWHLGKKYPFQLNKEVEEMIRKKLKLAHYEKAKNLNIICHSQ

SEQ ID NO: 934252 - protein, 171 aa, Homo sapiens
MSLGLVQHYDLLMSCFCLHHCKGIPEAMQFIKKSLIGSCFCRLYRKYSASICFWFGKYPGTSEEIYSSSLLSTQGPFSIIPLDYGWASCPPIPGLHQPSGNDRPWESERQCPSSSRSAALLPPTGCGQPASPLDWSQNAKAQHLRVPCLQKGLSLRTGMVLVCKILQCIRH

SEQ ID NO: 934253 - protein, 145 aa, Homo sapiens
MASYSAGLLEFAGGPLQTLSASVSPVEAAEQQISQNGKCCYLILPLEASSQRGTWLYEVSVSPYWEISDSVLEEPLLSSKLSDRDAEVCISFCCLLFSYALPPEVESTEAGRPQQTFWKDYSQLTSSSCDVFGPYCSIFAQGGSH

SEQ ID NO: 934254 - protein, 137 aa, Homo sapiens
MDSTYEGDQVLFIVHKWLFTSPLFLRFSPLRAANKNKTFKWQRDLRENSRADTGMADGVNPLCICPWDPWKDQKYFSGPRVALDSEATSGFKGIPEMGLYQLVVKVLATHICQYVLSSAPRIMKWLLVNVHMSSSLG

SEQ ID NO: 934255 - protein, 142 aa, Homo sapiens
MVWSMIVAVVEQAFCSQAIHTGIYDGCNGLCKIVLRPASGMCRPCEGVLQLHCWGQQDPCRCLPLHFSPRGTVSCDGGCGCEMSMGLQRCGDAGAIGPPGRMQSGGHCKCGGCEGPELWEPTLFTGAQTKKQVKAQRKQIEA

SEQ ID NO: 934256 - protein, 145 aa, Homo sapiens
MAEACSFSSCSHLIEDPKVGGRHDKDWEKIFAEDISDKGLLSKIYEELLKLNKKMSNPMKRCAKDLNGHMPKEDIQMVNMHMKRCSTYMSLGNCKIKTTMRYHSTPIRMAKIQNTDNTNVCEDVEQKLFHSWWECKMVQILWKIV

SEQ ID NO: 934257 - protein, 134 aa, Homo sapiens
MRFFGKDIFYFLITLNDDKVATKQAVLIADSSICWLKTLLESTFANSALPPEPSSQPWTLNVFRPPNLACGNSYQALLCSFFAGGAWQELETLSARNCCPFLFYPPRLPQVQILILNIERGLMRANLGTILAKM

SEQ ID NO: 934258 - protein, 148 aa, Homo sapiens
MKPSGPRLFFTGRLFITTWILLLIIDESQFLATTTTSPQGVLPDYRHVTLRPTGLFNLLVNAAWPRTHPSGHSIPFWPRAGPKLLSKSQDLESRIPRVHLVLYLPVAKLMSKGPRALQLASDKSRQAWVLPFKAAGSLLVQGVSRNAV

SEQ ID NO: 934259 - protein, 204 aa, Homo sapiens
MCSHGLGQLCPCGFATYSPLCLTPNPLLSWARVVSASFPGAQCKLFMDLPFWVLEDGGLFLTDPLASAPVGTLCGGSNPTFPFCSALAEVLHDGSTPAANFCLDIQVKTGSCTLQLSSHRSETAGLQALGGISCLASSSRGKVTYPGVWVLPGTTGNCEHWLSSHCRRTTVPECMWGHVLCVLGISLDNRKLYTFAEFTQKQDH

SEQ ID NO: 934260 - protein, 234 aa, Homo sapiens
MSMFKLKTPAFIHLYVNFHNYMWILECHILLCLGSDQNEGFHCREECRILGHSDRCWMPRNPMPIRSKSPEHVRNIIALSIEATAADVEAYDDCGPTKRTFATFGKDVSDHPAEERPTLKGKRTVDVTICSPKVNSVIREAGNGCEAISPVTSPLHLKSSLPTKPSVSYTIALAPPARDLEQYVNNVNNGPTRPSEAEPRGADSEKVMHEVSPILKEGRNKESPGVKRLKDIVL

SEQ ID NO: 934261 - protein, 135 aa, Homo sapiens
MARCSMPSCNLHGKNNMDIGCGVTMEEPPLASASEMLSPLGGLHWDRDVPESTGLGHIVHEFKKRMSSSLLPDSGGLKNRLLQCGGSPCGKVSRHSLELQRADIRLMAEVTKRKTWFGKGTNQSCSEKKMGCLVR

SEQ ID NO: 934262 - protein, 184 aa, Homo sapiens
MGCNLLSAPSMPLLLNVQGHFVTDFDLVAAQPGRFVKDQIVVDKIGFKTKTIRRNKQGHYIMIKGSIQQDDITILNIYAPNTGAQRCIKEILSELKKEIGPKTIITGDFNTLLSTLGRTSREKINKETSDLICTIYHVDLIDIYRTFHPRATEYTFFSSTHGLFSRIDHTLCHKTSSETFKKLK

SEQ ID NO: 934263 - protein, 203 aa, Homo sapiens
MYEPLTFLGILGLQLTEDASMRGWWSALGSVTTRSRGSQKAAWIWLATDSSRSEAASNWSGSSGSSKLQHGPLASIPGRYNTDISRVFNGNNGTSCQQKLLPGSCCKELKDILLLHLQDIKRSGHCESFPLSYDGNPEQRHMDPSSGPSSARLLDFAGSPLQTLFVWVSPAEAIEQQRLLPAPSSGSVIPEGYLSDGRWSSPV

SEQ ID NO: 934264 - protein, 179 aa, Homo sapiens
MRIIGAVLVLLVHQLCHDCDYSFSWRTSVFGQYVKSPRFHSPTSPLCNDLGPLILNNLPVKWVAWSEASKGNSTAEEVAERLSDVPGDSVQGVDTGSVALVGGAWRPYLSGPSAAGLLEFTGGPLQTLFAWVSAAVAAEQWILVNRKCFCLIVPLEVLSQRSARPCEVSVHPYWGGPAG

SEQ ID NO: 934265 - protein, 151 aa, Homo sapiens
MSVEHQPDKCAKKHFLFLVIKYLTPHFARRQVIPDSWVRETNVGNQRVMYLATPVGSLTQSGGTGSGTRLMKYSGCPFAEGVHCTGRNPTHLDCLDSSVQTGKLGSRRQFPVEWLLQRICTALCLGLKALVAWAHKGYLLICGLHRLMDKA

SEQ ID NO: 934266 - protein, 136 aa, Homo sapiens
MQLWGSWGPYLRLWFQGPMVRAGWSLTVQLTRTPEAVVVQNSEKFDRLKPFSLSSSKSFSVQLCYIAGPSAAGLLEFAGGPLQTLFAWVSAAEAAEQRILLNSDCCCLIVPLEVSSQRGTRPCEVSVCPCWGVPPS

SEQ ID NO: 934267 - protein, 383 aa, Homo sapiens
MLLTNEDNPHGNDSVKACQARTKAGDLRDIGIFLDLMPLKKPGGFDISLNPVHFEESSNLEDLLQKVRAKETRKWALSRLKLKLNKDIVISVGIYSLVQKALKPPSIKLYRKTNEPVKTKSRKFNINTGSLLLPSDTKRSQIYGSHQIILEKEETEELKWFDEPALMLMVFKPLVMLKEHHYPRPSLFTYPEESPVNGSSTLFSALLIKCLEKVVIALCRYTPRRNIPPYLVALVSQEEELDDQKIQVTTPGFQLVFLPFADDKRKVPFTEKVMATPEQVDNMKAIIQKLCFTYRSDSFENPVLQQHFGNLEPLILYLMEEQAVDLILPKVEEMNKRLGSMVNEFKELVYSPDYNPEGKITKRKCNNEGSRSKRPKRSIQKRS

SEQ ID NO: 934268 - protein, 144 aa, Homo sapiens
MIDPPTACTVHLEIWQLPGASPSSYPFKNFLCCPSANLEKHLFILVMMMLIKIRRYEKKLPQLLSSHFIQLGIEVKKGVFEAVETLGSSLISLFILDLSSKNFWLCFQIYPDTDYFSSASLLLHGSNHHLLFLGLLQQPLNSFP

SEQ ID NO: 934269 - protein, 153 aa, Homo sapiens
MQPCVNLHLLLTFTSEHSSLRWCVKLRSDSRNLQKSQNAHPQYFKKKIHIIPWHQEATQELQLAELGHREWQVLHEIPEGIVIIGDDNSMCPIVPEDLPVENDVEMKVGDIDDPDPLNAAKYPKMNRKFPPNNYLVENDHNAEVVILCLRIIG

SEQ ID NO: 934270 - protein, 148 aa, Homo sapiens
MVYYHFDELLDSVGAGCKLTLIQPFRSLEDNGPLLTTTVGSAPTLQTVFGKKRSSVGGHKGASQVECGGSGSGEGSTVAMTVSHFSGTIFQSSLLRRPLGSSLAKTKGTTIIKTVDSLWLPSGALEVPQNKSCWSQSMLLETTVISVV

SEQ ID NO: 934271 - protein, 138 aa, Homo sapiens
MAHVHVWVIVLGPVSLTHKTKYFILDCGKLQKAQKGASLKPERTHRPTKGSRLVLQDLGDTPNTQLQQDPPKESLSSYTSSSAPNNGPTHPVTKDKRHTFLGVLGSCPPPVPPYTTIADTFWKAPPPGRRPTSTKIVP

SEQ ID NO: 934272 - protein, 136 aa, Homo sapiens
MYGDTWVSRQKSASGAEPSCRTSTRALQRENVGLEPPHCIPTGALPNGSVRRGPLSSRPQNGRTTESLHHAPGKVAGTQCQSVKPANGSVSCRATVGKLPKTLEAHLLHHRGLDVRHEVKGDCFKSFRFNNCPAGF

SEQ ID NO: 934273 - protein, 193 aa, Homo sapiens
MHNCESIAPLSFVHCPVSAVTERGQCTAWAAASGGGCSKPWPLTHGVEPAGAQNSRIEIWETPPRFQKMHGNDWMPRQMFSSWRISARAVWKGNVGSEPPHRVSTWALPSGAVRRGPLCSRPQNGRPTGSLHCVPGKARNVQHQSVKAAGRKAVPCKATRVELPKIMGTHLLHQCDLDYLKLMYCAATVERLS

SEQ ID NO: 934274 - protein, 136 aa, Homo sapiens
MGQKKKTEGTSSSSTFKLNSVSNKRRLMKLYHSYFCCYCYYYSCWSYYYYYYITITVAAAASNTPLLLLLLLLQDNIAIKDRRKERKKERKKERKKERKKERKKERKKERKEGRRKKETKKEKKERERKREKERLI

SEQ ID NO: 934275 - protein, 215 aa, Homo sapiens
MEKYFQDIIQLQILPYRHKRVGDYSQTPVLYSGCTESLALASAAGEASGNLQSWQKAKWEQVLHIVKAGARERERVGSTCHTHLNDQISQELNIMSTAPSHERNASSFCPFNVVLAYKGGKGSSTAEGVAEKLSVAPGGSVQVVAKLLLAQQLWQGVAAERGNATTHGWLQFQASGSYFIRSHGSGACRLSLLSFLDSACFLGKPLNLLYYIAVK

SEQ ID NO: 934276 - protein, 155 aa, Homo sapiens
MSQWLQPRVFCFSPGDCTPERCRRAIAQCSQTRMENLCCGPKPGVLCLVTNCGGWGMGQTSGRCTGLLSLCKMQLVGVEERRKGFLLEPQAVQTEVKGKDLPMSCSLYGLDCLSSILGDTDVVALDVKVCSKGTKLTTIYTEKPPLSEPKISSPC

SEQ ID NO: 934277 - protein, 139 aa, Homo sapiens
MNLDEDCSAQKEMVLSSRNDSSLNTQKSGNVYHWEVEEAKHREHGKYFYPVRLENQCEDNQARRLDQENIQTSALLEEGALNLATRKLGFDSTLLQVALFCSFFICNMDNIILVIFLLTMTYENLKTQIYSLSTEGFGT

SEQ ID NO: 934278 - protein, 206 aa, Homo sapiens
MRVIYRLPTQQKYLHKDQKSGAFVVDLLNGFDQNAGSDIDSKFQAEVVSDRDEELVRNWNKAHSCYAKGLAAFCPCPRDLWNFELERDDLGYLVEEISKQKSIKDEAEHKNLKNLQPDNIIEKKNPLSGEKFKPAAEICISNKKPNVNCQDNGENVSRASQGSSWQTLPLQAQRPRREKLFHGLAQGPTVLCSLRTCPGYFSFSCG

SEQ ID NO: 934279 - protein, 134 aa, Homo sapiens
MPFTKRRCLFRWFLGLEFYLWFIQAMWEGPQSSHSLSGVATLPEPSCARQLGRSLSSVHLSFCRSFISMAGEGEAVMSFFTWQQQGEVQSEGGEKPFIKPLDLSGPSAAGLLEFSGGPLQTLFAWVSAAEAAEQ

SEQ ID NO: 934280 - protein, 137 aa, Homo sapiens
MNPKEDLKSENRASMESTEQMNKKWEFRQTKVTLESEDTGVNRVLGGRESIYKDLGQRKNCLSMELKEWQCVWGIGNEGELGKRTNQRTCSLKMQKEVDSRALRKEGNNKLGYRLPQKSKPLLTNSTILIEAKHRKN

SEQ ID NO: 934281 - protein, 158 aa, Homo sapiens
MLFFKESSSTCRTDKTPWGDCPHTLPNAVPIQGFGPVPHISGIPTCFFMKLQLSFYIKGIKGIQEIGNTEPVFLHFLWFGNSRSRILKITWVSSLPTPTSSRLSVDNPTVTKLERPLTSNTGANDTLPTDEHIHKMHAWPSLVVQCLTSDSIKTKIHK

SEQ ID NO: 934282 - protein, 162 aa, Homo sapiens
MLYSGASVSRTTLADSWSSKWIAQMLIVTAVGLMGVQVLRPLGSRYGKGYDSTSGRKTLWVPRSSCSSFLFQASRPPGILSGSSLHHEAVVSIPTSSWRCTATLYVETKPTSSQCYTWIVFLHSRELQNKLSLSLNLQTLEAALMCSVVFFHPAPLTILYTK

SEQ ID NO: 934283 - protein, 269 aa, Homo sapiens
MFQLKVLYLLVPSIPFPELKHCAGRSAAVFRAGRQEHLSLLKLQPQLPLPPGALSQGNGSFIYQPLTGAAAFLSEMPCLERRNIERQSLYSGFAVLQWTPLPQPSLSNSGQLQTAVLAARISSQWTLACWSPWGWDLLSKTTWLLGFSPLSRGVNGSVLLAFQVPMRYKKTLLQLAQCLPKWPPSFVLETQGPGGVGIRGNLLVCRLRRPWEKHSIWAGVRCSSRHGPSRLSLARGGSSPSPCTFWVRRSPTLLLLALGGLHPLSDQSQ

SEQ ID NO: 934284 - protein, 287 aa, Homo sapiens
MPPIKTAQELEGLEDRNMWESLEFPRDLLNGFDQNADSDTDNEVQAEVVSDGDGELVGKWNKGDSCYILAKRLEAFCFCPRDLWNFELERDDLGYLAEEISKAVQKENVGSEPPHRIPTGVLPSEAVRRGPQSSRPQNAGSTNSLHHTPGKATDTQYQSMKAAGREAVPCKATGAELPKAMEIHLLHQHDLDVRHGVKGDHFGALRFDCPAGFWTRMGSVAPSFWPIPSTWNGCIYPIPVPPLYLGSPETCTGQEVKGVNLRAGPEVDMEVSKPYKTYRLRQVHFHC

SEQ ID NO: 934285 - protein, 309 aa, Homo sapiens
MLCWENHCSLQSCQTGTFKSAEVVCCLLFSYALPTEVESQGIFLLTGLSATGLLECAGGPLQTLFAWVSPAEAAEQQRLLPVPSSGSFITEGHPPDASRRCPVRGVCPTLLEGVSQSGSTGVRDPLEEAECPLAELEHCAGRSASLFRASRQEHLSLRKLHPQPPLPPSALSQGEGSFIYKPLTAAAAFLSEMPCPERRNLERLQWLCQAAVGSAQFELQGGSVYTTRGKPPMQASVMADAPHPTKLKRPRSSLDCNAGSKNFKPVDPSLLDSIGVGSAELDHLAPWLQPPFQGSKWFCLAGVPSTTGV

SEQ ID NO: 934286 - protein, 138 aa, Homo sapiens
MRQGWSYGPDLAKVPLFLVPNDWSRDEHMIKVRLATVFLLKLLQNTSGVADGHILSLLCLYGEWGYKIIKLGFSSLAESQCSSYLYEIVPSSPGLDFRIFPNSLELINNFLLCPHTANQIPSYKDLIFEVNCIFLISK

SEQ ID NO: 934287 - protein, 166 aa, Homo sapiens
MKIPEEGADNSLCCSAASTGDTQVNRVWSGSPANSSRTAEERPPQRSKVDKSMKMRKNQRKNSENSKHQNASSPPNERNTSPARAQNWTEDETDELTEVDCRRWAITNFSELKDHVLTQCKEAKNLDKRLEELLTRITSLEMDINDLMELKNTAQNLYEAYTRINS

SEQ ID NO: 934288 - protein, 171 aa, Homo sapiens
MCFNASYQMAPLEMMLTLEYLEKNSPESFMHLHLPCIITCRVLPQTKVMLISQMISPWAMQFGQSSVWLLWFAGGPFQTLVASTFPVPGDITSEGCKTASLAACPFFWKLHPREGIDLLLACILWKAPMCYWCLAGISGQWVLSCEVPWGPQNDAAWFPGFWHYPREAKIK

SEQ ID NO: 934289 - protein, 194 aa, Homo sapiens [sequence omitted]

SEQ ID NO: 934290 - protein, 150 aa, Homo sapiens
MELRRDYDLCLQLSGRVDKDYQVAREAGESWQSQASPYFHAACNPKGWSHSHCASPNSTKSISRQLVTRAENLPQTTSLLIEKANRITVFQHLRKPVGVIQFLQRVCGCSWLSRYVPVVVLGAKVHNVSLHTLLCPSERELQTSLASYLF

SEQ ID NO: 934291 - protein, 157 aa, Homo sapiens
MTKIKKIDHTKCGKFQFKQGFERASEFDLHVRRGRCQRNKKQKWTDSRRESRDKVKDIPTATRKRLKKTLKDRLTVPDRGGKEGSNKPVEELGGGGLEGISGDMKETVAIVCSGRDDEVCGTVERGGRSDWLLSHSGSVDQKVHGLNLSLSNVLSCG

SEQ ID NO: 934292 - protein, 149 aa, Homo sapiens
MGLGTVEQGVVLVGEARAALEPMEWVGGSGMMGCRSRALPRGKAAKARREIERSAGGPALLGDSVHPLQPLARVLSPPLPGASRAGWLLRVRGPPSPRPPGTPAGPQAPHAAPVPAHASPSTPPCKLREALSLYGSDALSSPMERYRFP

SEQ ID NO: 934293 - protein, 159 aa, Homo sapiens
MMLFLLIARIHESRNQVMEIGMSPPTIIPSDLLAKFLLPVPMTLCFAGLEVLVPKREMLPPGDKIIIPLNCKLTLPPSHFVFLKPLTQQARKGVTMLAGMIDPDYQGEIGVLHHSGEPRLIQEPNLRPRQGNVVKQEIIRTWLGTEVEEEGLFIGKNQI

SEQ ID NO: 934294 - protein, 180 aa, Homo sapiens
MQGLKNTSNTNFRFPTSDLIYSSNWEGKGEEEDEDEDLSKYKLDEDEDEDDADLSKYNIDVSEEGDSNKKKSNRKSHSISQSSHSLSSSCSFSLSNSRSRSRFPSRSSSSQSRSCFSSREHLRSSGLKSRSSSRSHRGSLNNPEPRANPYRTHYFTQAPQVIFWIIPFWFPFKFKKEIRH

SEQ ID NO: 934295 - protein, 134 aa, Homo sapiens
MCFNASYQMAPLEMMLTLEYLEKNSPESFMHLHLPCIITCRVLPQTKVMLISQMISPWAMQSLEGSNVLLVPAGISGQWVLSCEVPWGPQNDAAWFPGFWHYPRDSEYLLRKIGVERTTPGFRGKRNLAQPIVL

SEQ ID NO: 934296 - protein, 194 aa, Homo sapiens
MIKTIAFGRYDLDTWYHSPYPEEYARLGRLYMCEFCLKYMKSQMILRQHMAKCVWKHPLGDEIYRKGSVSVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPECPLSDLGLISCCSYWKEVLLR

SEQ ID NO: 934297 - protein, 135 aa, Homo sapiens
MPIVYLSLEHGQAHDANSHKSVYVSPYVFSESPEDSRNLETGPHQTPVCWHQDLGLPSLQNVINEFLLFVSHSLYGILSWQPEWTKTGVSNLWATDQYWEIGQKCQPSSQEMIIRNETKPAKIPGLVICHMSKHR

SEQ ID NO: 934298 - protein, 197 aa, Homo sapiens
MAVCKPGREPLTELDHAVILILDIPASRTVRNKLEGVCLAGGKPTCLSYPDSSELPGGKAKSAGLQRLWPPLPLGAQAQGDPGSVSKPLVRVIGVPAGKPSPNEEGWVRTSLDINRVVRHPIRLHMAATASHGAGSPSPREFGGLKQIPTERLLRVCTFQGWDARPYGVGSQLKLLKQLIVVWAFNTWPLLAMLYEI

SEQ ID NO: 934299 - protein, 290 aa, Homo sapiens
MHNGSSDGSGPSKLKTFWKGFTILDAIKNTHDSWEEVKISRVTEVCMKFILTLMGDFEGFKTSVKEVTADVVQIASIFVEEISKQQSIQEVTRVLLKAFNFIRAAEHKSSENVKPDNAIEKKIPFSEEKSKLAENICISKEELNVNPQDNGENVSRASAPIIAERGQHRAQAVASKGANLKPWQLPCDVELVSAQPPHRVPIGASHSGAVKRGPPSSRTQNGRSTDNLHRAPGKAEDTQCQPMKAAGREAIPCKATGVELPKTMGPHLLHQCDLDCLAYLNSCLLLASFG

SEQ ID NO: 934300 - protein, 139 aa, Homo sapiens
MPSKYQVLESGTPSILLMLYPSVAMLVPKVQDKVTFTFPSTFLKQMEFLHAASTAAINITTIIHGNDYSRHFVIEAVEVMYIVIDTASKMKKVRIQTQIPFISNPLCFLHYIIMMPYLSSNNMNHLTPLNYLSLISPPS

SEQ ID NO: 934301 - protein, 195 aa, Homo sapiens
MTEWETAAPAVAQTLDIKLFGKWSTDDVQINDISLQDYIAVTEKYAKYLPHSSGWYAPKRFHKAQCPIVEPLTNSMMMHGRNNCKKFMTVRIVKYAFEIIHLLTGKNPLQVLVHHQQWSLGGLHTHWASQDCETTGCGRVPTAPCESGHLAAVHRHLNTKRIVMDGCDLLEIKANQTSAPLNLLHGCSLKANVSI

SEQ ID NO: 934302 - protein, 327 aa, Homo sapiens
MNSGNRLHNFLLRKTYENTWSTVKNTLVMMIMMIVMMMVMMVMMMIVMMIVMMMMIIVMMMVVMVMMMMVMIVIMLMVMVMMMMMVIAMIMMMVIIMMMVMFVMMVVMMVMVIMGDDNCDNDSGDGDNNGDGNNDDNGDDGDGMMVIMMMIVMMVVMVMMADDDDCDDDNGDGNDDGDDGDGGDDDGDGDDDCDDDDGYVNDDNDYGDDGDDSDGNDGDADCDDGDGDGEDDDGDEGNDGDGDGEDDDGDEGNDGDGNDDSDGGDGNDDNDDCDDDGDDNYCGDDNDGDGDNDDSDGDDGNYYDDGNKDSDDDNDDNVMTNSQTAYI

SEQ ID NO: 934303 - protein, 153 aa, Homo sapiens
MLRADEPGHLALQEQWQAFSLIGSGNRRLTGSGAQWTPCQIQRDGSQRQVCDGSKQQWWEGTRRRRDNGEEDITEITMTKFTQFVLDIKSATQESQRKTNPDKYDNINCRKDKNTKTPNAVKDIEQQKLSLIAGGNAKWHSQVGRQVGSFLQS

SEQ ID NO: 934304 - protein, 169 aa, Homo sapiens
MSGSTLKPSPEEDAGTMLLVQPVELQLLGSWSPISVLMEEYTSWGQSPVIKSISDLSSPHPEGSQSGYQRLKNLRMNSSEVPPDPQRCPVFRNADSTTAVKSLHSLPCKKQTLGHMLFQEKSTFCIFTEGQDRVTLAADPRPSPLAAQELQGEMELALRGLQRAREWAY

SEQ ID NO: 934305 - protein, 143 aa, Homo sapiens
MAPHMPLEDRGCVIQLINPSEARQPPPLLQSQDQTSYPRPFSATQATPPFQWNPGTLKGQHRALSEGSQQKEQVGAETQATLPSLSPVLWHRDADQRKEYFYFICPDEPLYEVIKLLYEPDQGTVTKASVCEFEKEWKEQVKP

SEQ ID NO: 934306 - protein, 157 aa, Homo sapiens [sequence omitted]

SEQ ID NO: 934307 - protein, 145 aa, Homo sapiens
MDYLVVPDRAINDPDPSKMQVWVTPQDKEPQPAEVLAKGKGNTEGVAEEGGYKDQLGPCDKVHVHNVQSLALLENHCFHHLSAAQDRSILNYGTEKTRMDPPCRQPKTKEGSDPVILNFFSQSSPSSSIILPKEGKLGERLGALL

SEQ ID NO: 934308 - protein, 136 aa, Homo sapiens
MMQALRRYLEAVLQAGGARLGPQERPVGQGMLRLDWPRLMGKTTLQHSDASHKWGTQTTNISIQLTTNSGVSTSHPLRFDNLLELFTGFRKTLYLYLLIYYKEYNSGTAKWNRCIRAVTKETAKKLETYQKVPPRI

SEQ ID NO: 934309 - protein, 139 aa, Homo sapiens
MFLYLFSASFSDMRLKPGPPVVCGGIGYGRQEQSEPKAPGRMLKWGKQWLHCGPAVGEGMWGRRDYWAPEQDAVCWGLVSQNGALLQLLKTWEEDGKMWGSLELPGDLLNAFDQNADSDKDNEVQAEVVSNGDEELVGN

SEQ ID NO: 934310 - protein, 153 aa, Homo sapiens
MLAFGYQSFLLCTQTKLTSPTGSKLNIENTVFAGSKTCVYRGPTFHICGFYRAVTVGLEYARIWEYVGVLEPILGDTEGQLYLCQFHGITGLHLVKENKKPRYYVLGCLTKAKYPFWPESQFFLFILLPFFSSLFLTLSHPPTLKIRQYSKVR

SEQ ID NO: 934311 - protein, 136 aa, Homo sapiens
MSLNKFKNSTQNKYIKGEILGNILQYMTDKSLIIYYESVQGVHVQFYYMGKFCVVGVQCTDNFVTQKDATHMDFPEFSEESQNGESEGALGLVIKRQVSGKIKGEQSFIENVTQCDTSFWHIPKEKYQCANLHSKS

SEQ ID NO: 934312 - protein, 145 aa, Homo sapiens
MPLPVCNPQSLSAQALAQGETTNEGRSSSLVDKQRARGVPSSCESLNLGVLGKDVLALFSFLNEQNRTSSPVLGFVKNFSLWLHHNSCSGTHNMYQEYLDSATGGAVTQYYREMGAQQCGWAHWIQIVKIQSLPIQCNRHQPTQS

SEQ ID NO: 934313 - protein, 177 aa, Homo sapiens
MNVTVYGDEEIWAHKRQQGHAGTEGSKRAAIYKPRRAASEETNSASTLILDIYPPELEAKTLGLVDRTLVSFWELHHYPQMCEAMACLKIGILAQWSQSPLWAPTAQLWLLITGGSLIPSSSSPAGPHPLTVCCPFATAGQADDPLACISSYLWGFLCPALDVALPAFVILGERKGG

SEQ ID NO: 934314 - protein, 282 aa, Homo sapiens
MHRERRGKNVVHQLSVTLEDLYNSATRKLALQKNAICDKCEDRGGKKGGVEYCPNCRGTGMQIRIHQIGPGKVQQIQSVCVECQGHGEQISPKDRCESCNGRKILREKKILEFHIDKGMKYGQKITFHGEGYQEPGLEGEDIIIVLDQKDDAVFTRQGEDLFMCQIVKHGDIKCVINEGMPIYPRPYEKGRLIIEFKVNLPENDFLSPDKLSLLEKLLPKRKEVEETDEMDQVELVDFDPNQERWHHYNGEAYEDDEHHPRGGVRIYRPNLVIDFSYVCGQA

SEQ ID NO: 934315 - protein, 241 aa, Homo sapiens
MHQSVESDIHGLHKIIDDTNVTQLQLEAEVKALKEELLFMKKNHEEEVKGLQSQIASSGLSMELARENQEELDKYGSQQTEESTTMVTTQSAEVGAAEMALTELRHTVQSLEIDLDSMRNLKASLESSLRKVEARYALQMEQINGILLHLESELAQIRAEGQCQAQEYKALLNIKVKLEAKIATYCHLLEDGKDFNLGDALDTSNSMQTIQKTTICRIVDHKVMSDIKPAEAGRRCKGKSL

SEQ ID NO: 934316 - protein, 204 aa, Homo sapiens
MYLLEGITAEPATPLDHRRCMQPHTWCDTSLPLTQIHLPSSCVCRKFSFGLKPNLQKVPTPSSVSLAAFHQTGKKKKSALKGKTGNQILISEDFNCFHKLNFPPGVKFSIYNKDIICPEICPCPPCLDRLILPKHNWYHDILLLRSLSDCPIPAAENPHSSASVHLSLLPSENCSPQPGARKGSCPTGYIKDLNNSMKCFYPQL

SEQ ID NO: 934317 - protein, 184 aa, Homo sapiens
MPGYSSETKLPEERPGSNICCSPISTVLQPPLLIPRQTGSGVDLQKIPTDLQLRVLTVRRKTNKQKGYPHQNPICTSPSSKTKAMEQSWTENDFDELREEGFRRSNYSELKEEVRTHGKEVKNLEKNLDEQLTRITNAEKSLKELMELKTTERELHDKCTSLSSRCDQLEERVSVMEDQMNEMK

SEQ ID NO: 934318 - protein, 154 aa, Homo sapiens
MPVWSCCQVATEWLTLYVPRLKMISCSQSHIWENACNFSWCLSLAESLSLSSTYLQVLGETKCSPLVLVAQIPSGKNEHSSYLAVNIFDFQNTFGIRLDFKTFTIKIFTTHVIGSEESHNQDISNPGIVHALGYLTKMGRTREENGYNHRGVDQ

SEQ ID NO: 934319 - protein, 160 aa, Homo sapiens
MHSSPVDHLFRQIQQNPTPILENFFFNRASQFSISPCLRSSCKLPYASRLALCNLHYHLPPTPSAPTLLLVVLNANCQVLPTSWVRQAATRGGPLVEGHHLVKSFLSGWIPGTSSLAFSMALAPGPWALADQQGCPWMRPFDQATGPFTYIGVLRSQQSE

SEQ ID NO: 934320 - protein, 137 aa, Homo sapiens
MVRCACFPFAFCHDCEFPEASQSCFLLSLWSCESIKCLFFINYLVSGRSLQQCENRLIQSNVFAGNYSSYLLLEMKEKGYQLPVLFPCPHGERTINFNTVRVYQKCFTSLRMRSREKYEPWVKIVRRQISGYINLQL

SEQ ID NO: 934321 - protein, 487 aa, Homo sapiens
MADYLISGGTRYQPEDGLTAQQLFASADDLTYNDFLILAGFIDFLAGEVELTSALTRKITLKTPLISFPTDTVIEADMAIAMALMGGIGFIHHNCTPEFQANKVQKVKKFEQGFITDPVVLSPLHTVGDVLEAKMRHGFSGIPITETGTIGSKLVGILTSRDIDFLAEKDHTPSSVSKKGKLPVVNDHDELVAIIARTDLKKNRDYPLASKDSHKQLLCGAVVGTCEDDKFRLGLLTQAGVDVIVLDSSQGNSVYQIAMVRYIKQKYPHLQVIGRNVVTAAQAKNLIDAGVDGLHVGMGCGSICITLEMMACGRTHGTAVYKVAEYAWRFGVPIIADGGIQTVGHVVKALALGASTVMMGSLLATTTEASGEYFFSDGVPLKKYQGMGSVDAMEKSSSSQKRYFSEADKVKFSQGILGSIQDKGSIQKFVPYLIAGIQHSCQDIGARSLAVLRSMMYSGELKFEKGTVSAQIEGGVHGLHSYERWLY

SEQ ID NO: 934322 - protein, 144 aa, Homo sapiens
MLKRVFLIQAWSHPYWSQQVSSTHDNMFINKHVHQKAALWVMASSWLLSQCPPIAEREKKLRCPHNEILHSSNENKQSTATHNNPEGSHKHNIEWKKPDRKTHSGGGLWLTPVISALLEAKAGRSPEALHLVYNYVNSKVKSIL

SEQ ID NO: 934323 - protein, 138 aa, Homo sapiens
MFNDRKRGGKGQSIFPHATFSSEKKYPSPNLSNRILLLSHWQYLGHIAALSGKGDWESIRFFSFYSGKAARERQQEFVTYHKTAPTPWELDFHSLVEMSPLHLPDTHAKWAVGQKMEGHSMNAGTTERFPGFRYRYIL

SEQ ID NO: 934324 - protein, 148 aa, Homo sapiens
MVELVNSPTNSGTLHSLGPSSLLKAPRSTGPLSPPSPSTTTNSSSPSLAPPFLLTGASQLLLERGPDPDPKSGFLDLTQEGIGEGKPEVVHHGWGRESTNGKSHTDIKLEKTHSLILELKLGHRCKMVKPLMLSYSIGQFPLPFPEGA

SEQ ID NO: 934325 - protein, 318 aa, Homo sapiens
MLHCLKYLVMGQRGLLSVVITISPYETDNRRLKLKNELLEAKRRSGKTQQEASRVCVHCHRNLGLIFDRGDPCQACSLRVCRECRVAGPNGSWKCTVCDKIARQLRIITGEWFFEEKAKRFKQVNVLGTDVVRQSILRRSPGAEEVQSQEQTRQDAEKSDTSPVAGKKASHDGPKRKGKFRSATRGEIITPKTDTGRSYSLDLDGQHFRSLKSPPGSDRGSTGSSDLNDQEPGPRTPKSSRSNGVTPGTQSSPAPSTRTVTSVISREYGFENSMDLAAIEDQSRSELDLSESFTEDSEDTVSIRSKSVPGALDKVMMS

SEQ ID NO: 934326 - protein, 135 aa, Homo sapiens
MCTATSPRFPRPVLLLFKTLNINPEREVGLLNSLGKLGSWQALDTKEPLNNNRPTPGPVVGVSKTLQKHNSTVTQHQAHTYLGMSLKPYDDCFGLLKHPTEQSPRVSVPSSPLLAPGTQEGTQELSDLAASGDSK

SEQ ID NO: 934327 - protein, 167 aa, Homo sapiens
MPRFWCVAVGGYGAKNIYQVAVERESTELPFKNLATLKLPCWREMPKNFWNCFLVPGGLGDLEHVEAYHLAQGPALAHCDDVADLDVPEAGGQVYGHVLVVLLKVVVLAGVVEIVSADDSPLHLHLGHHAKEDPPSNGGITSEGAFLVNVGALNRLFRCLEAQIDVL

SEQ ID NO: 934328 - protein, 138 aa, Homo sapiens
MTFYDPPKNLAVSLYQILLAETVTSWLRFNLGGESDAPSPLVGYQAHDTEEQLNPVLTHRDLLCIDFKGLDEKGEGLFHQPLDLVIEFLALLFASTASNGPIWWLASEAYCIPSIPFHPESQLNIYQHYHWLDPTARS

SEQ ID NO: 934329 - protein, 190 aa, Homo sapiens
MGGWMDGYHLPHPGEYPHWPRPSHWQHQEMQGEFSGAADGCIANVAEKSTCKCRATYFCSLISICCAVISWAPIGPSTQSPLQGTAERSSGVPGAGQSFIAGHSPELHGSNFNLHDGRDLVMPFLSSPISPEPRMAIDRDPQKQILRWKFTCEYLIKGMLPVGDPADTSTGSAHSNQQASKRLTQMHRHI

SEQ ID NO: 934330 - protein, 174 aa, Homo sapiens
MKLAPSSFRECPVGAGKATWHAVGLCLVTCRKQERVQQGILSTDFCWTQAQSRGLHYSDLYTSIQKSAAALSHWRIEVKFMCDVWVEVKQQPFLYSHSWEEGWQALSQLTRVVTDLWTHLAGVGGSRAHSPSSACQSSSFGFSEFWGWRVCGYMVDGTGLACRTGKQKNGRVER

SEQ ID NO: 934331 - protein, 183 aa, Homo sapiens
MTQGKQNGSHFKSFHGPRGFLLFPLLLLHQLIFVINLLHEIWELLLWNAGEDFSRLYPPRVGDEGVCSKSSQCLSPLILQGQISGIQNLSNMARKNCRNTVVCFYWDGCYGDVRSGRFCVYCDTPSTPSFKTSTVAFLGLGLALPATSLKLLHEDPPGFRKLQCCVAHLFPVNASSNWSTEFK

SEQ ID NO: 934332 - protein, 134 aa, Homo sapiens
MQGSLPYAFAFCPLPLLPRVMCASTKNLSQPARVISLRLREVKDESYGQSCGEVARDTSFHIPGLTPFPSAGPSCLSPSHLASMPFPPHLVSSADFEAQLEAALSSIPRHRYCTVSPALTDSWLALLPQCQGWL

SEQ ID NO: 934333 - protein, 154 aa, Homo sapiens
MCQSLSALPMLTQPSQQPVRDVAFNHSDLLPLQCVADISLIFQVQGALNSAYVPSASSRDLNSSSCQTELRIYQGDTKFIKRLSTNKPTQVSARGQYWLEPGWSIWTGCGEGGGGGHGNASGVNHNGAALLLALWWEGLGDSHHPQLWMLPALT

SEQ ID NO: 934334 - protein, 144 aa, Homo sapiens
MPPTSCSQPNIALPMRMPVSSQHHQWSMLSNLEIRFAPEWLFISLGKSGFNCLRAVIQLRNVDIGNESLQGARKHEHGEEIEEVMGRALAATTLMSDYPFHTHRRSAPYKRDMPKADNKRLNSTLNLSLDSHLELRPAAPLQRI

SEQ ID NO: 934335 - protein, 139 aa, Homo sapiens
MEDKSIGRGYREWEHVTLCWSRAIAMPGFKHGLSQHWVLKILLGTRKSMHQPYASFQEWPPDISCLEASQVTKRSQGQQFFTENWARNRKIGNRPVVPRINQRCSLKYEFLKRQWNPCGLSNNLGQVLGNWFTAGPAAG

SEQ ID NO: 934336 - protein, 144 aa, Homo sapiens
MPLDSCRLLHDSVDSESPAPAAETEIYLENCRSPNRVEKDVMSYVLKHFKKKAFHFLLVSMVSDEKFADIQIVIIMSLDMDNPRRLSRKLPLGHSGSLQLRQSLKKLRAKGCLPSVLLAPETTRTSLKRDLDSAPEWPEHLDVQ

SEQ ID NO: 934337 - protein, 208 aa, Homo sapiens
MDQHLQMRPQALTEELAASSDTSELSGSPHIAEVMNCLGVIMPLSFEWGPEQEKALQQVQAAVQAALPLGPYDPVDPMVLEVSVADRVAVWSLWQAPIGESQRRSLGFWSKALPSSANNYSPFERQFLACYWDLVETERLTMGHQVTMRPELPIMNWVLSDPSSHKVGHAQQHSIIKWKWYISDRAQAGPESTSLQNEKVLKLFFTTM

SEQ ID NO: 934338 - protein, 136 aa, Homo sapiens
MLGLGHFGLGTQFLLVEDNPPEKAAAEQECPHVLTSPRSLYLQMSDELVNVPAPPTAVASRMSPVTPHLLYYDWALSHTPNPTLALYGTPQLAFLQAFQTRVQRPVVGVYTGQLVHVARSTWGCEWKFTSSGNFDC

SEQ ID NO: 934339 - protein, 145 aa, Homo sapiens
MCPEFLPSGGFMVSLTSGVKLQTFVVSVAALKGGASGVVHSFRWVRVLNGLRSEAADLRGASEGVKSLPGCLLPLSKGSGSTGSGQFSAIKWRKLLAPLMILLAGVGCGWIVQLRTHYCSCYEYIGFAAIVGCGAGDGLSSNATT

SEQ ID NO: 934340 - protein, 146 aa, Homo sapiens
MAVFTIKKEYTLQRKEVWGHEFSWRTLVGEPRKQAVVKDLKPAAGCYHWAVGKEETVRVGQPLGAHSLATHTELCTPVSCGIRSMTDRMCDRAQDICTTGCKFAKVQENKEILYYHWEAKNEGNLEKSPQKISWHRIIQTDRSEEA

SEQ ID NO: 934341 - protein, 139 aa, Homo sapiens
MGKSSTSFFEYEYPGFPACFVEKTVFTSLNGLSILVKTHLTIPSHKESKDLFLGYLFCFIGLYIYLIPVPHCFDYYSFVHLDSISPLPSGLQVSDEKSAHSITEDSLYLMNHFSLVAFKIPLLSLSFKSLIITCLIESR

SEQ ID NO: 934342 - protein, 142 aa, Homo sapiens [sequence omitted]

SEQ ID NO: 934343 - protein, 134 aa, Homo sapiens
MPRPALAHTRWAAPTVLPPLSDEPHASKCGLQKVPEYFYKSKFDVIDGVRSSARNQWLRHLLLLHPPRIEYQKCQKRFSISTSQVLLVSEISCKWPPQLLLVCARAHTGTLTCFPTPGAAPTKLNPHPSLSLEG

SEQ ID NO: 934344 - protein, 148 aa, Homo sapiens
MLRSGLLGADTFNLVHRVLEWQLSGSGSQTQQHQHHQNLLEVQVLRPKAMAAIDNYSSNGFGQSKLKTFWKGFTILDVLKNICDTREEVKISILTGVWKKLIPALMDDFEGFKTSVEEVTADVMEIARELELDLEPEDDLNVGYSLGC

SEQ ID NO: 934345 - protein, 141 aa, Homo sapiens
MRILCLPWGFEIGIGNLERVQNVIKVLGNRCTEQGLKVQHWTCPIKTQYWAGPYDPRLQALPEIELPKVCHRNQLGSCSPRHQMSCTTTRLTPVAPGSVYQNLWDREKVVLRGKCIPIIAYIKNEEIVYYEFKGYMNIWEI

SEQ ID NO: 934346 - protein, 175 aa, Homo sapiens
MAPPRSPGAQAGQRLSGDPPPYLPPASITLREPSCLFFPCLTAFSNLAGSSGATIAYHTVLIWAKMVRPLCLPLTQPPDVGCPQKYATLIKHGCGGFGKPTIMAEEEVNRSFSTWQQQGEVSSKRGKAPYETFRSRENALSREKQHGDNHPMIQLLPTGSLPQHVRIMGTTIQVP

SEQ ID NO: 934347 - protein, 164 aa, Homo sapiens
MFRLNWSPEGILTPKASDYKCVPRVFSVISGKCQLLIVQEAIIPTQKIVQRKKGRNLVSETKDRKKKAYKEMKIKKYIAKSAMIYIYYLFYIQKINTDIVAYSYSHLSLHLHPYFYPTHICVHIQIHISVLICVYFAFIQMIYSLTHKVISNMVHMLFMNMPDK

SEQ ID NO: 934348 - protein, 789 aa, Homo sapiens
MAGLRYSVKVYVLNEDEEWNNLGTGQVSSTYDEQFQGMSLLVRSDSDGSVILRSQIPPDRPYGKYQETLIVWYEAENQGLVLKFQDPAGCQDIWKEICQAQGKDPSIQTTVNISDEPEEDFNEMSVISNMVVLPDCELNTLDQIADIVTSVFSSPVTDRERLAEILKNEAYIPKLLQLFHTCENLENTEGLHHLYEIIKGILFLNEACLFEIMFSDECIMDVVGCLEYDPALDQPKRHRDFLTNDAKFKEVIPITNSELRQKIHQTYRLQYIYDILLPVPSIFEDNFLSTLTTFIFSNKAEIALQPQSKDALFETLIQLGVLPALKIVMIRDDLQVRSAAAVICAYLVEYSPSRIREFIISEAHVCKDSDLFINVIIKQMICDTDPELGGAVHLMVVLHTLLDPRNMLTTPEKSERSEFLHFFYKHCMHKFTAPLLAATSEHNCEEDDIAGYDKSKNCPNDNQTAQLLALILELLTFCIQHHTFYIRSYILNKDLLRKALILMNSKHTHLILCVLRFMRRMICLNDEAYNNYIIKGNLFEPVVNALLDNGTRYNMLNSAILELFEYIRVENIKPLVSHIVEKFYNTLESIEYVQTFKGLKIKYEKERDRQSQIQKNLHSVLQNIVVFRGTIEEIGLEEEICFMEDAGEVVMPPLEDDDEFMETKRTQEGEAVMPPLEDDDKFTETKRTHQEGEAVMPPLEDDDEFMETKRNQEHEGKVDSPKRTSSGDFKFSSSYSACAAIGTGSPSGSSVVRLVDHPDDEEEKEEDEEEKEEDKEDETSPKKKPHLSS

SEQ ID NO: 934349 - protein, 137 aa, Homo sapiens
MANSKNPVEIEIMVFSSTLNMPDVGDNKVNKSMACSSLIKAVEFCEVVRGIQRRQCHYLYPQRANDVWNQRRRSDSKHDHRRKVFKCSQQIEMINALSQWSPTFLAPENGFVEDNFSTDWVEGWFQDETLPSLIIKH

SEQ ID NO: 934350 - protein, 349 aa, Homo sapiens
MPRGQKSKLRAREKRRQARGGLEDLIDALDILEEEEESPPSASACLKDVFQSSLDGASNNPHGLREAQSTSTSATAASHTRHPEGVNDQMEERPICTQDLEATDSFPRGPVDEKVIILVHYLLYKYQMKEPITKADMLRNVTQMSKSQFPVILSRASEHLELIFGLDLKEVEPNKHIYVLVNKLDLGCDAKLSDETGVPKTGLLMTVLGIIFTNGNCVAEEEVWKVFNTMGLYDGIEHFMFGEPRKLLTKDLVKENYLEYQQVPNSDPPRYQFLWGPRAHAETSKMKVLEFLAKVNDTAPSEFSNWYTEALQDEEERARARVAPRLALVPQPVHVPRLSPASPPNCSKV

SEQ ID NO: 934351 - protein, 215 aa, Homo sapiens
MKEPITKHNMLKYVIKKDKAHFHEILKKTSEVMVLAFGIDVKEVHPTRHYYTLISKLNRTCEARLSGEEIMPKTGLLMTILCVIFMKGNCATEEDILQVLNKEPLFLWGAQEAHHPKFRVKERHLEHRQVLNSDPVRYEFLRGPRAHAETSKMRILEFLAKIHDTVPSSFPSLYEEALRDEEERVRGRFAAMLPTSARASARSRVNSSSFTPREV

SEQ ID NO: 934352 - protein, 156 aa, Homo sapiens
MAESLSLVIGNSTPEKCGATANWNDQLGMEWHITGLSEESLHCEEQGSGKLMGETLWPPVCRTAAACWRCKQSNQGLYSPAQGQQGHVPWQWSRQRGCQVHQGQVSIQRQWQRACWLSLGILPQRNTELPVTEVIRRTVTVPLVIMDETKWIENKE

SEQ ID NO: 934353 - protein, 621 aa, Homo sapiens
MSYFLSYCKAHGGALLTGYQALRAEGFLCDVTLETEGSEFPAHRSLLACSSDYFRALFKSHTQESRARVIHLHVPSAAGLQRLLDFIYTAWLSLSMDTVEDTLEAASYLQVTEALGLCGRYLERQLAPENCCFAANVAARFGLAHTLDAAERCIVSHLQELLARGAGPAGLLELNPTSLRAVLGAPDVARVPEARLLGLALAWLRQEPTTERLAHCTELLERVRFGLVPADVLRRVYSGSGLVLPARVKGLIIQALNYHTTPSRQPLMQGEQTSIRSPQTRILLVGGRRAREVVIEEVAAPQRAARGQVAAPEPEEEEEELEEEEEEEEWELTQNVVAFDVYNHRWRSLTQLPTPLLGHSVCTAGNFLFVLGGESPSGSASSPLADDSRVVTAQVHRYDPRFHAWTEVPAMREARAHFWCGAVGERLLAVGGLGAGGEVLASVEMYDLRRDRWTAAGALPRALHGRTSSLRDLYVLGPEEQVWSKKAPMGTARFGHHMAVLRGAVFAFLGRYEPFSEIERYDPGADQWTRLRPLPYDRFCYGLAVVEETALLLGGLKWRDSRQVPTRNVVGYDLDLDRWEDIGCALPWAWSGLRCAVLQLAEGGDDEREGEVGEALDLVLG

SEQ ID NO: 934354 - protein, 158 aa, Homo sapiens
MATERGKWSSQSKRRPGVALDPKNKLLLFHRSDHVWDGNAGKDKDELFTFYKQKGNSFHLVVQEMRFRKVHIKMLEQESLTLIIEKSISSYNHLGAVCQSCSLFQKAPNTTRNDVWWSSCILILSVGMGWSHLGSCDILLNGDVYQGRELIVQYGTAF

SEQ ID NO: 934355 - protein, 236 aa, Homo sapiens
MAAETWNVAEAEAPQPQKRYYRQCAQSNPMADHTLRYPVKPEEMDWSELYPEFFAPLTQNQSHDDPKDKKEKRAQAQAESADIGCGYGGLLVELSPLFPDTLILGLEIQVKVSDYVQDRIWALRAILEIKHKRQIISPTLLAKYAYVLRVGGLVYTITHVLELHDWMCTHFEEHPLFERMPVEDLSEDSIVGHLGTSTEEGKKVLRNGGKNFPAIFRRIQDPVLQAVTPQTSLPGH

SEQ ID NO: 934356 - protein, 151 aa, Homo sapiens
MNISAQNISTIVLKTCEDVALRDKRDFADVIRLGILRSWGDDPGWPQWAQCRHKDHYKREAGGSESEKIGNGSRDQRGRFEAATLLALKMEDRAISEQMQVASRSWKRPGNRISPLAYGRNTALLALDFSPFTPSLDFYPPEKEKDEYVLF

SEQ ID NO: 934357 - protein, 247 aa, Homo sapiens
MSLAAQGLREKLSWAVTLEEDLAEITDGSRAGYPLAFTPRGSMSCERGSGSRGLWQDHRPQNVQKQAELKGRAENRIPQGTVKLVPRTHEDAPTIDFQAAPKLAQRPLPLGRHPRLREEGPQAGSSAAAGAVRAALLSQRCGAAGPCPSCLLPRAQLSPRKPTTVPSGIWNSESFPLDWPRCIRGIALYGGYSFMKWTSSTIRLERGDDPWSHGLQNACCARRPENNVNLPGALPQSSWVTRCLVNG

SEQ ID NO: 934358 - protein, 228 aa, Homo sapiens
MFLALSSTRLVYFLEFNDRIHEVPSIQYPLLPPGRFQIPDLALHFQNNGMIYPEYSRINSVNVPGPACKHKLPVSLFQAVRMKKDSRKQWCSSQLDPDVSNGWAIECFNNTQLKRNKAFRKFLLSNNETGPNLGPIASTLYFRDQTRLGAFTVLEPDVVRVQPDTRNSFIFLSKSFHMESNPWAEPQIFFSTSHVLSLACSRSLFMLQHTKALDSSSTIRLHETSFLI

SEQ ID NO: 934359 - protein, 604 aa, Homo sapiens
MFLALSSTRLVYFLEFNDRIHEVPSIQYPLLPPGRFQIPDLALHFRNNGMIYPEYSRINSVNVPGPACKHKLPVSLFQAVRMKKDSRKQWCSSQLDPDVSNGWAIECFNNTQLKLNKAFRKFLLSNNETGPNLGPIASTLYFRDQARLGALNHNTRRQYGCSWSNGWAIECFNNTQLKRNKAFRKFLLSNNETGPNLGPIASTLYFRDQTILGAFTVALSSTRLVYFLEFNDRIHEVPSIQYPLLPPGRFQIPDLALHFRNNGMIYPEYSRINSVNVPGPACKHKLPVSLFQAVRMKKDSRKQWCSSQLDPDVVSVQPDTRNLNHITKRQYGCSWSNGWAIECFNNTQLKRNKAFRKFLLSNNETGPNLGPVASTLYFRDQTRLGAFTVSNGWAIECFNNTQLKRNKAFRKFLLSNNETGPNLGPIASTLYFRDQTRLGAFMVALSSTRLVYFLEFNDRIHEVPSIQYPLLPPGRFQIPDLALHFQNNGMIYPEYSRINSVNVPGPACKHKLPVSLFQAVRMKKDSRKQWCSSQLDPDVSNGWAIECFNNTQLKRNKAFRKFLLSNNETGPNLGPIASTLYFRDQTRLGAFTVSDMAIDYSRRF

SEQ ID NO: 934360 - protein, 201 aa, Homo sapiens
MLLNLHSEAFKSCLGSFNRSIKDSRNHRHDGGDICGGDFPGKALGEPAGLEETTFGRLCVGEILSYVTDFSDMGNRTHKLCFLQLGFVCGFSDSSPNLLKREMASVFRLADSFVGDGINDPSSEDEQKAYVLTITVYNWTCPKLQPGLAHGCQNHLGCCGDGYGVGAFAIDITIRALLCTLIIRSSITGIFEKLLEGVRDL

SEQ ID NO: 934361 - protein, 172 aa, Homo sapiens
MIKDTSRGQEWEGDRAWDAGENIGSQHQPCLDCVYLGHFHYEKKKLQRPLNNTGLNCTSPLIRNFSSASVTPETRPAPPLPPPLQPTQQEDDEGEDLRDDPHPLREYKVYFLFLRIFFMTISFLWFTVFPLTSSWEEHRAYSQKVWCESCFCHSTANTDVPQFLYHPSVKEH

SEQ ID NO: 934362 - protein, 131 aa, Homo sapiens
MSQFCHYSKNLAIAPNKGRVVDDSDELQNFTEFQREPEKWYLNSEEDRVNDALFKNVLKIAGNFDPLGGFATTGRPPGIFRAYMRVEGRRRVRIEKLSTGYYADYLDDEIIWTANPRDTQFTRVTYLHMYP

SEQ ID NO: 934363 - protein, 139 aa, Homo sapiens
MKWWLAISLIAESNQRWGLWVAITSSLCRSPTLHATALLTFRIHNCEEKHFGNCHEDSTLEKGDYKMTADDGGSFQANWGQAKGRQGQTRHRWHRQPEQWWLQKSPSPTGLWNTDDMIGPIQDYAYPSKNFQAKFFQIS

SEQ ID NO: 934364 - protein, 197 aa, Homo sapiens; identical to SEQ ID NO: 882456

SEQ ID NO: 934365 - protein, 208 aa, Homo sapiens
MGLGAVEQGVVLVGEAGAAQEPMEWVGGSGMAGCRSRALPRGKAAKAQREIQHSAGGPALLGDPVHPPQPLATGLGAKSLIARGRQGRPAAPSAGPAKPTPTQNSSWPASAARSPGSCSRLSLHTSLQAEGPGSGLGQPRKGLPQCSGGRKDSSSAAKVGTQAEEAPRASEGSEDCQHAAAAFAIFELETDIIHADREESCLLSGDEN

SEQ ID NO: 934366 - protein, 134 aa, Homo sapiens
MIVRPPQPCGTKHEIEKMFTQKSTFIRTKKSGHKHCNPWAIPIALLGLEQVDWMGMQSSKTPAGVAKGVLVLPLSQPQGAQLATLGETPSLCLRRGEVKAVLHLGHLVRLRGVLDSNVTQHILSCGGYGKRLML

SEQ ID NO: 934367 - protein, 189 aa, Homo sapiens
MSAYAFFAQTCREEHKKKNPEVPVNFVEFSKKCSEKRKTMSGKEKTKFDEMAKVDKVHYDQEMKDNGPVEGGKKKDPNALKRPLSGFFLFCSEFHPKIKSTNPGISIGDMAKKLGEMWINYSDREKQPYITKAADLKEKYEKDVADYKSKGKFDSAKGPTKIAWKKVKEKDKEDEEEEEEEEEKKEEGE

SEQ ID NO: 934368 - protein, 144 aa, Homo sapiens
MVEGQALTTNGQRNGKQWLTSARICGETPCGWGSLTIMVGGKEEQVPSYMDGSRQRENEEDAKAETPDKTIRSRETYSLPREQYRGNCPHDSIISHWVPPKTYGNYGSTIQHEIWVGTQSQTISFCPWPLPKNQSCLPNSPPKS

SEQ ID NO: 934369 - protein, 144 aa, Homo sapiens
MLNTGPLSLLAYRVSAEKSAARMKGFPLAAVVCWKPTPDPVHLGPSHTWRCHQWRLQNSKADSLLLPRATLFQWGTNLMPVGMLLSGLVRQSGHSVPQLLYCAVGNSSWVQTTQSPLHWQGKMADWSCSGGCRPSRKELSPLRQ

SEQ ID NO: 934370 - protein, 138 aa, Homo sapiens
MKIPCCELPQGRPKWQETKEDPQPTVKEELIPENNNDGQSTNSLHHAPGKAIDTQCQPMKANRTRAVPCKARGAELLKTIGTYLLHQCDLDESHRIRILTECFHCKCTYYKIRGLYFPCQLFLQALKCAGTSIAPLLT

SEQ ID NO: 934371 - protein, 169 aa, Homo sapiens
MKQASLWWVRTCSVSSEKFVITNLLKPTSVSSSKSFSIQLSWVADEELRSFGGRGTLVFKIFKFSSLVSSHLCGFIYLWSLMLVTYQWGFGVDVLFVDVDAIPFCLLVFLLTVRSLSCRSVGVCWRSTPDPVCLGITIGGCRTANIAEQQILLPVPSSGSFVPERHPPV

SEQ ID NO: 934372 - protein, 171 aa, Homo sapiens
MLVLGLSQSIVDPNLTQKCSDLLFCSAVTFHEAYTQEHHQDTTFRQCFITTQTPVAGDIQFTEKSIDMTAGVNFFNSRPKTSSMHSEILLRISGKWSLHFLLITFSNAAFVMGSLILHFSSRNCITKLPFLNRRSLCELQWWLLLERFLAFPHFGSWHVHQILCMKHLQNK

SEQ ID NO: 934373 - protein, 226 aa, Homo sapiens
MKPHNKTSLACTTRKFIDILKSAPGGVLSLSQVAAKLAVHRRRIYDIISVLQGVKLIEKTSKNHIQWIGPDFNSGATPEEKKLEEEVSKLSATEDALDKLIEDCSQQLCELTNDKELGKLAYVTLEDIHNLERFQEQTVFVAKLPVEITLEIPISEDSFSLRLSNNDGPVDAYLCLSKKDYEANYTSESAGTSSESTGTSSESRHPEHPEEEENPQQGEELLDMSN

SEQ ID NO: 934374 - protein, 242 aa, Homo sapiens
MWRNQRKKAENSKNQNTSSPPKDHNSSPSREQNWTENERWVITNSSKLKEHVLTQRKEAKDLEKGFDELLTRITSLEKNMDDLMELKKTARELREAYTSINSRINQVEERISEIEDQLNEIKREDKIREKRVKRNEQSLQEIWDYVKRPNLRLIGVPEGDGENGTKLEDTLQDIIQENFPNLARQANIQIREIQRTPQRYSSRRANPRHIIVRFTKVEMKEKNVKAQPERKAGLPTKGIPSD

SEQ ID NO: 934375 - protein, 140 aa, Homo sapiens
MKIIQSVFLDHNGIKLKIRNRKVAEKEPSTWKVNNSFPYNPDVKRDVVEPKGFGAGTSVVEHSSSASRWCQTSRVLQQRGPTVKHQPTQALPQLWPPSCHFACMHSPRVNKEPLGPLTLQLCKNITISFQKVFKLKLCTH

SEQ ID NO: 934376 - protein, 394 aa, Homo sapiens
MSQDFQDYVESSGKIAHPCHVPDLRGKAFTISPFSKKLAVEDLQPFTRVTLHWGKGNDQTFWGLVDTSSELTLTPNDPKHHYGPPIKVGAYGGQVINGVFAHIQLRVNPMGHWTRPLVIFPVPERKISIDILSSWQNHIGSLIGRYHIKDLKDAGVVIPTTSSFNSPIWPMQKTDGSWRMTVGYRKLNQVVTPIAAAVPDVVSMLEQINPSPASPFITQWVHEQSGYGDRDGGYTWAQQHRLPLTKNDLAMATPSAQFPSSETNTEPLTWRHPRGDQPATWWRVDYIAPLPSWKGQRFFFTRIDTYSGYKFIYPAPNASAKNTIWCLLVLPCPVIKVNGKQQQPNPSRTTNGPDPSGMVWVTPPSKKPRTAEVLAEDKGNTEWVVEESSHQYQL

SEQ ID NO: 934377 - protein, 182 aa, Homo sapiens
MRKSNCQKFDISKSQSVFFPPNDHTSSPAVFLKEMEMTEMTEIAFRILIGTKIIKIQENIETQFKKAKNHNKMIQELTDKIANSPRSDERKNLLKAAGEKRQAPLLQVCCSLLEVHSRPYLPGYHQWRLQNSKDCCLLLPLEASPQRSTSLMPAGALLYEVSDDPCWESLSLCLSHLQQGLE

SEQ ID NO: 934378 - protein, 418 aa, Homo sapiens
MMCENVGHIENQGQDWTGPYNWASTMAGTKNKTRAQAKTEKKAAIQAKAGAEREATGVVRPVAKTRAKAKAKTGSKTDAVAEMKAVSKNKVVAETKEGALSEPKTLGKAMGDFTPKAGNESTSSTCKNEAGTDAWFWAGEEATINSWFWNGEEAGNSFSTKNDKPEIGAQVCAEELEPAAGADCKPRSGAEEEEEENVIGNWFWEGDDTSFDPNPKPVSRIVKPQPVYEINEKNRPKDWSEVTIWPNAPAVTPAVLGFRSQAPSEASPPSYIVLASAEENACSLPVATACRPSRNTRSCSQPIPECRFDSDPCIQTIDEIRRQIRIREVNGIKPFACPCKMECYMDSEEFEKLVSLLKSTTDPLIHKIARIAMGVHNVHPFAQEFINEVKGSRRSWMAVTYIIGNAKSRFTSRHHTLF

SEQ ID NO: 934379 - protein, 199 aa, Homo sapiens
MDYSSDNFLHLHVGCAGFPFPFCHDCKLPETIQAMLPIQAVELKLPNSSYDDVSLRMMFWTASNPLLPPLAVGFHSDYIAVEFYDNFGPEEKVVEIEQASLQVYLGPQSTLACSGVDCRETQVLRPGMGESPLARSGPDAPSVSGHWLSPARLCSLVWQGSTEFNVKFPSHCLLLLPSVQTLWAAQLLPGYGGGVASAI

SEQ ID NO: 934380 - protein, 305 aa, Homo sapiens
MFHTLYDVHTFTGSLGCHFSGRKPLWPVAPLLEFFLGPLGSFHPLDLAGCAQLMLPAWITRLPWETAWSSEGCVSKCVVQPLHSQKCRLLQRVGSSRCQHGCQLSTGLPLDQVRHGFHSWHQGTLWCLEAWRRQELQCLKDRVTALAQQVNPTSVQLSAERVAPLCSWSSHHLHSSQQRGGPREWVAPLCRQVIPSSPHCLFIISAALSREEALEWVAPLRSWSSQRLLSSGLSQGFYGPRRGGSACQLLHGWPWAGPERAPQVPTPVRRTGSPTPAQVWSRSGPWDWQPRLWAPTSIGGKSRGG

SEQ ID NO: 934381 - protein, 123 aa, Homo sapiens
MQGRLAGWRPNEELQFKSEGILLAEFPLPQGSTGVTGGWDHKECCMEGNSEIINGMMPLRPHEQTTRMNGIHVCKDQQQLCSRAEGRSYRQEPWGECAKAQGKEQSSCGWTLLAVAAVCSFLS

SEQ ID NO: 934382 - protein, 136 aa, Homo sapiens
MPHSSQALRPWLQLLVWLGSNSPGRSEGPEVQASSTCQPAPGGCHPMPSSIGFDHLDLRTLTNTPYNAKYTCSPTEESGKVQNYPIKNHCFRSQALIKVRGKCYYSSLSEKQNNNEHKETGSQCASLIPHICSLFL

SEQ ID NO: 934383 - protein, 168 aa, Homo sapiens
MAPPHSSFSSSHVRQTCFPFTFQDDSKFPKASSEAEQMPASCFLYSLQNHEPIKPLINYPSGPSAAVNSFGVYWRSNPDHACLGISRGGCRTADIGELQMLLPDRSSGSFVSEEYLAVSQAACWENHYSLQSCLTGTFKSAEIIAPLFVCALPPEMETAEGVINVEKA

SEQ ID NO: 934384 - protein, 182 aa, Homo sapiens
MAFIQKTDINEFWQERGTLVYYLVRTHSLSGEQYGEMAPMIKLSPLGPNVDSWGVLQFKMRFEWGHRAKPYHSAAGPFKISCPHISKHNCALPTVTVMQKMGSHRHGQLHPCDFAGYSPHHGCFHGLALSVAFPGARCKLMVNLSFWDVEDGGPLLTASLGYTPVCTLCLWACDGKACWEDL

SEQ ID NO: 934385 - protein, 154 aa, Homo sapiens
MTTCESCQEEGFSCKATGMELPKAVGAYLLHQCDLDMKHGVKGDHCGILRFNDCLVRFQTCMGVPTGVMPSRAVRRRPPSSRPQNGRFTSILHPVLVKAAESQCHPMRVATGAKSCKATRAELPKTLGAYPSHYSALDVGHKVKALRFNDCPAG

SEQ ID NO: 934386 - protein, 159 aa, Homo sapiens
MGAAHQHGTRIHIFWTLGLTPVVCQGFLVLCPQAEGCTVSFPTFEVLGLGLASLLLSLQMAYCGTSPCDPPRQRFGVAAARGERDTDRTKRKKAVDFIEQTDSIKLPQRGRGPKRVAGVRFFDYLLNFLRREIRVAGRCYQSKKQRQLTCLRSRGKQEL

SEQ ID NO: 934387 - protein, 377 aa, Homo sapiens
MRPARGIWELSRFNWGPIRDIRQKVPSEFGSSEVQVPFSLQDLKQCNGDLGKFSDNPARYIEAFHNFTQIFELSWGDVMLLLNQTLTDAENQATLQAAERFGDKLCITYSIREGGKHYPTGREAVSRDDPKWDPSDKTENWKRRHFQVCIMEGLRRTRTKPLNYTKLSMIDHGFDDNTTAFPEMLREPLLKYTSLSPDPLNGQIILKDKYITQGAPDIRKKLQKQVLGPDSALENLLKVATSVFYNRDREAQERERKYRKETEALMATSKPTNPRIPRVHLIATDVASQVETNINPEIWATQGKIGGTTTAIPVQVHLKDPTSFPNQKQYALKPENGPPLGDTSCSPQDGYNRRTISFIYQLPTNGKYLKAFTRPST

SEQ ID NO: 934388 - protein, 307 aa, Homo sapiens
MNTNEAESRNSNFATVVAGSEDWANAIEFVPGQPYCGRTVPSCTEAPLQGSVTKEESEEEQTAVETKKQLCPYAAVGQCRYGENCVYLHGDLCDMCGLQVLHPMDAAQRSQHIQACIEAHEKDMEFSFAVQRSKDKVCGICMEVVYEKANPNEHRFGILSNCNHTFCLKCIRKWRSAKEFESRIVKSCPQCRITSNFVIPSEYWVEEKEEKQKLIQKYKEAMSNKACKYFDEGRGSCPFGENCFYKHMYPDGRREEPQRQQVGTSSRNPGQQRNHFWEFFEEGANSNPFDDEEEAVTFELGEMLLML

SEQ ID NO: 934389 - protein, 151 aa, Homo sapiens
MRVTIPMIQLPPTGSFPRHVGIMGTTIEDEIWVGHSKSYWRPFKRITLAFPVLKETVVVIIGNFVSDFQKCIFKCLEGLASSSPFRLWELCYPYDRPTAKENKMQSALQQEMSGDHVYKEEDMKHVIMKQCYSRTCCTPFHLKLQFPRMYQ

SEQ ID NO: 934390 - protein, 161 aa, Homo sapiens
MGLSLILFRITFAYHRSWMFPRQLQAQLEATSNLDGKFPMELEVTTTDKDSMKQKTSCHAAVTISIGSQPRFAFTSEGTQFTFTRLLMGHLSSPAVPHNFTGKILATSIFLKEHRYDIKLMTSSSDGIHLTYLFRPYKHKGTLEKGMDHCLTHSTRPCYLS

SEQ ID NO: 934391 - protein, 146 aa, Homo sapiens
MVEGEGGAMFLLLTTKYIDLLGIIRNKYMKSDMTIENPSTENVTKVADSVKNEPCEKYAIIEKGHGCSCRSLSLANNPGTENQILHVLTYKWELNDENTWRHGGEQYTLGPVGERRASTYVVPSTWNTLHETCSYFIWFVEILPSL

SEQ ID NO: 934392 - protein, 146 aa, Homo sapiens
MAFFCFSGHVGRTREPQMVPLALKSALSYKSISCTGMVCMYGGFAMKGGSSILEDEGTTRSGTSNGRSKFPLFELRFSSKRALTFENLASWNGITPLIGFKQKIAQLVLLRVDSDIPPSPKQGGQQWKRGVVSAERSAVSVMGFLL

SEQ ID NO: 934393 - protein, 155 aa, Homo sapiens
MDRNKDHQDAGILSCHTDLPATHNYSYWAYVPFPPLIRPLTWIDAPAEIYTNDSVWMPRATDDRCPAQPGEEGTAFNVTMGYKYPSLCLGDAPGCIHLETQVWAAYLPERSATEEPGHLVSGLSLSPLKQMKGGTGCYLAWRSGNESRTSHANAV

SEQ ID NO: 934394 - protein, 180 aa, Homo sapiens
MLTIVSQLPTVFSTVTCCTGLQRRTSQRPVNFINEMDMLTWNLKQYELGTLLKFPGKSSPYLYLSVVAGETVYVRESEGNLWRQTDLGSFPLYHLLACVTSSQVSGGHTDEKVFRSQLYVDFGDPSRNPGTTTCYIGRLGVKDGFDESQALEPGGENEANGTSDGNNAKSNQRRSQNERW

SEQ ID NO: 934395 - protein, 136 aa, Homo sapiens
MSMCSHHLAPTYNLPAEASDTVEQSGTQISCPQKILPKLKIPLCNPQGLEDPTHEPMPLGPSVPTLEHADVQTLNSFSAEICLSLLNFLVEKQPAPWLWLPAPNTLAVAVSFQSASSGLTLTHPFSVGGASLQEVQ

SEQ ID NO: 934396 - protein, 139 aa, Homo sapiens
MWSNLKTLAQKISSGIRFSQECEPIVNCIYEGSRLHAPYENLIPDDLRWNSCILKPSLLLPLFVEKLCSLKLVFGAKKVGDHWILGNQKKKNTQCGPKYGKTESHELLVGVKTEEELVASLTPTTVPYEKSLPAGSQTP

SEQ ID NO: 934397 - protein, 156 aa, Homo sapiens
MPSLSRAPLVLPLPPPASQHQDNSITYSSGSPNMGPGPAASTSPKNLLKVYILEPHPRPTDLEIVGLGPSNLCSTCPPGDLLLPLSQQAKKGVTVLVGVIDLDYQDEIRLLLHNGVLPYPVIKINEKLQQPNPGRTTGGPDPSGMKVWVTPPGEKP

SEQ ID NO: 934398 - protein, 145 aa, Homo sapiens
MAGYSSETKLTAERSGSNICCSPKSAVLQPPLLIPSQTGSGVDLQQTPTDLQLKVLTVRRKTNKQKGHPHQNPICMSPSSEIKVMEDQMNEMKQEEKFREKRIKRNEQSLQEIWDYVKRPNLSDGEKGTKLENICRILSRRTSPI

SEQ ID NO: 934399 - protein, 141 aa, Homo sapiens
MQGARMCLATTISDKATEFGDADALRMIEWINNSYSLSDLRSHWEAQRKQAAEGDIKWCSLQFPAVTLNGTACITMVPAGTTAQLIVSGSVDTGYPHFSYPYLVSQQQMVMVVTFFQLSTLQRRTQVCLYTPFPHFEESEG

SEQ ID NO: 934400 - protein, 126 aa, Homo sapiens
MSLVGKGFGMFLNYSFFLGGFITHKVNGDTLKDQQEYPQESDNAEYRDTESQLYIMLATCTRSTLEGRGQEAPTGHMGSNITLLKGDSQSLYPLVPGSDLIKAPGHSQNPRMKQWPSSGWNQRSYT

SEQ ID NO: 934401 - protein, 210 aa, Homo sapiens
MSSILFSSISSGRGEFRYLSSFCRVFRRSFSSASLASRLQFLINAENLAKMSIPAVFDSGCFGESFKYLGGHKTSSRNSSILLTSVLTSLLKLTNGGWVLGAKFCRSAGFHFRSTVVTLNTTPLSQRIMKNLWEKGQFPMLSPSLPALTRSSMRGSLSSSFSPFNGIDNAMAGSAALRKRRRLLLLLLLLLQGCSDCRLPPQCSLDILMC

SEQ ID NO: 934402 - protein, 119 aa, Homo sapiens
MACLSPVNEGLAHQQALPTAHKYTFLGPLLKSSFFTLHPNSPLLPPNPSECLLDIHISFAEVWIVNALVSYFPEGLAFNGWKIAHQVPGDRKLVAPYLLDESSDGDDIITVNYPFAKSA

SEQ ID NO: 934403 - protein, 137 aa, Homo sapiens
MVILSKRHQLQPESWAAAASQDEEPLTPKAMGRAGPPGPWGKHATLPPGANQGALGLTVPVNVIPANDHIPAATWAGPRPPFMNGLMLLLQEWGSRNVPRLLMVAARPSDMVKADPESGWRQPFPGHALCYAPIRQP

SEQ ID NO: 934404 - protein, 136 aa, Homo sapiens
MAPMQKTSNQSPQSFITKSRIRTGLRRKKNAGTRSRLNCWLLCKPPASIPGCPKDTPPDNCHQCRSPGHWKANWPYGMNDEKPPHGLPPLPQARPLEMGLPWRAKGTSQKALMSKSESPCHKWSVQVVRRFAKEKL

SEQ ID NO: 934405 - protein, 161 aa, Homo sapiens
MTVVAALCSGIGALLLSVCLFAPEMVLAQGWCAGWHRTVCAFMHVFKLAAAAAKFGVSMLIKALMAMKVHQGSGVVCTNINSYDIVGCTYMCTSREGVVRSTCMHTHWQSNGEGGCGQVPAGKEAQGRMWWGDRMYGLVHIHGSALLGSPSVKYGSPAHKL

SEQ ID NO: 934406 - protein, 140 aa, Homo sapiens
MPAPNPLCPAPDFKCCPYPFSKQLSLPTQASMVVKKSPSAGIPEACAQLTCSSRVNGDQKHALVHFCLCHFQFHLPLMQLPCLPSVHSQDLPSEDLLGRHQSVPWWQLFHLAASSWLTVPAPTKKHFRGHGTTVDFPIDC

SEQ ID NO: 934407 - protein, 124 aa, Homo sapiens
MKFITECLLYSHLWRKEKKKDWPKKKFGFYSVPIKGSADPVGIFQTEMIQQYFHSRGQGLGLKFVRQQRFQPLREINRSALKGENGLEMIDNGHRMGSKDKQELLDKLHKECIHINFVDQIMFI

SEQ ID NO: 934408 - protein, 199 aa, Homo sapiens
MNTVGSSRFCWALFFFLDWTADDQLLNRCKDWCGFLLLAGRAPNGSLGMRVSEKQTAVTVIFLLNLATQQRALSCGYQHLLQWRQQESEVDYATSLSAEKTSRLTVLWLSVEPVAAIHLFQRVCGSSRLSWYVPAVVFEVHDGHQQCRLQSVAEGLRAPGKPLMEVSSPRLQVGPQSEENEVGHEENTKKKPQSHKSHK

SEQ ID NO: 934409 - protein, 144 aa, Homo sapiens
MPASIMCCFASVLASMMLLASQNEKTAFNLWDSFRCLVYSTINTYDCILKLLCVFQLYQDVLICCQPESTCRRWLETLFGSSHSDRRNGIRDSLKEAVWLLFCKAAVLFWGYLQPLIVLGFPRPTATNKIKNLVINQRSKKSLQ

SEQ ID NO: 934410 - protein, 149 aa, Homo sapiens
MGTTCLQIGATHSGCNTNRAETRPSSTTLQVMRRREERRREERRREEVQPFREPRLRSSQSQGYDILFGALWFMAPPCFLVPTVEAACGTPDPTAAGSQHLCQCLELPAPPQQLVCLAVHSSQIPCLLIHTSLTTPCLAHPWQARDPGW

SEQ ID NO: 934411 - protein, 140 aa, Homo sapiens
MGLVGHQKNQLIGNFTPATDFWEAAGLLDFVGGPLQTLFAWVSPAEAAEQQILQNGKCCCLILPLEASFQRGTRPYEVSVGPYWEVPPSQATWDVSFAGLHIEDDEPLILKTNCDKRILYCYKTDGAYQSIENLHFVKYP

SEQ ID NO: 934412 - protein, 167 aa, Homo sapiens
MDPSSVSGKHTPEGAAVATAYPRAHSDPPAEGAVLPLLCTAVPPPLCTAVHRCYWASFAESSPSAVSQLIEGPNRTKRLTPNREFYCLSVFKLQHQFFLVLQHPADLQTQTGISTLQIFDLPASIIRLKWLTVCTVTCEKVHVRVGVQVWVWKEACMEASGTRGTFS

SEQ ID NO: 934413 - protein, 211 aa, Homo sapiens
MPEPSSPCLAVAIQKQRGELSRGSVLKVWAEDLRDPDDLDFSNLAFDARIARINALKESTYAMPDGFLAAQNDANELLCLVRATKEKREESRPEAYDLTLSQYKQLLSIESRQLGSACRKMAMAEKSPEEMLLAMTSSFQVLCCLTEACMRLVKVVNSETQRQEIVGKIDEVVINYICLLKAAEAATGKNPGDPNVGLSARHSTTMAALID

SEQ ID NO: 934414 - protein, 143 aa, Homo sapiens
MLSVAVAEGKREPWRVVGLQSVLSLEMTLVTSIFSGPYSVNMVSAKDKINPSHINTNPYSITVQASSRPYVWYLPGVANIWKHDIDKEYAGLRGKKKWKNLGLTEPKIYEANPRRAGAQASEEVALTQSAGAGTFKGRKIMQL

SEQ ID NO: 934415 - protein, 166 aa, Homo sapiens
MTTKLSSDFVEFLFPDSLSLMRNGYPAPLPIQLGKQGTTVSSKPFSFLPMPTLPLILILANVVSLFVMLFCVFSILEIFHENITKEANGIGKLGNGRIFKVGTDYSHTTLNVPDLIKVEIERGLVKTQILILQDLGEAQESAFLTRCSQLPEDADAADAAGLWPML

SEQ ID NO: 934416 - protein, 136 aa, Homo sapiens
MALRETPSLGKEPRMPPTVMKTASTHNSEGPFDMGAPIHSAFSKFAAKTVFVGFVAKLYDKKDTNRIPFLKDYAGFCSPWLCSDNKCMLRGSPCHETDTFSCLLNRQPSPVGSYPHDSCPLLLPLSETHLPCEPLS

SEQ ID NO: 934417 - protein, 149 aa, Homo sapiens
MAPTTQYLGLPDQTRRVLVTQPQDVLTTCAQGGWGTAWFYTFLGDMRHQSISVRSTLILPERGDNSKQGGGFQVTGELSVTGILCSGLMACVSSLLPGGTGELQECKSKLWPMEFMHLLTLSCTVCSVNCSAGEGVSNQLPQAPTILNT

SEQ ID NO: 934418 - protein, 815 aa, Homo sapiens
MIAKIQEDDFNNLNQLQILDLSGNCPRCYNAPFPCAPCKNNSPLQIPVNAFDALTELKVLRLHSNSLQHVPPRWFKNINKLQELDLSQNFLAKEIGDAKFLHFLPSLIQLDLSFNFELQVYRASMNLSQAFSSLKSLKILRIRGYVFKELKSFNLSPLHNLQNLEVLDLGTNFIKIANLSMFKQFKRLKVIDLSVNKISPSGDSSEVGFCSNARTSVESYEPQVLEQLHYFRYDKYARSCRFKNKEASFMSVNESCYKYGQTLDLSKNSIFFVKSSDFQHLSFLKCLNLSGNLISQTLNGSEFQPLAELRYLDFSNNRLDLLHSTAFEELHKLEVLDISSNSHYFQSEGITHMLNFTKNLKVLQKLMMNDNDISSSTSRTMESESLRTLEFRGNHLDVLWREGDNRYLQLFKNLLKLEELDISKNSLSFLPSGVFDGMPPNLKNLSLAKNGLKSFSWKKLQCLKNLETLDLSHNQLTTVPERLSNCSRSLKNLILKNNQIRSLTKYFLQDAFQLRYLDLSSNKIQMIQKTSFPENVLNNLKMLLLHHNRFLCTCDAVWFVWWVNHTEVTIPYLATDVTCVGPGAHKGQSVISLDLYTCELDLTNLILFSLSISVSLFLMVMMTASHLYFWDVWYIYHFCKAKIKGYQRLISPDCCYDAFIVYDTKDPAVTEWVLAELVAKLEDPREKHFNLCLEERDWLPGQPVLENLSQSIQLSKKTVFVMTDKYAKTENFKIAFYLSHQRLMDEKVDVIILIFLEKPFQKSKFLQLRKRLCGSSVLEWPTNPQAHPYFWQCLKNALATDNHVAYSQVFKETQR

SEQ ID NO: 934419 - protein, 341 aa, Homo sapiens
MSPEQRNQHCEPEESLEAEGDEALGLVGVQAPLAEEQEAASFSSPLTVGTLEGLPAAGSPGSPQSPQGTSTSPTTIDNTLWSQSNEGSSSQEEAPGTSPDPADLKTLFQEALDGKEVDTTGHSYILVTSLGLSYDGLLGDDQSKPNAGLQIMVLCTIIMEGNCTPEEVIWETLSVMGLYAGKKHSVYGKPRKLLTQDWVQENYLEYHQQDAWVCSDGLGGCSCTQGSEAPVCSMKREACIQSCDLGSCSCTQGSEAPVCSMKREACIQSCDLGGCGCTRGAPTPPTRKGQGSHLSLPHAGSKECAALAAPPCCSSYDGSIHSRLATAAFSETYWETFHIAL

SEQ ID NO: 934420 - protein, 154 aa, Homo sapiens
MPYSTVQCCTAGANSGDLCLGCLVQPLLWRDGREHGTKAEYGYIYFEEHVFVIEIVTVMVWWVPRHGSWLQIPFPAFWILEKTTLWLEAKYAGSNTALLLFATLSCLGKEKHKSSLRAHPGTVPFLELIHDTDSFAHVSLLTFSPPVALLHSPR

SEQ ID NO: 934421 - protein, 142 aa, Homo sapiens
MLIAVGIHLLLLMFEVLVCDRIERGSHFWLLVFMPLFFVSPVSVAACVWGFRHDRSLEESRVAYAQLGLLCSRKAKLETDVRTNHEGGGGKGDRRNYQNTPEGSKTVWWDLDGQEEGSKKERVIHSISRMPVEVFLLPPGYR

SEQ ID NO: 934422 - protein, 143 aa, Homo sapiens
MNSYGPVVALPTASRSTLAMDTTGLPAPGMLPFCHLWGVQRAPTPTHQNPEVSLPVIFNLTVGGRVLGDVGRGHKRMQTWEWINPESSHGLQVDLPVSACSLTNGCSFTNRCESHFIICELLSFQEVQFSHVFLGLYAYASRV

SEQ ID NO: 934423 - protein, 375 aa, Homo sapiens
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAELVHFLLHKYRVKEPVTKAEMLESVIKNYKRYFPVIFGKASEFMQVIFGTDVKEVDPAGHSYILVTALGLSCDSMLGDGHSMPKAALLIIVLGVILTKDNCAPEEEHMFYGEPRKLLTQDWVQENYLEYRQVPGSDPAHYEFLWGSKAHAETSYEKERLQMLIHIFDLLFPGHKGRIHNQHFCLASARSRVTVPFPGHYHVSSLLTLRPDLLLALHCCLPLEAGQTPLPFLQHGAFLALEVVPWFSHGSPLVQSHSRNHSGR

SEQ ID NO: 934424 - protein, 256 aa, Homo sapiens
MAACGASLPMPWRQQRGEGFGSQRTGRPGGQKPQEAPEEHRRRRSICGFLPIAQLLPALQPAALTRVIMSSEQRSQHCKPEDGLEAQGQEALGLVGVQAPATEEHEAASSFTLIEGTLEEVPAAGSPTTTLYGANPVRAPAAGKRRGQPPRHTPLTWRPCSNGKVAELVRFLLHKYRVKELLRKLLTQDWVQENYLQYRQVPSSDPPCYQFLWGPRALIETSYVKVLEYAARVSTKESISYPSLHEEALGEEEEGV

SEQ ID NO: 934425 - protein, 135 aa, Homo sapiens
MPYKSQVLELGTPKACLVLYPPVGILVPETRKSQEAHPKPLMYLGVVAVYSGPTTQRISLHHVFQLEVASAILDCFFYLFSASFSDVKLKPETMGVHQIFGSYEGTWMELETLMLSKLMQEQKTKNHIFSLISGS

SEQ ID NO: 934426 - protein, 187 aa, Homo sapiens
MALKLQEAILLILLSTFQKQGSLTPWLSPPQANGEYFQTTTDVLLKPKGSSSPRALKSTVVRHAGTQVLTTGICSSPLARAGLNAPSMGACQLSLVWFSFLLQRDSSELSASQLLYSPSPPQPPAPSTENCSLRHASNAGGSGSGSIGNSRLFFYVFSASFSDMKLKPGACLSLAPAVTNYYFRETV

SEQ ID NO: 934427 - protein, 146 aa, Homo sapiens
MLCSRKHKHSITAIFNLINGDVYKVTNSLNRRYTRKRDDSGPRWDRLLPKYNGGTGFGEIHLFQMRKIGPNKGATGPMQVQNRCQILKFQNDLLSLHVSHLVHADARDGFHDLRQLCPCGFAGYSFPPSCFQGLVLTVCSFSRCMV

SEQ ID NO: 934428 - protein, 183 aa, Homo sapiens
MRSFMLQPWLNGAKVQLRLWLQRVKDPHLGSFNMVLSLQVHRSQLIEVWEPPPRFQRMYGKAWISRQKFAAKVEPSWRTSARTVQKENVGLEPPNRVPTGALPSGAVKRGPPSSRPQNGRSSVSLHHVPGKAIDTQCRPVKAARRGDVSCKATEAELPKAMASCISVIWFICATMQRSQFIPS

SEQ ID NO: 934429 - protein, 155 aa, Homo sapiens
MAGVAGTQCLGCTEHGNAGPGPQNHFFLLGRQACDGRGSAEGKCGFAASTHSPYWALPSGAVRREPPSSRPQNGRSTDSLHHAPGKAADTKCQRMQAARREAIPCKATVAELPKTTGTHFLHQCNLDVRLGVKRDHFGALKFDYPTGFWTCMGPM

SEQ ID NO: 934430 - protein, 164 aa, Homo sapiens
MAHDTALNIQIRPEFLPSGGFVVSLASGVKLQTFTMSVTAIKAVHLELSIPPGGFMVLLSSGVKLPSGVKLQTFVSPPDSGAQLASPNGSHTGAVGRAAGQSRTVRLHSSALGRLMGLGTMEQGAAPVGEAWAVREPTAGGLGHGWLPGPKPCPAGRWQRPHEH

SEQ ID NO: 934431 - protein, 140 aa, Homo sapiens
MLNPELIHELKKSYFKDIIGKISEIFINFGLQSQIFFLPLDRFGYRYFVASRQGRLSLLKLRPQPPLTPGALSQGDGSFIYKPLTGAAAFLSEMPCPERRNLERQSGYSSFAELWLPPLSSNFQAALITLVTFNQNYGPS

SEQ ID NO: 934432 - protein, 136 aa, Homo sapiens
MTVVATGDWLHRGGVTSLEAAGKGSLAAVVVNATPLVLGLQPREMSDGTDPLLWQWQRGCQLALGAPTHSNSEPLPVGMLSNGWGGCSAFLSQGTYLVKRGHGGSQGRETGLLYVCWLHCTGGASVMTIVFVLFPA

SEQ ID NO: 934433 - protein, 175 aa, Homo sapiens
MDLSVLHTVFFDMYISISINSVLLNIGLHNLLKIPEWLICWQLALCFWKSCRAYKKQLWGLNLEIHKCGAVQGLGSTPFAPVCPVFSRSTLRETPTGVEGQTTPTGGSLPKWPRATSKMVASLVFSDMGFLASRIPTKEILGHANEPGHLAVQEQWRAFSPIGSSNGRLTGSGAQ

SEQ ID NO: 934434 - protein, 162 aa, Homo sapiens
MVGKCLLVPCHFRKNVREDKYTSSIDKPSIILEKCICENKDMSELDNHFEEIGDNIRRSNAKSTIYSFTVLNYIFISIVYPADMLKALISQYLVNNGHFIKGLCCFLYLGKIGRNTIYSVKILRTIFTENSVIITENLRAPERAQTNIQQHLASFTSHLALI

SEQ ID NO: 934435 - protein, 174 aa, Homo sapiens
MKGIEIKRRERLKCSTKIERRKRLRDREKLRADGIAGKDSFMTNKQPSELLIQRNLDHFLLPQDFTLAHYIDDIMLIGSSEQEVANTLDLLVRQTVPNEAKGAGTFHAIGIVPSSRACGGNFCMAECQHRQSPGRKPHHGHRSGTANSHDIGIAPLSLPDVVCMLITSESHVEM

SEQ ID NO: 934436 - protein, 135 aa, Homo sapiens
MLCIPDASAPAMAKGGQGIARAIASAPSLGSFHVVLILQVCRRQELRTVRKKNVGLEPPHRVPTGALPSGAVRRGPPSSRPQNGRPTDSLHCAPEKAADTQHQTMKAARKGAVEGTCLVSDETLDLDVWVNAGMS

SEQ ID NO: 934437 - protein, 140 aa, Homo sapiens
MKVLDVIIFQQKAVFVYNENLLFKETASPSPVVARSPPRPMLPSAFPPLSEEINPALTEATVMASPEAAVRQDNVDSPQYPPRTPLCASRPITRLKSQWAHREEGIKRLVEIGMEEWISHFRPTHPSWEGPEDISLNNAL

SEQ ID NO: 934438 - protein, 141 aa, Homo sapiens
MSRGCESWESSEEDRRMRENLKLPRDWLSGCNQNADKDMDNKVQGDEVSDGDEEDIGNKNKATVLHCGEFLLDPNHPVSLLPAGEKVADWHCGDGCRPSCKELSRLRQQAAAVLTANSFPQGLGSLRQSPAKKFNWQEFRY

SEQ ID NO: 934439 - protein, 134 aa, Homo sapiens
MLKLLVAVLFLHLQYPNGRNFGVHAIVSSKNYPEQAKSHRKLQTDCSRLLLGRAIKTAKCCSVVAKALSFPNGDMSSGPWLDTTFKHPWSHLPALTASNRPRPTERSTASLSAVKSYRRLTFVHFLQIIGVLGS

SEQ ID NO: 934440 - protein, 169 aa, Homo sapiens
MCLELVPAGGFVVSLTSRMKPQTFACVRGPEWVATAGRGGQFLFPYLSPPMILLIGAFYRALTGAFYRALIGVFYNPVASYRVLIACQFYCFPQRLHNKADNSTQELICDQHIQVITSPSLAEYSLILSLGKSQIPVDCPQLKEKGFIFIYSTCEVPTGHSKVRVLAKT

SEQ ID NO: 934441 - protein, 158 aa, Homo sapiens
MLGVPVFPVPGVRYNNVKKNYYRKLVSSEKWGFALKIPENVEMTIKLGNGQRMVHPPTACTMHLEKLQALNAVCEISPGDCTLQSNRGGATQGQGAQPLHQCGLDVRHGVKENYFEALRFNDFNLYITHYLPYTGNYSYPMLSNNRSNLRSHGALDED

SEQ ID NO: 934442 - protein, 133 aa, Homo sapiens
MVFKACKSCDPQKGTKLLSGDWDRYSKDDLYLFWESLHTLGVKIIPRFWTSCLRSCALALDTLYPLSVRKFSVWTRCWIPNSLVGEQINRSSTYCRRCPPHSSIRSCKALVKACPNKWELSLKPCESTVQVSY

SEQ ID NO: 934443 - protein, 235 aa, Homo sapiens
MKYLEKYRQMWEGLKLPRDLLNGFDQNADNDMDNEVQDEVVSDGGEEVVGDCKIHKNVEATLELGNRQRMEQLGGLRKRQEDVEGLELPRVLLNGFDQNADSDMSNEVQTEVVLGEEEGNLQPLWELRDSYLTTDVMYQSGEKLPLLHRIVCARSGAQQTSVSPTQIPCTWQVNTDRLAPVSKKKEIILPDTIPVTLGSVDSLDVGVKDPGHPQSSIVSASSEEISSCNGEGASL

SEQ ID NO: 934444 - protein, 141 aa, Homo sapiens
MQQYGNLSDAKPSYCQLVSERSVKDSFHIHAQMTENEEYSSSGGDGGSEEDFSTNTKAVSRKTICTVDQKGRKIESNEDYCPITMSDAWQALKGPSTGESSNEGLTSVFSTSGSPTDGPWISHVPYSKSAHILMYEVYFAA

SEQ ID NO: 934445 - protein, 165 aa, Homo sapiens
MVFVNCYGTGGSVAEDDQRTMEHGELLLPKRGNMRANGTAENDPFVTNKQLPEFLVKYCCNGDTETQTAKDGHVKTKAEIGVMHPLANKHQENKPIDFTQSTLQIKEHPHTDMRKNQCKNSNNSNGQSVVCPSNDCTSSLTRVLNQAKLAGMTNRIQSMDRNKDH

SEQ ID NO: 934446 - protein, 164 aa, Homo sapiens
MVDPLTACIVSLEKPQTLNPSSRKQPGGVELHKTVETHLLLQHDLDVRQGVEGDNLGPLRFDCPTGLWTCMGPCAFVDFVDQLAVVFWSKPFDKSLGSSKLSHIFLSSEPSKSLGNFKLFHVFLSSSESSKLFQPLLVTRFQSHFHILGYLYSSSPLPGTNLLY

SEQ ID NO: 934447 - protein, 166 aa, Homo sapiens [sequence omitted]

SEQ ID NO: 934448 - protein, 146 aa, Homo sapiens
MEQFHPQAITCYPQVHGKIVLHETSPWCQKGETWGTKGPIQPVGVEQIKFPKKKLLPKCKAEMPWCQEAPGWRLPSSARGSTWQIVSHRDYSSKGTLVLWVPQNTNNFAPMVLHDWKSLPLPQTITGQETDYNASIYNTYSQVKAT

SEQ ID NO: 934449 - protein, 136 aa, Homo sapiens
MEDIPLKSSPRGWHLMRWDPLSQAPEGISWFAGGKVHGKSAVSGPECTVPSSHAVSHGFQWLGTGNPQTPCTSHSIKNLEKYDERTLFGEGSQLKKEITVFQSKTVSETVRIPEINHTKTSVKIHFSPENDPCTYF

SEQ ID NO: 934450 - protein, 134 aa, Homo sapiens
MAESQNHYVEDKKTDARVTYCMIPLMQNSRIAKRSHVEGSLFSQWSHPKQTVVLDHLAEGKEYLYQIKSEFTSKDIPFYETVCRKDAALTMQPESGVSVIKMYLNKENGKRPRENSKADQRFALIKGIFHLRVS

SEQ ID NO: 934451 - protein, 214 aa, Homo sapiens
MTPPEQTRGEKKQKVQEKLEKSLKHESTEDKEEEMKSSASRSGPLTNTSPSTYPWYQSHWPIYTEIINSPKYQKDPVCQILQRRLQNSKDCCLFLPLQTSSQRGTCQMPAGALLYEVSFDTCWEVSPHQEAWGAGRQERFSLLKLRPLPPLLPGALSQGDGSFIYKPRKGAAAFLSEMPCPERRTLERQSGYSSFAKLWWAPSSLNFPVALFTL

SEQ ID NO: 934452 - protein, 470 aa, Homo sapiens
MHKPTGGVSCLQEAAVLPHQRTVTMKAKKKASSSDSSEDSSKEEEEAQGPPESSSSEASSDDEEDDKKKKSVQKGVKPQAKTAKAPLKKAKSSDSDSDSDSSSEDEAPKKQKPKTSVAAKARAKVPATPGTPAQAAPKVANGKAASCNSSSSSSSSSSADSKEEMAAAIPKKTIPKVQCPRPAPPSKKSLGTQSPKKAVEKKQPSESSEDSSDESDSTKKAAESSSDSSYSNSSEDDEALSKLASTSKNSSDKPAATTKSPAAEPAATLKQPASSGQEPLMRKADSNSSEKESSSSEEEKTKMTVAPPKPKVTDKAAPYLPAKQAPERGKDSSSHSDSSNSEEEEEEEKTSKSLVKKKLQKAAGGTAPSKPASTKKGKVKSSSNSSSDDSSEEEEAKPKGKDSPRPQVPKASGTSALTAQNGKAAKNSKEEEEEEDKKKKAAVVVPKLGSGKKWKQLRLPKRQRLLQPRK

SEQ ID NO: 934453 - protein, 144 aa, Homo sapiens
MNRSSNVPRKGILKSGTRSLQKVCRVHFANARNARSLLSNQYPDQSAVIHIKYRSFFDEAPAFSGGRNNSWRKLNLENIPRTMLMYDIVHYSESGVISNRLRNEMKFLLQRPVTQEIHKHQLRIVSEIRNDSLKPGARTIGISR

SEQ ID NO: 934454 - protein, 134 aa, Homo sapiens
MKETTLMIQLSPTWSFPQHVGIMGATIQDEIWMGRQLNHDFFDLLTLVHLTSIGGLMHLVLVRFHTADEDLPETGQFTKERGLIGLTVPRGWGSLTIVAEGKEDQVTSYMDGSRQRERESLCRKTPPYNNHQIS

SEQ ID NO: 934455 - protein, 320 aa, Homo sapiens
MVKTSEFYRYSRQLRYEVDQALNYFQNVHQQPLLDMKSSRIRSAKPQTTVFRGMIGHSMVNSKILLLKKPRVWWELEGPQVPLRPDCLAIVNNFVFLLGGEELGPDGEFHASSKVFRYDPRQNSWLQMADMSVPRSEFAVGVIGKFIYAVAGRTRDETFYSTERYDITNDKWEFVDPYPVNKYGHEGTVLNNKLFITGGITSSSTSKQVCVFDPSKEGTIEQRTRRTQVVTNCWENKSKMNYARCFHKMISYNGKLYVFGGVCVILRASFESQGCPSTEVYNPETDQWTILASMPIGRMRIGVVYDKFWPCSMQALLKSI

SEQ ID NO: 934456 - protein, 311 aa, Homo sapiens; identical to SEQ ID NO: 788931

SEQ ID NO: 934457 - protein, 152 aa, Homo sapiens
MIRNIYVFCIFTLLTCIDNKTFYLYTCSHGPRSPVMRSLNNKNHQLKVGILHLVRREIRVQLRFKVLGRERKNVYGGEEAYVCIMPYVMTSNRRKENIRKGSQTLAEMPDLETDLQELSESKTGDECRDGPDVQEKILLNLEQFKMPEGGAC

SEQ ID NO: 934458 - protein, 149 aa, Homo sapiens
MALRSVERLAEVYSEEGPVLCGNFSTPLWRFEWVGLCVPTKLDFRGETGLANGWVTKEPSDEEPQQEEPPTESRDPTPVPDLETDLQELSQSKTGDECRDGPDDKGKILPKSEQFKMPEGVIDETESDHVRFYFTNGNTFKCKKRDSSY

SEQ ID NO: 934459 - protein, 164 aa, Homo sapiens
MTISLIHLTFTPFPHISFFPVPHPGHTWFNDGSSTRPNRHSPAKAGHAIVFSTSIIEATALPPSTTSQQAELIALIQALTLAKGLHGNAYADKVAKEAASVPTSVPHGQFFSFSLVTPIYSPNEFLVIASIRGPPEEVKKVESDLKGKFFPNIAIWGKVVLRKI

SEQ ID NO: 934460 - protein, 154 aa, Homo sapiens
MKSLTFLLAFTCASSQLACLCLQLDFTDFSLLENDLRLLFIKKKSLTEDSHTLNICLNDFFLTPISSARYFFQRVCESFQYSWYVFAVVLGAKVHDVSLHTMETQTKWELFSSFCAEVLLVVSEGVLYFCRVDDNVSFIISDCTYLVFLSFTFY

SEQ ID NO: 934461 - protein, 148 aa, Homo sapiens
MAVQLLVRLIEQCVETHFVNFCSQELPQEHTRKAKKIQRSFEGTGLPLQTPETLKNCEPACSLNREVRGLGRVLSPGHRLPRNRLSVPHFPGYLYDSAEAAIIPREYNTIRQGTTPQPLQQPQQARPKDRLSSDMPISAPTWWSFSTC

SEQ ID NO: 934462 - protein, 135 aa, Homo sapiens
MVDKLFDVLLHSVCQYFIEDFASMFSGPSAAGLLEVAGGPLQTLFAWVSAVEAAEQRILVSSKCCCLIIPLEVLSQRSTQPFWMKGWVAPPHLWVFLIRWNKRLGKEKDTETKYRERNKGTWGTSVQHMEDPASL

SEQ ID NO: 934463 - protein, 155 aa, Homo sapiens
MQNSLVDDMEFYCLHGRSNQPQHSFMPRSNPEKVPQLQVCWSLLEDDSRSCAPGYHQWRLQNSKYCCLIIPLEALSQRGTPLYEVSFGSYWEVSPTRLQPCWSISECCASRHQGSMDMGPAKPGTGENRLICGLLRLWEKHSIWMGVSHFFQDFE

SEQ ID NO: 934464 - protein, 157 aa, Homo sapiens
MRFFVINFSSTIIFSVSVFYVFLMTWLEHLDADTKYLPELFSYDKVKALCPHLNCILNCNPQVLRERLTKRLEAFCPCPRDLWNFELERDYLKLELMFKRKADLKSLENLQPDNAIEKNNPFSGKKFKPAAEICISNQEPNVNCQDNGENEKGAESL

SEQ ID NO: 934465 - protein, 149 aa, Homo sapiens
MKVVGYRWIIVHLGFVCAVDPKLSLDEWTWRRGKATGTDAEAGIAEGTLDSTWPYGWVWGLILEVKDLDLSVADTQGRLPKDKEHNPSHVFLWLSGHSRKSEIIKSKGVGNGKEYFIWKRVRMRALDKNSDAVTSFKFSTKCMWEQLPL

SEQ ID NO: 934466 - protein, 138 aa, Homo sapiens
MRDIAILKEKQEKEIQTLQEETKKVQAETAAKTREVQAQLLQEKRLLEKQLSEPDKRLLGKRKRRELNMKAQALKLAAKRFIFEYSSGIKRENQQFKKELLQLIEQAQKLTATQSHLENRKQQLQQEQWYLEKPVFNF

SEQ ID NO: 934467 - protein, 161 aa, Homo sapiens
MSEFHEHGPIATLLLLQSEVLNQKQCRVETMAVCKAFCKSMDGSKSVSNLITLGNGFKPGAQCLLLGDWALSHGYSQAREPKFQESITDFDDCSRTHVLMASRSQSDVEDKVLISTLNPPNNHPGPLPLPLPPVAPAHPPPYGTCGAGGGHPQSLMGEKSG

SEQ ID NO: 934468 - protein, 142 aa, Homo sapiens
MHFFDPPTPAPSSKPSSKTSHNGIIAPPPSNDKTKIAIVKVKDLKQTLAIKTGYQLEWIKYSIHTLNKSNCYACAHSRPEAQIVPFPLRWSSSRPGMGCMVALFQDSTAWNSKSCQALSAISRSLAPCGSAPEGHPASVSQH

SEQ ID NO: 934469 - protein, 134 aa, Homo sapiens [sequence omitted]

SEQ ID NO: 934470 - protein, 142 aa, Homo sapiens
MVSNGVPKPLLIPWSPRGSGCIRKGYRLKMNGYPSRKRGAGIPGSLLCLTDTRAKVRGNRWHMENWVTSTLILCFSDGLSKRHTRRLDPVPGLEGPMPTEPHSLLTQQSEIKLQGGSEAGGGDTFKAVCRGKFIALNAPKRK

SEQ ID NO: 934471 - protein, 143 aa, Homo sapiens
MSEIWVGTQPNHDANADAHKNLDELRKPYAEQKKTDKKVTKEPGECNKTEAKRGEDFKGGMVNSKRIHREFEDHNVKGKILDEKPDLCRFLCQRGYGELRAKPKGLTGFCSGSLKQEKKQTAKASNVNLFHTFTWAIWGNPLS

SEQ ID NO: 934472 - protein, 252 aa, Homo sapiens
MSATGDQDLIQEDQEAPVNQEGAQAEAGGDREGGDSGPDSGNTVAGVAGPMRGLGEEEGEQAAGLAAAPGGGNAEEDSEIRIVVEMVEEEEDEEEEEEEEEEERNEADNFDLVAAARRYPIRGFRMEFLDMVHSLLLRIYHNDHILIRMQEPRLLLVHERLGVGAAGPEGEGLGLLQEAALVPEPEVPADLAEMAREPAEEPTEEASEKPTEEAAEEELSEEAAEEPRKEESAAEEESAQEPATQEGAPLKV

SEQ ID NO: 934473 - protein, 136 aa, Homo sapiens
MIQLDVIRAGPENREHLISTGLIGSNGRWKEPQVSQSLSNCEVGPDRSSGGKGGLRSSPNTGVICPFYHAAHTKANPSGESGKQLRAEENLPWCPERLPPLKEGRQRKETWRAHTNEDDLRIHIMKTRMMTIPLPA

SEQ ID NO: 934474 - protein, 217 aa, Homo sapiens
MILNTGCVPLIFRALKKKPLATTILFFTSMRFTVLAPIYEDVDEAGNHHSQQTNTGTENQTPRVLTHKWELNNESTWTQGGEHHTPGPNVTIGENRSKENKNLGANDGDSRKKEGSIKIVHIAANTVAKYQHEKLRQHGLQGQCLSLDDYAYTEFPSVKRISTEVPQNQNFRLRFQPTFRRNMDGAECYYPQQTNTGKENQILRVLTYKWKLNDESL

SEQ ID NO: 934475 - protein, 140 aa, Homo sapiens
MRLHGPNSITQDFLEGFKEAEEFGWFVVFMTQPTHFTSNQNEHGFSLHLLSREGGIQTSRSATVASATTASASPMPILATKIPRLRSRPNGAEMLLGGETKSAGPHRLWPPLPLGAKAQGDPNSVPEPLDGVIGDPEGKP

SEQ ID NO: 934476 - protein, 148 aa, Homo sapiens
MENLCQGSMEGKCGVGASTQSSTGVLPSGAVRRGPPSSGNQNDRSTDSLHCVPGKAADSKCHPKKASGRKAVPCKATEVELPKTLGIHILPQCDLDARPGLLPMFTQDPRALQSANGKASQACVFPFRVSRFPRSHMGPDVLSRGQGL

SEQ ID NO: 934477 - protein, 157 aa, Homo sapiens
MARPCSKILEAFAVIHLWGPAKGSKQHLYLPLTPQALLDLLGHMAQVAEQLAQQPEPVAELSPVLDPTQNWQLFRQGPNVVILPAAQYIYANYAFWHWENDNRMSLGTHWTYFNALTLTVDTWKGCACTFCCRHSQDRYFASFNPIKLTFNINHHSP

SEQ ID NO: 934478 - protein, 140 aa, Homo sapiens
MWRIAVGLEKAVLWGVIRRAGAWLWGCPTGALCQPGIIRQCRSYDAETLGTQGCPASRHYQAGASVEASITRDAQARLVLSNGQDCSTEFRFDSSPSAKVFYGNKLSLITGSGLALLSEKITKLENTDKILSADVGKHVA

SEQ ID NO: 934479 - protein, 175 aa, Homo sapiens
MLQGCTAAAGQRRSSLLRRWGGQGEALLTFQTVAQWCRGISQVRPPGRGASHFPGRTAAGQRCSSLPRRCGSQAEALLTSQTVGQPNRGAPHFTDGRASRQRCSSRPSRGGGRAEAHLTSQMVGRPGRCAPHFPDSGAVGQRGSSLPRWWGVWVEALLTSQMDATIAIEEEEPEG

SEQ ID NO: 934480 - protein, 846 aa, Homo sapiens
MQTFASQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPVGIQVSNTTF

SEQ ID NO: 934481 - protein, 217 aa, Homo sapiens
MIISSKPGNYISCIDNESSLEDKLFTEAKKQASGSIKYLAAILKCVLLFPACPGEIDSSLQLLVHFLVNEAAKLCPVIHISVKLEFISLAANCKVALGHSGLCSLKIHLVAGQPALVTQHQSSPDGRPSNEVAMAGAAVRRQRTKWSQLRGPTPVFKTIRSQETHSLSGEQYGKDPPPYSVISHQFPPTTYGNYGSYKMRFGWGHRAKPYQPPIKPI

SEQ ID NO: 934482 - protein, 263 aa, Homo sapiens
MVNGLTRIDGFKNGSFPTQALSLPAAIHRHDLGYRVEEISKQQSIQEVTQVLLKAFNFIREAEDKSSENLEPDNAIEKKNPFSEEKFKRAAEICESNEEPNVNPQDNRENVSRACQRLGLSWRTSARAAQKGNVGSDSPHRVPTVAPPSGAVSKGPQSSRTQNCRSTDSLHSVAGKAAYTQHQPMKIARREAVPCKATGVELPKTMGTHLLHARHGIKRDNFGALRFDCPGGFRTFMGPVAPLFWPISPIWNGCIYPMPVPPL

SEQ ID NO: 934483 - protein, 136 aa, Homo sapiens
MYDTNISPCEDRRKLSIMAEDKGHADTSDGRLPVEQASLWEPRLFHTFSEIQGSSRFFYPQQGYVKINAMDACGVQVQENIAFGVPKEGGCLTSMSDSACQFLQREPAGIFDKKCVEFVNVFSRYYHHSSNKTFNS

SEQ ID NO: 934484 - protein, 176 aa, Homo sapiens
MPHNFCVLPPQYPEMPSVPCLCCQGVREGWSGNSRLFFKNIFSISFSDMKTKTDTMRTQLIFGSYEDVQMCLEFLPSGGFMVLLTSGVKPQTFAVSVTALKGGVKLQTFPVSVTALKGGASGVVRSSHPEVFVLPSGFVVSLASGVKLQTFAVSVTACKGSVDPKIIIHFNSRIFT

SEQ ID NO: 934485 - protein, 167 aa, Homo sapiens
MASYSLLRHLCVPSFHLKPWNGTPDIRQITVGFEGHSTGQGGPESWGPGCWSHELQCGLVMPILGPPMAAHGFPWTTRAGQRMVRGLTGQRDDGTTSYREELPSLLIAGGDGKSSCREELPCLLRAAETTCPHGGATLSRASSLPRMADIMTASCSEELHSSGLPLC

SEQ ID NO: 934486 - protein, 657 aa, Homo sapiens
MTDSKYFTTNKKAEIFELKAELSNEKKEKRKEAVKKVIAVITVGKDVSSVFPDIVNCMQTDNLKLKKLVYLYLMNYANSQPDMAIIAVNSFVKDCEDPNLLIRALAVRTMGCIWVDKITEYLSEPLLKCLEDEDPYVRKTAAVCVAKLHDINAQMVEDQGFLDSLWGLIADSNPMVVANAVAALSEISESHPNSNLLNLNTQYINKLRTALNKCTEGARFSCWTACLITTLKMIGRLRASDSDYYNMLLKKLAPPLVTLMSGESEVHYVSLRNINLIVQKRPEILKQEIKVFFVKYNDPIYVKLEKLDIRIHLASQANIAQVLAELKEYATEVNVDFVRKAVWATGRCAIKVEQSAEHCVSTLLDLIKTKVNYVVQEVIVVIRDIFRKYSNKYESIIATLSDPVMAKEVVLSEKPLISQETEPIEPTALEELICHIGSLASVYRKPSSAFVEGSHGIHRKHLPIHHGSTDTGDSPVGTTTATNLEQPQVIPRQGDLLGSLLNLDLSLPVNVPQVSSMQMGAVDLLGGGLDSLVGQSFIPSSVPATFAPSPTPAVVRSGLNDLFELSTGIGMAPGGLTGVIPSTPLAIHTPLMPNQSIDVSLPLNTLGPVMKMEPLNNLQVAVKNSIDVFYFSCLSPLNVLFVEDSKMEHQYSLVVCN

SEQ ID NO: 934487 - protein, 172 aa, Homo sapiens
MIPEKPLDKKEKKKGSQLNTVNLYLYASGGSLHGTGCYIGGGNKHVGETNPTPPGGYPKSSGDKGVRKKQNKSSKGGSRGPECWRLAQGPELLGSAYLLVYKLFVLRADGKEAAHGSLWVSRTGKTNSSGTLETLFPTSQLLGRLRLEDCLSLTSEAEMCQDHVTVLQPEEQ

SEQ ID NO: 934488 - protein, 408 aa, Homo sapiens
MAEKEFKMGCKAVETNRNINNAFGPGTANERTVEQPMMTSSVVGLRRSSKAAPKAKLAPKKMAMVTVWWPTASLIHYSFLNPSKTITSEKYAQQIDEIHQKLQWLQLSLVNRKCSILLQDNCQPHVTQPLLQKLNELCCEVLFRPPYSSDLLPTDYHFFKHLNNFLQGKRFHNQQDADNASEEIRAKSEENNKEEKPDSKKVEEDLKADKPSSEESDLEIDKEGAIEPDTHAPQEMGDENAEIMEEMMDKANNKKLAAIEALNDGELQKAIDLFTDAIKLNPHLALLYAKRAKEHERAQREEEARRQSGAQYGCFPGGFPGGMPGNFPGGMPGMGGGMPGMAGMPGLNEILSDPEVLAAMQDPEVMVAFQDVAQNPANMSKYQSNPKKETIPMTSTAPGPQQVLLFYH

SEQ ID NO: 934489 - protein, 150 aa, Homo sapiens
MSHNCCVLPPPVPRNMLHTKLQLQEEFVPTVMEANKFHVRCLQAEEPRKAGGVIHSESEGLRMGVSTLMSMQFERDFDKPKIVQNGVTKEEKVTLAFPFLDKGILCQDIELKKAFSCYSLVKSCVHFGCWYHKIFQKVKLGFHKEKRNNL

SEQ ID NO: 934490 - protein, 497 aa, Homo sapiens
MTLMVPREEEWKLFLTESGQEIRPALAKWWPRVWAEDNPPGLAVNQAPVLIEVKPRAQPVRQKQYPVPREALQGIQVHLKCLRTFGIIVPCQSPWNTPLLPVPKPGTKDYRPVQDLRLVNQATVTLHPTVPNWYTLLGLLPAEDSWFTCLDLKDAFFSIRLAPESQKLFAFQWEDPESGVTTQYTWIRLPKGFKNSPTIFGEALAQDLQKFPTRDLGCMLLQYVDDLFLGHPTAVRCAKGTDALLRHLEDCGYKVFKKKVQICRQQHDCVEVLDSVYSSRPDLRDQPWASVDWVLYVDGSSFINPQGERCAGYAVVTLDTVVEARSLPQGTSAQKTELIALIWALELSEEARKAASAPFRASVTAPLLPQAPDLVPTYSKEENDFLQAEGGQVMEEGLIRLPDGRVAVPQLLGAAVVLAVHETTHLGQESLEKLLGWYFYISHLSALAKTVTQRCVTCRQHNARQGLAVPPGIQAYGEAPFEDLDPGGLHRDAKVWR

SEQ ID NO: 934491 - protein, 168 aa, Homo sapiens
MVVWGRYTHNGPQWGRPLLHPQQSTGPMSYNPSEGEQTSRDPHSNYPDARVGAQSCTQVQGKSYPGDVTGGSWMDNAERKMSADSGLAMDLGAQCVVTWWYPTVMMSTPLCDERQKWLWGMTSRRQNSSDTELKKEGVYSAAGIGKTPVSRAELPERAIPVPFKGSQL

SEQ ID NO: 934492 - protein, 139 aa, Homo sapiens
MQLFPKMLLSHSLVGFSCEEAILHDHSTASIWTYDISYVHYDVEEYIPEAEGPRAPRRPPVPSLRVQKPKNLESYVQGRREKCIPFQKGMRKQRKRIPLLLIVFPNRAHSLFDCTFSHWGCVYSHTNQPWKQPHKDRDT

SEQ ID NO: 934493 - protein, 146 aa, Homo sapiens
MQTNSRISVGAQVAALLRLHSSVFGSKTLMVWAHEGISLPACCKDPCAKCGFPGGVTQLLTTSFRWGWELPWLCATPRWAIAPLSFSSFSMGQAVQLISPNARAWILQLKVQNSLAVFFPLPLKLPYQLLVALTQTGTSELNYYLA

SEQ ID NO: 934494 - protein, 150 aa, Homo sapiens
MAHVYLWLRRRKMLESLELPRYFLNGFDQNAESDMDNEVQANVVSDKDEELVWKWSKGDICYVLAERLAAFSPCPKDLWSFELKRDNLGHLAQEISKHQSIQEVTWVLLKAFSFVYLQIHGLELRSSFPISSSGNTCLPTHAAINLSTFF

SEQ ID NO: 934495 - protein, 138 aa, Homo sapiens
MLEEPFCPLLHCGSPSLGWPRLEPTPSACGEAVSSLLYWPAGIPSQWVFVCKVPWKWGLLSEAAWLSGFSPLPTAMDGSPASLKFPEPKYAKTPVSQCLLDRPPTLAAVISLPSSVLGTQGPDGKFDSKLALFSSQNC

SEQ ID NO: 934496 - protein, 245 aa, Homo sapiens
MITLILSPAKSWNFEVYWGLEAKFICGIKGTRISMLALAKCLVVRKKSAAEAEPSWRTSTRAVKRENVGLVSPHRVPTGELPSEAVRRKQPSSRSQNGSSTDSLHQAPGNDSGIQHQPMKADMGTVLRRATGAELPKALGANLSHQHSLDEPFSLPLGCGGPSLGLAKAGAGSLCLPGPVEAEAWAEAGAARACRDRFRVRKDLAGPSHLACQCLLGFIGGMSSLWAAGVPRLGATKSRASAIES

SEQ ID NO: 934497 - protein, 145 aa, Homo sapiens
MLASSSPSAMIVKNLKDNIPGINFKKYGIAISGVGAKESVHNLQLFWRKCASYAANRHVNVLTDGQLCLGFITRFSHHLYIFFLDYPNCSHCYHQQSNSSSNTSSYILLSNPTAYFTSSRSLDLICLKQKRLSSLPNMICCYINR

SEQ ID NO: 934498 - protein, 134 aa, Homo sapiens
MEVEVALLTIAPGDPLAKFLLPVPTTLEEPHLMATATSGSQGILPDYHQCFLKVQGLFSQLVLNAAGLGLTLQGSGSPLPYRHKKVFSTMLPVPVDVGGVTSAIQHCFCYLFSASFSEVKTRYSSDKLVQPDDG

SEQ ID NO: 934499 - protein, 257 aa, Homo sapiens
MRDRQTKRSRGLGFVTYSCVTEVDAAMCARPHKVDGHVVEPKRAVSREDSVKPGAHLTVKKIFVGGIKEDTEEYNLRDYFEKYGKIETIEVMEDRQSGKKRGFAFVTFDGHDTVDKIVVQKYHTINRHNCEAKRPFLNKKCSLLDHREVVEVGLAILWVAEEALEMVEVILALVETLVEEEAMVVEVVAAEVVMGEVMVDIIDLEVMVATMAVVLVVVVEGAMAVVDQDMETKVVGMVEVVEDMMVTMKEEILAVRP

SEQ ID NO: 934500 - protein, 201 aa, Homo sapiens
MYSSTRFQRMYGNNWLPRQNFAAGVGPSWRTSARAVQKENMGFEPPHRLSTGPVPSGAVRIGPPSSRPQNDRSTNSLHHVPGKATDIQCQPMKAASSGGWTLQNHRGRDAQYHGKPPLASANIWGVICQSPWEPVGDWLQKWPLPPTENNNSNTGFMREGIESGRRKDTETRLKGEKAGNPAQGYHELGLISGPQWLQGNR

SEQ ID NO: 934501 - protein, 216 aa, Homo sapiens
MFLKEMEMTEMTEIAFRILIGTKIIKIQENIETQFKKAKNHNKMMQELTDKIANSPRSDERKKLLKTAGEKRQSGPSSAGLLQFAVGPLQTLFAWVSPAEAAEQQRLLPAPSSGSFVPEGHRPDASRSSPQSSSAVPVKPSLSGSAALFRAGRQEHLSLLKVHLQLPLPSGALSQGDGSYIYKPLTGAAAFLSDMPCPVKRNLERQSGHSHFAVLC

SEQ ID NO: 934502 - protein, 370 aa, Homo sapiens
MGPLHFFADMNLVICVLLLSIWKNNCMTTNQTNGSSTTGDKPVESMQTKLNYLRRNLLILVGIIIMVFVFICFCYLHYNCLSDDASKAGMVKKKGIAAKSSKTSFSEAKTASQCSPETQPMLSTADKSSDSSSPERASAQSSTEKLIRPSSLQKPSIPNSAGKLTRPSYPKRSSKSSCSKKLSKSSHLEKAHKKGSLEKLCKLDYACKLASSDKPVRPPQLFKPLYSSHPQNEISPSKPFGPQELAKPPKHFNPKRSVSLGRAALLSNSELAETCQPYKKKHLVAKTYRPLVNDISEAKEKNTQNLHVSSKVKSSSRSFRKLDSRNNAYGDHVNDSDTMKYYSEVDSDKVIIITCDRGYNQVTSEVTLND

SEQ ID NO: 934503 - protein, 135 aa, Homo sapiens
MSTQKYHNSSLAREINWMENEFDKLTEVGFRKWVITNSSKIKEHVLTQCKEAKNLEKRLGKLLTRKTSIEKNISDLMEQKNTAQELREAYTSINSQINQVEERISEVEDQLNEINHEDKIREKRMKRNKQSLQEI

SEQ ID NO: 934504 - protein, 164 aa, Homo sapiens
MQVTDGARPNPERHSRTASDPYSGIPGCEDCEDGVFSPQDPPRRGHGFETPEETWGHVRDEDISGTPGAASPGHLGLTLVPAQNQLSRAHSGKVYELNEEVSRPHRRGIPIVGRVGGIREQLLFKQLCTVAAEVLLLMEQGCPIGSQPRVAAQRQFCTHIYTHL

SEQ ID NO: 934505 - protein, 276 aa, Homo sapiens [sequence omitted]

SEQ ID NO: 934506 - protein, 126 aa, Homo sapiens
MLHRAGLSHLRGCLDHPLITSLPSQGTKKCSRTSRRQNPSDIELKKETVYSARSISKTSVSRAELPNVEHNDESEHQCCVPDLKALGANNSGGDCYGFCIKVFYHVKKIRIFSLLVVFIIKYVDYL

SEQ ID NO: 934507 - protein, 144 aa, Homo sapiens
MGHKAAETTRSINNAFGARTSNERTVQWWFKKFCKGDKSLEHEEHSGRPLEVDNEKLRAIIKADPLTTTREVAEEIKVVHSMIIWHLKQIGKVKKLNTWMPNELSENQKNCRFEVSSLILHNNEPFLNQIVMCNEKWILYDNQR

SEQ ID NO: 934508 - protein, 160 aa, Homo sapiens
MIRGSHRKDPKQHGILHWKLRCRREPDKGGLKLTPWQTTAALQKRDLTIERKINKQKATTTASTKVPTETSSKGQQSQRLKLDKLMKMRKNQQNKQNAENPKGQSASSPPNNCNTSQQGQANAKEIHHHKACLQELLKEALNMERKNQYQPLRNSPKHKN

SEQ ID NO: 934509 - protein, 141 aa, Homo sapiens
MFFTVTERPCTESPLGHCLVELWEWGHHPLDPRIWQNHWQFAIPAWKGHRHLTPIHESSYRVTLQSRRGRATQGLGSPPLALVCPGCGHGVKDYSGALRFNDCPAGVSDLHGACCPFHLDDLSLLEWESLLNACTTIVSWK

SEQ ID NO: 934510 - protein, 139 aa, Homo sapiens
MFLYHFLLNAPGFISSSAALCTAASTSSRKLLKSACSSGDTSSGEDGDVTETLTFFFGWAIPVSFWLGADSGSGCFSLDIWPFGKGHRGRLCTLSGPLGPDLAGTDASALNRCLYIQSRRILTDSAGKFPLRFFLCSVH

SEQ ID NO: 934511 - protein, 152 aa, Homo sapiens
MWLCSSKCRPLGGVYGLWGYTFRRNAQVKAGQQCCGPLTAETRSPQLEQQRLAAVGCVAHLHFPPTKVALGFINTLGGMHMCWASLLSLWPWSGKDLASSSGSCKGLVSDLWECALRGTQSHSCSVQMKVGQVHWRPKDDKAHLAGSSEDLA

SEQ ID NO: 934512 - protein, 148 aa, Homo sapiens [sequence omitted]

SEQ ID NO: 934513 - protein, 153 aa, Homo sapiens
MFPSPDPFKGLGGPSSNHWRLYDYILGKQRQFEFFFTDLDGLYFFLFSALARNSSSMLTRSGESGHLCLLSVFRVLPGGHCSQSSQDGGGPLPKWWRATSNMVASLVFSDLGFLASGIPRNGILGHAVSVIALLEALGHGRELWNPVTNVQLD

SEQ ID NO: 934514 - protein, 151 aa, Homo sapiens
MIGSFLRPRQKQILLCQQWPWQCVWTLSLGNLLVCSHLDAYGVGVALSSLRQANLRLWRPHALASFVVGTVSPGHCTAFFPGCRTLCGLECWGPFCTVGSSQNCASAVLQVYVGECLWGSEDVEMLVLLGLKANYNQVFTVTSLLNFSALS

SEQ ID NO: 934515 - protein, 142 aa, Homo sapiens
MGFEVIGIRLCRGNFVFCQNCYKVQLEVSFSLWSFPNSTGGLTQGSFSLSSSQLQVKSNPSPMMWTLRFPSEDVCLGADDPPFTFSRFGHSEFFGHFLEPEVAIHFFQRVCGFLWLSWYGPAVVLQAKVLDMGLHTPLCPCL

SEQ ID NO: 934516 - protein, 144 aa, Homo sapiens
MAKRCQGTTQAIASGDASLKPWQLPLVLSLHVQRCQELRCIHIEDYHVFLEDCSVYVMPHIIADNFPCTEACFVIITTPYFLVLLTKRVKLYKIFEDIYFEPNVSDQWLMPQPSGDCKNMCPRWPGYSLVLYVLERQKTSINAY

SEQ ID NO: 934517 - protein, 136 aa, Homo sapiens
MQGVHGWVWERMPISLRDPVHPFKPGDSVWVMKWNPTTLGPIWVGLHTVILSTPSIVKVAGIVPWIHHSWLKPEIQDKWTSQQNPDHPSRLILRREPVATEDNSPALGTPFTCVWGWAHRKVPPLHSHHVVGEHSN

SEQ ID NO: 934518 - protein, 161 aa, Homo sapiens
MLGPFLLTDLYIFLVEEQYYMLDADSKHIRQSGKPCPTPIRYFHLPGAVTESSKGNSAFYQGSCFRIVWNMVRPVNSISICPLPHFFSREVISLFKSNAVYNTMTVDKAYCKSMDDSFNRSISCRKGGARCNNLSFILDELLHVPHHLFPRNFTEVEDPLI

SEQ ID NO: 934519 - protein, 140 aa, Homo sapiens
MFKKAHCVQRPGPNFKAGGESFQNGSFHSINASPHKTPVYYKSKQVTLQWRKLADITSIKQYNYLEIKNNVLMNDFWVSNKIKEEIKKFFDTNENKEWENIFANYASNKGLISKIYKKLKQIYKQKTNNPIKTGAKDRNR

SEQ ID NO: 934520 - protein, 151 aa, Homo sapiens
MSEERSGAQRLLLQAVLFPCWSQGGWTTWSKDLSPTAQHTDCGRLKPQCLFRLDSDSSFLIGNSNNSSQRLRERTWISLGLRLQGRGGHSLCRPADIAFSPGSSEESRQPRLVGFSPVKHTPSTKGQTKCFIKWVLFPVPPNWVGPSNRDC

SEQ ID NO: 934521 - protein, 144 aa, Homo sapiens
MGCKLNLKIFQTLTKPPTWDGGQWKNMGLPPPMHAIAETSSVVETLTRGARGIKDTYTQKYSVWSGKSGDSQPSELRASNRDLHTYLLTASQKPTTFIVGVMAITNMSQCCRDFIYGQLRGQFKARCWGLSPASHTPPGHRAAQ

SEQ ID NO: 934522 - protein, 177 aa, Homo sapiens
MWCLVKVYFLVLRWLSSHCVFTWQKGYDQSGDVIGASRPRSAQVEPASSDVQNCPAEIRSDSSPRAKVSHGSKSSLEDCHPWPHFATDASTPNPLGFTSAALLPRPFFLSLRKYTPERCKSAIVQCYQPRMVGLCCGSKSGVFCLVMSSGGCVGAMGDRLASPWVDSSLLELWTRDI

SEQ ID NO: 934523 - protein, 218 aa, Homo sapiens
MSCDPPPPPTPGPLSLGLIQHQDSPKSLLPALLEGLRCSHSAGNSTLMGCSGQSTSVGQRQRLPVKELWWWLLANASSGKLRLRCKRMWPGRDAGIGQQTAGHSDQTDPIPWPRLPCCVQVQQPANTKATERSVLSRQFSLQSQMSVGVMGSPAAWIPEVHGENEPLYACFTRPFPRSHSGPKMSPGPQQPDAGFPASSPFSSGPLSPSCHSYAFAPS

SEQ ID NO: 934524 - protein, 177 aa, Homo sapiens
MFKSAEVSAAFCSAMPCPQMWSLHRQAGLLQLRWAPPSSSFLAALFTYSSLSNSGRPPPASLPPCSLISDCCASSEQGSLGVGLSEPGTGYNVLEREFPDPLHFPGEAMPRPRRPLQLTLRGLHPLSNKPQCDEPGTSVGNAEIRNHPSSASLTLGAVDCISSYSVILEPPPSGISL

SEQ ID NO: 934525 - protein, 162 aa, Homo sapiens [sequence omitted]

SEQ ID NO: 934526 - protein, 182 aa, Homo sapiens
MFVGCFLMCFPFIRYLVFLSGCSEHFFLHYDFENLKILCLKVDLLVEQLTGVLWISQTLFHRAAAACWGSTPDPISLSPSHPWKDHQWRLQTSKNGRIILLLAGLSQRGTDLLLAGTVLYEVTIRQKRLRPLIYNTAAAPLPRGSSQEDQSSVHKPLAGDTEISAGKPHLRLQCDHMVEEDL

SEQ ID NO: 934527 - protein, 159 aa, Homo sapiens
MKLSLAGYEILVTRTFLSRFLPSLNCVKTCYFSSEEFVITHLLKPTSVNSSNSFSIQFCVLAGEELQSFEGEEAFWPLFCWSLLEVHSRPCLLGYHQQGLQNSKDYCLLFLLEASSQRSACPMPARALLYEVSVNSCWEMSSSQEAQGSGIHLRREYVP

SEQ ID NO: 934528 - protein, 160 aa, Homo sapiens
MFTNTLLHLMSVDPTVFLLLACVKDHSQHLMKHFGWQHPLECCGQQLETTMATPQEQQVSNFKGPENKMLLKLVHVSRSSRAMVFSSIKSLKVFSMLFILVSHSSNLFSRFLASLQWVRTSSFSSEKFVITDRLKPSSLNSSKSFSIQLCSITGEELHYF

SEQ ID NO: 934529 - protein, 312 aa, Homo sapiens
MPLENMQDSTLPMKAATGAVPCKSTGLELPNALGYLEGSEDRKVWESLKLPRDLLNGFDQNANSDMDNKILAEVVSDGEEELNFELDRDNLGYLAEEISKQQSVQEEAEHKILENLQSNNVIEKKTPFSGEKFKLAAKICISNEEPNVNHQDNGENVSRCPPPTVPNVALPSGAVKRGPPSSRPQNGISTNSLHCAPGKTADTQCYPLKAAKSWATPCKATGVELPKKMGTHLLHQHDLDVRHGVKGDHFGALRFDCPSGFWTFMGPVAPSFGNCVYFAHEQDYRLFVGIAHGQFDHKRSLQVSVWLLFFMK

SEQ ID NO: 934530 - protein, 136 aa, Homo sapiens
MMLAVGQGEKDHQVRAGISFSELSLSLGAVAVKDGGVVPIPVEFVFSGGLWLSLLSHTGLHESGGKPAVRGLALLLCSPQPLRLISLPSLPTPNSTESISRQLVTRAENLPQTKDSTEFSDSQFLALFPLEPREAP

SEQ ID NO: 934531 - protein, 148 aa, Homo sapiens
MFSWMLLMSVDAHQYPGIEELDDRLEALLLHLIYLEIAKLCVEINAVDFYPRRNTGAQYKNKGNFRYFEKHGRQQTMPWVWQKTGSDSPVHKKGRKCLSDTYFHWRARQSRPQGSSLTLPSTESDLRSSGETVRRSGSGKSFAHVSRP

SEQ ID NO: 934532 - protein, 151 aa, Homo sapiens
MQAVNVQIPIPGIGGFICPHEVFSRAYVLKGPTAAALLEFAGGPLQTLFTWVSAAEAAEQRILLNSKCCCLIVPLEVLSQWSTRLCEVSLGPSAAGVLQFAVGPLQTLFSWVSPEEAVEQQRLQPLPSSGCLIPEGHLPDASWCSSVRGVC

SEQ ID NO: 934533 - protein, 142 aa, Homo sapiens
MSGMGWLKSQAWRMHLMRRYESGHSRNFFIGLLQHAGGLLQFLLTLDFAVPGGGCNIAIGGWLEFQVNGSYLVRCHGSGAFRLSLLRPKELEASTALDLAHGLSLQSDNFSLALRMFRDVFWEPGLGVKNFTSLPDALFYDD

SEQ ID NO: 934534 - protein, 146 aa, Homo sapiens
MVVLGEVLCAGEANLYLETCLSPITYRPLPLDNGMRLCMPTLWLDGQEAKVGAPPAAKYVYANYTFWHWGNDHRMSLETHWTHYKGIKADGNVSWGEDVSTTEYGKAVSSGKKGSSKFTSSVSPALLRSSHTSPFKVGGSHSFSNQ

SEQ ID NO: 934535 - protein, 148 aa, Homo sapiens
MATKATNIASETYKGNEDFKSNDLRKKGSAKRTLSCRRVGVCRRSTPDPVCLGISSRGCRTADIGEQQMLLPDRSSGIGERLEESTGAWLGQHSTSGFDWGQMLPLWIAADFPLLPRLMQAKGEDQYYVEKLARDLCLANMQIMLPAE

SEQ ID NO: 934536 - protein, 261 aa, Homo sapiens
MSLPVEKATRLTVFQHLRTPAAVIQFLQRVCGFSWLSWYVPAVVLGAKVYDEKLIVPVAEEEATVQNNKITVVSVGQVGMACAISILGKSLADEFAFVDVLEDKLKGEMMDLQHGSLFLKKLKIVADKDYSVTASYKIVVELNPEIGTDNDSENWKEVHKMVVENAYEVNKLNGYTHWDIGLSVADLIESMLKNLSRIHLVSTMVKGMYGIENEVFLSLPYILNARGLTSVINQKLKDDEVAQFKKSTDTPWDIQKDLKDL

SEQ ID NO: 934537 - protein, 152 aa, Homo sapiens
MKNAQYPLIMHSSYSGIPVQNMQIRLLEILQIGSKQSKRVSREKGTVNVTGVRYLSYHQQRIQTRRSVCDTLLHYSKAKPHNDLIQKDKIPGPIEQGGQREGRPQRRRKPDFPIPLGSWGGQWKKAFNLSAQGPNLTAFVFHAGALALPDPA

SEQ ID NO: 934538 - protein, 153 aa, Homo sapiens
MFTSGRIHLELSMLKQILAERCLRICTAMGWGLGPSGVGLRVGSSDLWVAQFCGKSMVSLAGWDTYHHSWLGCGGSYASCCSQVATAGRCSFFLSMDHASCFISSGEGTWISWLLVKDSHANYGSFRWETLIAAVSRQPSWPHSSNFLLIPPQ

SEQ ID NO: 934539 - protein, 196 aa, Homo sapiens
MGDRTGPDPKLGNMWELTVLKAGVSLHERSLCLPPSTVMINTECQLDWIEGYKVLILWVSPDNAIEKKIPFSGEKFKQAAEVCISDKEPNVNLQDNGQNVSRACQRFSQQPHQSQGQRPRSKMWFCGPGPGSLSCVQPRDFVPCIPAAPAMAERGQHRARAVALDGASTKPWKLPYGVEPTGTQKSRIEDLQYNDE

SEQ ID NO: 934540 - protein, 145 aa, Homo sapiens
MADKYGHRCGLFLFSSYDLATYLTETRSTGGTGTDWNLPGFCVLRLVDDHSSYIMVEQQNSNSSGAGRMKVAKALSARYKLSLDLPFWGPEDCGPLFTAPLGSSPVGTLFGGSDSTFPFCTALVDVLHEEPLQQNICLDIQVCHT

SEQ ID NO: 934541 - protein, 140 aa, Homo sapiens
MSHGTWEHPFPGPLAGESKFFLELFLSAPIGVSRLPVSSAPSLGSVRQKENPQKPPLSSSMDPEAVGTTQGEQAEAEWGVASHEKCKELGDLPTPPAKGSREGLCYLAWVLCFSRGFCNLQIRRYPRVSNYQDRGFLAQN

SEQ ID NO: 934542 - protein, 632 aa, Homo sapiens
MVSMVVGGQKTDLMIDTGAEHSVVTQTIGPLSKDYVNIIGATGRDLLHKLQAQISFTPSGDMTLSLGLKEAMVLTLTIQKTEEWRLYESNCQECGKRYTVAKGEKLFTDLLLKLPGVWAEDNPTGLAVNRAPAVVELLRRTYPVRIRQYLIPMEAYWGIEKHLKRLLEFWIIEECTSSWNTPLLPVLKPSAKPLYEATKVGIKEPLLWGKEQDMAFKEIKKALIQALALGLPDLTKPFYLYVHERKEMATGVLVQMLGSWYLPVAYLSKQLDWVATGWPPRFKVLAVTALLAEDANKLTFGQKLIIQVPHTVVTLMEQRGGHRWLSNPRMLRYQWLLCENPYITLETVNTLNLATLLPIEYAEHGKPPLCAPGYHCCVETVDEVFSSRKDLKDQPLKDPDIEYFTDGSSFISEGIRKAGYAVATLNSVAEACPLPVGTSAQKAELIALIRALLLAKGKSVNIYTDSKYAFATLHAHGAIYKEKGLLTTEGKEIKNKKEIEQLLEAVWTPKKVALIHCNGHQTGGSNEATGNRKVDREAKRAAITKMTEKRETYVMPLLEPPLAETPNYTSSEKAWFAQENGDYQRKEAGGSFQTGGLPSQKPFDHKRWPPPEAAILEAYPQGCVLFLRDVPC

SEQ ID NO: 934543 - protein, 226 aa, Homo sapiens
MESPAVKLNLIGNTMSPDLAADFQELSQSKTGVKAEMVLMSRGRFCQNQSNLKSHKENCDYGTAGVTQLPNIPHRTLSDVIHACEEEKLVSMSTLNLLPSNSLPKSKTQMNCLDWKRNPKGKGPSVGGHTGGLGQLLPDECMTCWGCPNKSRFLVPRSTTYALWDCFYVCALTIHHCLIPGRHSHQLHLPGQSCAEPEMVAHAGQKWLTQNLRKEVPCLSKIDLHH

SEQ ID NO: 934544 - protein, 135 aa, Homo sapiens
MPCLAVQEEMAATQALPAVVYVRKNCPIPKSSSPPQPPGPWLVRSLMGSLTLLSRRLSHRCSFAWRLSGLFYSLCITGSTVHASSSSLCVPQMTISSVSPPTYSQMDRPSPRTRKWFRERRPRCPNTCCRILLQD

SEQ ID NO: 934545 - protein, 217 aa, Homo sapiens
MAAVPHIKNEDLEALLPLSLPPTGDPPEAHWLLLTLTHTSTPSWIGLWTYLLHLRSKCMVVSLTSSRRMRLSVRPRTKWPNPWEVCPLSLTLTHTSTSGRTDLWTHLMCHSQQERSHNISSHSSAGTEGRQQDPQAAGTCIGRNMHIEPGTFRDSQSFLTVTMIAAAAAITLAAAGRPSQGCTLCGGSRSQGQVGSPSFTSWGGSSWVHLQLPKQQL

SEQ ID NO: 934546 - protein, 147 aa, Homo sapiens
MVSNTILFITYGELSISNEEDSLENGQSLSSSQLSLPALSEMEPVPMPRDPCSYEVLQPSDIMDGPVSEESPSASESGVLLSQDPSAKPVLLLPPKKPAAFPGDHEETPVKQLPLLKQPPALPPKPTTRIANHLTGEIDSMSTFLQR

SEQ ID NO: 934547 - protein, 162 aa, Homo sapiens
MRASINQHKTEPISLALLTTREQEGISGGEYSKGPEERRSVVIGKSRGQSGRERYPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLER

SEQ ID NO: 934548 - protein, 136 aa, Homo sapiens
MDVQHMPIYISSDTQLTTVQGVVTSFCGDYGVIDESIYFSSDVVTGNVPLKVGQKVNVVVEEDKILYGLRAIKVRITHIRGRSGVIKNTIFFTLDSVKLPDGYVPQVDDIVNVVMVESIQFCFKWRAVSITPVQKS

SEQ ID NO: 934549 - protein, 143 aa, Homo sapiens [sequence omitted]

SEQ ID NO: 934550 - protein, 135 aa, Homo sapiens
MVLTSAFGEGLRKLTIMAEGEGQPACHMVRERKKELFTAQRGEDEQRISVLLLQPLHRCDRNCPPNITGLNPLNHGHIDDIISLSQSKGEAQDLLNNWSCSQLLSERQSSTQPFFLQNNNNNNNDNNNNLTVIHE

SEQ ID NO: 934551 - protein, 148 aa, Homo sapiens
METKYSHACTSVWYIGRAAYMELAVVICKTEAPLRVLLPMKTTDIYPASSAPCSSICYVPALSGREGVADTEGLRKRREKRKQKVGGILPISIVSGFGKALSVCACTFGFLQPLKQASCCCVSSQVPPGGKLKEKSLATFLPPLHSFL

SEQ ID NO: 934552 - protein, 176 aa, Homo sapiens
MGALANKEHLSRPLPTPPLRVTKSINVHITCCAWALGRREPLRRIVLGVWLPLINRCLDLTSALWAPQHCHHPSPLISPSLIRFQKGDFLSMGRTSVRRHITANSGPIQSYKMGYPRPVFCGLREPSLHAWMTHSHHPLSGPSASCSPAGQCPGFLCFSASELVPCWASSNAFLGS

SEQ ID NO: 934553 - protein, 145 aa, Homo sapiens
MPWSLHPFNGENNAGSKESVTSNRTLQTSQPTPPEEVYTFGCVFINNGQIQASPLQTSQPTPPEELHTVGYVFTNDGQQMRSDEVNQVATGHQSKQKRSRKSKRHSSSKRGKSMSLRLDKQEGEGESNLWASTMSKDICSHVLEG

SEQ ID NO: 934554 - protein, 706 aa, Homo sapiens
MAFIDASITHNVHEEKVKNGQPAPGNVITTVPPVLINMAAAGISSMSTRDQYAAVTHSIREERINNGQPAPDNTLSTARLLVIWQQLEFHPRAREICLNLFHWFPDVTITHNVREERMENDQPQTDNVLSTAPPQLGYMAAAPSTSIRDLYATVTFTVPEEKMENGQPQSENPLSTAPTGFINMAGAVIPSMSTNDLYSTVTHNVREEKMENDQPQPNNMLSTVQPVVIYLAAAGILGMSTRDQYATVTHNVCEERVENNQPLPNNGLSTVLPGLTYLAAAGIPAMSTRDQYATITHNVREETTENGQCQTDNVVSTVPPQLGHMAAAGIPSMSTRDLYFTITHNVCEEKTKNDQTAPDKFLSTVTAGLMNFAGAGIPPLSTRDKYATVTQNVREERMENNQPSSNNVLSTLLPGLTYLATAGILAMSTGDQYAAVTHIVCEKINNDQPAPDNILSTVPPWIGNMAAAGISSTSTRDLFSFLETEHDRDIPVELPKCTYLTAQHFPLVSRCYRQSKLSIRRIYLWGYHSTLILQLNLFIWFPDATVTHHVRGEKINNGQPAPDNFLSSVTPGLINVSVDGIPPMSTRDQYVTVTHNAHEEKMENGQQAADNILSAVPLGLINTPEAGIPAMSTNDLYATVIHNIQEEEMENGQTPPNGFLLNSAPPELINMTGDHMPPNALDSFSYNFTSLSRYKLLYKPDSNDLW

SEQ ID NO: 934555 - protein, 147 aa, Homo sapiens
MWFPFFCWLSSRNCTKHLEPSYTFLGALLYPQSGPAVSHPSCTLIPLPLLLLLGKENALLLKDSPARDPNIMNTSKPNYLPKAPPPNIIPLGVRVSSYEFSEDTNIQSVHNACLPQKPEADSFITTGPTGIALKDSGEGKSSKREDA

SEQ ID NO: 934556 - protein, 440 aa, Homo sapiens
MHLPHSSTSSFEQRMENGQPQTDNILSTAPPQLGDMAATGVSSTSTRDLYATITHNVGEERMENSQPQTDNVLSTIPPQVRHMAAAGIPSMSTIYQYATVTHNVYEQKIENGQPAPDNVLLTLPPELINMTATDISSMNATITYYVPEEKMEDGQPQSDNVFSTAPTGLNMTGADIPAMSTNDLCLNLFIWFPDATVTHNVCEERMENNRPQPNNVRSTLPLRLSYLATAGIPAMSTRDQYATVTHNVHEEKTKNGQPAPDNVIATVPPALTNMAAAGVSSMSTRDQYATFTHNVHEEKMENGQPAPQNILSNVLPGLINMEATGIPSMSTRDLLALTLRVIEPMWGFCQSLSMIPTMHSETGKQPEGGFMDQLSPLYVGPDVKPHGLPDVKSHDYQKLQLLLEEHSDILGILELAPVQSHYQVIPENSDYLLLHHDLPH

SEQ ID NO: 934557 - protein, 395 aa, Homo sapiens
MCDDGVEIRVFNSNSHLHFFRIFELNHFIWFPDAAVTHIVCEEKINNDQPAPDNVLSTAPPWLRDMAAAGISSTSTRDLYATVTHNVCDERMENDQLQLNNVLLTFPPERVNMAVADFSAMNATINHNVYEVRMENNQPQFNNVLSTVKPGHINMAAAGIPAMSAKGLCATVTHNAYEEKMENGQQAADNILSAVPPGLINTSEAGIPAMSTNDLYATITHDVSEKKIKNSQPATDNFLCTVTPGLINLAEAGILATSTRDLYATVIHNIQEEEMENGQMPPDGFLSNSAPLELINMTEDCMPLNALDSFSYDFTSLSREELLYKHDSNEFAVGTKNYSVSAGDPPVTAMSSVETPQISPAMAKKINQDIKCQLMKEVQRFGQTHSWAALDLYVI

SEQ ID NO: 934558 - protein, 158 aa, Homo sapiens
MVQGQWKEGKPQDTACPAPTEHGDLCRAPESLGEGSRSVGASLENQEAQPSPSLTLAPSKGGLPTTQRSLDDKRMPRSLHPFNGENNAGSKESVTSNWTLQTSQPTPPEEVYTFGCVFINNGQIQASPLQTSQPTPPEELHTVGYVFTNDGQSVVCVE

SEQ ID NO: 934559 - protein, 171 aa, Homo sapiens
MSQLTEMDFGVFHNRNLNEEEGRVQCKNRGRLTKHQALLLDCPKVTIKTCDTLNPALLMPVNSSENLTHSCIKTIEQIYLGRRDLRDTSLKNPDDEYSFLHSDGSSFLKNGKIRVGCTVALDLGQGKALNIYADSKNAFFVLQPHAEHKNLDFKTALTVNSGICSCLIKKY

SEQ ID NO: 934560 - protein, 172 aa, Homo sapiens
MKRRRRPFGCRFGLAINLQISFSALSAEMVKYLYKKKTKSETLKNFSAQVYADGDTQLTTVQGVVTSFCGDYGVIDESIYFSSDVVTGNVPLKVGQKVNVVVEEDKILYGLRAIKVDVVPHPLNDDGPSDSKIRVLNGCVTSISEDTVYISNIIYFPMDIVSEVCLFKYVQK

SEQ ID NO: 934561 - protein, 151 aa, Homo sapiens
MTFHIIYPPVCSTCSWKEYVFCSIWTECSVDVVPRHLYGAGPSDSGTRVLIGCVTSICEDIIYISNCIYFFIDIVSEGGAWTWVSLQSTPGVSNGPTRLEINDLHRSDLHSCRTQGEEVQSWLQCLLGFSIIISIIYTHRSALLAYMEEMG

SEQ ID NO: 934562 - protein, 170 aa, Homo sapiens
MNPTGHTRHSWKVIPLILQKRSQCSFPGMSFLKAFPSEHHGKSEHWLKQLLPMEVQREEVSLGAQRLAWRFSFWLTSPGNMSMLLCPSAPASLSAPWAQRFMKRKQRSQCLLTFETDRPVSLPLPSFSLSVTFPGDSNSPHTCHLGMTAGLMSNLIKCQIILPWESQQNV

SEQ ID NO: 934563 - protein, 159 aa, Homo sapiens
MDTVEPEQTVQNSQTSKSNLILYEVIGITEASPWKPYLINPAVKKDGVTHLPFTRGLQARGGKGAVSSGIVWSCFLEVEAKGLWWESCPGHSAFKGVFPTPFSMPGTTTKHIVECNVRSIPFGKDRTFMMGIEPYFPLSLRIPDLATGEGLASVYTLSL

SEQ ID NO: 934564 - protein, 153 aa, Homo sapiens
MRQQEMGHADPVGRGGTWQGASDRWGQSPAGKGGLPPCSAARISSSPGGLPPVLSRVHPSVPRSVSQRSLMEALGSGHYVGGSIRSMAAAALSGLAVRLSRPQGTRGSYGAFCKTLTRTLLTFFDLAWRLRKNFFYFYILASVILNVHLQVYI

SEQ ID NO: 934565 - protein, 158 aa, Homo sapiens
MWKRKSAFLWENAGSASAQEETLGKSSLESPLLFRSTKVVKLRDSLRNSSRKRKLDLNGKRHFFSQLRQVESECYFSIKRPLCGHNVTGHYTLVVEKNLEVCAEENETLVFEVGLVLNSISGTQGASWGQKRRVRAPPAGHQRQCEILSAHCVAVAIS

SEQ ID NO: 934566 - protein, 138 aa, Homo sapiens
MELPEEGTGCHLYCLAAFTVATFRYWKIQGDRGLEWTPIILQHSYGEVDRHFVTWVPDPVSLHSTGPPGLGLQPTATRAIEPAAILQLPKTELPGPEAGEDPQYRASTSWKKGQTLLYAGPDPHFSLLGRNAQSGTPA

SEQ ID NO: 934567 - protein, 167 aa, Homo sapiens
MIWLCLHPNLILNCKSHNSHVLWERPSGSSGHGFRVCKPQAFHVVLSLQVHRRIEVGNLCLGFRGCMEMPECPGRSLLQGRGPHGEPLLEQCGREMGWMPHTESLLGHCLVKLWEVGHCPPDPRMVDPVKACTMHLEKPQTLMPAHESSQERDCTLQSNRGGAAQDP

SEQ ID NO: 934568 - protein, 236 aa, Homo sapiens
MDFRQTPTNLQLRVLTVRRKTNKQKGHPHQNPICTSPSSKTKGMQLRTSNEHRWMENDFDELREEGFRRSNYSELKKEVESMTKKITNAEKPLKDLMELKTMARELRDECTSLSNRCDQLEERVSVKEDQMNEMKREEKFREKRIKRNEQSLQEIWDYVKRPNLRLTGVPESDGENGNKLENTLQDIIQENFPNLARQANIQIQEIQRMSQRYSSRRATPRHIMVRFTKVEMRKKC

SEQ ID NO: 934569 - protein, 194 aa, Homo sapiens
MVGKTKWKPLELPLPRNTINQKQYHIPGGIVISATITDLTDAAVVIPTTSSFNSPIWPEQKTDGFWRITVDYLTEKAASFELGPEQEKALQQVQAAVQATLPLGLYDPADPTVLELSVADRDAVWSLWQAPTDGGTLPPGDTTIPLNWKLRLPPGQFGLLLPLSQQAKNGVIVFPGVTDPDYQDEINLLLHNGV

SEQ ID NO: 934570 - protein, 142 aa, Homo sapiens
MTWHSWAAHWSSGVILVLMFLPQRRGSRGGDLSSGCDQGEDEQDWELLKKQSDPVLIEQLRCAGGPLQPLVTSHSEAQRLEWGSAMLLLLADWNSKPVGLILAVSSTLALGRYRNAIQESRPRIGEPKSLLGALPHCGQAGT

SEQ ID NO: 934571 - protein, 142 aa, Homo sapiens
MGKKQSRKTGNSKKQSASPPPKERSSSPATEQSWTENDFDELREEGFRRSNYSELREDIQTKDYVKRPNLRLIGVPESDGENGTKLENTLQDILHENFPNLARQANIQIQEIQRMPQRYSTRRVTPRHIIVRFTKVEMKEKM

SEQ ID NO: 934572 - protein, 157 aa, Homo sapiens
MCSHDEAVLALVLLECGVSCTFSQQNMIRGRLFLMAQISSGMFHFDQGEPLIWLHGELRQQRGEGLRGFWGMARKRMRANGRSEVQTMLTSKESLKVPNLFYGVHVGEVDLPVLPCQVPSGLMCGERRSFDNFLRQVEVGNPQSEVSHKAQEGEEVL

SEQ ID NO: 934573 - protein, 161 aa, Homo sapiens
MDPNQKEIPDLPEKECGRSSINLIKEAPEKDPRIISVPEEEEKSKSLKNIFGGIIEENFPSLAGDLDVQIQKAQRTPGKFTTKRSLSRYIIIRFSKVKTKERILRALRQKHQGTYKGKSIRITQISQQKPYKLEGIGVLLLTSLNKLSAKNFVCSKTKHHK

SEQ ID NO: 934574 - protein, 142 aa, Homo sapiens
MAKKLKTEKKLDEWITRITNAEKSLKELMELKAKARELCEECRSLRSCCNQLEERLSVTEDEMNEMKQEGKISYPAKLNFIREGEIKYFTDKQMMRDFVTTRPTLKELLKEALNMERNNQYQPLQRHAKLYRPSRLGRNSIN

SEQ ID NO: 934575 - protein, 142 aa, Homo sapiens
MLNIGPHSLLACRVSAERSALRLMGFPLWTGPSAAGLLEFARGPLQTLFAGVSAAVSAKQWFFVTRECCCLIIPLEVLSQRSTQPCHESSTLMIVIGALIKEAYRSPFAFLPCEDTVKGHSEKVPFLKQRVTPHQSSNPLVT

SEQ ID NO: 934576 - protein, 170 aa, Homo sapiens
MVCLETRKLSGPFPLLPLPSYFTWLSKLTQLQDVEHLELLHAASGNVNWYNHFGKQFGSFLERTKVRRDKLTKFRKQGPSAGGDWKYRNSHAGESVDLYYYSRELTESRQLNLSHAPCPSNFVPESVSQRNSPMNSGTESTECKDKPFTTALRAGGKKDMTVNLLRVPRY

SEQ ID NO: 934577 - protein, 158 aa, Homo sapiens
MLLISAEESHTLTTTTPGHEEYCQTIANVPLRPKVSYVSLSLAQGPRCTWLSLLVIQGPRALQLAGDECWQDWVLSFRAAGFLLAQGVSINVILELGPGMEARRKGSLLELQAELFPHCNQIHALRVNSTQLVETVPEAALSPRELSSPLHGLWIDCQ

SEQ ID NO: 934578 - protein, 133 aa, Homo sapiens
MNPGPWSSMHNQPTVPHQGIEASDSTLWAQVSGPPTYCPRCLASLPKDSDGNLAIGSKHSKFGERCEYPGTGKAKFFNPNKTTPRHLIIKLSIIKDKRRILKATREKKQIKYKGLSIKLVGDFLAETLQARRE

SEQ ID NO: 934579 - protein, 155 aa, Homo sapiens
MNLIIMCLGVALLEEYLCVFLLTVRTLSCRPVGVCWRSTPDPVCLGISSGGCRTADIGEPQMLLPDHSSGSFVSEEYPAVSQAACWENHYSLQSCQTGTFKSAEVTAAFCLSVPCPQRWSLQRQAGLLSCGDDSLCFGSRMLWPTVLHPLSGTPQ

SEQ ID NO: 934580 - protein, 142 aa, Homo sapiens
MTYRCGFGPSAAGLLEFAGVPLQTLFAWVSPVEAAEQQILQNSKYCCLILPLKASSQRGTHLYEVSVGPYWEVTPSFWSKPFNKSLGSSTFHIFLSSSEPSKLFQPLPVTQFQSCFHIFGYLYSSTPLFQYQVTVISLFSCC

SEQ ID NO: 934581 - protein, 212 aa, Homo sapiens
MPQNNREDRKMWESLELPKDLLNGFDKNADSDMNNKVQAEVVSGGDEELVWNWSKGMEVWEPVPRFQKMYVYGTTWMPMQKFAVGVRSSWRTSARAVQKGNVGWESPHRVPTGAPPSGAVRTGPPSSRPQNGTSTDSLHCVPGKATDTQCQPVKVAGREAVPCKTTGAKLLKTMGTHLLNQCDLDVQHGVKGEHLGALRLDRPAGFQTCIGP

SEQ ID NO: 934582 - protein, 188 aa, Homo sapiens
MSYPSARIPEAFGERVFMQSQFTGFDLTKGFPGVVLDPGFSGTGLDLGPLEPRFDLMLTLAWSRFLWGLLWRAGLWVLAWILCPLMLAWGLVVQNWNGSFQELLLANEVSKDEFITGYIHRVTNAFYKNESKAFVFCRRKQNSVFTQEEEIHSLGEEGTWMKLEIIILSKLSQEQKTKHCMFSLIGGN

SEQ ID NO: 934583 - protein, 167 aa, Homo sapiens
MHTLWLFWASLPACSRMLAVRLTGAATVFVSSHDVCWVLPRLSQLDFSAGLSLSRCQCLLQPTIPLCSSPSLVISCLSDNLHFVMSLVSTGPSFSRIDSPFYYALTEGLTPRLGPPYIMQHQPCIPNHAYPPMLPPTIHLPPDFTLRWMHPHLLIYLTYFFPRRESL

SEQ ID NO: 934584 - protein, 164 aa, Homo sapiens
MGLVPTPQGLRYSHPWLSGVTVATNTHLSPFSKISFSHRKTSHPMATHIPSFPLPSGNPHPVDGQCRDMKVDQCPVHSLIGRLVTKTGQETCGWSYGSEHKREHSKKSSIKLQSCGCFPGVSGLLYQERSRKGTGSILAGEMDPDHHEQVRLRLYKGRIHLVPR

SEQ ID NO: 934585 - protein, 159 aa, Homo sapiens
MEKTALFSPGLAAYICTITFSTTRRCTTRRKHDDYEEDTDQDQALSCLDSITEQSSILDDADTYGNFNNLRFWYNLEIHSTPGPPIEIMEMTCIALPEMAEEFWYLLKLTIELPKPTTMPEIQCDLGKLRDKQSSGAGGKERNLANFPQGEAEVSNEQL

SEQ ID NO: 934586 - protein, 230 aa, Homo sapiens
MTVGIDYKGAARWNFGGDHTFLYGNVMADVIPSERWIVNFDKDLSDGLVFATQLGAYCPFLDSAQITPKFLQKSHITPSYSSVWGWLSGVFSCASLFPEGVNLTGLKDAKMTGNVLFLGVSEGVSKGDGCRSQWPEKGRYALSVGCYHPIGCGSGQNKETEEGGYSATDICDPNPILMLMLCVYMYERLPTYLPKKVVSFECTLHDTVLNKEKQEFTAKEQDGDQWVGND

SEQ ID NO: 934587 - protein, 129 aa, Homo sapiens
MLSCMGLISLKKEEQVLVLSRVVPYCSNNMPPICVQNTPKVNPCFASSNIYSDSERILLSWMNINYENTRHVIWKNCHKDLKAEKSKIKVLAGSMSDKGCCLFPRWCLDDAHSKQEEHCVLTWQKAQKR

SEQ ID NO: 934588 - protein, 312 aa, Homo sapiens
MLAVLWLDAPEIQASACYAQLFFIHTFTFLESSVLLAMAFDRFVAICHPLHYPTILTNSVIGKIGLACLLRSLGVVLPTPLLLRHYHYCHGNALSHAFCLHQDVLRLSCTDARTNSIYGLCVVIATLEPLRYAAILTNDVIIGIGLAIAGRALALVFPASFLLKRLQYHDVNILSYPFCLHQDLIKTTVSNCRVSSIYGLMVVICSMGLDSVLLLLSYVLILGTVLSIASKAERVRALNTCISHICAVLTFYTPMIGLSMIHRYGQNASSIVHVLMANVYLLVPPLMNPVVYSVKTKQIRDRIFNKFKKHEV

SEQ ID NO: 934589 - protein, 453 aa, Homo sapiens
MLQMKTLHKASTLWKHRENNYTDCTQPILQLKGHLHTEMGKNQFIKAEQTLREPMFYFLAILSTIDLALSTTSVPRTLGIFWFDVHEINFGACVAQMFLIHAFTGMEAEVLVAMAFDHYVAICNPLHYTNILTCRVLNERSEEDAEEKFEVSKVTFFLIGIPGLEDFHMWISGPFCSVYLVALLGNATILLVIKVEQTLREPMFYFLAILSTIDLALSTTSVPRMLGIFWFDAHEINYGACVAQMFLIHAFTGMEAEVLLAMAFDRYVAVCAPLHYATILTSQVLVGISMCIVIRPVLLTLPMVYLIYRLPFCQAHIIAHSYCEHMGIAKLSCGNIRINGIYGLFVVSFFVLNLVLIGISYVYILRAVFRLPSHDAQLKALSTCGAHVGVICVFYIPSVFSFLTHRFGHQIPGYIHILVANLYLIIPPSLNPIIYGVRTKQIRERVLYVFTKK

SEQ ID NO: 934590 - protein, 323 aa, Homo sapiens
MHGTASEFHPSSFLLLGIPGLETLHIWIGFPFCAVYMIALIGNFTILLVIKTDSSLHQPMFYFLAMLATTDVGLSTATIPKMLGIFWINLRGIIFEACLTQMFFIHNFTLMESAVLVAMAYDSYVAICNPLQYSAILTNKVVSVIGLGVFVRALIFVIPSILLILRLPFCGNHVIPHTYCEHMGLAHLSCASIKINIIYGLCAICNLVFDITVIALSYVHILCAVFRLPTHEARLKSLSTCGSHVCVILAFYTPALFSFMTHRFGRNVPRYIHILLANLYVVVPPMLNPVIYGVRTKQIYKCVKKILLQEQGMEKEEMLEIKF

SEQ ID NO: 934591 - protein, 148 aa, Homo sapiens
MFYFLAMLATIDLGLSTATIPKMLGIFWFSLREIICDACLIQMFFIHNFTGMESAALVGMAYDHFVAICNPLRYSIILTKKAVSVIGLGVLVRSFMSVIPFVFLILRLPFCGDHVIPHTNCEHMGLAHLSCSSIKINIIYGLGAISIL

SEQ ID NO: 934592 - protein, 157 aa, Homo sapiens
MWLIHTFQGIESGVLLAMALDRCVAICYPLRRAIVFTRQLVTYIVVGVTLRPAILVIPCLLLIKCHLKLYRTKLIYHTYCERVALVKLATEDVYINKVYGILGAFIVGGLDFIFITLSYIQIFITVFHLPLKEARLKIIIFKLFTEVYHTIRKVHQS

SEQ ID NO: 934593 - protein, 250 aa, Homo sapiens
MIELIYSPTNHVKTFLFLHNFTGMPCQRGVIWLSGHSSLAELQWAPPSSDFLTAAVLAANFKIVACLAPWVWDQPSQTTWLPGFSTPFQGSEEFCLTGAPGTTGKINPVLPEATVMVSSEAVERQDNVDSPQEPPTTSLFASRPITRLKFWLAPRGEVQSVIHKGVCDTRKKLLKFFNLYKQKSREQAWEKILRVWDKGGRNIELDQAEFIDLGPLHKHSAFNIAALEVKKCSKTVCAWLAKIWIKRWAT

SEQ ID NO: 934594 - protein, 150 aa, Homo sapiens
MSFLFVSFPSNSQDPQLQVCWSLLEVHSRPCFCVSAVEAAEQQILVNSKCCCLIVPLEVLSQRSTRSYSIWHKNLVRICWNLKEVLSYELVPLGCAPNHQPVYSAFGNRKKHNITTAQRACWAKAKILELDELNQKTEHWGRSSMKVARE

SEQ ID NO: 934595 - protein, 149 aa, Homo sapiens
MKLKKDYGYCAFPMVFAICRSKDSLVCLHHQGSGFQTQNWVAVWTDTELAEGVFIIHQWCLEIQQFSTDSAKEDGRFGLGGIQHSVAKQLWPDCFSRFLLTGQGVSEGKAAVRFRGLQIKLSSPWDKAPNGRGSCAYSFSILNLSCLSE

SEQ ID NO: 934596 - protein, 157 aa, Homo sapiens
MMKVSFFSRGWWRNTEGKRGIPSISSRGRVSEWCGQGDQLELCHNHWPRTQGPSVTMQPPSGNDLSTVVLIQKPGPRRLPIHRSNSAIPLNTPTLQGLSPGPVHVKASLLAQSSDSLDCKPAPAWLTRQLLYQTSGLNYNLCHERSFQLFPSLRTFP

SEQ ID NO: 934597 - protein, 134 aa, Homo sapiens [sequence omitted]

SEQ ID NO: 934598 - protein, 177 aa, Homo sapiens
MKLPEEQSGSNICCSAIFTVLQPPLLTPRQTGSGVDLQQTPADLQLRVLTVRKKTNKQKGHPHQNPICMSPSSKTKAMEQSWTENDFDELRQEGFRRSNLSELKEEVRTHCKEAKNLEKRLVEWLTRITSVEKSLNDLMELKTMTRELCDKCTSFSGLFDQLEERVSVIEDQMNDMK

SEQ ID NO: 934599 - protein, 152 aa, Homo sapiens
MASAWHLCLISSCTWHSGPQHIDLPSDDPTDQFPDHCQKPILITPCSKFEDFRADPRKDMIMTSGDLLRQWHGATAQKGKRAMELLVEKGIGEGVMCQGDVAQQQDGESVSESSEGQQQLGVFYSPRICFIYGRQRLGAVLQGMQSREVLNG

SEQ ID NO: 934600 - protein, 225 aa, Homo sapiens
MAQEPQGLHGLSQWRSALSFRASSLQPASDAFLNAIWTNTGILKQEKWAIYKLRRDTWKRSFPLSTQKEPTQLTLSFGLPSSITVNNKFLLFKPPANLQTVWHREQGHQSQSALLEPAVKGMQETGKLAKERVTGRKFTLILICVLESLICEQEETLSLALHHAGEVIFESQQASGVGNLFAGKWRDFVLFRVCQALSRVCHKKSRPEGALSSLTLLPRAGITNP

SEQ ID NO: 934601 - protein, 193 aa, Homo sapiens
MLGGPAGLGCCHGNPSYTAPLTHQFCQKVQATGLGHHLDINPPGAEEVAEAKKGAARTGKTQAVSLAGQSAPGAMNGDDAFAKRPRDDAKASEKRSKAFDDIAKYFSKEEWEKMKFSEKISCVHMKRKYEAMTKLGFNVTLSLFMRNKRATDSQRNDSDNDRNRGNEDRPDSTISHNHYKRSENPVLEYLPSF

SEQ ID NO: 934602 - protein, 164 aa, Homo sapiens
MEPWWPQSQQVLPHQRTVNRGSAHTVSDHSCLWGTEKAPRSEPASTLPQANITSEVTAYTVSSSGPLLPAPHSCFASAAVLLHLDPPSTVDSKHQGAREQSWGPIQVPQRYSMQSRGWELNIGPLVSSRNEARWMNPPYTTIKPPRSSNRIKEKKHPKVSNLKS

SEQ ID NO: 934603 - protein, 146 aa, Homo sapiens
MVTVIIRIIPLEVCSPFITHERNLITPHCPLGHCSAPSRSPHLLHVLWYLRTNPGSPCKGVVSIRGTGSNLTCKRNSLSLSSCRTFGPVEGEISEVRPHSVTWNQVLHFSIQGLSVQSLDEGQSPRLGPSQKQDSEEPDSSLVKGQ

SEQ ID NO: 934604 - protein, 133 aa, Homo sapiens
MKLSIFSYNQTLCFFPRGLGNLNPKSGQFLTLFHMEVSFLFPESKKTAVSILGDYGLNNLALHVWESRAQQGFSGSPVLTYHDNPCGRGSCDGGSDGIHDGNSGDDIDCSDGVDGRDGGDGCEGNNGGGVRVS

SEQ ID NO: 934605 - protein, 145 aa, Homo sapiens
MTIYLKAEAQLLVLRSTGIRGKKLFHPWELRGWCPVCGGSSGGGGFTVLDSGGVRKNKIADMIDTFSALLTFGQYEFCRQKREVCELGEASGEVNRIPLSLQRQTRWSHISEDMWDVNPAAWPQSPWSSWQQHVCRLSCVQVNEE

SEQ ID NO: 934606 - protein, 182 aa, Homo sapiens
MGLRKQDWESSTYAAPVCCHFNESCCLTPLAYQELSLAKPQFWGSTALHHLATNEGIKAVKMAAMDGETAPSEDPLLAGSPRRPMPFPESPQSPNSEGGPASALTKDSSSRSSDTPPPHPTSPSLYPHFPQNKPNQYYQEWSLILAPKVKSVSIAGAKGPSPSGHQHHQPLGNSARPPPMFT

SEQ ID NO: 934607 - protein, 200 aa, Homo sapiens [sequence omitted]

SEQ ID NO: 934608 - protein, 152 aa, Homo sapiens
MLAGGAEGTQGFLKDISSKCRSVREHILPHISAHLCQVVKQFLSNGAEAVARLACHVSTDSAAKEMASCLAHFLEKNHRTFCQDSSQTSVNTERLTPVSKRKEIILPDTIPITLGSVDSLGMGVKDPGHPQSSVVSASSEEISSCDGQGALL

SEQ ID NO: 934609 - protein, 172 aa, Homo sapiens
MPFFLLICKVFNTRILQPFYNSESNHLHEKLFTEDSGIFLPTNEFFASITTSHSLITVTMMLYFLIFPGFFLLWVPAPYCPADKRAVRACGQGKEELVDPQIAPSSPPLPFCLEVPGSVFTDIWGKKRSRKLPRTELSRKQQQHHAKTLQRKRRKAKVQRAKEGGKTPVWRI

SEQ ID NO: 934610 - protein, 300 aa, Homo sapiens
MVLFCLQFYKSYNCMQGEKEENCPGFLQERQRREHLNMEKLYKENEGKPENERNLESEGKPEDEGSTEDEGKSDEEEKPDMEGKTECEGKREDEGEPGDEGQLEDEGNQEKQGKSEGEDKPQSEGKPASQAKPESQPRAAEKRPAEDYVPRKAKRKTDRGTDDSPKDSQEDLQERHLSSEEMMRECGDVSRAQEELRKKQKMGGFHWMQRDVQDPFAPRGQRGVRGVRGGGRGQKDLEDDVKKVIMFPWMTNLKNKAHNGIAASIINALERHFHTNSQLDYTGPEIVNCFCSECGYSDKW

SEQ ID NO: 934611 - protein, 246 aa, Homo sapiens
MLKEGPRCALACLVGSARTLALCLPGAEHLMPEPAQALKHRRPQPPDIRLLGQTENVLSTTIIAVNSIIIIIIIIIIIIKGWCSVNIQWILVTFTLKWLHGYINDKLPLPKSINLNCFSKLLLLTKVSKVKYRTMTKKCERRVIAVKEEKGKTTFDMENSHQENEESVHNVEEELHLEEMEGQEARGNNLQEQAPPTQEDGDGLPHRHVNNNEGRGRKRMRRRKEMGRRRKRRRKRRRRKVSRRDF

SEQ ID NO: 934612 - protein, 167 aa, Homo sapiens
MASRCETKHREKWTRPCPKRPLLPAGPLTKGANTTTSVNRHTVAVWALSPPGPHSRAVNASRCCEGPHRGQQHNTHQYPVAADENETSQLNYTTMKPARSSNRIKEKKNIQRTATSKIEETSTHKDEKEPNVMAEMTEIELRIWIGAKMIEIQENVETQSKEAKSHN

SEQ ID NO: 934613 - protein, 140 aa, Homo sapiens
MASGSRRQQRKKAVSKCLLLLCSSNAAPRCQEEEAPVQMSPGGFCLCSPSDTCMVVICQLCPGPMPFQSKLTLVELLEVIKHNCLHVKAREVEAQSGVASRGEDDDKPKVTWQVRQAPRSRTVWKETLGPTRWTPFPSPE

SEQ ID NO: 934614 - protein, 144 aa, Homo sapiens
MISFDSKSYIQVMLMQEVGSHGLGQLCPCGFAGYSPPSWLLSQAGIEYLQLFQVHNASCQWIYHSGSPQALPAEPLGQGLMVPGPSSGHLTDLPPQSALTSNSKGAIDRSGQLCPQCPGACEGVGGDLGSQYRGWVMKCDHSVV

SEQ ID NO: 934615 - protein, 237 aa, Homo sapiens
MNGIPSLWIIVLLRPNNLITNPSYNLKSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEKLKVRDLGSIPYTTLSHKCS

SEQ ID NO: 934616 - protein, 124 aa, Homo sapiens
MSLKCPGDIFLIVLVINIWLLITYANFCSQLEFLPRKWSFLFLLGCKFYKFLCCASPSMLCRLEISSTRYSKSHLSSSKDGRVEENSCISGHMQFRPVVQGSTVICNDEKMISSCQKVRDWEMG

SEQ ID NO: 934617 - protein, 185 aa, Homo sapiens
MSQGLFDTSLLGLDESCHYWTQLCILNRVAVKSMKYKNKLIQKIGIKEWDIAIKIPENVEAALELGNGQRLEQFGGLRKRHEDPRMVDLLTTCTVHLEKLPMKAATGAVSYNAREAELFKALGAHPLHQYALDESQEDPQTIRRKWTVPAGPGRHPKYFEYPSWGSGKGRSSTPEHTPPLGKLKV

SEQ ID NO: 934618 - protein, 146 aa, Homo sapiens
MQPDCFLMQVPGPVPPHGVGSPDRGPQPLPSVCLDWQQELEQILSILQQPYKKPGQTVCYEGPESHIFSLEDLCGLGLHPPPGTIKPVAFLLWRVCRPKGFSGHPEEHPPHGKVVRLFSTQFPVLNSPHWAGLPDLGRQENHSAPT

SEQ ID NO: 934619 - protein, 144 aa, Homo sapiens
MRKNQRKKSENSKNQNSSSLQRITIPCQQGKKNCTENEFDELTEVGFRTWVITNSAELKVHVLTQCKQAKNFEKWLEELLPRITSLEKNINDLMELKNTTRELHEAHRSINSPIDQAEERISEIEDQINEIKQIWDYVKDETYV

SEQ ID NO: 934620 - protein, 164 aa, Homo sapiens
MLLAQSEELITDVQANHIQSMVKSHQKTEEPHPMAITTTVPGVELPDYLFCSLKAQKLFSQLAVNAAWPWTHLSWQWALLWPRPSPGMLSKSQALELGTPKTGLVLYPSVAELVPKGPRALQLAGNESHQDWVFPFKAVASLLAQSVSRNVIQELVPEKVASGL

SEQ ID NO: 934621 - protein, 179 aa, Homo sapiens
MSEMTEVDLRMQIKANLAELEEHIATQCKEAKDHDKTMQEQKPEYKILQEEIITETHNCQILQGPNERKNVKDSQRESPEKFNHLKPSSLNLSESFSIQFCSIAGPSAAGLLEFAGGAIQTLFAWVSAAEAAEQRILLNSKCCCLIVPLEASSRRGTQPSHAATLWLLMEIFIYIQCHY

SEQ ID NO: 934622 - protein, 206 aa, Homo sapiens
MPYFGTWRTVGIRCPRRKPRSADSSAPKDKTCNYKFPLLPNLLPGASGPNGQTDTHWQHMGHLSKLKPWWGRENYPMDRDSCYALEDNQIPYCWLQMTSNIYAYAVVLPFPYLRKFLPSPMSIIPRLVDHPIPGNPHPTAGRTNNVLLGLPITPAKPIPHSWEHINAIYYWQSTGNSSTMHNSHSKEEHAIANYTKRAYSLSHSNI

SEQ ID NO: 934623 - protein, 195 aa, Homo sapiens
MFNIGPQSPMACNVFAQWSTVILMCFVGNCTLLLNSHRNREAGPETLAGPPAWLQVADTDEVMCSDLQVFPMTTGSCSLQLSSHRSKASGPEGLAGIAPAGYQGQGQVVLCFAVQVLPVTTGSYDLQLSSHSSQSTGPEGLVGFAHLATSGSDVQGVFPMATGSCALQLSSHKCGTAGWLATSARGGRRGWLSSC

SEQ ID NO: 934624 - protein, 193 aa, Homo sapiens
MVPYPPVAKLGPGPRRMLSMVVAAIAEAAALVAAGAVATGTRIPCGGSTGTGDRRWTCLSLKPDPMESTQILTLHSEYKDKNNLHSGIKLSQALPRALPCPLCLVTTTVFCLGQQMICVSGRGPSSSIALHSQGTKALQLAGNECCQDWALSFKGVGSLLAQGVSRNVVWELEPRRALTTATGALSAVAELVF

SEQ ID NO: 934625 - protein, 163 aa, Homo sapiens
MPCHPHRVTSEGCFLYCGAESMTECYPRKYPIGLDLALSSGAVRGGQERGRLFRQHAETDTAAASCASCLGRGAQGILTFDHPLTENFNFHVLSFIESAWQNSLPSSTIFLQKTIQPLAGWNCCKFTFFNFKHVLNSVKQSFYASLRSFPVHTKDNSTCHHFL

SEQ ID NO: 934626 - protein, 138 aa, Homo sapiens
MAFAAPWMESETIILSAVIQEWKTKRRKFSSVSRTGWHMKCGAKSIPDRGNSVCKGLEAEKSLDVERQNSWRNASGLKFSDPFYKKTHEEYLSREDHQKRARQGKPYLYKLKHVFIQMTPEGSDSNAYSEMLIYQWSS

SEQ ID NO: 934627 - protein, 160 aa, Homo sapiens
MVDAPTPTKLDDPKSTSDCCAGSENFKPVVLSLLGSVGVGPTELDHLAPWLQPPFQGSERFCLTGVPGATGHSTRSYSRPAVTTLRLWPMFVQGPGTLQSANCKAIQALFLPFMMGPRALQLAGCESCQDWFLPFKAAGPLLSQEPRNAFCTMLPLLEDE

SEQ ID NO: 934628 - protein, 153 aa, Homo sapiens
MFVSTEPNSGLAQISVLHIVSIHSDPRGACAGRSNAVTNMFDNCYSSPVVLKEWPQTTTTTAIAIIIIMPGNLLETSVLRPHSKSTELETLGMRPSRFCFNKLSSLNGNLIQNGSLQNGTNRPNRPLSSNIRKEKLTLTSHVYKMSKEPDLLF

SEQ ID NO: 934629 - protein, 2974 aa, Homo sapiens
MESKLMDWNRMDSTGTDSNGMESNGRESNGMDSKGKDCNGKVSNGMEINGMEWNRMKWSQKEWNRMARNRIEMESNHKEWTGIEWSRIEWNRMEWHQTEWNGQPRNGMHSNAMESKLMDWNRMDSTDGIGWDWNEMYWKGLEFHETEWNELERNGLEWNGMSWDGIKWNGIKWNGIECNGMLWNGMECIGMECPLMEWIRGSKGMESNGMVWNGMNTNVMQPNRMESNGMEYKEMESKRMETNGMELNGMELNGMGTNGVKLYAVEENRMECKRKERNGLEWNGIHWNGRECSSEMESNHKEWTGIEWSRIEWNRMEWHQTEWNGQPRNGMHSNAMESKQMDWNRMDSTGTDSNGMESNGRESNGRESNGMDSKGKDCNGKKGFEWNEKELNGIEQNGIKSNEMEWNRKEWNEMEWKGFEWNAIEWNGIERNGIKWKKTGKKWNRNEWSVMERTQKELNMGLDGIGMKCTGKDSNFMKRNGMNWNGMDSNGMECHGMASNGMTSNGMESNAMECYGMEWNALEWNRSKGMESNGMVWNGMNTNVMQPNRMESNGMEYKEMESKRMETNGMELNGMELNGMGTNGVKLYAVEENRMECKRKERNGLEWNGIHWNGRECSVMDRPGIKWNATVSNGIKMYGMECNETESNVIECNGCKKMNPKSLTGKAGCRKELTPMEWNRMEWNEMESNHKEWTGIEWSRIEWNRMEWHQTEWNGQPRNGMHSNAMESKLMDWNRMDSTGTDSNGMESNGRESNGMESNGMDSKGKDCNGKKGFEWNEKELNGIEQNGIKSNEMEWNRKEWNEMEWKGFEWNAIEWNGIERNGIKWKKTGKKWNRNEWSVMERTQKELNMGLDGIGMKCTGKDSNFMKRNGMNWNGMDSNGMECHGMASNGMTSNGMESNAMECYGMEWNALEWNGSKGMESNGMVWNGMNTNVMQPNRMESNGMEYKEMESKRMETNGMELNGMELNGMGTNGVKLYAVEENRMECKRKERNGLEWNGIHWNGRECSSEMESNHKEWTGIEWSRIEWNRMEWHQTEWNGQPRNGMHSNAMESKLMDWNRMDSTGTDSNGMESNGRESNGRESNGMDSKGKDCNGKKGFEWNEKELNGIEQNGIKSNEMEWNRKEWNEMEWKGFEWNAIKWNGIERNGIKWKKTGKKWNRNEWSVMERTQKELNMGLDGIGMKCTGKDSNFMKRNGMNWNGMDSNGMECHGMASNGMTSNGMESNAMECYGMEWNALEWNGSKGMESNGMVWNGMNTNVMQPNRMESNGMEYKEMESKRMETNGMELNGMELNGMGTNGVKLYAVEENRMECKRKERNGLEWNGIHWNGRECSSEMESNHKEWTGIEWSRIEWNRMEWHQTEWNGQPRNGMHSNAMESKLMDWNRMDSTGTDSNGMESNGRESNGMDSKGKDCNGKVSNGMEINGMEWNRMKWNGIGWDWNEMYWKGLEFDETEWNELERNGLEWNGMSWDGIKWNGIKWNGIECNGMLWNGMECIGMECPLMEWIRGSKGMESNGMVWNGMNTNVMQPNRMESNGMEYKEMESKRMETNGMELNGMELNGMGTNGVKLYAVEENRMECKRKERNGLEWNGIHWNGRECSSEMESNHKEWTGIEWSRIEWNRMEWHQTEWNGQPRNGMHSNAMESKLMDWNRMDSTGTDSNGMESNGRESNGRESNGMDSKGKDCNGKVSNGMEINGMEWNRMKWSQKEWNRMARNRIMESNRMKWNGIERNGMKWNGKDSNGMQSNGMESNGMEENGRKLARNGIEMNGMGLDGIGMKCTGKDSNFMKRNGMNWNGMDSNGMECHGMASNGMTSNGMESNAMECYGMEWNALEWNEWTGIEWSRIEWNRMEWHQTEWNGQPRNGMHSNAMESKLMDWNRMDSTGTDSNGMESNGRESNGMDSKGKDCNGKKGFEWNEKELNGIEQNGIKSNEMEWNRKEWNEMEWKGFEWNAIEWNGIERNGIKWKKTGKKWNRNEWSVMERTQKELNSNQWNQIKWNGKELNGVDGIGWDWNEMYWKGLEFHETEWNELERNGLEWNGMSWDGIKWNGIKWNGIECNGMLWNGMECIGMECPLMEWIRGSKGMESNGMVWNGMNTNVMQPNRMESNGMEYKEMESKRMETNGMELNGMELNGMGTNGVKLYAVEENRMECKRKERNGLEWNGIHWNGRECSSEMESNHKEWTGIEWSRIEWNRMEWHQTEWNGQPRNGMHSKAMESKLMDWNRMDSTGTDSNGMESNGRESNGRESNGMDSKGKDCNGKKGFEWNEKELNGIEQNGMKSNEMEWNRKEWNEMEWKGFEWNAIEWNGIERNGIKWKKTGKKWNRNEWSVMERTQKELNMGLDGIGMKCTGKDSNFMKRNGMNWNGIDSNGMECHGMASNGMTSNGMESNAMECYGMEWNALEWNGSKGMESNGMVWNGMNSNVMQPNRMESNGMEYKEMESKRMETKGMELNGMELNGMGTNGVKLYAVEENRMECKRKERNGLEWNGIHWNGRECSSEMESNHKEWTGIEWSRIEWNRMEWHQTEWNGQPRNGMHSNAMESKLMDWNRMDSTGTDSNGMESNGRESNGRESNGMDSKGKDCNGKVSNGMEINGMEWNRMKWNGIGWDWNEMYWKGLEFHETEWNELERNGLEWNGMSWDGIKWNGIKWNGIECNGMLWNGMECIGMECPLMEWIRGSKGMESNGMVWNGMNTNVMQPNRMESNGMEYKEMESKRMETNGMELNGMELNGMGTNGVKLYAVEENRMECKRKERNGLEWNGIHWNGRECSSEMESNHKEWTGIEWSRIEWNRMEWHQTEWNGQPRNGMHSNAMESKLMDWNRMDSTGTDPNGMESNGRESNGMDSKGKDCNGKKGFEWNEKELNGIEQNGIKSNEMEWNRKEWNEMEWKGFEWNAIEWNGIERNGIKWKKTGKKWNRNEWSVMERTQKELNVIEWSGVDSNIMDWNGMKSHGMGTNGMEWKGMESNGKESNGRE

SEQ ID NO: 934630 - protein, 3022 aa, Homo sapiens
MECTRMQWSRNKWTGIEWTRLSEMESNHKEWTGIEWSRIEWNRMEWHQTEWNGQPRNGMHSNAMESKLMDWNRMDSTGTDSNGMESNGRESNGRESNRMDSKGKDCNGKNGMESSGMELNGMEQYEMEWNGMEWNALELNGLEWNGLKQSGMESVEIEWNELLWNGVVCNAIDWQGIKRNKGFEWNEKELNGIEQNGIKSNEMEWNRKEWNEMEWKGFEWNAIEWNGIERNGIKWKKTGKKWNRNEWSVMERTQKELNMGLDGIGMKCTGKDSNFMKRNGMNWNGMDSNGMECHGMASNGMTSNGMESNAMECYGMEWNALEWNGSKGMESNGMVWNGMNTNVMQPNRMESNGMEYKEMESKRMETNGMELNGMELNGMGTNGVKLYAVEENRMECKRKERNGLEWNGIHWNGRECSSEMESNHKEWTGIEWSRIEWNRMEWHQTEWNGQPRNGMHSNAMESKQMDWNRMDSTGTDSNGMESNGRESNGRESNGMDSKGKDCNGKKGFEWNEKELNGIEQNGIKSNEMEWNRKEWNEMEWKGFEWNAIEWNGIERNGIKWKKTGKKWNRNEWSVMERTQKELNMGLDGIGMKCTGKDSNFMKRNGMNWNGIDSNGMECHGMASNGMTSNGMESNAMECYGMEWNALEWNGSKGMESNGMVWNGMNTNVMQPNRMESNGMEYKEMESKRMETNGMELNGMELNGMGTNGVKLYAVEENRMECKRKERNGLEWNGIHWNGRECSSEMESNHKEWTGIEWSRIEWNRMEWHQTEWNGQPRNGMHSNAMESKLMDWNRMDSTGTDSNGMESNGRESNGMDSKGKDCNGKKGFEWNEKELNGIEQNGIKSNEMEWNRKEWNEMEWKGFEWNAIEWNGIERNGIKWKKTGKKWNRNEWSVMERTQKELNVIEWSGVDSNIMDWNGMKSHGMGTNGMEWKGMESNGKESNGNGIGWDWNEMYWKGLEFHETEWNELERNGLEWNGMSWDGIKWNGIKWNGIECNGMLWNGMECIGMECPLMEWIRGSKGMESNGMVWNGMNTNVMQPNRMESNGMEYKEMESKRMETKGMELNGMELNGMGTNGVKLYAVEENRMECKRKERNGLEWNGIHWNGRECSSEMESNHKEWTGIEWSRIEWNRMEWHQTEWNGQPRNGMHSNAMESKQMDWNRMDSTGTDSNGMESNGRESNGRESNGMDSKGKDCNGKVSNGMEINGMEWNRMKWNGIGWDWNEMYWKGLEFHETEWNELERNGLEWNGMSWDGIKWNGIKWNGIECNGMLWNGMECIGMECPLMEWIRGSKGMESNGMVWNGMNTNVMQPNRMESNGMEYKEMESKRMETKGMELNGMELNGMGTNGVKLYAVEENRMECKRKERNGLEWNGIHWNGRECSSEMESNHKEWTGIEWSRIEWNRMEWHQTEWNGQPRNGMHSNAMESKQMDWNRMDSTGTDSNGMESNGRESNGRESNGMDSKGKDCNGKVSNGMEINGMEWNRMKWSQKEWNRMARNRIMESNRMKWNGIERNGMKWNGKDSNGMQSNGMESNGMEENGRKLARNGIEMNGELNGVDGIGWDWNEMYWKGLEFHETEWNELERNGLEWNGMSWDGIKCNGIKWNGIECSGMLWNGMECIGMECPLMERIRGSKGMESNGMVWNGMNTNVMQPNRMESNGMEYKEMESKRMETNGMELNGMELNGMGTNGVKLYAVEENRMECKRKERNGLEWNGIHWNGRECSSEMESNHKEWTGIEWSRIEWNRMEWHQTEWNGQPRNGMHSNAMESKLMDWNRMDSTGTDSNGMESNGRESNGMESNGMDSKGKDCNGKKGFEWNEKELNGIEQNGIKSNEMEWNRKEWNEMEWKGFEWNAIEWNGIERNGIKWKKTGKKWNRNEWSVMERTQKELNVIEWSGVDSNIMDWNGMKSHGMGTNGMEWKGMESNGKESNGNGIGWDWNEMYWKGLEFHETEWNELERNGLEWNGMSWDGIKWNGIKWNGIECNGMLWNGMECIGMESPLMEWIRGSKGMESNGMVWNGMNTNVMQPNRMESNGMEYKEMESKRMETNGMELNGMELNGMGTNGVKLYAVEENRMECKRKERNGLEWNGIHWNGRECSSEMESNHKEWTGIEWSRIEWNRMEWHQTEWNGQPRNGMHSNAMESKLMDWNRMDSTGTDSNGMESNGRESNGMESNGMDSKGKDCNGKKGFEWNEKELNGIEQNGIKSNEMEWNRKEWNEMEWKGFEWNAIEWNGIERNGIKWKKTGKKWNRNEWSVMERTQKELNMGLDGIGMKCTGKDSNFMKRNGMNWNGIDSNGMECHGMASNGMTSNGMESNAMECYGMEWNALEWNGSKGMESNGMVWNGMNTNVMQPNRMESNGMEYKEMESKRMETNGMELNGMELNGMGTNGVKLYAVEENRMECKRKERNGLEWNGIHWNGRECSSEMESNHKEWTGIEWSRIEWNRMEWHQTEWNGQPRNGMHSNAMESKLMDWNRMDSTGTDSNGMESNGRESNGMESNGMDSKGKDCNGKKGFEWNEKELNGIEQNGIKSNEMEWNRKEWNEMEWKGFEWNAIEWNGIKWKKTGKKWNRNEWSVMERTQKELNELNGVDGIGWDWNEMYWKGLEFHETEWNELERNGLEWNGMSWDGIKRNGIKWNGIECNGMLWNGMECIGMECPLMEWIRSEMESNHKEWTGIEWSRIEWNRMEWHQTEWNGQPRNGMHSNAMESKLMDWNRMDSTGMESNGMVWNGMNTNVMQPNRMESNGMEYKEMESKRMETNGMELNGMELNGMGTNGVKLYAVEENRMECKRKERNGLEWNGIHWNGRECSVMDSEMESNHKEWTGIEWSRIEWNRMEWHQTEWNGQPRNGMHSNAMESKLMDWNRMDSTGTDSNGMESNGRESNGMESNGMDSKGKDCNGKKGFEWNEKELNGIEQNGMKSNEMEWNRKEWNEMEWKGFEWNAIEWNGIERNGIKWKKTGKKWNRNEWSVMERTQKELNVIEWSGVDSNIMDWNGMKSHGMGTNGMEWKGMESNGKESNGRE

SEQ ID NO: 934631 - protein, 172 aa, Homo sapiens
MQPEAVLRESKSLILCCLKPGPSEFILVVVQTGDKVHCAGLKPGAVGSGLALRQKAVQINASVRRQSLESAIVSVVGSFQWILGLADFKNEAADLCGHPNCCWELGDDHSSYFLLDRGEEGALQLARRRVIARWMSRDLERGEAMSPNSRGWYKSLKGLYGPVLMDLSSEGH

SEQ ID NO: 934632 - protein, 526 aa, Homo sapiens
MDSRHCAQAHSIQIMKVEEIAAGKCRRPSVKQFHDSKVKFPLPHQVLRRDVSTTWHSNNDDVYRVPPIDRSILPTAPRAAREPNIDRSRLPKSPPYTAFLGNLPYDVTEESIKEFFRGLNISAVRLPREPSNPERLKGFGYAEFEDLDSLLSALSLNEESLEIGILTKQIRTGGLVLLQTALMTRRGDDSFGDKYRDRYDSDRYRDGYRDGPRRDMDGYGGRDRYDDQGSRDYDRGYDSRIGSGRRAFGSGCDDRRPPQRPKLNLKPWSTLKQDDSSASTSQSTRAASIFGGAKPVDTAAREREVEERLQKEQEKLQRQLSEPKLERRPRERHPSWRSEETQERERSRTGSESSQTGTSTTSGRNARRRESKKSLENETLNKEEDCHSPTSKPPKPDQPLKVMPAPPPKENAWVKRSSNPPARSQSSDAEQQSPTSGGGKVAPAQPSEEGPARQDENKVDGMNVPKGQTGNSSRGPGDGGNKDHWKESDRKDGKKDQDSRSAPEPKKPEENPASKFSSASNYAALS

SEQ ID NO: 934633 - protein, 147 aa, Homo sapiens
MIGMDKENVIYIHNGILFRHKKNESMSFAETWMELEVIMLSEISQAQKDKYCMFSLIVTEAFEEPTEEPKTQRVGSHSTKEEMTNPLPLFPTPISTLVRIQIGTGKWREKEENLSLLLFQRHLATTTGLSMGLVGNKASPLSEDGES

SEQ ID NO: 934634 - protein, 135 aa, Homo sapiens
MESGEIKMYLAGGKKYRSQYSKKLSASYVQGRHSTVTRDPRRSESQAKPPTLCLLSPELHPDPAQIFKSCGMVSSCTNPLGSERIKRANYAEKKGSKRAKRKQGYVPSYGDGSLPCRIPQTMPGELQLPISLLEE

SEQ ID NO: 934635 - protein, 135 aa, Homo sapiens
MAPASASGEGLWLLPLMAEDEGSWHVQGSHGGREEARERSGMEVPASFKEPAHMGTNRRIPLPESHCNWQHSIVIKGMAFGARQQTLESQVSPLLGVIWCSGVYVQVCYIGKLHVTRVWCTDYYITHVISIVPDR

SEQ ID NO: 934636 - protein, 142 aa, Homo sapiens
MGSMKGRVQGAVTKSWGLVLIMERQGRPSRGNDTEVKFVITDLLKPTSVNLSNTFSSQLCSLGGEELQSFGGEESCQTGTFKSAEAVCCLLFYYALPPEVESIEPVGLAELWLREVKKLQKKSLKLAEVGSWGLRKEANSTT

SEQ ID NO: 934637 - protein, 195 aa, Homo sapiens
MLVTFRWGFGVDVLFVDVESIPFCLLLLLKQSGPSAAGLLKFAGGPLQTLFAWVSPVEAAEQQSLLPVPSSGSFIPEGHLPDACQTSPQAVCPLAELEHCAGRSTVLFRAGRQECLGLLKLHPQPPLPPGALSQGDGSFIYKPLTEAAAFFSEMPCSERRNLERQSGYSSFAKLPWAPPNSNFLVALCTLYYLQY

SEQ ID NO: 934638 - protein, 139 aa, Homo sapiens
MVVVFDGGSSLPVHVTYYCPLILLDLNPGVQFLSYDGLLLGQTDFMPWIQTNHSIDYFYDGAGAPGAASFLRVKACQCLIPLIWQQVWTLVEAAQIIYEVFYILHSHPRIESQLEHQGLPSVAPCYVSSTYELLWICIN

SEQ ID NO: 934639 - protein, 1026 aa, Homo sapiens
MASDQDKCRASSRKSSVALISGVDITPKAVCGVDIVPGPEALISGVDIPLESVAVICGMDIPMPHPEAVALGSGMGIDPETEALINDVDLAPEAEALIGAVAILPDTVYVVCDKDIDLEFATLVCNVDVAPEAMVSISGIDISPEAMADIKGMGIVPEAGALINGLDIPPETMAVVCAVDICPEAEALINSVDTVSQAEGLLSGVDIVPEAGALTSGEDTPPEAGARTGSVHMSPEAVGIICDVDVTLESGALISGMDIPPEAVDLVSGMDIAPEMGAFTCGMDDIIPEAVAVISGDLRGVAISPEAGALISGRDISPEDEALVSSEGLSPGSEVLISGVDIVSEVQALTVGVDITSEVGEFICIPPAVMDFMGDMDIPPGSWTVAVICDVDIAPEAVSLISDADNPPEAVSVICGMDRAPETVSLISSVGIASEAVVVIFSVNIVPEALGVISGLDNAPEARDLICGQDITPEAVSLINSVDVDPEVWAVISGVDIAPEVMAFICAADVNPEAMVLICGMDIASETGALICSMDIDPEAGTVNCGMDIVSEAVAVTGWVDIAPEVGALLSGVDIFPEAVALLYCFATAFIEPVGIAPEVLAIVNCADITLEAVADICSVDITPELGTVISEVVMAPEAGTVFCNVDIFPEAGAPISGVDIAPESKALTGGADITPEAVALTGGLDIISESTFCVDHGDIAPEPGAGIVWVGITPEGRAVISAGDIASASGAGFGNVDISPASGTDSSGVDITSEPGDDIKSDDIIPESRSDMSGVGIPPEFWVLVGWGDVPPEATADIISEDIASESVPDISSEDISPEARAVISTLDIASVSSSVICNGDIASELGAGTGCVDITPGFISCIRIGDNSPESGASINGVDIASEDEVLIIGVHTTPEDGAGIANGDISAESGATISVADIVPKSGIVIIPGDITPYSEVDSNGDNVPESKAGISNGDSAPESEAGISNGESAPESEAGIRGGDNAPEFGTPIRGADMVSKTGDVINCVDVPPGSEAEVETIGNCT

SEQ ID NO: 934640 - protein, 159 aa, Homo sapiens
MQRKTSFELASGVEEMEQPDKSRGESEPTEQLKEEQVHLASALDTRRGRPVPTMSPHLDPNQLGILLKVLRKEKEDGDYPDMMATHPSSRYEACSSGITLEKPEKLRSGKVKEEETLLERAYKFSQGFQMKVPTRDPTRLSFLREKYPGMVAAARKFEK

SEQ ID NO: 934641 - protein, 199 aa, Homo sapiens
MQLLYWPEINLGPTAQKADLPTWTGYGVGSSQLGVMKDVLLRAGRTTTLFKAVRQGHISLQRILLPFIWLCPAPRGGVYRGRQASLSCGGLHPVQASRLLCLPTQALAMAGTPPPALLPPCSLISDCCASNVRGSVGVVPSEPGMGYNLLVCHLLRPLEKCSIRVGVTQFSRCHLSPLSLTTKGNSLTPCPSQQVAETL

SEQ ID NO: 934642 - protein, 124 aa, Homo sapiens
MRCFYFFCGSSVTSGHLDVYVQVTGDAMAWPGLRGLTQSSQICQTNLKHTALSLHIYHSPYPDFPFISFIFVCFLQYPSQVTSSRKAFPKDVIFAHHKVCKFTLQGLIFQACNILNKPEWEIES

SEQ ID NO: 934643 - protein, 146 aa, Homo sapiens
MREPRRRRLLHGGLIGGQSPNVGGVEGMGPFWVKTTPGPAAAAAYEVQTPLAGSKQHTDNYAGKEGRDFQFLATKDSHFPARLNNHLGRLAKRKATSTAYKPITVHTAQTHWAYKDAGPAPECAFNPKLGKLPQNVQEISYKTFLV

SEQ ID NO: 934644 - protein, 156 aa, Homo sapiens
MAAAAHVQWLLRRCWLQQGRHGWGYLFCGAGEIQEQAGVLLPTKLSEWEPRIPRHICSLPAVALDPGIPVLSRVQEAPAPAGSEVPAPAMQMVTAEAACSTSGPSAASCGASTCAGTWSYPSRCSSQNAWLCTVARPSACWPTHPSLLRAWLALDS

SEQ ID NO: 934645 - protein, 145 aa, Homo sapiens
MRRLVTYVYMCHAGVLHPLTRHLALGFKSDELGYLAKEIFKQENVEAAAWLLVIVYSKKRVQRNNLKMKFLIKMEVEHKDLKSFQPDFVNNKKVCLEEKTKSVAKLLFDKVSMDRMNPDDIHQDNGRMTPKAFQRSWRMLCPLQA

SEQ ID NO: 934646 - protein, 130 aa, Homo sapiens
MFSGRLRARALIKVVNSGKSQRDRKGSSFPDILAPSSSRDHVGRHCYSPSRDLLTLMDCKPESYQSFSNRRNKVESRKTLEYGKQTALCTWMMFCPIYHCSFLRAGTMSYSLLHLTPWPSPLPNTVPDIL

SEQ ID NO: 934647 - protein, 156 aa, Homo sapiens
MSKSSLGLPEKQMMLCFLYNLQNMIQLNLFLQITWSQSGPSAAGLLEFAGVSLQTLFALVSPVEAAEQQILQNSKYCCPILLLEASSQRGSYLYEVSVSPYWEVTPKWNFQFPTKLPVILPWLKEASSDTTAAEKSRNTSLLLGASGSPRFPCSLH

SEQ ID NO: 934648 - protein, 162 aa, Homo sapiens
MTFKSDSICNSEMTHQYGVSEWTSFLLMLMHFFVFVSFPSNSQAPLLQSYGIFIYKPLTGAAAFPSEMPSPERRNLERQSGQSGLAELQWAPPSSNFLVAFLHCEAKIAYSSLSNCRRPTPTKLEHPRSISDCCAGSENLKPVDLSFLVSIGKLTPITRSLY

SEQ ID NO: 934649 - protein, 159 aa, Homo sapiens
MDKTTKNCRGYYEHLYANKPENLKEIDKFLEAYDLLRLKHEEVILELHQAGTTVCRPAVSLQLSALWRLALLSLPLACEPGDLKSLSDPRVWAHPCLSTTQDSKSHLARRFGCGCGHLICPHASQGNMGLCLPTEFRQKQYHWTGSSSGCGPSGYERQT

SEQ ID NO: 934650 - protein, 178 aa, Homo sapiens
MGKDVTTKTPKAMATKAKTDKRDLIKLKSFCTTKETIIRVNRPPTEWEKIFAIYPSDKGLISRLYKELKFTRKKTNNRIKKMAIIKMSGNYTEYYAAIRMNEIMSFAATWMAAIMLSELTQEQNLIPHVLTCSHAPSQCSESVDSFPTSVLATDLGLALPVCALQAWGKLRLFAYSSA

SEQ ID NO: 934651 - protein, 172 aa, Homo sapiens
MNPSGPGLFLVGPSSAGLLQFAGGPLQTLFAWVSPVEAAEQQRLLPAPSSGSSLPERHWPDASRSSPQSWCTVLAECLLSGSAALFRASRQERLNLLKLHPQPPLPPGALSEGDGGFVCKPLTGAVTFPSEMPCSVRRNLEKQSGHSHFAAPIPDLTASLALSGENLLLKPQ

SEQ ID NO: 934652 - protein, 167 aa, Homo sapiens
MKHSSHTPALDCPTLTLTLENLGNMAKPCLCQKKNNNKKEISWVWWHVPVVSATLKGEVGGSPEPRRLSLGDRVRPCQKKERRKRKKERKRKKERRERERQRKKEERKKERKKERKKERKKEKKKEREKERKQEKKKERERKKERKKRKVKFFLPKPRLKSHYPGVT

SEQ ID NO: 934653 - protein, 137 aa, Homo sapiens
MLHFPRPLCAHTPHPVPIKPQDPSGQTTTSGWTSRDAHQQKENKWLDVERSTAVEEHADRHQQTPAHQEAIHWRNDTEFGPGDLGPHQLRCQIRHSIKSRKLTRSEKGMTGESRYSLCGNSLKKNNLVVQTGFKKRL

SEQ ID NO: 934654 - protein, 165 aa, Homo sapiens
MCALTVVISLQNLKVAWQAGTQEWEWVVIKPGNIRVWVLFTCACFSFDLFCHVLSSKKALTRSQADMGAMPLVQPTELGCTGLQPLCMAMRAHPLHQCSLNVKHGVKGNHFGALIFNDFLVGFQTCMGPVAPLLWTVSPIWNRVFIQGLYLHCILEVTSTTQWLY

SEQ ID NO: 934655 - protein, 165 aa, Homo sapiens
MAIIRKNQTDQIELKNTLQECHNAITSINCRIHQAGEESQRDQIYDSLVSLKEGEKASNLENIFQDVIYENFPNLFGEANIQIQEMPRTSASYYTGRPSPRHIVFRFTKVEKEEKMLKAAREKGQVTYKGNPIRLTADLSAETLQARRDWGLYSAFLKKRIQPRI

SEQ ID NO: 934656 - protein, 159 aa, Homo sapiens
MIPSPKKWTEHSIGPSAAGLLEFAGGPLQTLFAWVSAAEAAEQQILQKGTCCCLILPLEALSQRGTQLYEVSVGPYWEVSSSLATWGCRLLRLSFAGKGNSPTRCASQVAKMSQAASLTIWEKPQLQQLSSHSSPMMGERLIPVPTAEALSTLITQFWL

SEQ ID NO: 934657 - protein, 154 aa, Homo sapiens
MGRNQSRKAENSKNQSDSSPPKECSSSPATEQSWTENNFDELREEGFRRSVITNFSKLKEDVRTHCKEAKNLEKRSDEWLARINSVEKTLNDLIELKTMARELRDASRSFSSRFDQVEERVSVMEDQLNEMKREEKKYRERHKDTPREEQLQDT

SEQ ID NO: 934658 - protein, 127 aa, Homo sapiens
MTRLRCLHCELWMDSLSSDQGLCFALTKSTKYTELLVCHNASFWECQITKGLQIYCSFQQPYQIDQASKYYYPHNIDGKASEIERDKVMIPRSHSSTYYKGHFSQKILPEIAMFLLKSGFAFILRIP

SEQ ID NO: 934659 - protein, 166 aa, Homo sapiens
MDSGQAGRQERLSLPKLSPQPPLPPSALSQGDGSFSSKPLNGAAAFVSEMPCPERRNLERQSYYSSFVELRWAPPSPNFPEALFTLLLGSMGVGSTELDHFAPWLQPPFQIGVPGVTGVRTLRLREFNDLSQDCKVSKFYIQGLKPGLFESPYTNNSPIFNVTSNI

SEQ ID NO: 934660 - protein, 195 aa, Homo sapiens
MTTATPMSPFLLAQEEQVFCPPYSLHLVPPHSPGPVSVNDYVTFGNVDLLRGPMVILHKPQRSNGPKPLGPQSLYCEIAEGLPKPWVVELQVLLLPELGAQTPRSHRDSKDWVLLKPLYSPEQALFRGGPAVWGMVATGKGRPGERSRLSFKEAALRLKDPGTPDSTAIREQLLETPWIRKCFWSCQMKERKKDE

SEQ ID NO: 934661 - protein, 141 aa, Homo sapiens
MPTRALLCEVSVGPYWEVSPSQDTWGAVRQRPCPEKRNLAVWPQQPCRAAVDFTQFELPSGFVYTVNIKPPTQASAMADTPSPTKFEFPGLISDCCCAGSGNFKPVDLSLLGSVGINKSLKSSLPLELRYKKCLRDSFRMK

SEQ ID NO: 934662 - protein, 139 aa, Homo sapiens
MRFRKGKPDSYCSSFSNLASPQSMERVLVEPKLSTSSSGKENTEKLHNPISRSKVHSGFVLLSYEVVVSGAWKAALEQWLQGPSAVIGLSVDISHQDPYPGSCTLEDRLWPHQAKELELDITEFEDRYCLVPFPVIDLY

SEQ ID NO: 934663 - protein, 284 aa, Homo sapiens
MVDKTFYESPDGCYWKKHYRKGRQIHIQNSHSNFCNLTNANIPVQIWVLLATSSPVLTDASADSTPLHPNSNVFPYSPPDSSKRGPDPSGSSARFLAGMHQPCPLATQCATVLQVTLKRQNLQAIGVEYCISTLDSHKYFRRASYCQISQIEDLAAFEDDNKANRKTKAFDVKGDVGHVCSRHCLLSASPFLLLSLLQHLPNWTSNPRDITGSTALFRAGRQRCLSQLKLCPQLPFPPGALSLGDGSFIYKPLTGAAAILSQMPCPVKRNLERQSYHSHFTMLC

SEQ ID NO: 934664 - protein, 142 aa, Homo sapiens
MGMEKITPHCGLTFKAQTASCLFGKHSDGWRKKLTDIARVHNFVYLILSQSVSILSHLSTYFFPRLPHIHTADPLHSTSCMKQQSPLSPAMSFHRPLLKTCQLHPYFSGAWQSKIKSEAEDTLVKTPNSSSAPTLMATKLYS

SEQ ID NO: 934665 - protein, 178 aa, Homo sapiens
MILINNLVRSESFGVYSRVVKENFFDDVIFKWAQVAAGCHTGQHSSKEKGGKTGPIFDPLWQLKGFQDPQVRQKGRGAWARGEEEDMFLMSSTKALAVIGHHLALFLHVVIGLGCVYTDPLSQAGGLNVKYELQRHRFYIPHSSPAPTVLVQLTLEACAERHSIYLPGLGHFRDDGNY

SEQ ID NO: 934666 - protein, 148 aa, Homo sapiens
MSWEILQWWSQVRTNTGAAVILGQKCENTDCPDAEQVTFIKSSPSNEHKRKLMPHEGKQLVSGHLPGRKSHLYGSQAVTPHSYPLSLIRNDSLVTGSMLGEVQQTAGPGSIFVHLHVDVDLTQNHLLKRLLLTVPSLPHSSHAWGNFQ

SEQ ID NO: 934667 - protein, 213 aa, Homo sapiens [sequence omitted]

SEQ ID NO: 934668 - protein, 160 aa, Homo sapiens
MATGWCSDCADGVWHQEGNQGPLNIQCSCSCFSIWDLNMGKIANMEESQEMEFPVDTEVKMGQQLGLYISGKQARGVKPAAFLLKGSGSCIQEVQDTEAQNWDGVQGISRETLMLVAWSIDQQHRHHLELIGNAEPQAPYQIYGIWIFLLTKFPDDLYTH

SEQ ID NO: 934669 - protein, 146 aa, Homo sapiens
MHLAWSAPLQITFSPVSAVRTNISNAGPHEDQKPRREPEKFLMLKGWPEEERSEETVKKWFIEVGEGRNTLVKAGETVLNIWSKGQVKPPSVKGIMRSEAERVRSDVAQAKKCQELMATTRSFKETRKYSTQSHKGSVVLLMIPCF

SEQ ID NO: 934670 - protein, 180 aa, Homo sapiens
MRPERKVILWSSVGGVMRPKGCSDLLSANFQIMFSLFPRKLVAAAYIGIGVKYEPFKKMSEHLHFYRKVKQSLKRIPPRVYSSRSSEIPGCSLQKKAYLQRGLSSLPVQRLRSVEGGVQICAHIGEECSEHPHSQIGWCGENSVTRDGENIVKRQPFTNQEESLYHSPTILAPSSQVSSL

SEQ ID NO: 934671 - protein, 594 aa, Homo sapiens; identical to SEQ ID NO: 791873

SEQ ID NO: 934672 - protein, 648 aa, Homo sapiens
MYQCPVLNTMKGLPVPLSLPEGINPEVWATEGQYGRAKNAHPIQVKLQDSASFPYQRQYSLRPEADQGLQKIVKDLKAQGLVKPCNSPCSTPILGVQKPNGQWSEERIQPIPAYPHPKTPKQLRGFLGITGFCRIWIPRYSEIARPLYTLIKKTQKADTHLVEWTPEAEVAFQALKEALTQAPVLSLPMGQDVPLYVTEKTGIALGVLGVLTQKRKEREIEGNCQADIEAKRAARWDPPLQMLIEGLLVWGNPLQETKPQYSAEEIEWGTSRRHSFLPSGWLATEEGKIILPAANQWKLLKTLHQTFHLGIDSTHQMAKSLFTGRGLFKTIKQIVRACEVCQINNPLPYHQAPPGEQRTGHYSGEDWQLDFTHMPKSQGFQYLLVWVDIFTGWAEAFPCRTEKDQDVIKALIHEIIPRFGLPRGLQSDNGPVFKATVTQGVSQALGIQYHLHCAWRPQSSGKVKKMNEALKRHLKKLTQETHLAWPALLPTALLRIQNSPQKAGLSPYKMLYGWPFLTKDLVLDREMASLVADITSLAKYQQVLKTLQGTFKLCILPKEPENPGDNASYSCEPLEDLHLLFKRQPIEAVKLQMLLKIEPQMQSMAKIYHGPLDRPASPCSDVDDIEGTASEEISTARPLLHPNLAGSN

SEQ ID NO: 934673 - protein, 157 aa, Homo sapiens
MTAATAINTNMGEEIPELQRPQGEAYGLLLCEPLMTLYLCECLGKFRHQHEYTLVLAQRDATLPCFPRPLATRKVLHCTVMYKVPFEIMYCRTFVLGPTPLADSEPLGSYLPSLIQTRYFIREAVNEAMPLPVDTSLSSQHNCLAGTDVFICQPDPQ

SEQ ID NO: 934674 - protein, 138 aa, Homo sapiens
MYADGEIEQALTRNWASLTSLNYSGSSGQRLDANMTKVISKCKNLLLARPDRANSCQKSGHRKLSGGASVEENFQGPVQGLCPLSPVPAPVPQKMVQANSPCSGAIEPELLILLALGNRGTRLLVSLRPPAAVRCHLE

SEQ ID NO: 934675 - protein, 146 aa, Homo sapiens
MRVHNSYPYMRYLTFYYKTGFMLDDFSQCYINVNVLGMLWSSLINSLELPDCFTSPFPVIHGKSHPAVYGMALHLRLEEVEKPDLVLKLHKEGSAGGSLDLSPGEAMSVVDIWRQSDSGDSQTSLLSKQPRVWQAKDSSCVNRIGV

SEQ ID NO: 934676 - protein, 134 aa, Homo sapiens
MKDPVKIQFILSHLEVCFLLTVALYPKQAFSWLSVIFPRCNPESFTPCLKPYCLQEKVRLFKLAYRAIHDLIPAHPDFSPSNPFIQLQEYDNLSPISFPLHKLFSLDAPLLCLQADLAVFSFLLSQYFVYILEV

SEQ ID NO: 934677 - protein, 154 aa, Homo sapiens
MMFILCVGGGGSSFASPSLDTSPSFLFLLFLFLLNFLGYSKFVDFSYMILHCLINFLKAAEILNSIFMSAYIKFGRIDIFNDIKSSFHEPGILNLFRSSSVSLAVFCSFHCTDLIKNFVKFIPNCFLCLHAVVNRIIFLTSFFIFFIATIQKYN

SEQ ID NO: 934678 - protein, 168 aa, Homo sapiens
MLRKHKGTLERSETTTDLPPTYLEVSVGQKSGHSLAGPLLKVLKETFKAVKSMERVLVEPKLSTSSSGKENTEKLHNPISRSKVHSGFVLLSYEVVVSGAWKAALEQWLQGPSAVIGLSVDISHQDPYPGSCTLEDRLWPHQAKELELDITEFEDRYCLVPFPVIDLY

SEQ ID NO: 934679 - protein, 139 aa, Homo sapiens
MLTSLFSAQLSQNLKGPKGATVKALARPLKGLLCPHSLGPVPSRLDDGPSLAPILHIKARGSVLAQMPGHFSSQPPSVAPRGLKDKVQLHGPEPSGSCSLPRSPLPDFLQAHIPAPTRALQCQCGKGLCPQDPAASLAS

SEQ ID NO: 934680 - protein, 155 aa, Homo sapiens
MIKVIIISNGTRGLVSWPPDAIHREGSSTSELFPWKVQNLDGIMRKHQPSPNTQKCCKITGPYAPENCRKPRRTKSWSRLKETKELGQLHRTCDQRCSFSGKNIIEKILLAQSINSKGVSSCKHWPRLPSILPWKFFILFLLYDAFKQDEIQLHR

SEQ ID NO: 934681 - protein, 176 aa, Homo sapiens
MRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKNWLNRHSWQRTPVAVTAWALLRDSYHGALCLRFQAQHIAVAVLYLALQVYGVEVPAEVEAEKPWWQIYTMDTEIP

SEQ ID NO: 934682 - protein, 126 aa, Homo sapiens
MALRPHSPHFIGLLFPFSTWQHRKTHFPGRLPREEKNGFKVIQSIRVHASKTGKKTNQAGHAGPSWRDIMLPQKNRKFVSVNPLSTSFCFKHDTGSTGENRNSVKQLSPGSKGLRRGLGEARVQVV

SEQ ID NO: 934683 - protein, 141 aa, Homo sapiens
MVLDQIQAHQGPRHSTWVSLFAIQDPRALQLAGDECWQDRILFFKAAQIPENCQEERLSLLLHRDCGYPSSYGLMPRDIRVLSLSLWMELFKFLQGGTTQPEEVVWLQSATAGVLSCGENLLGPSHLSSLAPAGEKSGLEL

SEQ ID NO: 934684 - protein, 181 aa, Homo sapiens
MMDAPPPTKLEHPSRAPLLKVCWSLLEVRSRSCLPGYHQRRLQNSKDCCLLLPLEALSQRGTHQMSAEALLYEVSVDPCWEVSPRQEAQGNVVSVFRPPKSCHCNEEDKVCCGLNVSSQIHVLKHNGQCDSIKSMEPLKGLEYGCNMIRPVFLEVYSSWQDWSIERLEQRNQLRGSMREYM

SEQ ID NO: 934685 - protein, 213 aa, Homo sapiens
MRSIPIATACTIYHKFFCETNLDAYDPYLIAMSSIYLAGKVEEQHLRTRDIINVSNRYFNPSGEPLELDSRFWELRDSIVQCELLMLRVLRFQVSFQHPHKNWLNRHSWQRTPVAVTAWALLRDSYHGALCLRFQAQHIAVAVLYLALQVYGVEVPAEVEAEKPWWQLPFRGPGCRTGVLASTDVAGVPGGGLPQRRTAFTELSGNLTVITGY

SEQ ID NO: 934686 - protein, 146 aa, Homo sapiens
MRVRARCGAQGAGCGALPAGLGPRGDARPQCRKDTQARRGAQVPRAGTRVPLPAAAPPAGSSSHPHPRLCPRRARAHPGGARAPRAPLTRAWARPPPRPRLRRALSLRAGVRRATIRSKDGKAWARGGLAGGAGRDPLRRARAAAE

SEQ ID NO: 934687 - protein, 141 aa, Homo sapiens
MVVGSFAHLLEPPPQRMQSMGGKGSSTAEVVAERLSVAPGGFVQGAFDQRTPVGVTGDPGWKSPPGYEEWDEEPTVQCCYRWLAGIPSQGVLSCKFLWKWDLQAFTAQPFDSASFLEVHQGEPVTGMGPELESAGSGKVLR

SEQ ID NO: 934688 - protein, 139 aa, Homo sapiens
MGVSPKAYYNHFLATAYVSSRPWASTISQQSLTLHLPHYPEMSVSEVHLTDELTRHQLVIQTSRAWVEGRPILKERPLMPGSTSNHGLHTSYTITVLPSCLRCSSDRPQSSMHCARQSCGHGCLHIDFKGCPQRAVELL

SEQ ID NO: 934689 - protein, 158 aa, Homo sapiens
MGQGHEGLIRYPRSLNFIFKILDTNENVPQLSWGSMVIFTVLMSIHGHGCVSICLVFRLIGDPESSQGLSASSSTPVFHLALQIDSAPGPSSAGLLQFAGGPLQTLFAWVSQMGAAEQKRLLPATSSGSFVPEGHWLDASWSSLVEQKIQPARSYLNS

SEQ ID NO: 934690 - protein, 240 aa, Homo sapiens
MYPHFLAFDTGASRSSADRAAASTTNVSTHASNIPTNLGFHSLLYHVEHDPLENDKLQVRSPPEPRCADHFDPSLQSSPDRKRKCLGARGEPGQTPLWGGRGAGRHPSAPRMLHAPPTTRPVPTLPPPRPRPLPARSSAHQTETPLQDALRERYPEAKSRQAQEPPPPARVSWGRGLGGLLGGGGGLGLGPAGSRKGGRLPRLPAEPSHRSRGWLKSILSLICLVLLSSDARSSAHLGVI

SEQ ID NO: 934691 - protein, 369 aa, Homo sapiens
MALAMLRDWCRWMGANAERSLLILGIPDDCKEHEFQEAVRAALSPLGRREQPGCEEESFESWVEHAKDMLQLWCHASEREKKRWLLESLGGPALEVVSGLLEEDTNLSALDCLAALGQVFRNQDTRMTSRLKFLTCTQGPQEGLFAFVVRLEGLLQRAVEKGAVCPALANYLRLQQVLSWARPSEALQDTLRGMQLEKRPPGFLGLLRLIREMEAWAAFPARSQQGVAWAAAPVESEDPAAAQASPAQGNASEAGPGAEDAAEAASATKEAARGAPAAGEGESAPAGPEGLGQARPIEVPWGSSPARMSSAVWVFPRGLSWGPEGLIQVRGQEARKPPLEGLQTILEEPENEDEDGAGDEGQPKSSQGK

SEQ ID NO: 934692 - protein, 172 aa, Homo sapiens
MLEEREQKYNLRTISILWLTVIIHVEWSLIVVNVVLVYYTDDICTGPDDLESLNLSKVFRWSGPRWVFNMLLYRLPPTTQKEARHLVWMFEFCRQHMLHLIVPHQCTQQVICRVACFRGEIQGKKRLCDRSRPLDPYDHVDSTGTGPLTHWEATRSLWQVPVGETHSKALEF

SEQ ID NO: 934693 - protein, 134 aa, Homo sapiens
MFKGGKDGSRKTEMMVGSSGGGVKWQDSGYVLRESMEPQKLLIIGFLLCSLTCLLLETVASSPLPLSALGIQEKTGSKPRSGGNHRSWLNNFRDYLWQLIKSALPPAAIVAFLLTSALMGILCCFTILVVDPVH

SEQ ID NO: 934694 - protein, 136 aa, Homo sapiens
MSTRLFYAIFQAIIRIFQNEETEALRAYITSLRSYNCVRKINLAEVSIDCGARVKQDQSSRERAEYNGKIEGSNDCPPSQRHHYNNYLHKNSTFIRTKNQSRKENQTQLSWQPPTALKPVLSEGNCQFQQPELEFM

SEQ ID NO: 934695 - protein, 315 aa, Homo sapiens; identical to SEQ ID NO: 791953

SEQ ID NO: 934696 - protein, 152 aa, Homo sapiens
MGLSKPFYPRLAQSLAGGLSEKLCSPGGLSLAELWGVRLDAGRVSLEEFFKATLTDLCVDLGPGSIALVIAPSRTRTSYIMSIQLKDVGLNNPRKYLEQATKKYVTQQDKMHYTQIKQRDPRDKSSEKMVEPEAGLEPQIYARKSSLQEDFH

SEQ ID NO: 934697 - protein, 144 aa, Homo sapiens
MPRSQLQAQSPLNVFLLSKYTVPTALYPKNNWACLSPGEALHESQRPALQKGPPGLSKSIKKLKLTRPPHLDNEIPGPSFIMIALLPLPSSCFPTRSYICSLPYKLLISVGQRDGFETDLSSPRLQQPIKDFSGNTCLSDWLAV

SEQ ID NO: 934698 - protein, 138 aa, Homo sapiens
MYIKYTLKYNQEAIRGATVTMTDHVRGCRKCGAAGTLRQCCLNKYYLSSVNITGLMVDSGDGVTCTVHIYEGYSLPHAVTELFVAGRDIIKHLTWLLFASGCTFPCILYKALVNNINGKLCNIALEPHKKLCERPETS

SEQ ID NO: 934699 - protein, 155 aa, Homo sapiens
MGTHLLHQHDLDVRHGVKGDHFGALRFDCPTGFWTCMGPPDNVIEKENSFFKEKFKLAAEICINNEEPSVNLQDNDKNVSRACQRPVCQFLPSQDWRPRRKNGFMGQAQGPCSMQSQDWVPCISVAPAMAKKPRYSSGHGFRGYKPQALAVFTWC

SEQ ID NO: 934700 - protein, 151 aa, Homo sapiens
MFLAVDSHPISTNTTGPEGILPGYHRCSLKAQELFNQLVVNAARRGTCPSGKWAPLLPTEGAEMPSNSQILELGTPTQNESHYSHHSWEYAGSHLKAAHLKISPKTYGLLPEYDCWLFRAQGYYTINYVRYSTLYYKIGFVLDDFAQLKAN

SEQ ID NO: 934701 - protein, 159 aa, Homo sapiens
MASKWCSFQKRFLWVSAQLFPKKWPPDCFLPLSSYLYLPVSRPPARGGYRSRPLPPAGIVGEAKLHELALLVSLVASTQRLFHWGAVVRCMVGLGGQFHSAVAAAQPQPQAAQDDFGLAIAVHEGHVQLGVATLQESVHGRGAGRCVHDQSMLVQHRVC

SEQ ID NO: 934702 - protein, 166 aa, Homo sapiens
MHSARTGSFPSRQQVCFWPKESLEMSSRSKTKRILVEQIVTQLKDNFSAFFACVHVTKFWLMRLKWSRYVILFEESPLKGRDHTFPFFFLQYTVRNMDVMAGIPIFILRHEGTYLRNGRVHTEKESGSLKISWYCHTSSGLLTFEILSYLSQPYFMSMLTEEIGFF

SEQ ID NO: 934703 - protein, 144 aa, Homo sapiens
MEEADLELDLESFKSAYQRLKELERRGYIWQRDQCEQIHTDRRRRKEERKKRRRRKEKEEKKKKKKKKKKKKKKKKKKKKKKKKKEEEEEEEEKEEEEEEEEEEEEEEEGGGGGGGGGGGGGGGEGEEKKKEKKKKKKRKKKEK

SEQ ID NO: 934704 - protein, 144 aa, Homo sapiens
MWGQSPHTESLLGHCLVELCEEGYHPPDSKMVDPLTACTVPTGKVTDTQWQLVKAARRGAVPCQATGAELPKFVGAHLLHQCDLGVRHGVKGDHVGALRFDCPAGFQTCIGFSYISIFIFDQHKYFERPSIQQVLCYRYLEYLY

SEQ ID NO: 934705 - protein, 144 aa, Homo sapiens
MMKPELNRKVQCEEGTLGRKSYICKSMDRKYRYSDDCYEEKWKEIGWSCKYPPRTLNVTLEYVDEGTKKGLADYSIDHLCCVLHLKPEKAGHQYWDDDDDNNDNEDDDGVHPIKIKDMQVCYIGKCVPWQFAAPINLSLDLLYR

SEQ ID NO: 934706 - protein, 170 aa, Homo sapiens
MKLNPGLVPASTGVDLEPVSTGAGLDLGFMVASLTVRLTEVVLMRYPAQRGEIWQPGHSGYAKLWWALPSLNFQVALFTLRVKPPTQASVMADALPPPSSISQVDLSLLLFWQREFQASGSSLLGSMGQQSLPAQVSLGVMVFPATRIPDVHGKSMTLFACSTYPFPRSH

SEQ ID NO: 934707 - protein, 143 aa, Homo sapiens
MLSLPPSPTPQQAPVFNVPLPVSKCSHCSIPTYEAMSQQSGESNTLKDQTTEKQTQQLVKRSMSEEPQAMTRQNELENTLEEYEEYEEAIPVPNEGKKGTRNTEGYKEQRKDLPVRPQTLLDLIRTLSQFCCCQSQIKCKEGL

SEQ ID NO: 934708 - protein, 157 aa, Homo sapiens
MSQERGPDPMSQERVLGSHTRKNFRASPQCKVKASLLRKFTRTVLKRSPQISPPGNLVVSECEGEPAGFGQVLRHRNHSPWLLREKGLAVDVRLLPGRDAPWAFVVVSGPGRRRKVDRRGEESREDGASAGRAVGVDIKEQDPDLEKEEMIKTLIIQ

SEQ ID NO: 934709 - protein, 150 aa, Homo sapiens
MGSAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVGLPPL

SEQ ID NO: 934710 - protein, 141 aa, Homo sapiens
MCAPSCAPKEEGAVSGKALRQEHADKFKEQERDGFQREYFQLLSIQCDVGCGFVIDGSYYFEVYDCSRTSHRQNPSDTELKKEAVYSAGSMGKTPVSRAELPESASAAAISQEYSLHSRILRVLWSSRLHLYSCTIVKWKQ

SEQ ID NO: 934711 - protein, 143 aa, Homo sapiens
MEEKTQNGSAEQRVEVSIRQNLFSLPGSRGNRLGEIDHDNSNYEDEDDERPGVKPTWSLGRFPQQQRESLLATRLAEARLGFGAALAERPRACKTEPERSAARLGVPGSAGTEGSAFLAFAARTASSGSLGCGSAERCKDPTV

SEQ ID NO: 934712 - protein, 196 aa, Homo sapiens
MWLGNLRSSRKIQEQTGKDNCLKSWKESGPSAAGLLEFAGSLLQTLFAWVSPAEAAEQQRLLTVPSSGSFVLEGHPPAGALLYEVDALPKEENSREAVWLKRLCQVAVGSTQFELPSGFVYTVRGKKPTQASVMADAPPPTKLEHPRSTSDCCVGSENFKPVDLSLLGSVGMGSTELDHLSCWCSRRHWGMKRDSL

SEQ ID NO: 934713 - protein, 165 aa, Homo sapiens
MWESLELPRDLLNGFDQNADSDMDNEIQAEVVSDGDEEPIRNWSKGDSCYVLAKRLAAFCPHPRDLWNFELERDDLGFLVEEIYKQQSIQENMPPQNIATWYTKYFKLKEIEKTEAGRPLSHLLSPFFSEASHKEFSGLPSQKVGHKTFIPEVSCSIPTDQEEAK

SEQ ID NO: 934714 - protein, 239 aa, Homo sapiens
MVNDGVCWGLIDTWGLHSSEVVLLDVNTAQAVLAHVFVQVQEELQGGLVGGAILDVGHFHGDSLFELDLENVRGSGGFGRVLGLRGETWKCLVLRVLQDSSLIADLHEVLVHVPQVLGSDWDGNPVLLCVFHKVISDLEPVVELGHPPGSNDLYLGGPESSRPGERGAQEVVVLIQCAGLDGQPDELLHKLLADFLNEHLFAPKLQCLLPGFLKVFLLASVGHVGNDVIALFLHYDFLT

SEQ ID NO: 934715 - protein, 290 aa, Homo sapiens
MSSKGSVVLAYSGGLDTSCILVLLKEQGYDIIAYVANTGQKEDFEEARKKALKLGGKKVFIEEVSKEFVKEFIWLAIQSSALYEDHYLLGTSLTRPCIARKQVEIAQQERAKMPKFYNRFKVRNDLMEHTKQHGIPIPVTPKNLWNMDENLMQISNEAGILENPKNQAFPGVPMKVTNVKDGTTHQTSLELFLYLNEDVGKYSLGRIDIKENHFTGMKSPGIYETPADTIVYHAHLDIRAFTMDREELVSMNVQVDYEPIDATILEDGKSKIKVLTSCEGFVLLHFMEEG

SEQ ID NO: 934716 - protein, 128 aa, Homo sapiens
MLTVGNLESYMHFMRKSLEYFQTFLLASNLEWISTHTLLVTWANPEAKVQQTLACCAVYQVLMIMFYLSKVLGAGRDKGTRNGADIVGSKEDDTGEGILPQLVQSLEHSSDEIAAHEGLSEFFREATL

SEQ ID NO: 934717 - protein, 141 aa, Homo sapiens
MILNSGPQQLSNGIMNIKKERKKIQINTIRNKKDATTDPTETQITTREYYEFLYAHELENVEEIDKFLGTYTLLRLNWKEIKSHHPHTKIWRRQKTKQKQTNKKTFRPISLLSINAKILNKILANLIQQQIKKPHLHVKNC

SEQ ID NO: 934718 - protein, 220 aa, Homo sapiens
MTYFLLNGDEEFIEGWSKGDTCCILAKRLVAFFPCPRDLWNFELERDDLGYLVEEISKQQRIQKVPWVLLKAFHFKRETEHKSSENLQPDNAVEKQKQKQKPCFEEKSKLAAEICISSKEPNGNPQDHGESVSRPCQRPSWKPLPSQAQRPRREKWFGGLGPRSLYCVQPRDLVPSVPDTPDVAERGQYRALAMASEGRSPKPWQLPCGVEPMGTQEIKN

SEQ ID NO: 934719 - protein, 158 aa, Homo sapiens
MSFFAFRPITRHKSQQALKASAFLFTSVNKDHQKQLTFRRQDRQYPFTVILHGYINAPALCHHRCRTTSSQDPTRMKVCVTHQTKNHGQLTFLLRTKNASNGKWEKHDILFRRNDLSAVIDNCIKITLKSGLQGQLHFPGTNMSSPDRCSDHIILLCM

SEQ ID NO: 934720 - protein, 161 aa, Homo sapiens
MRSPRCPGDNLYFQFNEIIAVSPGKIIPPFGAKTSGPTEYKVMGIRNKNFPSGSLSLLSQEDLGRSQRALGQSSRVSESGYQVSWTVRFPEGSHTDGTRLRSSPGLQAFLGLVARFLALVASFWERRAWRNAWPLRFRRLEFLCAGDVTGVCLTVEVGIEQ

SEQ ID NO: 934721 - protein, 138 aa, Homo sapiens
MRTLTNTDFGPGVVLEEQNFKDGFLQLVLGFLGWLLNMIRLQNAKDSISNSMENTDSHWCKLFREICRINAFDTSDSPLLRGKKFSDSIHNIFDRMWKIKGYNEVVWLLLSSLDKVMNENLSEGMVAAPSCTSGRIWL

SEQ ID NO: 934722 - protein, 141 aa, Homo sapiens
MKNAVDGITPIIQDYLKKLLAHYSLHKPPQLPYIPRKETKWERMEVFAGLAKDLQETPLDNAEIEWYTDGSYIREEDGNFTAGYAVVLLLEVIEASPLPQARSAQAAKLIALTRACQLAKDKTANIYTDSHYGVAHDFGIL

SEQ ID NO: 934723 - protein, 143 aa, Homo sapiens
MIITVNLSSTLTIGCSPPGNVKNFSKQNFSFSSGGVCSKNGGLPFPLPQLGHYQYLRCLLGPAGAVCCLQRVCGYSQDCWFVLAVDLELKFTVQAFAMLLYLELQSSPTSCLPLSAEAPGLHYNVTFGGDKYPNDKNHFFNFC

SEQ ID NO: 934724 - protein, 147 aa, Homo sapiens
MAEGKGGEKSLLTWWQSREKGKAKGEKPLTKPSDLIDGTACGDSHCELLLQGLPQEHSRKTKRIHRTFEGSSLPLQASCDSQKTVSAQGVREERSTSEHKSSLGNLKIHIMEKDLIFPRAKTNLECEAKYKGRRSSRKSPVGTRNPQ

SEQ ID NO: 934725 - protein, 145 aa, Homo sapiens
MEQNSLAGRGGDSMRAWRGTPASRAGPLGHLSQPGQEEESDCSPVCPKKGRKRPWKGWVGLKPTFLTPRSNRGWGTVASTLRRNPRDPKLRSKREKGFFVCASGIFTENQLDADAWNYFVQFIHVFGFMPVACCFGYFVVYFEVR

SEQ ID NO: 934726 - protein, 237 aa, Homo sapiens
MEMLNTKCLPRDLLNGFQQNADNDVDNEIQAEVISDGDEELVAAPAVPERSKCRAWVMASEGASPKPWQLPCGVEPASAQKSRIVVWELPSRFHKMYGNAWIPRQKIAAGAGPSWRTSALTVRKGNVGLESPHRVPTGVLPSGAVRKGPPSFRPQNGRSTDSLHRAPGKAADTQRQPSRQPEGGCTLQSHVGRAAQEHGNLPLASAREWTNTIIIHKCKIAAKLEVNRSCVEVIDQG

SEQ ID NO: 934727 - protein, 142 aa, Homo sapiens
MCLSSCLSETLGSSVCQTEGPGGVGSQGYLLTLGLQRSIEEAWFPKAAHLFTTSLGCGGSINSMSLPGKMYNLVWLCEETHSLCINSPNYSDFSIQLKLKGELSHTSITVLYKDTIADSVIPILWNCREEIFLFKFIMFSNV

SEQ ID NO: 934728 - protein, 154 aa, Homo sapiens
MIELMYIPTNSSDDGKGSSTAEAVAERPSVAPGGSAQGVTCVLMVLVEDGWNLKPGAPAWCPNSKDGGPPFPLGSSFLGKGNATTSGWLEFQASGSYLVRCHGSRAFRLSLLSPLDSASFLGNRCGDHDYTFSQQRTYTRLHDPYSQLNQKGWC

SEQ ID NO: 934729 - protein, 142 aa, Homo sapiens
MWVGSDKGIKAGCLSQQLQPPWVLFHAVEALFFHSSAVTLTLKVCSFTPEASETMNPPVARPRTHQKEETPDTSEHQKEQTPDTPSLRTVTLTMRVHSFILEVSETKNPPILDTGSKTTEVMEGYRMPYFSDCQCLTQKKTN

SEQ ID NO: 934730 - protein, 136 aa, Homo sapiens
MISKAPPIAAHYPQQGHQFNNYLHRKKHPYKNRNSGVEEEIKRNTPSSDKWQRKTLNSDLTLMSVLLTIVLVSCGCHNKLPQIGLHKTAAIYSLTVLEARSFKSRCQQGHAPSRGSRGKSIPYLFQLLMASVFLGL

SEQ ID NO: 934731 - protein, 248 aa, Homo sapiens
MGKKQSRRTGNSKTQSASPPPKERSSSPATEQSWMENDFDERREGFRRSNYSELLEDIQTKGKEVENFEKNLEECITTITNTEKCLKELMELKTKAQELPRQANIQIQEIQRTPQRYSSRRATPRHIIVRFTKVEMKEKMLRAAREKGRVTLKGKPIRLTADLSAETLHARREWGPIFNFLKEKNFQARISYPAKLSFISEGEIKYFTDKQMLRDFVTTRPALKELLKEALNIERNNQYQPLQNHAKM

SEQ ID NO: 934732 - protein, 143 aa, Homo sapiens
MQFRKLQGLKLGVTFQREKQMAQPQGDPGSVSEPLDGVIGVPAEKPHPLRKNESGSSLKRHSVCSLPRQCVELWRTNLSSSGVWTLGPGGIGSLVGSSDPWVAQFHGRSTVSPVLVTYDNALSSKKKQRNFKLYDSVKMIHHQ

SEQ ID NO: 934733 - protein, 187 aa, Homo sapiens
MILSRSAYPRTLSNTLMKSRDVASYKQDCSDYYFSPGSSHPAELMGSGLVLGSVCKKSCDVICLQVSQLWITAPAPVEVSLAVAAVGDGSVFLRPMELRSQGNYGCLCCILQVTREMGNQAELSGFAPPGRSFYAPICTFCLPPYLQILPWKICAQSKLLQSSAGIFLLSVVFSQFHWPPSSRTPVR

SEQ ID NO: 934734 - protein, 140 aa, Homo sapiens
MYTVSFNYLNTVRRSRSIQPHHMVPCVPAAPSRAIAKRGEGVQKTGVEVWEPLPRFQRMYGNAWMSRQKSSAEAETSWRTSAMAVQRVNMSLEPPYRVPTGHCQVELLEKGHHPPGPRMVDLPTACTMHLEEPQTLNTSP

SEQ ID NO: 934735 - protein, 250 aa, Homo sapiens
MQTLPKGDGLPSVAHQPSSRSPEADPEAKAQQHEGTSAEPRAAGHSLGAQPPRVQQVCSYLRTDPRILGDFCVGVLSQNSPCTWTSRAHGFYSAALSRHAELLFLPHLLWTSPGPMDRPIPATPAGLQQPDPAHPTENPESHGAAIQPKPSPTKALREKGPRGAMGAPETAKMDTQGTEFLGHWPELDCGPRQGKPLKAVCGYAGPVHAWQSQASDVTRLKEQPSTTAMVGQEQVHFATGKSQKRWPQSM

SEQ ID NO: 934736 - protein, 137 aa, Homo sapiens
MWTNIAILSSAFSQSQYSVCRVKYELEPSVPEPQQEEPPAESWDPTPGQKREEDQGAAEIQGAGKGKKECLLGEGGLYGHHGLCHDQEEDWGPPQVEEILPPPCPWIWALISPLPWLSSLTSCSGRFGLASRNSCMS

SEQ ID NO: 934737 - protein, 141 aa, Homo sapiens
MGICCIDDFVTQGSVEAKCGVEPLHRVPTGTLPSGAVRRGPLSSRPQNGRSTNSLHHATGKATDTQCQPVKAAKRKALHCKAIGVELPRAVGAYPLHQCDLDVRHGVKGDHFRTLRFNDCPIGFYTCMGLVAPLFWPISPI

SEQ ID NO: 934738 - protein, 153 aa, Homo sapiens
MDYKALCDLVISCFHPHLGLSKCSTVKSQATGKYLPPSIFSILFFHSFSANEKGLGEFLSRDSSFFLPISKPFDLYWEDHGVVAGNGKQDTFFQGSEAAEACTRSCMATKILFKTHKQKIVVFISAEIEEVGLKETLDLQKLDAVQGEVPDLT

SEQ ID NO: 934739 - protein, 172 aa, Homo sapiens [sequence omitted]

SEQ ID NO: 934740 - protein, 134 aa, Homo sapiens
MTTITNPVSIYQVVGQFWRRLSHEHTVLMNKVSVLTKEIEGNALPCFTSSNVRMMEKLPMRNGSSLDIKSAGAFSLDFLASRIQRKLSGTERFFNVKSGNSPQRPKCAKYTPIKEQNFKLYNTKLIELKEKNTH

SEQ ID NO: 934741 - protein, 179 aa, Homo sapiens
MLDVNLELPRSRFSPVSSHAEEVFHSSHHSWECAASPKSQHVSEPKAHSTPWILLLVIQGQRALYSGVDQFCQNWALAFKAVCSLLAQEISRNVILGIGPGKGTSHLCLVPYPTMAKLVSKMQNKILFTLFSSTKAEGKSHLCYCELHCLGLEEGGQEHSHSHASWCLPRSCATLVHWL

SEQ ID NO: 934742 - protein, 143 aa, Homo sapiens
MSHKYLKFNLFNSKPIISPPPMYCLSMSPVTVLKALQWLPVNIKQEVSQCATQKIRESSSEINNAGILIPNLQTSELASPFCLQACKIKKQVSYFLETMEVQVLGKYNYSQWEKLARIKELKAPYKSKIQRGSQILKLQNDLL

SEQ ID NO: 934743 - protein, 135 aa, Homo sapiens
MLNIGYQFLLACRVSAERSTVSLMGFPFFECGPEREKALQQVQAAVQAAGQAALPLEPYDPADPMVLAVSVEDRNAVWSLWQLPIGEPQKGSLGFWSKALPSSADNYSPFERQLLARYWALVETECLTTGHQVTM

SEQ ID NO: 934744 - protein, 138 aa, Homo sapiens
MRSDGFIKGSFLHMLSWLLPCKMCLCSLFTFHHNCEASPATWNLSFTVPLPVNLRWVEKKYFPSLHYNVQQSLPTRKNYPTLNVNNAMILFAWSLPHLEVSPVEAAELQRWLNAPSSGISFPEGHRPDAGMNTPVKDQ

SEQ ID NO: 934745 - protein, 225 aa, Homo sapiens
MYYVGHTYIKQLFIVHLKFIFNWASCILSSSCIPAAHVVNLRTVSVCDSHYSLETPTPPAGRPSCVLGATAASSGSLRNHTLSPPPGSSLSLKPGRKAAAPCGCPGAWAVWPDQSCKAQIQVRAAVETKPFPVAVKLRPDRVLFHLPRQRVTYLLTQFYRCSLQNGLGFVNIFLYQAVVIEMSKSSGKGKTTGIRTPYPCPVPLTANLATASLHFLERAAPAIHY

SEQ ID NO: 934746 - protein, 163 aa, Homo sapiens
MAWLGLRGLTLITSIIDGHSSLPLHEGVRTTSQHKVAKNQRRRQLMQDFQSAALSPGTALEKFSLLYLFFPQLFRVSNASFLNAIADAEGNVVMMVKGNAHWSILDFEFSDQACSNNWNVEKLGEQERTIMALVTRQLTEVQYLVAPYDWSFSFQHWESTNLF

SEQ ID NO: 934747 - protein, 155 aa, Homo sapiens
MDGSYYSAKKTKKRESLELTRDLEGSEDKMWETLELLRDLLNVFDQNTDSDMDNKVQAKVVSDGNEELVGNWSKDHSCYRERLAAFCLCPRDLWNFKLERVDLGYLAEEISKQKSVEEEAEHKNLENVQPDYVIKKKTPFSGEKFKLAAEICMSD

SEQ ID NO: 934748 - protein, 129 aa, Homo sapiens
MGVVTILGACKLELGCLGIQGPWAPWRPEQQLFPASMQLSIQSGGPGRREQGRISYAQDCKSLWQKCQSLGVLTHSFPTVKKKGTSSTYCIYEKPTNVIIHNGEGLNAVPQDQEEEKYVHSFHFHSTLY

SEQ ID NO: 934749 - protein, 136 aa, Homo sapiens
MHLSQPPISCLELEKHFSHGNNVTNGEKVPRPVHKGLFNQEYGWTIGPIALESQPPLRLLFLWENVLPGLIVDASSNSIALSSLWQLEPGLPQSPLSFRLARWKGEKSQGNQRESVGELLSFKIHYKATVTTTAWY

SEQ ID NO: 934750 - protein, 160 aa, Homo sapiens
MGLPESQNAVIVISLLAVDTSTCSGGGGRGVKWTLRGTLVVVLFRVLVFSNAGCPGSKVVVWTDSGPLASQDVTGVEVAGEQGWEFAPGYKPPHRTFRLHSLHGMASVLIPALPIRPEPPDSALENSRPVKIIIKFNWKFPSPCGLSPIPLEASQRIPVR

SEQ ID NO: 934751 - protein, 139 aa, Homo sapiens
MASHWMQAAPEKGKALLNWISALIKEATESLLAIFLLCEDTRRQHSVTKKRVLTRIQPCWHPDLRLPDSGTGTWECWYGLELSCHKTRRKWDPHAHLQPWKKLSTRGNAERNTFRQFLKAGHSGQILLACSLSHVFLKR

SEQ ID NO: 934752 - protein, 135 aa, Homo sapiens
MFSVIPDLHSLDASSTTLPSVITTKNVCRHCSVSPESFASHSAVTIIIIITGMEEISGFEDYLFSRARPHYLSGCLGFNYSQIERKGVKHQEDWVLILCNFGQILALLCTSFGHVCKEKVFYYGLTNTDSDVSPK

SEQ ID NO: 934753 - protein, 174 aa, Homo sapiens
MQETKNCKFWPLAVLSLAWLTYDWNTHSQGGRRSAWVRNWTLWKYFRNYFPVKLVKTHDLSPKHNYIIANHPHGILSFGVFINFATEATGIARIFPSITPFVGTLERIFWIPIVREYVMSMASSQGTVTNVSLSGQIVILLDTRKQLKPNIQSMALEQEYFSMARVWRQFLPSQ

SEQ ID NO: 934754 - protein, 135 aa, Homo sapiens
MGWSLSQGSTEKVAQEVAVGAGPYDKKLSTLCTLRIVGNGCWKCEQLFSTCVSQTVIFVCLPNGVPSTWNALAFSIAHLNLSWPFKSPHFPCSVIPPPQAGPGHPHFISSSSYWTTALTVGPWIGGHLDLCWSHL

SEQ ID NO: 934755 - protein, 135 aa, Homo sapiens
MRCCSLFGSSMMLNGKRELKFAGSSSTEQTRSPQPVLTVALFHLTGSNRRSRLTSASASPPPFAFFSAFGHCVSMATPPQVLGHLLGHPQMPSARIGCWETGSMSPLDPTAKVFGGIQIWPSCNVCGSWACRVFR

SEQ ID NO: 934756 - protein, 142 aa, Homo sapiens
MPDLDLGLPFKKRPGPDGFTHKFYETLKKEIMSVVHNLKKKKKKKKKKKKKKKKKEEGGGRGEGQEQEGELPNSLPCGARSEEEKAAPFKRVSESEDLRGEFDFSKAQKMKGTYKEAVVDTGEWGLPSIFLVVQVVMNSFGY

SEQ ID NO: 934757 - protein, 143 aa, Homo sapiens
MGLGAMEQGVKLAWQAAGSEPCPAGRQLRPVEKSSTAAAGPGAQPLTARGLRASRLLRVLGGQAHAHPELALAPVPTCASPSTPPHNLREPAPALAGPKGLPQCSGGLKGSSSTARVGAKAEEALRASEGCEDCQQLSLLNTT

SEQ ID NO: 934758 - protein, 119 aa, Homo sapiens
MPGQKPQGNRVLQLNPKNNCLKNCPSMKLERKEIVSAPLLEMCEQGLDSHIVDIQRVEADGLLASSGDPVMRLPGSMNEVTHLCEMQPKERALTPWSSPRDGDLSLYLPRHLARCDNIM

SEQ ID NO: 934759 - protein, 143 aa, Homo sapiens
MQKIAERHDSLHLLDLGCKAEAQVAVKPVAGDDDTQARGLRVQVKLQLSLKVNPRGQGAGSVATAVAIRGCRPKKPGGALLALADDDPGPHLLCPIVPGLPIPLVVPKDSVPFLKALSFETFPTQPATPSQPGLCGGLRPRPL

SEQ ID NO: 934760 - protein, 135 aa, Homo sapiens
MGHRAHTHLLTPGPRPGERETYIARDQGDPGLTGVGRSHLVWRHANTYAHALRHPNELERTVGGLVTSYVTVPHKDALAQVSRVLMNTGKDKRELGALGLQRSGGDQAFCVLLRITDNLGVQDGIKAQGPVAAAK

SEQ ID NO: 934761 - protein, 147 aa, Homo sapiens
MSWHYATSLLLGLLRPCIGHSSSSVIRGHADLTRERLDLIKLLACVGHRAGMSEILQSSCSEPIVLDEYSGPDWKDPKISLQATEAQSRGGMWPQSGSLSVAYLGLKLGDTVFQSSAYITTSLPRPTLWPLASPTLLGTYTCLWWWP

SEQ ID NO: 934762 - protein, 153 aa, Homo sapiens
MGSPVPTHRLITEGSLRQENRLGHVPDTPGGTSCTTHRLPFSLVFHSSWPSPKPANRPSRAGWGRLKGEGGAERPPCSQHGCLPAGYGFLQPRLLRNTRFPGPCCRDPCLLGTVLQEKEQRGLFGVLFRGSCSPLPHPGHVITIRNIRHFNSN

SEQ ID NO: 934763 - protein, 156 aa, Homo sapiens
MYQALWMKTNMVPPSRSFQKTGVDPQGSQHGGRTGKPQCGDPLWSRTPLSSLSWGHRARAQKPFVSDHSYPPGFPSPCLLTLPTLVEPTAQPRIADKIPSLFFPLIVARKAEEGVCVSKTLFVCMYMLVSSRGEDRSRRGRGCASVGLLGRGIANI

SEQ ID NO: 934764 - protein, 162 aa, Homo sapiens
MNGKMPTANATHLVATQPSFLVSAIQGMACWETSKFLLGNLQLIKHMLGGLRLNSGSRGGWYVVPTNELQAAAACCGSPHEEELTGLSFVGGGQAGPMLTWGRRTHVRKKAIHAGLRAVRPQTLSPCHAGREYHQYLQLSKLSTQQKPDSDFSLAGAGKPCP

SEQ ID NO: 934765 - protein, 209 aa, Homo sapiens
MCGGVSEAVCLHRVEKGWFMCGCVMGASDKEIETWGGKRIAQGHAAAQGLLGVKTGEATAWPESDGKAARKQQEDECPELHCIWDMLHRALWIEHPESQGAGKRAQAPAPDAKQARQPGSAVTDIPYSLNESSQKALSDSRPLNAILPSILGKAAETPALLLSFQEAYLNARPSMALTQGISNPCLPQRREERAGDVKKRETYLLFVGL

SEQ ID NO: 934766 - protein, 134 aa, Homo sapiens
MWEVLLFLIPDLAGPLGEGYNDQSLVSGFWKESQPHPGLRASSYPAHWALPAWEGTEILPSVTGGVESEREKFTEGARSRHQEEEAPATERKKEGEREEKMWKNRNQADKNREIVRVGESLRDTCAMERERVCA

SEQ ID NO: 934767 - protein, 243 aa, Homo sapiens
MFSPDCSGYQAPAAGEEMAVPFLVAFGDHGSLRGQKEGEVSGGISVSAQGHFSLRGRAGPPRAWTLGTWNLDFREAKEKNEGQYPREKRPSLYPYPSEAARKPAPTPATSSSLDTSEYPEPSPRLLTFLDPPKKQAGGRSIEVAADKLEQLNKLLLINYRGREERRPEASLLPERHLHLCPGAPGCPLSQSAYLAWLPGEPQAFLQSQEVPLGLEREASQTLGLVELQQGLLTAPWDVITAAS

SEQ ID NO: 934768 - protein, 166 aa, Homo sapiens
MLDFIKCFFCVYSYDYVIFALYSDNTSQNELGSIISLYQSGFTRETIGERSCVQERLIYYKESAHVIRVHEEEVKSLHDIYSSSNIQKIKYYDVKLPQRIPERPKPLLSCFYLLAAGSGPVTVKEAERGRKYRRSAGSSLGYERVNPLRWPTGEIKREVEQAQQIR

SEQ ID NO: 934769 - protein, 152 aa, Homo sapiens
MQLGLCFGRLPLDAVWVVDWRGREKQQGDGEIDYCHCPGRRNESPAHSKGAAWVAMALEPVSSLNWAQSMHPEACPYSRTEPLDQASFTLEALVAFSTQTSATSQDLLQGPDLKSDLNSSRKLSLVFFPNLSLWSVPLCFLHVALTPLHFHH

SEQ ID NO: 934770 - protein, 139 aa, Homo sapiens
MDAELQITLTVEDTSTPSLATDHAPLTIPLKPHHPYPAQCQYPIPQHALKGLKPVITRLLQHGLLKPINSPYNSPILPVLKPDKPYKLVQDLRLINQIVLPIHPVLPNPYTLLSSIPASTTHYSVLDLKRAFFTIPLHP

SEQ ID NO: 934771 - protein, 166 aa, Homo sapiens
MRAHLLHQNNLDYGLIYLIFWALLLGATLPGSRQYLHLSFSSLNVLLISKVYFVPETQVKMNFPASMMMDGNSFLKFQLTSNRNGEFEFFLLLRLYRAVFSQGFILRSMTSETSQGNRGSCLNRFTGESKAALWTKLQTSQIKLILGTLCPQGISLWANLPSEQKI

SEQ ID NO: 934772 - protein, 144 aa, Homo sapiens
MGSGIKHGSLYPPSFWNSGKANQHSLKHGCRKTSKVGKPIDSAAFSLWPKAREPLANHWYTCCKCVHSSLRRYWSRTLSVLPEVLHPDSGYGRQLKHTEKSQDQTVLVLSKALDGPRTLKGCQWFSSSWFLHMSFIFQFVQYTD

SEQ ID NO: 934773 - protein, 137 aa, Homo sapiens
MWARVQRLESSRQDPIVDWLSNWHWRWPWWSVRDRQPTLEPRLLLPGLVKLPPWSEELDMREEKWTDDAKMYALEEKTKTYYEVFKNYIAITNFILINMKIDEMDTWKVVKLLKKKQKPSIDPQSGEKLMGSAGGKS

SEQ ID NO: 934774 - protein, 147 aa, Homo sapiens
MQDIVRDDDDSVDDSNDDSDGDGDDDNDGDVSGDDGDGDDDSDGDDADDADNYWDDDDDGDNGDDDGDDNSDVMVVMIMIMMAKMMMMIVVMMVMMMIVLMVVMIIIMMVVMRMMVMDDGGWLNSRKKSFIGDNWFANWEEIVSGVD

SEQ ID NO: 934775 - protein, 139 aa, Homo sapiens
MSLFIRLWSPNVSGIGGFLVSLTSRMKLRTVTVSVLQFLKMVCPEFVPSDVRTCPEFLPSGGFVVSLTAGVTLQTFEVSGTVHKDGASGVVRSSPWVRGLADFRSGAADLHVLQLIKAARTQRVSSSKFYCEEERTKPP

SEQ ID NO: 934776 - protein, 174 aa, Homo sapiens
MVEASTSLATAATSCKYGSMLGRAFWLCFCRRMHFCQQVLCWVCGMTYKPVDGAMGKSWLLPVLLAVYFILVYWEELSVAPGNGLKSRVHINLSSLSPRGRGIGGTRWVQPDREDSPSVVLLPVQVWENAGSVSLCLSPTKSPSLFSNELQGLGKTISSSARVAWISSGKGGLL

SEQ ID NO: 934777 - protein, 148 aa, Homo sapiens
MLDNSGKSGNPHCVLDRREKLFICSPFSTVLTVGWQVLLASRWIQRCCLGIRARSKSVKVYLVFYCAMAVAQTTRCSPSHSFHHCPKAEEHQSMANSNTGHGGLLPDYHQCSHKAQRLLSQFVVNAPVILKCFFFFLAGGGGGWSLAL

SEQ ID NO: 934778 - protein, 175 aa, Homo sapiens
MLLAVQLGQEAFATILLPNGADPNIMDFFGRTALHYAVYNEDTSMIEKLLLHGTNIEECSKAQIAFLQGERKGQENLKKDLVRRIKMLEYALKQKRVRYHVVRRPMNEPPGKKPWGPLGADGNPQLTARTRQGPPSYGFRTYPPKKPLADEDWEASTEMIETVQIRGECAQDMEN

SEQ ID NO: 934779 - protein, 138 aa, Homo sapiens
MVGLIYASTDGIMHWYLNECLESSTSLKWLAYPEQTVCPEGFLDPGVSCLGVAEELAHTWAWRVSAGFIEWKLSADGWGARRETEREGGFPLKWGRIRVTTWKMETQRACPAGMESLWKHTLLRRKATQTGFSHLFVL

SEQ ID NO: 934780 - protein, 138 aa, Homo sapiens
MADFNARELDPGCRRCTSPSGHIMLTPSLTQMDSLSSLHGVGWKCYSWCPSRCFKLQRLTSRPLSPCPPVQVISIEIVLAYTDLLITDFLMALAERLPDPNSPLIIITVYTCSGITGKEHLILLLSCVGSHTQANVLC

SEQ ID NO: 934781 - protein, 168 aa, Homo sapiens
MVEADCHGKLFIGGLNREANEKVLKEVFAKHGPLLEGRTSKSRDFVVIIFENAADAKNAARDMNGKEAAMRKSGENILGPEITAEVSRGAIPIKRGPSSRSGGPPPKTSAPSAMARSNSWMGGQDRGCHYIVKTDIKASGSSSPAVSAFHTDSHCELLSLTIQLLRPQ

SEQ ID NO: 934782 - protein, 204 aa, Homo sapiens
MLKGYNLSLGRILEVNKPHSDHSQGFCIFLGEKKIKEKILLFPHFSVKKPWSSRESHEVQIFSCYRPSGCTRAGHKGYDGLAWAQRPDTSFSVGPRREWLTFRMNLGSNCITLSLLYPGNSYWRPAACSHSIIVSDTACVEVFTDGHSTWVQGTTVESIGCVRGITAGDTAWAHGVTVEVPASVNGFTVGDSACVHRIMVSDSG

SEQ ID NO: 934783 - protein, 143 aa, Homo sapiens
MTLSVGAICFLPGSQLLLTDAQIILDVGDVINRSPVTQGAPLGELQPGGEISHFVTSCPYQAVQWYLMGYRTIPGTAHFRNHSKVITGNPTQRCCRPQEWFTNSEETYTSTNTACDSGSLNQLRRKLEVVKVTRHPNQEHENW

SEQ ID NO: 934784 - protein, 215 aa, Homo sapiens
MSPAEEIVKANAKQGSYSHSQTPENGECLVQMTTGFSQAETEFTESLDRAVSVFQADDEEDPSCSHRTESVNAGIQQPRREGDIEAWQLPVRIHAPGQQGNIITTFEPFPFKLLKEFKPAINQYGPGSSLVMVLLKNVAVPSQMIPTEWDALTGKAHLIDYIKACDGIRGNLHKATLVVQAMTGLKVGKGNTPFPGACFNCGKHGHTGKECEKNQ

SEQ ID NO: 934785 - protein, 130 aa, Homo sapiens
MNEVETVILSKLTQEQKSKHYLFSCISGNGTMRTQWGLSGSRGYGKVGCISLPLREMTAWINPPQISEIFQGYHQRVHGADALSLQTNSLRSRLSSQNSISTIENTVSDELDDRSKMRNKIVRGAIILTY

SEQ ID NO: 934786 - protein, 152 aa, Homo sapiens
MGLANHQFHLEAEERNIFLEHTGLLVYGSGSSAAGLLEFAGGPLHSLFACVSAAEAVEQRMLLNSKCCCLIIPLFLTSLRWVQASCFNSEKFDHLKPSSFILSKSFCVQLCSIADEELHSFGVGEALDFSNFQLLCSVFSPSFWFLSTFGLC

SEQ ID NO: 934787 - protein, 138 aa, Homo sapiens
MGKDKLAKLGSGSMFMTKRVQKSKDCCLFLPLKVSSHRGTCQVPARALLYEVSVDPCREESPSQEAWASWTHLRKVNCHCPQLTGMQGSLCPQHRSRISAPNPDDQDVLDGHKTCPTEDAPLFPHSTGSMYQQVGIEQ

SEQ ID NO: 934788 - protein, 144 aa, Homo sapiens
MWKNKDGPGVQNYRMRFQVETGNQRQCAAIGWSHGNEQEVHVHNVQVELMSPFPRTAESVFLLLSPGTLPSFVGNLHKSLSIKKILDDFDCGAHLLSAWIPVAAARCTDYIRSWVCHQKQIICHVLKMVYQFQQIQLGHANSLL

SEQ ID NO: 934789 - protein, 143 aa, Homo sapiens
MVRISVLLAWGSGPSTVQNCLGQYSHILSTYSSHTVHQLLDLLLVEEKLRNKTSSFWLFPGEHAQCLGNPWTLEESSDSVIISYYRMKRMGVNSEMKTKTKKICSKTWLCIATKDPTTNVINIPKETFTEIIMPKALQAQCIS

SEQ ID NO: 934790 - protein, 199 aa, Homo sapiens
MVRISEKLRNKTSSFWLFPGEHAQCLGNPWTLEESSDSVIISYYRMKRMGVNSEMKTKTKKICSKTWCLSKFLMSSHQHCPRSLCKDFFKVLSADVLSQEVKFLISHFSWPSHSCLFNQKPIRCCYGNEGGKHFPVWDFWHHKGCWLLDFHTPQTSDWTTFRLDQWWIQNSYPADLFADIFYHPITFPVPLRRELGRET

SEQ ID NO: 934791 - protein, 158 aa, Homo sapiens
MLKRAAAHLKACPCLNPATFYQGKLEKMNMIVNSSFVLVIPISHGFIYLGYFMPMVFGLGFCMSALFVDVDQSGISSAGLLEFARGLLQMLLYWGISWSVGCKNPVKSAGYGLDDTAPDGFPWLWEEVSSPLRFLGEATITLLLLAFCGPHSMSNQSQ

SEQ ID NO: 934792 - protein, 136 aa, Homo sapiens
MLVDEVFSVSTDGSLGRSIGCRIGKRISSVSTLRNGAIWTDQCWTLLLANGACSSGHSQVSFVWNTKIRGQLWPFRVHRLRGSRCHDCDTLLGALHFLASPSFWAPLRFTVSAVDAACSMPGPAAASQNENIKYTI

SEQ ID NO: 934793 - protein, 136 aa, Homo sapiens
MAGYSSEAKLPEEQSASNICCSPISAVLQAPPLIPRETGSGVDLQQTPTDLQLRVLTVRRKTNKQKGHPHQNPICMSPSSKTKEDLDHYEMKEEPTSEKKLEDEGTEKENWAILEKIRKTERQGHLNVCINIWTFW

SEQ ID NO: 934794 - protein, 135 aa, Homo sapiens
MCREYSKSNITSEVRLQRDYDACLGHPSPALSIAPSDGSQLPCDEVPYGEAHMTRSFVSPPFCWFYTNFKACEDEVVCDSYHKGYYKQTNFQQVYHHYHPHHKTVSSKGNTIEGSQFTGFHQALRDLFVLSMTSS

SEQ ID NO: 934795 - protein, 209 aa, Homo sapiens
MSSNPLAQGHLLLGEPYPTATRPDREGTLPEPKWWSYKGWLAGVVARGPSGPSENPGSSEGPWGRHGGQPILFKEKLTMKMDSLVEEKLECSLWCCLSDPSSLVAAVFWKGALYPGCGRLYNLPKHLDVAMPDQPLPMGQSGPSAAGLLEFTGGPLQTLFAWVSAALAAEKQILVNCKCCCLIVPLEVLSQRSTWQYEVSVCPYWGGAS

SEQ ID NO: 934796 - protein, 150 aa, Homo sapiens
MTHTNQLKSINAPQGGFLLSQNKTNVQSGFTRRHSIPRGIQEMEAFLLLILLNTDPLWVSDWKTVRSFLSHKAISQTISVGKNLGQYLDFLGQRSLKLSAVYCAPDTRLPFPWSSQTFCGILSKPLVLSGPLQTQGALPTCSALLLSATS

SEQ ID NO: 934797 - protein, 153 aa, Homo sapiens
MSLTLTLQGYTLSLWTTADKEKHLDSPGSLVWEEERVEIWAESEDTWILSSDPELSAFTINTTEPGSPFKSTSPYKQEELCEYFLVNDLVIHQPNFLDNIIFIAMRKMMREIKWLTQSHPESGYETVPSGSRDHMVDNGRNNQYQDEKMRVIL

SEQ ID NO: 934798 - protein, 204 aa, Homo sapiens
MPIPWGIGCCMISITMDPTTLLHPADIMTLRPLGGQEGMSARTQDTEMQGILDPWAKGSLMQDSSQPHDMQIQAVKFVMHDVCRSYFQGGSTDIDFSPEQAREKVVQTACFLLLHCQSRTSFFQEEPARQISCCGKAEKKARRPERGSLSHLYFTKNLSRENSRRDLLLEQACEASLLCLVTEGECYLFHSGFQRSNCLIFSGE

SEQ ID NO: 934799 - protein, 326 aa, Homo sapiens
MIYLCTHHLGDMTLLSCPDTLHNMPTKIIVTYFCVHLIGDVTFLSGMGPAQRKAHHFGDMTLLTCLDIVHKRHYAIELGLAPKFSDFSITEEIVPYVEQASEQYVTHPLALSMKGTITYHWDHYPDDANYLPENCLPRELCLICDVTLFFGMGPARRKDSDILQCQSHSKHKIVHTGEKPHIHEECGKAFTRSSTLINHKRIRMEERPYKYKECGKTFKCFSDLTSHKTIHTGEKPHKCEECGKALSSFSHLIRHKITHIERSSTSVQNVEKPSISHQSLGAVSPGWKICAFSQVRGSLSGEEHWGVCEPHGGWSNLLSLGIMQLV

SEQ ID NO: 934800 - protein, 146 aa, Homo sapiens
MKTSQDPPGEGDLNHQAPEELLGGEVVSRHFSVVSATHSLYADGIPPFRQQIPPSVAPMGESPWGENSEEIRTRASPWCAVGVWLLSCLGLVQALRVRKHTASRPKAHPVWSNTVKQREKNLLDSMQMQQLPVALGVARLAGFLKA

SEQ ID NO: 934801 - protein, 165 aa, Homo sapiens
MLIPYLVLEQLHCAQKKKKSYSCVEHGWLNSWLTRWGQKDKCGAEFRSFDRVNGSGISPWLLSSKFSVVLFSIPHQTPGLFGAAWTGALLASGKLLAGLRMEIPEEKKKEEEEEEEGEEEEKEAEEEEEEGEEEEEEEAEEEEEEEEEEEERKACFSGYSQEVGV

SEQ ID NO: 934802 - protein, 149 aa, Homo sapiens
MLCARHVQPRPLVVNPPPPPQFQNVWRNPNTETYLQPQITPNPVTQHVQIPLHWPVGAQRSYVVPPAFPAYPNSPFQVATGYQFPVYNYQAFPAYPNSPVQVTTGYQLPVYNYQAFPAYPNSPFQVATGYQFPVYNYQVFMCLSNGRST

SEQ ID NO: 934803 - protein, 165 aa, Homo sapiens
MVRSVDVQGVDRGAQKKKKSYSCVEHGWLNSWLTRWGQKDKCGAEFRSFDRVNGSGISPWLLSSKFSVVLFSIPHQTPGLFGAAWTGALLASGKLLAGLRMEIPEEKKKEEEEEEEGEEEEKEAEEEEEEGEEEEEEEAEEEEEEEEEEEERKACFSGYSQEVGV

SEQ ID NO: 934804 - protein, 159 aa, Homo sapiens
MWLYSFPWVSSCNIKLVGSEFIPVLDKSIKFKKEPRKEQLERDFPLCGALGGENTAGEEDSTTWAQLSLKTLNPVNTGQAVALVHLGLRRSSDQISSNYPSFHSGEPKIGFYLPLEWGGPGAPTKEAVVGLSSHEFCAYAHKDKGSSSSRHARKAYGSQ

SEQ ID NO: 934805 - protein, 152 aa, Homo sapiens
MQDWYLCTTCRFVTYVYMCHVCVLHPLTRHLALAKPVNLINKAKLLSCAQTSLNIKKVLVETSAENVKNVAKTFHPREMQCCYQWLAGILSQYILPCEALRKCVLQTINAKRPEFCLFPMDMFKIVTSCFAGVPANFSGKAGKNYESDFDKM

SEQ ID NO: 934806 - protein, 150 aa, Homo sapiens
MPHCCHSIIYLTKIQGFVGKIGPNGLGCIARVGLLMPECFPSERENGPLFLFVCFSTCPRTHNGSWTLLIRIVVLTDAAAETLVFLLDHNKTCSLACPPRPQRGLRKIGFRSLSHSSLFLYSFPHEGGSHTSFTDCLTQWAPTADLAMGE

SEQ ID NO: 934807 - protein, 191 aa, Homo sapiens
MDDERFEGGYVKEFKEDMKTGDGSSIERDQSSQLELAQNQKEFSTVGERKTAFAILDAENPLGPVRTDPKPNNRDLPDVHTTTLSQRGNSCKTRCPQRPTLLVHGPVLRVILSKRLSRTYIREPFAQGSNIPCISVSWVLADMPSCPPRGLSVMMSAGCSNVVGSMVMEIMQHPIPQGIGIPAYLSGCVKT

SEQ ID NO: 934808 - protein, 148 aa, Homo sapiens
MPPGQRLFPTGQIAWSQIDKKEKNKIAITPLTLKGMALLSIHYVPATAVGTLCVLSHDIHHHSNPNEAAAVIVSTLHVKRRLVFHVSAPVASTVQQASGLLGLLPHLSSLALQPERSLLPPLGSHGAEVSKKMALRSQTAVEEYPGLG

SEQ ID NO: 934809 - protein, 138 aa, Homo sapiens
MMREIKWLTQSHPESGYETVPSGSRDHMVDNGRNNQYQDEKNPSKPQLSFAAWRIQMDKCLHRKGGFDVPLTSLEVTYVDTLCGLRDLMGPVAQRVGSMNFTVWSPANPHGILSWGCEDTVGYQGPVCASLIPGRPGP

SEQ ID NO: 934810 - protein, 159 aa, Homo sapiens
MEAFLLLILLNTDPLWVSDWKTVRSFLSHKAISQTISVGKNLGQYLDFLGQRSLKLSAVYCAPDTRLPFPWSSQTFCGILSKPLVLSGPLQTQGLVPDLHPVIISCHLAPYGVLQGTLRPRRDHWLRPLSEVWRPSICPRASSPPPFLQAPVSATVPWR

SEQ ID NO: 934811 - protein, 145 aa, Homo sapiens
MTVSASGPLTFRGLNEIIRGNIRHVAHLADGGWLPLLFHQSLVYSLNAGKKDGWSKGPRPGQATEPHGALATLLMGQESGSQPPHALMPRVFRQVKLKSQEAPSLRQQQDQYLCTALGALIPQELGELFISSICGLPSSARSITL

SEQ ID NO: 934812 - protein, 136 aa, Homo sapiens
MVIELRPNSCNSASASLDKPATGLSPKPIAPNEEFPWRYSKEIIFEICYDGRYTECAYQESALYPLKARNNTVKLCLARVFERMAYSALILLLWKYEGEKNSKLKFPVECNLKIWPMIALFFSSKVGHSDLLGVLL

SEQ ID NO: 934813 - protein, 140 aa, Homo sapiens
MYTFFTVHEVLLWFPSVILFVITFPPNQILCIPIFILSFVNNSFNLKLLGSHEERHGIGTVAVPPLFQLRLHIDTSFCLQLFTRFCVWMNLFYFVTTGVVKIVRNSSYAMCLNLSILTAWWDSLGFVSWCMTTCSVASGS

SEQ ID NO: 934814 - protein, 182 aa, Homo sapiens
MPQNHEERRLTCLIENLFGTVRLRVLSTLAPHLGQRHVSEARDSPSSWPCSLDWAVNSAHSGASEAAWEAASDWRKLAPDDSGIHNCPSSGTSRNEVLLIVLNTPFPARPLRVSPETSDLFSSGSSAAGLLEFAGGPLHSLFACVSAAEAVEQRMLLNSKCCCLIIPLYQLELMDDYIIRTN

SEQ ID NO: 934815 - protein, 150 aa, Homo sapiens
MRIKPPSLLDMSRSGRCYKSPGATTRVRIKTSPQDPPRRVHGIETSGGQEVKQFWNALDQKEGSIQMAVVGGGTGENSISTIENTVSDELDDRSKMRNKIVRSDRSHHAGIKTLVAFLLVECPYGTFANTWLIVTNKQQQQQKVKFSSLY

SEQ ID NO: 934816 - protein, 137 aa, Homo sapiens
MTRAWFDSLLYDQPQGNCPAETGSRSGLTEWFPKRIYSGISKIKLLKIPCLFKMKYFGPKRKEPGCLLIPETKDKAPTLVGIKGQERPMGGTGGFYWAFETNKSHLPMRLTRLKLVQITSNQCPCVVVYFSNRWYKN

SEQ ID NO: 934817 - protein, 152 aa, Homo sapiens
MGFLAGNSAWFQVITGVYFAWVHSLTVPGRGYNQKLIAGDFVCVHIMTVSARASLLGIITRDTAMYCSVTIPGTATVKGFIAGNRSWAHDVFTDGHSTWVQGTTVESIGCVRGITAGDTAWAHGVTVEVPASIFGKNKRFGSNLNVHQQIKR

SEQ ID NO: 934818 - protein, 225 aa, Homo sapiens
MVEADCHGKLFIGGLNREANEKVLKEVFAKHGPLLEVLLIKGRTSKSRDFVVIIFENAADAKNAARDMNGKSLDGKEIKVEQAKKPSFPSGGRRRPPPSSRNRSPSGSLRSARGSSGGTRPWLPSHEGHLDDGGYALDLNTSSSRGAIPIKRGPSSRSGGPPPKTSAPSAMARSNSWMGGQDRGCHYIVKTDIKASGSSSPAVSAFHTDSHCELLSLTIQLLRPQ

SEQ ID NO: 934819 - protein, 139 aa, Homo sapiens [sequence omitted]

SEQ ID NO: 934820 - protein, 173 aa, Homo sapiens
MAWLGSNLVPELKELTQLNYTIAFIHTHTDQCLVCTTHPYVFLTGTNISITPGNATFVTRVQGQAWFASCITGHDMSSLKTSSVVVLRRQSEALLPANLTCNWQDSSALATLESALSQVRHKRFTFTLMVFTGSAIVIMATVSIAVVSITESVQTTAFVDNLAKNICDELLLQ

SEQ ID NO: 934821 - protein, 160 aa, Homo sapiens
MHVHPDPPSHTRIAEEVCGLKVAKWPLTGCCVQQYHSIPHVEKVSQGIRAKTPTEWDEDMSKYPLWLWHRQDSSIIRLLGPPVCNNSLFIQCRSRSVTSSVCKSSKFFFVGTVQIKTGESHDLNAVLSNMSQFHHLKGPGRERESCQLGYGLRDMSQCPH

SEQ ID NO: 934822 - protein, 139 aa, Homo sapiens
MAGPLNDRPYHQRKAFPAYPNSAVQVTTGYQFHVYNYQAHLAFSVTGRFCCFQKPPASLSVARPRPDCLFISVPMDPTNIIQGPDCSSPFPEQDHTHFTPPGHYDMLNKTLKLWFTVTRLRLRFKRQNCQLGALFSLSF

SEQ ID NO: 934823 - protein, 142 aa, Homo sapiens
MWPFDLVIWEVTGQEKMTLSVGAICFLPGSQLLLTDAQIILDVGDVINRMPQQSPTESRHSLSNPPDQKFRSPVTQGAPLGELQPGGEISHFVTSCPYQAVQWYLMGYRTIPGTAHFRNHSKVLGPKAGHIPQGPKGSLITS

SEQ ID NO: 934824 - protein, 217 aa, Homo sapiens
MEMSPAEEIVKANAKQGSYSHSQTPENGECLVQMTTGFSQAETEFTESLDRAVSVFQADDEEDPSCSHRTESVNAGIQQPRREGDIEAWQLPVRIHAPGQQGNIITTFEPFPFKLLKEFKPAINQYGPGSSLVMVPLKNVAVPSQMIPTEWDALTGKAHLIDYIKACDGIRGNLHKATLVVQAMTGLKVGKGNTPFPGACFNCGKHGHTGKECEKNQ

SEQ ID NO: 934825 - protein, 155 aa, Homo sapiens
MVPSTPDRDRGPGREGALPHTLRALAKLQGVSLHAHPIIRRLLDQRQIVRHTEMLAGITNDDEVLLSYVRDGFAGKGRKATLPGTGSRMKFSFYHSLYFHNEVIIQEYCLGILASSCRPYSSYLTFFSWLADHDCPGSGRIAEEPPTSTSRSLTP

SEQ ID NO: 934826 - protein, 121 aa, Homo sapiens
MVPSTPDRDRGPGREGALPHTLRALAKLQGVSLHAHPIIRRLLDQRQIVRHTEMLAGITNDDEVLLSYVRDGFAGKGRKATLPGTGSRMKFSFYHSLYFHNEVIIQEYCLGILAAGRTAPT

SEQ ID NO: 934827 - protein, 153 aa, Homo sapiens
MPFKFLLAPPSKLPSYLQDPGLSSLRYPPSPASWLSPCAPCLAPLLPTPRSQMPTPCCQSFRMGSCKDVPLAQKLEMPWLMAPAPCQASPQPPPGPCHDVVHHQHLLLPQECLRTLRPGCPLLQSLQFEWGASFGGPTDHDLHCPLTVHSTSR

SEQ ID NO: 934828 - protein, 461 aa, Homo sapiens
MSQLVLSAKPREELHHVGDQCRDMSKCPCEQSLDKIYITWVISAETCYNVHKGMECNGVKWNGMEWSGVEWNAMEWSGVEWNGVEWNGMEWSGVEWNGEEWSGVEWNAIEWNVMEGNGMEGNGMEWNGMKWNGVEWRGVEWNGIEWNGVEKSGMECGGMKWSGVDWSRVEWNAVEWNGVLGDTVISCRKKGMECNGVKWNGMKGSGVEWSGAEWSGMQWNGMEWSGMEWHGMEWSGMEWNGEEWSGVEWNAMECNNGTVSNGMESNGMQSSGMEWTRMERNGIKRNGNGMDSNGMDWNGRQSNGMESNGMESNVMDWNGMDSNGMDSNGMNLMEWNGMDWNGKELNRIKCYGIKWKETEWNGMDSKGMEWNGMTWNGMEWNGMTWNGMEWIRKEWNGMDSKGMDWNGMESNGIECNGMQWNGLEWNGMERNGMDWNEMELNGMEWTGMEWTQMEWNRKEWN

SEQ ID NO: 934829 - protein, 314 aa, Homo sapiens
MESNGMESNGMYWNGMDCNVMEGKNGIEQIGTERNGMEWKGQKWNGVEWNGIKWNGLELSGNERNRMEWSVTEIYRMEWNGVESNVMELNGLEESDGTEWNGNRTEFNGMECIGIDLNGLLSTVMEPNGMESNGMEVNGIERNRMEWNNGIVSNGMNWNGMDSNGMDRSGMDSNGMEMNGMEWNGMEWNGMEWNGMQWNGKDYHGMESDEKKLNGMELNGMASNGMEWNDSNGMDSNGVEFCGIQSRGMEGNGMVWTQMEWNRIEWTQIQCTRKERSQMEFIRNEWNQMECNSMEWNRKELTRMEWTRTERTRM

SEQ ID NO: 934830 - protein, 327 aa, Homo sapiens
MEWNGMEWNGMEWNRPKKWNAMEWNGVKSSGTELNGIESNGLELIGIDRNAMDLNGIYWNKMESNGLELNETEWNQIYRIQWNGMEWTRMEWNGMDSNGMEWNGLEWNGLEWNGLEWNGKEWNGMEWNGMEWNGMEWNGMEMNGMEWNRMELNGMEWKWNGIKWNGTEGSVKARYRMEWNGMEWNGMEWNGIDSNGMDWNGMDYNGMARSGMDSSGIDWNGIDLNGTEWSGMESKEIELNGMQSNGMECNGLEWNGLAWNRIEWNGMEWNGIEWNAINAKEWNQVEWNGMEWNGMEWNGMEGNGPKWNGFEWNVTDEWNGIECNRNE

SEQ ID NO: 934831 - protein, 252 aa, Homo sapiens
MRQKCVSHSSRDSEVQGQVVCPGVTVSAAYGWSHNPVLLEVGTAFAFGKNKMQKVGLGRQTDAVPSPAQKMWPVELTTCWSWTPRSTSSSDTGWLLLAGPCGAEKRDGPPPTSGLAFLEWGPQIYAGYAWSFAVSEEGDVFFWEATNTSHESIMYLKAVLNIQGTHKPTSPTAVQDMKTLHGVFSEQAAMGYSRSLVMAALSPRIQAFQAHDCLTLPGEIELSESNDNTFDEEAVHTASSPSHPWFRNGAYR

SEQ ID NO: 934832 - protein, 130 aa, Homo sapiens
MGFPGCVVLRILLQQTLWALFQLLCCSYHLSKQLSLPTQVSVVVKGSPPARIPEAYGIRLTMGEAEILIYSVDTLTSKALAKAQESPRSDASGNEVEVKVEALVDGGAQSENKSHTLILHSSTSIDNAKN

SEQ ID NO: 934833 - protein, 126 aa, Homo sapiens
MLPLRAVTLTAKVCSFTPEASETTNPQEGNYSEHVRTSEGTNFRHTILRKVTLTGRFCGFVLKVRETKNPPILDTVSQNTMDGVDYKQQTLFSHSAGGWKSGIKLALIPFRRLFLNLQSKNFNIEF

SEQ ID NO: 934834 - protein, 217 aa, Homo sapiens
MAHGPGVSADPNSWELAPPIPDAMSSKGSMVLAHSGGLDTSCMLVWLKEQGHVVIAYLANIGQKEDFEKDRKKACKLGAKKVFIEEVSREFVEEFIWPAIQSSALYEDYYLLGTSLARLCIAHKQVEITQQEGAKMPEFYYWLNGCNDLMEYTKQHRIPIPVTLKNPWIMDENLMCISYEAGILEKHKYHKHLQIEFKKEVPVKVTNVKDGATHQTS

SEQ ID NO: 934835 - protein, 1632 aa, Homo sapiens
MCFSPKKLYKHEIHKLKDLTCLKPSIESPLRQNRSRSIEEEQKQEENGDSQLILEKIQLPQWSISLNMTDEHGNLVNLVCDIKKPMDVYKIHLNQTDPPDIDINAMVALDFEYPMTQENYENLWKLIAYYSEVPMKLHRELMLSKHPRVSYQYRQDADEEALYYTGVRAQILAEPEWIMQPSIDIQLNRPQSTAKKVLLSYYNQYSQTIATKDTRQARGRSWVMIEPSRAVQKDQTVLEGGRCQLSCNVKASESPSIFWVLPDGSILKVPVDDPDSKFSILSSGWLRIKSMEPSDSGLYQCIAQVRDEMDRMVYRVLVQSPSTQPAEKDTVTIGKNPGEPVMLPCNALAIPEAHLSWILPNRRIINDLANTSHVYMLPNGTLSIPKVQVSDSGYHRCVAVNQHGADHITMREDIVEDEGVSGTGDEENTSRRLLHPKHQEAFLKTKDDAINGDKKAKKGRRKLKLWKHSEKEPETSVAEDLRVFESRRRINVANKQINPEHWADILAKVFGKNLPTGTEVSPIIKTTSSPFLSLVVTPPLPAVSPPLASPIQTATSAEESSADVPLLSEGKHILSTISSASMGLEHHNNGVILVEPEVTSTPLEEVVDEYSKKTEEMTSTEGDLKGTAASTLISEPYEQSPTLHTLDTVYEEPTHEETETEGWSAADVGSSPDPTSSEYELPLVVVSLAESKPVQYFDPDLETNSQPHEDNIKEYSFAHLTPTAIIWFNDSSTSLSFEDSTVGEQGVPGKSHLQGPTENIQLVKSSFSTQDTLLIKKGMKEMSQTLQGGNMLEGDPTHSRSSENEGQESKSITLPDSTLGITSSTSPVKKPAETTVVTLLHKDTTTETTPRQKVASSSTMSTHPSRRRPNGRKLHPHKFHHRHKQTPPTTFAPLETFSTQPTQATDIKISNQMESSLVPTSWEINTVNTPKQLEMEKNVELISKGTPRRKHGKRPNKHRYTPSTVSSRASASKPSPSPENKHRNIVTPSSETTLLPRNVSLKTEGVYDSLDYTTTTRKIHSSHHKVQDTLPVMYKPTSDGKEIQDDVATNVDKHKSDILVPGESITNVTQTSRSLVSTMGEFKEESSPVGFPGIPTWNPSRKAQPGRLQTDIHVTTSGETPTDPPLVNELEDVDFTSEFLSSVTVSTPFHQEEAGFSTILSSIKVEMASSQVETTTLGQDHHETTVAILHSETRPQNHILTAAWMKEPASLSPPMILLSLGQTTTTKPELLSPRTSQICKDSKENVFLNYMGNPETEATPVKNEGTQRMSGPNELSTPSSDHDAFNLSTKLELEKQVFDSRSLTRGPDSHHQDGRVHASHQLTRIPAKPILPTGTVRLPEMSTQSTSRYFVTFQPPHHGTNKPEITTYPSRALPESKQFTTPRVASTTPLLSHMSKPSISSKFADLRTDQSNGSYKVFGNSNIPEARNSVGKPLSPRIYHYSNGRLPFFTNRTLSFSQLGVTRRPQIPSSPVPVMRERKVNPGSYNRIYSHSTFHLDFGLPAPPLLHTPWTMVSPPTNLQNIPMVSSTQSSVSFITSSVQSSGSIHQSGSKFFAGGPPASKFWPLGEKPQILTKSPQTVSVTAETDAVFPCEAIGKPKPFVTWTKVSTCKIFKHLLFFGSIFILLASNITIH

SEQ ID NO: 934836 - protein, 162 aa, Homo sapiens
MRHDSSSSSSSSPSSSSSSSSFLLSSSSSSSSSSPSSPSSSSFLLPLLLLFFLSFSFFFFLLLPLLSSSFLLSSSSPSSSSSSSSSSSSSSSSSSFFSLPLPILLLLSSSSSSSSSSSSSFFNLCRDGICYVAKYDLEHLTSSSPPALTYQSAEMTGLSHRA

SEQ ID NO: 934837 - protein, 133 aa, Homo sapiens
MPGFGEKGVLFLGSTLGRRDSSFYGALDENGTEILKMVVEGVYADSSSFQGGTGFSRSKFPSICDSLKPAGGKTGSHSVTQTGQSQLTEASTFWAQVILLSQPPKEDECSQIVKTSMKHEQEKNKEIIFFWEE

SEQ ID NO: 934838 - protein, 118 aa, Homo sapiens
MEPWSITQAEIQSPLVFMSLVCALLNTCQAHRVHDNKPNIILIMVDNLGIGDLGCYGNDTISEVWIRTMYSDQIRVISASSVSTINEDGQSKSVAVRTQVLALYLLPLKSWRKKALYP

SEQ ID NO: 934839 - protein, 138 aa, Homo sapiens
MCDCRLQKTKRRSTDGNRANPPGQKRNPSFTDPSSNCADSYRMRFTCVLTSHNKAGKKHLQGEVKTAAPLTQIPNPDPVLLHPRLSSGTPTWFWPYKTLQSLLLAKLLLPESARDPRISYSFSIASNNIQHRGRVRPE

SEQ ID NO: 934840 - protein, 151 aa, Homo sapiens
MGRRQPRCRPQAWKSTRLPKDGASVLRVRDEDLFPPTAPGRRSAGPRPLRAAPRTMSGSHSVTQAGVEWYNHSSLQPQTPRLKYPPTSASQVAVTTVTDQAFVTLATDDIYCQGALVLGQSLRRHRLTRKLVVLITPQVSSLLRVSLVAQA

SEQ ID NO: 934841 - protein, 146 aa, Homo sapiens
MQSSKNLLIYICCKRSLLDTFLDILSTKAAVCADLGIDATVTLAVARMTVAETKKALSPQPVAAAGWADLPTYTSCPSLGDQFQPTEPSCPMPPLPRRLSSQEYLLAPGPLPHCLLLFAINLAAAHFLATLYFYELMIFFNTYSLF

SEQ ID NO: 934842 - protein, 427 aa, Homo sapiens
MALLTSRMKLQTFTVHGLAHFKKEAEDLYDVFRVSSFWQVHGLAHFKNEAADLYDVSGLSSFWQVHGLSHFKNEAADLSDVSGVSSVWQVHGLAHFKNEAADLSNVSRYSSFWQVHGLAHFKNEAADLSDVSRVSSFWQVHGLADFKNKAADLYDVSRVNSFWQAHGPAHLKNEAADLTDVTGVSFFWQVHGLAHLKNEAADLSDVSGVSSVWQVHGLAHFKNEAADLSDVSRYSSFWQVHGLTHFKNEAADLSDVSRVSSFWQVHGLADFKNKAADLYDVSGVSSVWQIHGLAHFKNEAADLSDVSRYSSFWQVHGLAHFKNEAADLSGESHSTEKVLCPEFVHSDVSGVSSFWQVYGLVLFKNEAAEISDVSRVSSFWQVHGLADFKNKAADLYDVSRVNSFWQAHGPAHLKNEAADLTGECYRT

SEQ ID NO: 934843 - protein, 930 aa, Homo sapiens
MKMQTVTVSVTAYKGVVDGVWSFRCIQSFFFEQVHGLAQFKNKAADLGDISRVSSIWQVHGLGHFKNETADLSDVSRVSSFWQVHGLAHFKNEAADIYDVSRVSSFWQVHGLAHFKNEAADLGDVSGVSSIWQVQGLAHFKSEAAEFSDVSRVSFFSQVHGLVQFKIESPDLYDISRVSSISHVHGLGHFKNEAADLSDVSRVSSFWQVHGLAHFKNEAAELYDVFRVSSFWQVHGLAHFKNEAADLSDVSRVSSFWQVRGLAHFKNEAADLSYKSRDSSFWQVHGLAHFKNETADPYDVSRVSSFWQVLGLAHFKNEAADLSEALDSDVFGVSSVWQVHGLAHFKNEAADLSNVSRVSSFWQVHGLAHFKNETADLDDVSRISSFWQVHGLPYFKNEAADLYDVSRVSSFWQVHGLAHFKNEAAEFDDVSRVSSFWQVHGLAHFKNQAADLSDVYRVSSFWQVHGLAHFQNEAADLYDVSRVSSFWQVHGLAQFKNEAADLYDVSRVSSFWLVHDLPHFNNEAADLSDVSRVSSFWQIHGLAHFKNETADPYGECYSTETCHVQSLFLQICPEFLPSGRFMVLLTSRMKLHTFMVHGLTAFKNEAADLGDVSRVSSFWQVHGLVLFKNEAADLSDVSGISSFGQVHGHAHFNNEAEDLGGECYSSYSCYVHGLAHFKNEAADLSGECHSTLRCYVQSLFIQMCPEFLPSGRFIVLLTSRKKLQTFRVHGLAHFKNEAADLSDMSRVSSFWQVHGLVLFKNEAADLSEFVPSDVSRVSSFWQVHGLAHFKDDAADLSDVSRVSVFWQVHGLAHFKNEAADLSGMKLQTLAICPEFLPSGWFMVFLTSRMKLQTLVVHGLSHFKYEAADLGDVSRFSFFLQFHGLAHFKNEAPDHEPARRKKLRTHLNEQSLDITPLSAATLTTNVCSFIL

SEQ ID NO: 934844 - protein, 4261 aa, Homo sapiens
MCPEFLPSGRFMVLLNSGMKLQTLVMCPDFFPSGMFMVLLTSRNKEDAELYDVYRVSSFRHVHDLAHFKNEAAEVSYVSGVSSVWQIHRLAHFKNGAADRSDVTGVSFFWQLHGLAHLKNEAADLSDVCRVSSFWQVHGRAHFKNEAADLYDVSRVSSFWQVHGLAHFKNEAADLYDVSRVSSFWQVHGLAHFKNEAADLSGVSRVSSFSRFMVLLTSRMKLQTLVKCPEFLPSDKFMVLLTSRMKLQTFTVSVTALMVLCTEFVPSDVSRVSSFWQVHCLAHFKNEAADLSDVSRVSSFWQVHRVAHFKNEAADLSDVSRVSSFWQVHGLAHFKNDAADLYDVSRVSSFWQVHGLAHFKNEAADLSDKSRDSSFWQVHGLAHFKNETADPYDVSRVSSFWQVHGLAHFKNEAADLSDVSRVSSFWQVHGLAHFKNEDADLYDKSRVSSFWQVHGLAHFKNEAADLSDKSRDSSFRQVHGLAHFKNETADPYGMKLQTLAVSVTALKGFMSRVVPSDVSRVSSFWQVHGLALFKDEAADFSDVSKVSSIWQVHRHAHFKSEAAEFSASSWSCSVQERMKLQTLVVHGLAHFKNEPADLGRECYSTYRCYVPSLFHQMCPEFLPFGRYMVLLISRMTLQILVMCAEFLPSGRFMVLLTSRMKLQTLVVHGLAHFKNEPADLGRECYSTYRCYVPSLFHQMCPEFLPFGRYMVLLISRMTLQILVMCLEFLPSGRFMVLLNSGMKLQTLVMCPKFLQSGRFMVLLTSRMKLQTFRVHGLAHFKNEAADLYDVSRVSSFWQVHGLAHFKNEAADLSDVSRVSSFWQVHGLAQFKIEAADLSDVSRVSSFWQIHGPGHFKNETADHYHVSRVSSFWQVQGLANFKNEAADIYAECYNVSRISSFWQFHGLAPFKNEAADISDVARVSSFWQVHGLAHFKNEAADLCDVSRVSSFWQVHVLAHFKNEAADLGDVSRVSSFWQVHGLAHFKNETGDHYDISRVSSIWQDHGLGHFKNEAADLSDVARVSSFWEVHGLAHFKNEAADLGEFLPSGRFMVLLTSRMKLQTLVVIVTAVKGVCPEFVPSDVYRVSSFWQVDGLAHFKNEAADLYDVARVSSFWQVHGLAHFKNEAADLGDVSRVSSIWQVHGLAHFKNEAADLSDVSRVSSFWQVHGLAHFKNETADDYDISRVSSIWQDHGLGHFKNEAADLSDVSRVSSFWQVHGLAHFKNEAAELYDVSGVSSIWQVHGLAHFKSEAAEFSGSRSCSLQERMKMQTFTVSVTAYKVVMYGFSPSDLSRVSSFGHVHGIAHFKNKAADIGVHGLVHFKNEAADLSDVSRYSSFWQVHGVAHFKKELRCKPLRFMVLLTSRKNEAAHLYCECYSIERCYIESLVLQMCPEFLSSGRFMVLLNTRMKLQTLVLSVTTLKGVMSQSLFHADLHRVSSLWQVHGLAHFKNEAADLSEFLPFGKFVVLLTSRMKLQALVHRLAHFKNEAADLSDLSTVSSFWQVHGLALFKNEAADLGDECCSTYRRYVASLFHQMCPEFLPFGRFMVLLTSRMKLQTSVMCPEFLPSGRFMVLLTSRMKLQTLVVHGLPHFKNEAADLSDVSRVSSFWQVHGLVLFKNEAADLSVLQHITVLSPEFGPSDVSRIFSYGLVQGLAHFKNEAADLGDVSRVSSFWQVHCLAHFKNEAADLGDFVPSIVYRVSSFWQFHGIAHFKNEAADLSDISRVSSFWQVHGLAQFKNETADLPVHGLAHFKNEAADLGDVSRDSFFWLVHGLAHFQNEVPDLIDVSRVSSFWQAHGLAHFKNEAADLSDVSRVSSIWQVHGLAHFKNEAADLSDVSRVSSFWQVHGLAHFKNEAADLSDILPSGRFMVLLTSTMNEAADLYEFLPSGRFMVLLTSRMKLQTFRVHRLPHFKNEAVDLYDVSRVSSFWQVHGLAPFKNEAADLSDVSRFSSIWQVHGLAHFKSEAAEFSERMKLQTFKMCPKFLPSGRFMALLTSKNDAADLSGEVHGIADFKNLAADLSDVSRISSFWLVHGLVLFKNEAADLIDMSRVSSFWQVHGLAQFKNEAADLSGECYSTLRCYVQSLFLQMCPEFLPTGTFMVLLTSRKKLQTLVMCEEFLPSGRFMVLLTSRMKLQTLVVHGLAHLKNEAADLGVECYSILRCYVQSLFHQMCIEFLPSGRFMVLLTSRVKLQNLVMCPEVLPSGRVMVLLTSRMNLQTLMMCPVSSFWQVHGLTHFKKESVDLYDVSRVSSYWQVHGLAHFKNEAADLSDVSRVSSFWQFHGLAQFKNEAADFSDVSRISSFWQVHGLVLFKNEAADISDVSRVSFFWQVQGLSHFNNEAPVLYDVSRVSSFWQVHGLPHFKNEAAELSDVSRVSSFWQVHGLAHFKNEAADLSDVSRVSSLWQVHGLAHFKNEDADLYGSWFAHFKNEAADLSDKSRVSSFWQVHGLAHFKNEAADLSDVSRVSSFWQVHGLAHFKNEAADLSDVSRVSSFWQVHGLAHFKNEAADLSDVSRVSSFWQVHGLAHFKNEDADLYDVSRVSSFSRFMVLLTSRMKLQTLVVSVTAVKFLCPEFVPSDKSRVSSFWRVHGLAHFKNEAADLSDKSRDSSFWQVHGLAHFKNEAADLYDVSRVSSLWLVLGLAHFKNEAADLYDVSRVSSFWQVHGLAHFKNEAADLSDVSRVSSFWQVHGLAQFKNETADLYDVSRVSSFSRFMVLLTSRMKLQTLVISPEFLPCGRFMVLLTSRMKLQTLVMCPEFLPSGMFMVLVTSRKNEAAEHYDMSRVSSFWQVHGLAHFKNEAADLGAADLYAECHSNLRCYVQSLFIQMCPEFLPSGRFMVLLTSRMKLQTLVLSVTAVKGVCPEFVPSDVSKVSSFWQVDGLAYFKNEAADLYDVSRVSSFRQVHGLAHFKNEAADLGDVSRVSSNWQVHGLAHFKNDVADLYGRGLAHFLNEAADLYMCPEFLPSDRFVVLLTSRMKLHTLVVSVTALKFLSPEFVPSDVSRVSSFWQVHGLADLKNEAADLYDVSRVSSFWQFHGLAHFKNEAAERSDVSRVSSFSPVHALAHFKNEAADLSDVSRVSSFWQVHGLAHFQNEAADLYDVCRVSSFWQVHGLAHFKNEAADLSDVSRVSVFWQVHGLAHFKNEAADLSDVSRVSSFWQVHGLAHFKNEAADLSDILPSGRFMVFLTSTMNETADLYDVSRVSFFWQVHGFAHFKNEAPELYDVSRVSSFWQVHGLAQFRNEAADLSDVSKVSSIWQVHGLAHFKNETADLSDVSRVSSFWQVHGLAHFKNEAADLYDMYRVSSFWQVHCLSHFKNEAADLYGECYSPERCYVQSLFLQMCPEFIRSGRFIVLLTSRMKLQNLTMCPEFLPSGWFMVLLTSRMKLQTLVVHGLAHFKNEAADLSDMSRVSSFWQVHGLVLFKNEAADLSDVSRVSSFWQVHGLAHFKNEAADLSDVSRVSSFWQVHGLADHKNESADLYGVSRISTFWQVYGLAHFKNEAADHHEIVPSYVSRLSSFWQFHGLAYFKNETADHYGERYSTERCYVQSLFLQMCPEFLPTGRFMVLLTSRMKLQILVMGPEFLPSSRFMVFLPSRVKLQTFKMCPEFLPSGKFKVLLTSRMKLQTFTVSVTVHGPAHFNNVAADLYDVSRVSSFWQVHGLAHFKNEAADLSDVSRVSSFRQVHGLAHFKNEAADLGDVSGVSSIWQVHGLAHFKSEAAEFSDVYRVSCDWQVHGLAHFKNEAADLGDVARVSSFCQVHGLTPFKNEAADLGDVSKVSSIWQVHGLSHFKSEAAEFSDVSRVSFFWQFHGLAHFKNEAPDLYDVSTVYSFWQVHGLAHFKNETADLYGMKLQTLAMCPDILPSSKFMVLLSSRKNEAADLSDVSRVSSFWQVHGLAHFKDAAADLSDVSKISSIWRVHGLAHFKSEAAEFTGECYSTKRCHVQSFLLQLCPDILPSGRFMVLLTSRKNEAADLYDVSKFSSIWQVHGLAHFKSEAAEFSDVSRVSSFWQVHGIAHFKNEAADLSDVSRVSSFWQVLGLAHFKNEAADLYDVSRVSSFWQVHGLAHFKNEAADRSDVSRVSSFWQVHGLAHLKNDAADLYVSSFWQVHGLAPFKNESVDLYGECYSNERCYVQSLFLQMCPVFLPSGRFMVLLTSRMKLQTFTLRHLKVLCPEFVPTDVSRVSSFWQVLGLAHLKNEAADLYDVSRVSSFWQVHCLAHFKNEAADLGDVSKVSSIWQVHGLAHFKNEAADLSDVSRVSSFWHVHGPAHVK

SEQ ID NO: 934845 - protein, 932 aa, Homo sapiens
MKLQTLVVHGLVLFKNEAADLSDVSRIFSYGLVQGLAHFKNEAADLGDVSRVSSFWQVHCLAHFKNEAADLGDVSRVSSFWQVHGLAQFKNEAADLSDVSRISSFGQVHGLAHFKNEAADLGDVSRISSFWLVHGLVLFKNEAADLIDVSKVSSIWQVHGLAHFKSEGAEFSDVSRVSSFLHVRGLAHFLNEAADLTDVSRVSSFWQVRGLAHFTNEAADLTDVSSVSSFWQVHGLPHFKNEAADLTGPEFVSSDVSRVSVFWQFRGLPHFKNEAADLTDVSRVSSFWQVHGLAHFTNEAADLTDVSSVSSFWQVHGLPHFKNEAADLTDVSRVSVFWQFRGLPHFKNEAADLTDVSRVSSFWQVHGLTHFKNEAADLTDVSRVSSFWQVRGLAHFLNEAADLTDVSSVSSFWQVHGVAHFKNEAADLTDVSRVSSFLQVRGLAHFLNEAVDLNDVSRVSSFLQVRGLAHFLNEAADLTDVSRVSVFWQVHGLAHFTNEAADLTDVSRVFSFWQVRGLAHFLNEAADLTDVSRVSSFLQVRGLAHFLNEAADLNDVSRVSSFLQVRGLAHFLNEAADLNDVSRVSSFLQVRGLAHFLNEAADLTDVSRVTSFWQVHGVAHFKNQAADLTDVSRVSSFWQVHGLAHFTNEAADLTDVSRVSSFWQFRGLPHFKNEAADLTDVSRVASFWQVRGLAHFLNEAADLTDVSRVSSFLQVRGLAHFLNEAADLNDVSRVSSFWQVRGLAHIFNEAADLTDVSRVSSFWQFRGLPHFKNEAADLTDVSRVSSFWHVHGLAHFKNEAADLTDVSRVSSFWQFRGLPHFKNEAADLSDVSRVSSFLQVRGLAHFLNEAADLNDVSSVSSFWQVHGLAHFKNEAADLTDVSRVSSFWQFRGLPHFKNEAADLTDVSSVSSYWQVHGLAHFKNEAADLTIQC

SEQ ID NO: 934846 - protein, 4258 aa, Homo sapiens
MKLQTLLVSVTAVKVLCPLFLPSDVYRVSSFWQVHGLAHFQNEAADLYDVSRVSSFWQVHGLAQFKNEAADLYDVSRVSSFWQVHGLAHFKNEAAELSDVSRVSSFWQVRGLAHFKNDAADLYDVSRVSSFWQVHGLAHFKNEAADLSDVSRVSSFWQVHGLAHFKSEAADLSDVSRVSSFWQVHGLAHFKNEDADLYDVSRVSSFSRFMVLLTSRMKLQTLVVHGLAHFKNEAADLSDKSRVSSFWQVHGLAHFKNEAADLSDKSRLSSFWQVHGLAHFKNEAADLYDVYRVSSLWLVLGLAHFKNEAADLYDVSRVSSFWQVHGVAHFKNEAADLSDKSRVSSLWQVHGLAHFKNEAADLSDVSRVSSFWQAHGLAHFKKEAAELSDVSRVSSFWQVHGLAHFKNEAADLSDVSRVSSFWQVHGLAHFKNEDADLYDVSRVSSFSRFMVLLTSRMKLQTLVVSVTAVKFLCPEFVPSDKSRVSSFWQVHGLAHFKNEAADLSDKSRLSSFWQVHGLAHFKNEAADLYDKSRLSSFWQVHGLAHFKNEAADLYDVYRLSSLWLVLGLAHFKNEAADLYDVSRVSSFWQVHGLAHFKNEAAELSDKSRDSSFWQVHGLAHFKNETADPYDVSRVSSFWQVHGIAHFKNEAADLSDVSRVSSFWQVLGLAHFKNEAADLYDVSRVSSFWQVHGLAHFKNEAADRSDVSRVSSFWQVHGLAHLKNDAADLYVSSFWQVHGLAPFKNESVDLYGECYSNERCYVQSLFLQMCPVFLPSGRFMVLLTSRMKLQTFTLRHLKVLCPEFVPTDVSRVSSFWQVLGLAHLKNEAADLYDISRVSSFWQVHGLAQFKNETADPSDVCRVSSFWQVLGLAHFKNEATDLYGRGLAHFLNEAADLYMCPEFLPSDRFVVLLTSRMKLHTLVVSVTALKFLSPEFVPSDVSRVSSFWQVHGLADLKNEAADLYDVSRVSSFWQFHGLAHFKNEAAERSDVSRVSSFSPVHALAHFKNEAADLSDVSRVSSFWQVHGLAHFQNEAADLYDVCRVSSFWQVHGLAHFKNEAADLSDMFRVSSFWQVHGPAHFKNEAADLYDVCRVSSFWQYHGIAHLKNEAAELSDVSRVSSFWQVHGLAHFKNEAADLYDVSRVSSFWQFHGLAHFKNDAADLYDVCRVSSFRQVHGIAHFKNEAADLSDVCRVSSFRQAHGIAHFKNEAADLSDVCRVFSFRQVHGISHFKNEAADLSDVSRVSSFWQDHGLAHFKNEAADLSDVSRVSSFWQVHGLAHLKNEAADLYDVSRVSSFWLVHGLAHLKNEAADIYDVSRVSPFWQVHGLAHFKSEAADIYDVSRASSLWQVLGLAHFKSEAADLYDMFRVSSFWQVHGRAHFKNEAADLYDVCRVSSFWQYHGIAHLKNEAAELSDVSSISSFWQVHGLAPLKNENADLYDVSRVSSFWQVHGLAHLKNEAADLYDVSKVSSFWLVHGLAHLKNEAADLYDVSRVSSFWQVHGLAHFKNEAADIYDVSRVSSLWQVLGLAHFKNEAADIYDMFRVSSFWQVHGPAHFKNEAADLYDVSRVSSFWLVHGLAHLKNEAADIYDVSRVSSLWQVLGLAHFKNEAADLYDVCRVSSFWQVHGVAHFKNEAADLSDVSRVSSFWQVLGLAHFKNEAADLYDLSRDSSFWQVHCLAHFKNEAADLSDVSRVSSFWQVHRLAHFKNEAAELSDVSRVSSFWQVHGLAHFKNEAADLSDVSRVSSFWQFHGLAHFKNEAADLYDVCRVSSFWQVLGLAHFKNEAADLYDVSRLSSFWQFRGLPHFKNEAADLSDVSRVSSFWQFRGLPHFKNEAAELTDVSRVSVFWQVHGLPHFKNEAADLSDVSSVSSFWQVHGLPHFKNEAADLTDVSRVSSFWQVRGLAHFFNAAADLTEVSRVSSFWQFRGLPHFKNEAADLTDVSRVFSFWQVRGLAHFLNEAADLTDVSRVSSFLQMCPECLPSGRFMVLLTSLMKLQTLLVRGLAHFLNEAADLTEFDPSDISRVSSFWQVRVLAHFFNEAADLTDVSRVSSFWQFRGLPHFKNEAADLSVECYSTVSSFWQVRGLAHFFNEAADLTDVSRVSVFWQVHGLPHFKNEAADLSDVSRVSSFWQVRGLAHIFNEAADLTDVSRVSSFLQFRGLPHFKNEAADLTGECYSTLRCYVQSLFLQLCPECLPSGRFMVLLTSRMKLQTLLMCPEFLPSCRFVVLLTSLMKLQTLLVRGLAHFLNEAADLTDVSRVSSFLQVRGLAHFLNEAADLNDVSRVSSFWHVHGVAHFKNEAADFSVECYSTYRCYVQCLFLQMCPEFLPSCRFVFLLTSLMKLQTLLVRVLAHFFNEAAELTDVSRVSSFWQFRGLPHFKNEAADLSDVSRVSSFWQVRGLAHFFNEAADLTDVSRVSSFWQVRGLAHIFNEAADLTDVSRVSSFWQFRGLPHFKNEAADLSVECYSTVSSFWQVHGLAHFKNEAADLTDVSRISSFRQFRGLPHFKNEAADLSVECVSRVSVFWQVHRLAHFKNEAADLCDVSRVSSFLEVRGLVHFLNEAADLTDVSRVSSFWQLHGLAHFTNEAADLTDVSRVSVFWQVHVMAHFKNEAADLSDVSRGSSFWQVHGVAHFKNEAADLSDDSRVSSFLQVRGLAHFLNEAADLTDVSRVSSFWQFRGLPHFKNEAADLTDVSRVSIFWQVHGVAHFKNESADLSDMSSVSSFWQVHGLAHFKNEAADFYDVSRVSFFWQVHGVAHFKNEAADLTDVSRDSSFWQFPGLPHFKNEAADLSDVSRVSSFWQVRGLAHIFNEAADLTDVSRVSSFLQFRGLPHFKNEAADLTDVCRVSSFWQVLGLAHFKNEAADLYDLSRDSSFWQVHCLAHFKNEAADLSDVSRVSSFWLVHGLAHFKNEAADLYDTSRVSSFWQVHGLAHFKNEAADLYDVSRVSSFWQVHGLAHFKNEAAYLSDVSRVPSFWEVHGFAHFKNEAADLSGEFYSNVKVLCPEFVPSDVSRVSSFWQVHGLGHFKNEAAELSDVSRVSSFWQVHCLAHFKNEAADLSDVSRVSSFWQVHGLAHFKKEAAELSDVSRVPYFWEVHGLVHFKNEAADRSDKSRVSSFWQVHGLAHFKNEAADLSDVSRVSSFWQVHRLAHFKNEAADLYDVSRVSSFLQVHGLVHFKNEAADLYDVCRVSSFWQDHGLAHFKNEAADLSDVSRVSSFWQVHGLAHFKNEAADLYVSSFWKVHGLAHFKNETIDFYGECYSTERFYVQSLFLQMCPEFLPSGRFMVLLTSRMKLQTFSMCPEFLPAGRFMVLLTSRMKLQTLVLSVTAVKFLCPEFVPADKSGVTSFWQVHGLAHFKNEAADLYDVSRLSSFWQVHGLAHFQNEAADVSDMSRVSSFWQVHGITHFKNEAADLYDVSRDSSFWHVHGLAHFLNEAADLTDVSRVSSFLQFRGLAHFLNEAAGFTDVSRVSSFWQVHGLPHFKNEAADLTEFVPSDKSRVSSFWQIHGLAHFKNEAADLSEVSTVSSFWQVHGLAHFKNDAADLYDVSRVSSFFQVHGLAHFKNEAADLYGPEVVPSDVSRVSYFWQVHGLAHFKNEAADLSDVSRVSSFWQIHGLGSFNNEAADLYDVSRVSSFWQVHGLPHFNNEAADLSDVSRVSSFWQVRGLVHFKNDAADLSGECYSTKRCYVQSLFLQKYPEFLPSGRFMVLLTLRMKLQTLLVHGLAHFKNEAADLSDVSRVSSFWQVRGLAHFKNEAADLTEFVPSDMSRVSSFWQVHGLAHFKNEAADLCDVSRVSSFWQVHGLPHFNNEAADLSDVSRVSFFWQVHGLAHFKNDAADLYDVSRVSSIWQVHVLAHFKNEAAELSDVSRVSSFWQVHGLPHFNNEAADLSDISRVSSFWQVRGLVHFKNGAADLSDVSRVSSFWQVHGLAHFKNEAADLSDVSRVSSFWQVRGLAHFKNEAADLTDVSRVSSFWQVRGLPHFLNEAADHTDMSRVSSFWQVHGLAHFKNEPADLCDVSRVSSFWQVHGLAHFKNEAADLYDVSRVSSFWQVHDLAHFKNEAAELCDVSRVSSFWQVRGLSHFLNEAADHTEFVTSDMSRVSSFWQVHGLAHFKNEAADLCDVSRVSSFLQIHGVAHFKNEAADLSDECYSTLRCYVQSFFLQMCPAFLPSGRFIVLLTSRMKLQTLLLSVKALKAVRGLAQFLNEAADLPDVSRVSSFWQVRGLVHFKNDAADLSDMSRVSSFWQVRGLAHFFNEAADLTGECYST

SEQ ID NO: 934847 - protein, 486 aa, Homo sapiens
MKLQTLVLSVTALKAVMSRVCSFRSVQNVFLLADVSSVPSFWQVHGLAHFKNEAADLTDVSGVSSFWQVHRLAHFKNEAADLTYVSRVSSFWKVRGLVHFKNDAADLSEISRVSSFWQVYGLAHFKNEAADLTDVSRVSSFWQVRGLPHFLNEAADHTDVSRVSSFWQVRGLAHIFNEAADLTDVSRVSSFLQFRGLPHFKNEAADLTDVSRVSSFLQVRGLAHFLNEAADLTDVSSVSSFWQVHGLAHFKNEAADLTDVSRVSSFWQFRGLPHFKNEAADLTDVSRISSFLEVRGLAHFLNEAADLTDVSRVSSFWQLHGLAHFTNEAADLTDVSRVSSFWQIHGLVHFTNEAADLTDVSRVSSFWHFRGLPHFKNEAADLTDVSRVSSFWQFRGLPHFKNEAADLTDVSRVSFFWQVHGVAHFKNEAADLTDVSRDSSFWQFPGLPHFKNEAADFTDVSGVSSFWQVHGLAHFKNEAADLTIQC

SEQ ID NO: 934848 - protein, 145 aa, Homo sapiens
MPVLPLYFRKVSPVKTEKQQRCQHAPSSRSFTPDGYWFVTHSNLAVESGWGFYLEGLTLLGGIESGTYLKKQFCCFLVEQPCCIRDPFTPQLLQSSSLDSSLASCTCHGINCLLVGTSINGTTLTLKLGNKPFAVCTPLDCILNP

SEQ ID NO: 934849 - protein, 140 aa, Homo sapiens
MRKLIMGLIFLKIWTCTVRTSTDLPRTEDFSQCIHQVTEATWKKDEKDTVHLQKGKSNSSCTSAHCNPLELLIANPLDLCWKTGEYVTLGINGTGLDPQGNILVQGYVHRCCPKPVFQTFYDELNLPAPELLKKTTYFPS

SEQ ID NO: 934850 - protein, 141 aa, Homo sapiens
MNRKESCFVTTSSCLGTAGLLDLAGGPLQTLFAWVSPVQAAEQQILQNSKNCCLILSPEASSQRGTQLYEVSVSHYWEVSSTMLCPQGWIQWRQQALPYCSELHPLRASSDTLFTYSSLSNGGQPTTCPAAALQVDLRLLH

SEQ ID NO: 934851 - protein, 176 aa, Homo sapiens
MCSFLFPIYCCLSILWWILLGKGIWCHGCHLCHGCCLCGCCTGLLLRELLSELLLLRLHHVRSHGVCQGQGLYGSAVEHHHPGEATQGTAINSRGDSQQGCDCASLGDIMQCLETLLVVATKRGCVVLASVFQWLFPCGSLEIEGNCLRSIVSNCYGVFYPKFWFTAFIGLSIGAQ

SEQ ID NO: 934852 - protein, 232 aa, Homo sapiens
MQHFLKIDGKVRVDITYPAGFIDVISIEKTGEHFRLVYNTKGCFAVHRITVEEAKYKLCKVRKITVGTKGIPHLVTHDARTIRYPDPLIKVNDTVQIDLGTGKITSFIKFDTGNVCMVIAGANLGRVGVITNRERHPGSCDVVHVKDANGNSFATRISNIFVIGNSRAVLLSSGLVLPQNQSCWMICVLLTGPLVLGSQLQLAVANPGYDSCNFNSSGSRQDYSVGPIPCGP

SEQ ID NO: 934853 - protein, 162 aa, Homo sapiens
MMHQTMGLLGPNPEIKKMTLQDPQLRLYLLHLYWAHLLHPSFFRLVTWADTPFPASNNVTAWLGGIDLLPLGFLINGTHWTKVRGNTTYHPTILPLYVNCKSSTPYCVPAQTQVWLHHGKGNVLTGLLAYSLKLGNAINATFSNIPHCAKEQKQESNGFHFS

SEQ ID NO: 934854 - protein, 126 aa, Homo sapiens
MGKKQNRKTGNSKTQSASPPPRNSVPHQQWNKAGWRMTLTSCKEVENFEKNLEECITRITNPEKCLKELMELKTNARELREEFRSLRRQCDQLEERKPYKPEESGGQYSTFLKKRIFNPEFHIQPN

SEQ ID NO: 934855 - protein, 366 aa, Homo sapiens
MGSICGTIPSQLSMGNGWKHQPAEEGALLPDCHGGRCPPEASCPAGYEDAWGASLAPWQMRLFQRDFRTRCFGCRGVPERLLGLPSSSPAPALCYSGRRSTERRESVSSCRGQWQWKSLLEVRSRPYLPGYHQWRMQNNKDCCLVLHLEASFQRGTCQMPTRAFLYKGSVSSYWKASSSLDTQWVMDPLDEAVCPLLELGCYAGRTTALFKAVRQGPLSLLKLRHSHPFPQMLCPRELWWVLSSPNTLAALFTLLMSAVVVMAGCVSQCLNPGRSNWAEQLIGLGCTGITRICQQTCSQAPWLYIQLLTVTERKECSSGHRQSAHLSAVPAMLQGCHWEVSSKSFSIQLCSIAGEELHFFGGGEAL

SEQ ID NO: 934856 - protein, 169 aa, Homo sapiens
MRDDTVSCLLRGMKKYTKKPFNCEKVKEVSQHKCENPDLFQGLLIEKIRQNPQLQVCWSLLEVHSRPCLPGYQQQWLQNSDSCRTADLGECKRCCLIVPLEVLSQRSTRLCEVSVCPYVGVPPPACWESHYSLQSSLTGTFKSAEVTAVCLFFCALPPEVEPTEAGSPP

SEQ ID NO: 934857 - protein, 140 aa, Homo sapiens
MILAVVCQSHSPSSFVPLLVGICVPLEEERTVDFGEQQMVLSDHSSGSFVSEDYPAMWGVSLPLRGDASHLGYSVFRDPLEEAVCLFSDLQLRAGRTTTLFKDVRQGHLSLQRILLPFVWLCPATRGEAYRGRQASLSSG

SEQ ID NO: 934858 - protein, 147 aa, Homo sapiens
MNPVHRPVCDLCTYSRHTGGVDSHTSNQDMCGILKILSLNLPAGYVMLHFCLHPVHRKIVTYGLTKQQGVVIVFHLQEKIVTPKQCYSFALPLHSEDIVIYYGAQNPGDVALAGPYPKGALGHMVGPTTQVQRPDDVSVLFCQDLTH

SEQ ID NO: 934859 - protein, 199 aa, Homo sapiens
MVKTGLLLPLQIQLTASAQESKHAASGPRSSQPLIKQNIISVTLINMLCLSSYSHNSVEEDYWFLGADNYYSAVKSRNFDPSGECDPSVLANKFGIKMNNPHVVLQRPTMEISWVGTGNSFYVKKRVFYDDYSKSLGKTPSYDQPRHPYIKHGESSMISRQQETSKLRCIGKNATYFDPLAWKEGIHQKGTYTNKGGTR

SEQ ID NO: 934860 - protein, 138 aa, Homo sapiens
MVPSWKTSPRTVWKGNAVSEPTHRIPTKALPSVTVRKGSPSSRLHNGRPTDSLQHAPGKATDTQPQPVKSDRWVAIPCKATEVELPKTMGTYLLHQCDLDLRPGVKRDHFGTSKLYFPTGFHTSMGPVTPLFSPISPI

SEQ ID NO: 934861 - protein, 146 aa, Homo sapiens
MSSWRIVYTPISTLSSSGNPLESTSGSGSFVLLLFAVNLAAAHSLGLHCLYELLTLTTKVCSFTPEASKTTNPLGGVNNSRCSTLRAVTLTVKVCNFTPEASETMNPPEGRNSEQSEHQKEQTLDTPSLRTVNTHCEAPWLHSSSQ

SEQ ID NO: 934862 - protein, 146 aa, Homo sapiens
MMLHHLKIMDTMTTVVLVGVNNPLEDIVFPADINKRFLNLMTVMATKGAVVEIILNIQVEVLTEMHIRVMDTIAQVMEHLQEVVGEADVKKETEADIKGDIKNNTYRGIQQGRWKNDERFEGGYVKGFKEGKGKIEGSERRNKKHE

SEQ ID NO: 934863 - protein, 227 aa, Homo sapiens
MVSELLVALTSKHGYTSQNLFSLITVTLITVVQNWNLTVKSPGGNCYNGSNYGNDYFSAPVLTDLGEDGTSVFLPKCCISQDHPGLPHLHPATPPSCDIRNPQILAGSDTAAGRLEGPLAEKDTATGPREDTGGRRAQRLRLQGIHRRRTLSFEELWEESADLSHSKGKLPSRSICLLGPHLSADNLYLMKPCTYSPSPRVSQFFRYTKAINPGIQIAFCLCKAPLS

SEQ ID NO: 934864 - protein, 257 aa, Homo sapiens
MILAVAVNLWTHSVCDEAKFWNQEEFPALLPLTEPIAKTVPQWIQDRFPAMNPWAKTMAETVIPLTLDEMTPVEFPAIHSWKQLETDIITLGTQAESLVMNSWIHSPISDMVTMCIQAESLLLHPWTQSETDILTTWILAETLGVIPWEQDIFQPWTHAEHPPVSWTQSLIPGKTPAMNPWRDVTADMVLPWNQAEFIVGNAWTQSETYTVTQGILNGPPARYSWTQQIADVDKLWTKPEFPTINPWTKSVGDTTIQ

SEQ ID NO: 934865 - protein, 200 aa, Homo sapiens
MAPHGCLTQGRPIHLAFLKLSFPQKVNDWTQPIPATVIPPNQAESVGVNPSTNLETEIVILWTQAHSKINNPCTYTLFDRVTPLAKNVCVADLLPGINPLTVAETGIVTLQYMAVSLVMIPRREALSDTVIIWTQTKPPAITFWLQSLPDAGKLQTQMKYPSVNTWNEAEFQAVNSMMESKSPVVNIWTDPESPAPSPLL

SEQ ID NO: 934866 - protein, 218 aa, Homo sapiens
MTSSCIHVAAKDMILFFLWLWTIPAFICTAFSLSHPRWMGSYVDAMGLIPVKRGPSSRSGGPPPKKSAPSAVARSNSWMGSQEIIEVPEKLGIMLHHLEAMHTVIMVILVGMKVILEDTEIVEVPEKLGSMLHHLEAMDTVIMVILVDMKVILEDIETRDYAPPHRDYAYRDYGHSSWDEHSSRGYSYHDGYGEALGRDHSEHLSGSSYRDALQRYGV

SEQ ID NO: 934867 - protein, 157 aa, Homo sapiens
MEHSPPAWEDQEAFEWGSQQEQAFYELKEKLMSAPALVLPDLTKPFTPYVSGREKMAVGVLTQNVGSWLRPVAYLSKKLDRVSKGWSSCLRVLAATALKAQEADKLTLGQNMNIKAPHAVVTLLNTKGYHWLMNARLSKYKAFSVKIPTQSMKFVTT

SEQ ID NO: 934868 - protein, 155 aa, Homo sapiens
MQHYPRELGPQRGNREEAREAAQGWGMRGLWVLEPGYIAKPRLKEETEALGMDESLPLHDHWHSKSCGKKQLCYVPQALHIYSMVGQLRLLFKVPRWLARTAIIRSSNWCPSLPEIWRTEFFLFILALASCSRSSRKATSVLGNQERKLNQRLLG

SEQ ID NO: 934869 - protein, 149 aa, Homo sapiens
MEKARKAAQASQAANHPTMHSKSFSPTKLYEYKMPKSRNCKVPKKVSQPALRSERSPFSSYLCLPQCDEQGASFIPVCVAGHSALTFNRSKTVVLHQERKSTNSLGQSKSSPVLPVVAALKERTMDFPFDQGKLLALPQLGVVPGADPS

SEQ ID NO: 934870 - protein, 188 aa, Homo sapiens
MTQHCGQPPGVDFSVFYKKTWNEESQKIQGGHKRMKEPVVETSESKNDPSDICHQSNVFSPDCSAGIMGPRLYSHCDTEDPSNSGGAAVKLEVSLVAQEEKLMKWLLEGLHKGGRAKIIVWPRTSQTQTASEKQTALHATREIQGQLHVVYSQRKIQKDSGTATAKRDDAKERQRLVTQLQAYKIQDI

SEQ ID NO: 934871 - protein, 148 aa, Homo sapiens
MTVSFSFRNRGFLRPNANPKANTVGMGTPFWFPSGTQRRASSALKSQVILQTQECGAGIEPGSHSRSFFSPMFGITGCCSHQCHHHHGYDGRHNFCYHIACRSGEKASSSEKKIWLQENCLNIRLVQKLLRFLPLKVMTKTAITFAPI

SEQ ID NO: 934872 - protein, 137 aa, Homo sapiens
MATSRVNTHFIHISSTIAQVSRDDVTGEHFMFFLFLMNNGATSFPSFPPCPRGCAVAVCAWQAESILANSVGTKWCFTVVVIYICLIPHFAFNICYLVQLLHLLHTPYSSVKLPQPSLHKHQFKDIASVFPAKESLT

SEQ ID NO: 934873 - protein, 164 aa, Homo sapiens
MRKLPDLFLFGHPKNPIPERVPPHTQKEGVLLREAKKNLDTQVWLGFPTQTISIGSGPFCPTLFLHSCPDLVELKHKNGPSPLVSGVFILNAPVKSSGAMTPQNQYNKQQFCKAECCCWNNNYTMSRSMPTEHYLPPGNGCHIAQKSNQPTPKPPLPIELFTSI

SEQ ID NO: 934874 - protein, 144 aa, Homo sapiens
MKKVQFRWFLSPKSFSIQLCSIAGKELCSIAGKELCSIAGKELRSFGGGEVEKPPEALFAHMEHNEQVRFLSIPSLALAALAHCDILLFSPFPHGRGLYRADFSSYRGSEALGFGSGCQLSSSVFFHVPFAGAKYANDFFPSCV

SEQ ID NO: 934875 - protein, 147 aa, Homo sapiens
MPTWMKFGFRVTEEVSGGGPHYTMLHKLREEMVGWMDEWMSGWMGRRIQPCRKLPFCFPAAPSLVPTQELPLAREAARTNSTCQVCIPPGQLSKPHQAPSYHTAHHHLTDVFLPQAFSHVAFEACPWEHVCPLGKFKFLCVHFCASS

SEQ ID NO: 934876 - protein, 262 aa, Homo sapiens
MTKQGSLTPTKITLVHQQWIQTKKKSLIYLKKSLEGESIGVYPVSKHYLSTLRVTSGWRFEVKPGDTSYDGLKEKCKLAVPGGTAIDEPSVIRMRNRKEGNMGKLNECQVDQRDTVMGVRCGICNNVGSRIEVQARNNGNCGRLSKGEPWARVSGALGVAAGRVGQSSFQWGPAQMGRGLGGILGCRHSLAQWPDFWHLKQDPGGGVPEGMPDCCGLGVLKFLCAGDVAGVSLTVEARNCKSEICCYFAAPTLLVHLGGEVN

SEQ ID NO: 934877 - protein, 158 aa, Homo sapiens
MLTIVNPPSLRNKNINSFWDYRSAASFLKSARPQIHRKEQTLVTSWQLRRDYHQAAFWERANNPRLFGIDIVGFPGTSFHFSCTSELSQRSTERKAHLQGPNKNLVDPVAMSRTLRATMPKRKTSVFAAALVSAIIPISRVQKLLWVLGQEGDQLLHQ

SEQ ID NO: 934878 - protein, 145 aa, Homo sapiens
MVHTGPAGAALAHAKRRSKGEGARRRWVLMEEESGQGGVPFTFHHEWKQTEASPEADAGTVLPVQPVELKKNCGIKPVDYDKVREIAQEKDENPTLIQGCLYEALRKYTNIDPDPLEVVMRQHTSSAYEDDEIKRVKTGIGNYDY

SEQ ID NO: 934879 - protein, 146 aa, Homo sapiens
MWGPQLPSYLASASSSTFRVLALKICSTCAGVIEIPVALCGSALPGCIWFVRAEEHTIQLLAVCCRGPSAAGLLEFTGGPLQTLFAWVSAVVAAEQRTLVNRKCCCLIVPLEVLSQRSTRPCGLQVTRECPNCRGSLTMYLCPEIL

SEQ ID NO: 934880 - protein, 152 aa, Homo sapiens
MAQASTSAEGFRLLPLMAEGASEGARTPYFLLGSRGSKDKCSNSYNYESVISGLLELSSQRKTKLQLQCSGVGLSEKHKAIAVVFRQVQVTCAGGLKQARHIWGSKDKCSNSYNYESVISGLLELSSQRKTKLQLQCSEADPGAMLIQSVEP

SEQ ID NO: 934881 - protein, 143 aa, Homo sapiens
MRAAICFSLVPPYEKHPQHVPGPSSNNMLGTNVLTLPNLPFSKIFNSQDHGLFTNNYPKPSTDSIASAVNPRPENRSSPCQQEVTRMKTPSLLLFSMIRSGLTEQEHCHLGQAPNSKVHFNKNHLNPKGISLMAKVGMTINHK

SEQ ID NO: 934882 - protein, 211 aa, Homo sapiens
MVLILTVPEAEEWQLSELCARKIPELDLHTRPLFEASKGKEREPLLWEKEEEKAFKDIKEALIQAPALGLPDVKKPFFLIRQWSCICGRSSTTADSAFKDQMETGHSLLTTEFREDRTDELDTQTATKKVLPGNSLTMGSGLAHGPPPGVTPWIHHSWLKAAAAVTPMTTSGLANKTQITPPEWSYNEIQPLDRQHYYELMDKEQDLELQY

SEQ ID NO: 934883 - protein, 152 aa, Homo sapiens
MAYASALEAGLCLWVVDVNEDPGMRRSCPYWSGKLGYTLDNLNDSCGGKKAQCWNARSGDLRRTLWCSVEGTVAKSNHTASKYFVENFLLPDTHFHHSQVWPSTKTVDLDIEVPFVNTATLSVKFNLSFGRDKYLNYRNSKLLYVNKSRNLD

SEQ ID NO: 934884 - protein, 158 aa, Homo sapiens
MPGQTQVQASLQRTQDADLILQTQRQGLIQQIPVFLASLQWVQTSSFSLEKFVITDHLKPTSINSSKSFSIQLCSIAGEELYSFRGEESDPSAAGLLEFAGCPLQTLFACVSPAEATEQEILQNSKCCCLILPLEASSQRGTQLYEVSVSPYWKVSPS

SEQ ID NO: 934885 - protein, 173 aa, Homo sapiens
MHNTFEPMNIVKLWKTKEYSEVGCWHLNSLDEVTKEKDKLRDYISWLQKHIPSLKYFKIALGESLIFCKQRAGIVENQTQALIMTKGQKMNLYDEVRESQPFSQFQDLSQFTNLEPLKRRDVSQFTDPVPLRKSLTTLLTIYAVNLSLILPQGERWPFTRVTVHWENKNNQTF

SEQ ID NO: 934886 - protein, 134 aa, Homo sapiens
MEQASHLDPTDHTPQLTWTILPQGFKDSPHLFGQALAQDLGHLSSPGTLVLQYIDDLLLATISEASCQQATLDLLNFLANQGYNVFGYQVLLLEGPVLQICTCMVLNPATFLPEDGEMIMHDCEQNSPDVCCPR

SEQ ID NO: 934887 - protein, 148 aa, Homo sapiens
MAVFVCGSPGCGGLRANSGPSNNCLHPTSSNECPKLKGLSLDLTEPYKQISNTPSTDSEATRYTDGSSFMIGGTQLSGYATINLTEITESGPLPGSSTSAQKAELIALTCALQLGAGLRLNIYTDSAYVYHAVHAHAAIWQERGLLMA

SEQ ID NO: 934888 - protein, 134 aa, Homo sapiens
MLENGNRTCFSSLKHTPKYNFDITQNASAEKNGIAISASSLQIKNKAFLKKDGASSLKNMVLHVTPDTHAQGPSSSKQGDILASLIHTDWCLLLVLLHSGVTIPLQEDFLLKECFEDEGSERLIIESLRAMMLE

SEQ ID NO: 934889 - protein, 270 aa, Homo sapiens
MKSLVLSLEEEEKKKKKKKKKKKKKKKKKKRRKKKNNNNNNNNNKGGGGGRKKKNEEEEGEGRGRRGEKEEKKEEEEKEEDEEEEEEGEGGEKKRKKKEKKKEEEEKKKEDEEEKEEEEKEEDEDDKEEEEEEEQVGGGERRKRKKEGGGERRRRQTGGRERRRRKKKKKKKKKKKEEEEEEEEEEKKKEKKKKKKKKKKKKKKKKKKKKKKKKQKKEGGGGEEDEEDEEEEEGKKEEEEKEKKKRNKKKRRRRRGGREEEEKSMDGARY

SEQ ID NO: 934890 - protein, 160 aa, Homo sapiens
MWVGPDKRIKAGCLSQQWQPALVPFHTVEALFFHCLQSILLLLTIWVYTAFMSYNTHRKGLQGKFNLAAEIFITTKDTNVNSKDHGEIVARSCQTPSQQPLPSQAKRPMRKKWLCGPGLGSPYCMQSRELVPCIPATPGVAERDQHSTQAVASEGESPKP

SEQ ID NO: 934891 - protein, 211 aa, Homo sapiens
MLRPHRSPRRGWEAQAWRAAGPETCPVGRQPRPGEKSSSAQSPIARGQQGWLAAPSAGPTKPTPTRNSSWLTSAARSPGSRSCLSLHTSLQAEGVGSGLGQPRKGLPQCSGGLKGSSNATKVGAQAGEVPRASEGSEDCQHAVTSHCHTEWIRVGPGQDRSPGQYPGPMPCSEFPGVSRIYNEEGERWVSQDGRIGRAPVTAPSTSDAEDG

SEQ ID NO: 934892 - protein, 148 aa, Homo sapiens
MCLFLSFVICKLRSQVPKPQKCGNQQCSLQSVAEGRRAPGKPLDSMYLQIATGLRAYTQFRQHIMQMEGKALVSLPNNSGSRVFKDKLVSGGTPVSGEGIGQELNHRELKLSSCAESVPVQGPQVEEWVLATSIMACAENLSFFWCHF

SEQ ID NO: 934893 - protein, 136 aa, Homo sapiens
MFNMAAPSSLLFANHMCDFQPPGLSESKCVCLQAIQLQCGHRHTQKDDPVRTRGEDDVYKPRREASGGANCGNILILDFQPAGLKAENSKNQSSSTPPKECISLLATEQSWMENVFDELTEEGFRQPNFSEIKKEV

SEQ ID NO: 934894 - protein, 140 aa, Homo sapiens
MPKFLHDRVRLHLKRRKKERKKERNEGRKEGRKEGRKEGRKKERERKKKEGGREGGRKEREREGERTEERKKERKKERKKERKKERKKERKKGRKKERKKERKKERKKERKKEKERKKEKERKKKKGKFCQEKLSFTHQM

SEQ ID NO: 934895 - protein, 159 aa, Homo sapiens
MKGNIFKGILNVLVFANVMSDNRFCYVILIYNYSPFINSMVFYFSNLSVSVSLSPSLFLTFFSLEVLRWSQRFIFESISLIYFSLFHPLNFICVLRSFLLLPKKKFSNIYAFKKLHNYNLSHCNIDGPGGHYLKGNNLETGSQMPHFLISKRELNNVYS

SEQ ID NO: 934896 - protein, 166 aa, Homo sapiens
MINQIIWLQAILEIITNKTDRALTILAQQETQMRNAINQNRLALDYLPAAEGGICGKFNFTNCCLHIDDQGQVVEDIVREITKLAHVPLQVGHGFDPGAMFGKWFLVLGGFKTLIIKSYHNIVWKGTVKIPVLFCSILITGACSPQSRTPYSLNGSRPSHVDPLEL

SEQ ID NO: 934897 - protein, 138 aa, Homo sapiens
MSTKPNCKTRTCNPLNFTVLKPELPFWSTGQTALLRVDRQAAGLGVPLLIVKKTRRTQMHPNLQFQVDKSFYKQFDQSVPELPPSTKNLFAQSENKTDSLRISNNGRAVMKITARMHKLAHVPVQTWSNQSTIEAIVT

SEQ ID NO: 934898 - protein, 316 aa, Homo sapiens
MTFKETSHLHNIKMQGEAASADGKAAASYPGELAKITNESGYTKQIFNVDKTAFYWKKMPPMTFRAREKSMPGLKASKDRQNFVLGLNADGDFKSMLTLIYNSENPSALKNVAKSSLPGLCECNSKAWMTVYLFTVLFTKYLKPTINNYCSETQISFKIFLPSDSVPGHPRALMEMYKEIHIVFRPANTVSILQPMDSGVNSTFKSYYLRYEFLKATAAIDSDSPDSSRKSKWKTFWKGFSTPDVIHNLHDPWEKTTISTLTGVSKKLIPILMDDFEGFKTSVQEVTADVLEIARELELDVKPGDLTKLLQSQDKT

SEQ ID NO: 934899 - protein, 137 aa, Homo sapiens
MDTTGDASILGLYSVLHHIHQEGCPLALPTEASLLESLQEELLSLAEVKAEGISRLILAGGAPPLGGGVGTPRSLPAGGASSTDGGDRQDKIKVPATLCSPRASRCYSKFSACWWNSVLRGSGTEVPTFLLLKVLGH

SEQ ID NO: 934900 - protein, 178 aa, Homo sapiens
MVANNSGEQQAKAQLKQAQTLCLENRCSLQSCQTGMFKSSKVSAAFCSAMPCPERWSLLKQAGLLELRWALPSLSFPDALFTYSSLSNGRCPTPSQTAASQFNLGLLASSEQGSVGVRPTEPEAESHAASRPNIILVMVDDLGIGDPGCYGNRTLRLERQLLSKHINHNVEENLLHKT

SEQ ID NO: 934901 - protein, 148 aa, Homo sapiens
MSLLFVSFPSNSQDPQLQVCWICWKSIPDAVCLGISIRGCRTVNIAEEKMLLPDRSSGRFISGGYLAVLTQCSTHFPGLTQQVLNCVPWTVWYWTTSWIESVMDCVFQTMGIFGCHPPSSTVFLGVTMSFTIFHSGGIFMPSCYQCFP

SEQ ID NO: 934902 - protein, 155 aa, Homo sapiens
MAPPLATAYQELKRYTSGNDDCDVDGDDGDGDEDDCDDDGDDDCGGDHGDGGDDDGNGNDDDNGDDNDGDDFGDGDDCDDNGDGEVGDRDDNDEDDGNDVGDDGDGNEGNDVSDGDGNVGNDDCDDDDSDGDDDDDGDDGNMMAIGGVMMTIMIV

SEQ ID NO: 934903 - protein, 290 aa, Homo sapiens
MVHLKICKENISHSKCYYHKISADQLQEETSNPERTYTPSEGSGLLLQDWGDNSNTVSAPTVEVAKRQTFLCDPPSGKKVNHGSLLISELCFYTEYRMSAYWSLHYHYCHHHSPYCHHITIIPIIIIITITIVIITIIITNIAITIRNIITLIAITIITNIITVVFIIIIPVTNFTITIIITIITITKIITIIIITIIIIIAITIIIITTITMITTTIIITVIITIIFITITIITIYITIIITTCVSFTVDQVLSYVFLLEMNFMNFCLQEIVCKMNRQVETETQAMNKS

SEQ ID NO: 934904 - protein, 169 aa, Homo sapiens
MTSLQSQCTLSDDEEESNFSLFSPQEEEHGDDPLPPPPIMEPVYVNSSSTKLLPPLPEEDVCHSSEWSVSHSSHPFGPLPSFKPTVSFDAPGPLLSETWNPASPHSTSWSSHSPSLSSSAPARPVRTSIQEAMCRAMASSGLDVWQLPIAIASKCEGAGGWGKGTAKGR

SEQ ID NO: 934905 - protein, 140 aa, Homo sapiens
MGKKQSRKTGNSKKQSASLPPKERKECITRITNAEKCLKELMELKAKARELHEECRRLRSQCNQLEERNFISSQTKFISEGEIRSFTDKQMLRDFVTTRPAIKELLKEALNMERNNWYQPLQNHAKMKPISRADTQIGSK

SEQ ID NO: 934906 - protein, 166 aa, Homo sapiens
MQLQLKRSFADSLQNIQQHTLIQIQLVFFYFYLKSYPSLCQACNSHKVFLLNKNVPWASPSSKIPFDPADEPTLYYYPPASAPHLSEPSAMVALPASKPSAPNSTPPPSPPVTHSKTTSAILSLGVKGNTCIRVHFSTSELLQIKAVLEAIFIALFLKGLTRIPLF

SEQ ID NO: 934907 - protein, 138 aa, Homo sapiens
MKVALSGKRDETVTERESNLPLGTVGLLTKATLSSCPCEVKLHLSDGHGCNWLGPASWAINEFTKTVVDKEEGRRGSGRCSRRYPEEGIIIMGQDSSMHVIAPEYLPVEQDVEVEDNGIDVPDSQDIGHKRKNKLIPD

SEQ ID NO: 934908 - protein, 148 aa, Homo sapiens
MSASHSSHSKPGSGGKNKCINIYTDSRYTFATVHVHRAIYQEHGLLTSEGKTIKNKEEILALLEAVWFPQQVAVIHCEGQQKEDMVIACGNQRADSAAKKTAQFPVMPLTLLPSISFLQPDFRDHPEYSLEEEKEASDLQASKNQEGW

SEQ ID NO: 934909 - protein, 141 aa, Homo sapiens
MMSLVPLYSDGFLVWVSFLFVSFPSNRQDPQLQVCWSLLEVHSRPCLPGYQQPWLQNSGGSRTVDICEPQMLLPDRSPGSFVSEEYPAVTWRVWDGKTARAQELESSLHNMVNPCLYQKYKNYIGITVHACGPSYWRQRLR

SEQ ID NO: 934910 - protein, 183 aa, Homo sapiens
MQQQKHLLPMNPQWSLGPADWNSCTHQRSSGNTSCPRTHNSPYALLIGIVVLTGTEAETLVFLLDHKEDRGRISYLLTEEEKLTDPVGLDLMGETQWNHQKGEVGKAEGNHPADDEAKIASSWNLPLEIPTEGPLIWNNPVQEIKPQYSTNETEWRLSQGHGFLPSGWLMTEERKVRILKASQ

SEQ ID NO: 934911 - protein, 163 aa, Homo sapiens
MESVHFSQPRESQFRLKQEATQSMVFSLLQPKVDETLDVPSINFTWNLLDTLLTEEKCTELENNFGSPSSSRCQPGFWRELSSWFVDGQFLTLSSHSIAAQWVHLARCLKRANFSRQGTYNRERVFYAELAVWETEVLLLLKLVSLSIWGSEYLRIIWWVVQQ

SEQ ID NO: 934912 - protein, 146 aa, Homo sapiens
MWSPHHTNSSPRPYPSTLSHRGLCFNMSFGADKYSKHSGFENSDDVCTALGRRKRGKRCNSHSEAKGLRTCEINFENLGTREADGIILILRTKARGPVEHPHLFCPYGMSDCPNGTDFVEDNFSMDLWVECRWFQAETAPPKIIRC

SEQ ID NO: 934913 - protein, 168 aa, Homo sapiens
MLTGLDGKEDGTNEKKVDALFSINQASSDLCNLLIVVIDDGDDGDSDVDDGDDDGYNDDSDGDDGNDGDAHGSDYDVNGDGDDGGGDINYGYGNDNNGSDDGNNDNDNVDDHDGGAGDNDSNDGDGDDGGDGDGNGNDNYDDDNNNGNGMIMMMMMVTMLVMIMIKMR

SEQ ID NO: 934914 - protein, 154 aa, Homo sapiens
MISFCLMTASCRISFFKKASFGAYIIGHVGYVTFPLPPKGQPWRNPLFAENFSMGFTDTTFVLDKSRQRKVEELDWLSFLASIFLPCWMLHGLKHQATSFWTFELTPVVCQGLSGPWPQTEGCTVGFPTFEIFGIQNGFFAPPLADGLLWDFTL

SEQ ID NO: 934915 - protein, 186 aa, Homo sapiens [sequence omitted]

SEQ ID NO: 934916 - protein, 138 aa, Homo sapiens
MEKQEECREQETPEVYPVKWKNRKCVLHGGERGSISLTGEKKEVCLALGRWRNCVLHSGDTGSVSSTQEEQKVCAAQERNRVTYFLCLLCKGHTSFFSPVQHTLSVFPCVGHTSCVSPVWDILPVSSLQDALTVLPLW

SEQ ID NO: 934917 - protein, 158 aa, Homo sapiens
MSKGHQTGIQLPAQGKKSAICKSRRDFSPILIQTGGKEILASWQYYTVIYWQKPHPQAWKFVGLNGNRHSCFLSQMLPFCPPYPPILNPYTPQTPGSMSRIAEEQKNGVEEKECLNIERSLAGDAPHHPTESHLHWAMKSPTFTIIRFVHVTWILPGR

SEQ ID NO: 934918 - protein, 164 aa, Homo sapiens
MKWTNLLYKTEDVMIHHDDCLLQEALKPKENHSAQQHSEWEKRNSGVVEKMHQCQDLLAAEPAQEEGGPHPAPNAQSPQELYPAAGPGACRPSRRAWPGPAWAFPMLGCHLPSCLQSQEGGTTVTAPSPPACVLRGHRTEEGGLCCQATLVHSSPERRTTLRCV

SEQ ID NO: 934919 - protein, 135 aa, Homo sapiens
MEHYAAMRKDECMSFLGTWMKLETIILSKLSQGQKTKHRMFSLTAGHMSEVFLNPVPQTSHHLKQLNKCPNVTTQRVHLALLLDRANLSTGQLQWRKSNSHRAGCVEDQSFNITHISLPEHSEIEVFRDNWTEYE

SEQ ID NO: 934920 - protein, 134 aa, Homo sapiens
MSVTVVFFHIHTYTEMDEKKTGHSNIENSCGKTFCFRYEINMKPPYVFTTQSVVLESATAAIAGGGFHCQTSGPESESAFLHDLKGVIPGHFSVSHFHSSVHQEVVGGQWSSEINLIHACNPSTLGGQGGWVTR

SEQ ID NO: 934921 - protein, 159 aa, Homo sapiens
MKEKKRSICTVKAGESRVPMSEDELKRGVRNMKEREFMGPECESRSGHPTDVIGWWCHCYCKGIEIDKANGDPRMSLPVADISVVNNTVQSPWFLEEGMLDVELGEQVGRNLKQHQKSLKRRKRRKHHLPYHLLFPQPQYQPAKIAKRKQRSYLILHFQ

SEQ ID NO: 934922 - protein, 162 aa, Homo sapiens
MDRQGHQRAPWSSGNASLWEDAIAKWTMLSLSLHKIFLVPTRETGDRLRELKKHPQDDVWGELNSSGGDSSPWVSCPPYLMGVIRKNDRLRPPFTRSISHGCCSTPCSTLKEEVTYSSRTRAGSAYWGLQSGRVFPSSVYPSCNAAHGRCRFLSKFIRSTPL

SEQ ID NO: 934923 - protein, 138 aa, Homo sapiens
MPMLHRPNIGQRVLSKHLESLADAKISYKGLAVREKFGIQVRQNPATPRNFLSCCLVTGVGNARTASLHALLSLRWPWDTMNSRYSTSKIRLLPCPWTLSNQLHKAGEEGSLFLRGISPSWGQRRANHQCVVIAHNCH

SEQ ID NO: 934924 - protein, 184 aa, Homo sapiens
MRNPVATSTKTVLVHISGITLRDFKRYYSTTVTKTAGHPYKNRGTHQWNSVESPEIRPHTYNYLMFDKAGKNKQWGKVSLYNKCCWDSWLAIRRRLKLDLFLTLYTKINSRWIKDLNAKPKTIRALEDNLGNTILDIKTGKDFMIKTPKTITTNANIDKWGLIKLKSLCSAKEIIDRVKRQPTE

SEQ ID NO: 934925 - protein, 129 aa, Homo sapiens
MHIRRGGGNRKGEPRNVESGYPRWRSPSWSLHRSPITEYSSYCSGIGVGHKGRNPTWKPFWVVMAVSAQGAFLSHLWYGLENPLFFHSPYFNAGPCWQQQASVLHQRKQSVTRLKHCVNLLCGTLQRHS

SEQ ID NO: 934926 - protein, 143 aa, Homo sapiens
MTDSPEFQSLTTCTCQEKPPPFLFPLKHMVMVGQMGFPRLDDKRGLAWTDLPWTTLQFLWVPLAKWAQPEKLRQQSVMTHSNLGNPVRKREKKEGKKERERKKERREKERKKERNKCGQITTSGHQDHPEQHSEILSLLKIQN

SEQ ID NO: 934927 - protein, 148 aa, Homo sapiens
MGSSGTSIPPERKEDHGGTGGILQTHDLRVANTCHNGTKSVKSTLPDTAWISQRGQLTPNSLLCRALPRTGVSGPTVEQNTPCGIQAYTRTISPSSWGLRSVDSHEDRSQKHICLFFYSSASDELRFQMKLQRVEGKALSLLPCFCEW

SEQ ID NO: 934928 - protein, 160 aa, Homo sapiens
MDKLFDVLLDSVCQYFIVNIHIDGVLSQGVGSFTYKSLTQAAAFLSEMPYPVRRNLESQCGHTCFACFLIVVEPLPTELYHSRLTSGFYVGSENLKPVDLSLLCSMEVGPAQWDHLAPWLQPLSRGVTGFVSLVFQVPLGYENYFAASSASVKAATQFCA

SEQ ID NO: 934929 - protein, 211 aa, Homo sapiens
MQDGMGKGVALVDGHRVGDPVSTVHDNASGAPKGIEGQHIPDGHVHGRGIEGLKHNLSHFLSVVLGVQWVLGQQHWLLLRGPMQLIVEVVPDLLHVVPVGDDAMLDGVLQRQNAALALGFIAHVGVLLAHVHHHALVSGEPNGGGKHGLGSIVPCKASFAHARAIVNDERSDLFFYCDGQRSGTEERQKNKALTRLPWVKTGIILLPGNPK

SEQ ID NO: 934930 - protein, 145 aa, Homo sapiens
MEMLGKWRFAEHNSMSLRKAAYLMKIPWISCVVMVESGSQRYCAAIGWSHGNEQEYQLQLTDDYIIRTSRVIEEERKNKDTLNKSLFIKKFLDDFDCGDHLPSVWIPAASYRCTDYIGSRVCHQKVDQIAPCVYGRGQKQAFRLT

SEQ ID NO: 934931 - protein, 291 aa, Homo sapiens
MPHVRISVYSPMNKGELANDSFINRTVKKEKKKMQKKVFPRERRRRRRRRRRRRRRRRRRRRRRRRRRRRRRKKKKKKERRRKKKKMKKEEEEEEEEEEEEEEEEEEEEEEEEEEKCPLKHTEAPCVKGIETIFWKAHKEAQERQKKQEADRGISDAITGLQNPGVLSWTAESLASSRTLQEEQQRKENNASSTLSSQWWRPLEGGMPAETYFALQGPILDNQPLGSSGSRTKGGQKATALHRNAVQLLSHISTTAEKQAAVQTAKEFEDEQLTSYSQSENKQKRKMKMDE

SEQ ID NO: 934932 - protein, 163 aa, Homo sapiens
MAGSPLSDIYISCECSTTVTSEEEKFCKQMDRINHPVETTQSLSRASAVITQRAHKQSGHDCRGEDYARVQQNGLLLTKANLAMATAACPICKQQSPTLIPRIIGYRNQGVEVKMSPLTVTPSDPLAKCLLPVSFTLCSAGLQVLVPGGEMLPPGDRMTFPLN

SEQ ID NO: 934933 - protein, 155 aa, Homo sapiens
MIDLTPVTQITSTDVCLNCLKNSQVTVAGADRGRQTVIDIELMEFNGNVILSPGGNISPPGTKTCKPAEHNVKETGSKHFASGSLGVTRNVISVTDKCDILQPPKEIKISLKKIKAQRSGSKCGVLPAAKCVYANNAFWHWENDLRMTLGTRSTH

SEQ ID NO: 934934 - protein, 186 aa, Homo sapiens
MAADPKFSCLFPVPTQKVQFLCLNAVFSCITAFVEFTDLGYMSKINCLQLTIVDNCRERRRRRRRRRRRRRRRRRRRRRRRRRRRRRRRKKKKKKERRRKKKKMKKEEEEEEEEEEEEEEEEEEEEEEEEEEKCPLKHTEAPCVKGIETIFWNLFVSIYLCTKNKVLSMSDCVSSCEWAEAVAGDF

SEQ ID NO: 934935 - protein, 141 aa, Homo sapiens
MGGSWRLLTQEYTTAPRRGQSNLLLMSDVLSQDELREKLHQTLKDRGVLGTLKYQLQLTDDYIIRTSRVIEEERKNKDDFDCGDHLPSVWIPAASYRCTDYIGSRVCHQKFQDLRIFSASFYPDLYFADIYFQSVAYLSIS

SEQ ID NO: 934936 - protein, 164 aa, Homo sapiens
MPEDNRCLQVSVGTEKKRIMSLSVSGWRLGMECGRGTPQSLASSRSLSHQVVSGPRENSQAIPTTSDQSPTEDTAYVSAHGIFWNFHSPREKRGPRGHGVANTCHNGTKSVKSTLPDTAWISQRGQLTPNSLLSSGQFSLLKYPFLSRVPQSPLCRESFKNLVQ

SEQ ID NO: 934937 - protein, 137 aa, Homo sapiens
MEDAESWAFSGEPTYYCGEGEKKKKNSGGESVAKKKFLQCEKRGGNSHTQSKVKINEQLLRQAIIACEHPAHRLLMKTIPFSVFKSFNTFDITTADYSPSYPVSTLHLYTVMQTQAPYPMKTSKYSQGPRFEGKELD

SEQ ID NO: 934938 - protein, 162 aa, Homo sapiens
MAHRNPRRAPGTGGRHPDIVTRMGKVLTYGDDDGGGGGGDNGDGMKVVMKMMVVMVMGDGDGAGDYGDGDDGGGDDSDDSDDGDVMVMMMVVTVMMVVMVMVVMVIVIMVMMVVEMMVMIGYGDDVGDGGDGDFVMVMVMMMVVIVMVMEDDDDDDDDDGDI

SEQ ID NO: 934939 - protein, 162 aa, Homo sapiens
MLSRACAPLSGESIPVCLVLRKEKRALQGRSPTFFGFNVGLSQMLGVTNCMASTTSFDQPPIDFQLSAAELLLRLYLSARQSYFTVSNCPILWLLIYTYMFFNYLFWFSVYESFNLCYFEGNTDAYLNFKSVFHPGCRHLVNNFSGDRKTHHHENVATFILQ

SEQ ID NO: 934940 - protein, 151 aa, Homo sapiens
MGSSSWSLVPAGYSGQLKPQITVAAPPSLRELGPSPAVSSLLPLASWNSKSVGLNLGMHGYVSHFAGILGAEYAKLLDFHACPSEPASTRLRLHTALCFRPKPWCLGLRGDLLIYRLQRSVGEAWFARQSRTITHRLTWLRDFPYYFEEEW

SEQ ID NO: 934941 - protein, 163 aa, Homo sapiens
MKFNVVVSAVVTRITKEFIKKQLILYYVKELHLTKKTKLLPQHSTECSQNGVLVPPQSRTAWGQAHHILGMYSSHTIHQLLDLLPVKVSVTAVKSIMVCSNINSCLLRRKNLAEGNKVAKETEKSFTANPAVADMPMLHRPNIGQRVLSKHLESLADAKSGLG

SEQ ID NO: 934942 - protein, 140 aa, Homo sapiens
MVLPGSEKADSCSPCWQPEELQDPHGQGEAAVRPLLAELRHQIKAEFRLFSAIILEIQTEMLPIILFRKLLFILGSGVHVKLCYVGALSQGDGGFICKPLTGAAIICFENTLPGEKKSGSLATSALLSCSSNFSEALFTP

SEQ ID NO: 934943 - protein, 156 aa, Homo sapiens
MQCDSCNLALFFSRSPSLYPPSNLKSLQMGLANHPFHLEAEERNIFVEHTDLLVSWGSLSAAPFSEGGKMEIRGKWSFAEHTSFSLRNAAYLIGDSVVLLCSEDDFDCGAHLISAWIPTAAGECTDYIESRVCHQKVDQIAPSVHGRGEKEVFRLI

SEQ ID NO: 934944 - protein, 137 aa, Homo sapiens
MLCICLKLIEKLVTDSDVICHELYCCAGPIVSVCIQGDQTKYCQDIQKIIQKHCDIVRHKPSPYWLGPYYPEPSEHFTFHFPLKSEECVLNSIVKCLQLPSTIKKVTEHRLSGYTTQRMQTTKIALEGCYTSKQPTN

SEQ ID NO: 934945 - protein, 191 aa, Homo sapiens
MEMLKDWSFAEPNLFDVRMAAHLTADSGLILHSEGKQRRGQVTATPGGMHISVQTGHLSTVNGCMWLESPSLLKEVGLDQLAHEIVVFQKELQKAENAIIAEHEEFKNHRPALQYNCNMHCKATSYARLQVTGITGNPTKKGCRQRECLTNSEETYNPTNRACESSLLSQLRRKLDVGKVAHHPNWEHGNW

SEQ ID NO: 934946 - protein, 145 aa, Homo sapiens
MVFAVTVPCIGFSLLMYWNPQWFLHPADRYSCAHRNSSRNTSFPPRTQRGPSKRSTADTVCLGNSSGFCRTADFHEPRMMLSDHSSGNFVSEEYPAVSEKFDRLKPSSLNSSKSFSIQLHSASGPSAEGLLEFAGGPLQTLFPEV

SEQ ID NO: 934947 - protein, 187 aa, Homo sapiens
MSKRYSFTPHSKFCCGSLFESVPSLRTLTLTAKNSAVNPYGPGLVFVGPPGAENLAVNPSGPGLILVGPSTLTKETQRANTHLVEWEPEAETAFKTLKQSLVQTPGLRLPTGKNFSLYITERAGIALAVLSQTCGTIPQPVAYLSKEIDIVAKTWPHCLWVFVAVAVLVSEATKIITRKRSHCLDYS

SEQ ID NO: 934948 - protein, 134 aa, Homo sapiens
MMKYGKVNIVTISDHFIDINYVVYIFRYDSTHGKFHGTVKAEKRKPVINRNPITTSRSEIPPKSNGAMLALITAITATQKTVDDPSGKLWCDTHGALQNILSVSTDTANAVGKIISKLNGKFTSMVFHVPPPTC

SEQ ID NO: 934949 - protein, 145 aa, Homo sapiens
MVNSMPSTPPRLQHCRGKAPTKASVIVGIPIPTKHDYFRSTSDCCAGSENFKPVVLTLLGSVGVGPTEPDHLAPLLQPPFQGILLLPYDVPALSLPSAMSKSSLRPPQKRLSGCDQNADSDDSEVQVYKKKFLNSKTSERKNSGF

SEQ ID NO: 934950 - protein, 324 aa, Homo sapiens
MLHHLYLALSLFSGPPPKNKVLSNNASSQKPTHSSCIPLLRLPDKQQKVNESIKTDMLCTDKEEECPAASLLQKYTNNSEKPSGKRQCKTKHLISQDLRQGFLLTGKCYSTVPRFRKQLEPSSNYDLTSSKQEMKPFNCLQELLPASQSMKLPHSCSPQETNQSRPVQLRARRIIVDRHAGETLLQQAAWLGYELLETIILHSTFMTSTFPTYEPLHGAVENDCLEIVRLLLSYGAGPTLATYSGRTIMKMTHSKVMEMFLTEPDNGGESNVLADPPGPEDQDDDNEACSDVFEFKFSDTPSYLVKTFKFHLCRGEHGCYVTEN

SEQ ID NO: 934951 - protein, 992 aa, Homo sapiens
MTSHQGGQFHSREWDIGKKYEILKRAKRLLQADVILNYLAVSLMYCYCCFEGVSQVTSMLLLCQGGCKLAYQIDGLEALIMDHTGLKQEGLLQKRTTEDGHQSPERHQFPHLSSYSEQETTRVPFAKAVASGFPGDTTLVFCASPQPSPQVHLPTQAVADIFSEFHEHYARISTAPSVTLSKANMMGSEFPTARLSNSKYPETLEVGESAQPVPMYTWKTVAQDRKDGVSPPLLEKQSITKSISNKPVELSSKVVEVDASKADHMKKMASMGLVHSMAGSGLVLSRSEILKEISSLRNGCAIYRSEFISTDPSSWVVPRPRTNEENNGESMLKNKVMDWMIIQQQSSFYLCMNGKGTMIPNVLGSVSCAGHPTSILTLYYQSPTPHRADGTRTNRSSVDTTSSIIQQVGQPPTVPVKQSSSTSSKVAKASSPELSFKANKNGLQPSPLFLPPNEAFRPPSISHPRSYFPYPVPKATAIRPFSLHDKGPVYPHPVLLPNNSLFLGCLASKPRLPYVVPMGHPEFLIYQDALGFGMVQPMLITHRPIEITKKEKPERRSHSQERACRKDPTLQNQFSEMLEASSTAFHPEVPNDSLKLNPSWNQDSNQQREKRGETRERSHSHERACHKDPTVQNQFSEMLEAGSTEFHPEVHTDNLKLNLSWNQGKTVSRNKKIVYIDLLQEEPDAKTEANMSKPCFTVKNIGQNAKPAKPPIVKASLQQHGDFIMLREELGHIGDLHEAYALKRTPANKENIGMPVSTSFLEPTLVSDGHAVTFGKIQEYPKPYCLGSAPLSMDIISTYTKDGANEAKSSDGKLLKPKPSNLVKRVTTSAGCMADRLKCVTTELYADSKTKDAKPYKFSTADSERWKGNQDKKPKCLLEEDIASQNNCERCSRPGVCLVAMPGQKLLAQELLFQENMPECFVDYLELDTEKVDARDGEGISYNKTPLRSTLSLPRFSAFLWQLFPSADFAGNCHVLDHGPYGRDDYFCPLRV

SEQ ID NO: 934952 - protein, 415 aa, Homo sapiens
MTQKLLPLSSFLGKAKNTPRLSPNLGLTCIVSVWCPTWDKEEYDSVKVGDGVISEVMSREDKFVRKGDKMGRTLLCAGFLALYRDLNLRARCRMCLACDTLRHPEAALDMLQDLLVAAPLPCILGMKLTDHGGEAFGCAAEFGPSAAGLLEFAGGPLQTLFARVSPAEAAEQQILQNGKCCCLILPLETSSQRSSQLYVSWLLLADASQLRYSEVRDTLEETDCPFSDLKLCAGRTTTLFKAARQGRLSLQKFLLPYVQLCPASRHEVYRGRQVSLCSDGVFVWVSFLFVSFPSNIQDPQLQVCWSLLKVHSRPYFPGYQQQSLQNSRYWNQRTVQLTVREMFQCESQMPLLHKRSHTRKWGSRWQPCHECDQSKSGVLQSSLPRGWREGWCFNPRGLTPFVKDEECTIWQDVHR

SEQ ID NO: 934953 - protein, 160 aa, Homo sapiens
MASCKEQTLDTPPLRTVTLISRVRGFILEVSETKNPPILDTGGPPSSRPQNSRSTDSLNFVPGEATDTECQLVETGAKLDLHDTDTRTNPTVPRGTGPQIPIAKLLESSSFSTNSLGQSKSSPVLPVVAALKEKTMGFPFDQGKLLALPQLGVVPGADPS

SEQ ID NO: 934954 - protein, 151 aa, Homo sapiens
MAPHGRWKGSSAVLIADHTDQVEKGISQPSCCAPCPGDQRIGGLLTDPSSQSPPNLLVYKLFVLRGHPWLPWVSHTGEKKSSGIPETLFPTENELSCSGVLAMFNDFCQRTQKPPAKCKQPQPPLRDQDPQPGLQPAYPKSLVLPEIPGGQ

SEQ ID NO: 934955 - protein, 154 aa, Homo sapiens
MRIREAGKASRLAELSGCLSTGKCTVRADLVQMRLREYLGNVCGGAKSEIVSSSAVKGHCVFPLKAKKNQGSTERKSCLMVKSKQCSKTPVRGPKSLLQSANNLSPHNETTTHNLECSQPTPSPFCSLKSLAAKRSGVRGSAMQQQPNERAPPQ

SEQ ID NO: 934956 - protein, 379 aa, Homo sapiens
MVANAVIHVHCFAGAEALTSAGVAVVPASGALEARALASYSRAAAGGCAGEDGLCTEQEGNPGGRGMLVGDDIIAEMEVVAKEEANVEPQQEDLQAQPGPGPSTPRPATDSLDVLHLERSYMNVPGCRASPASGPEPYPCSCQFGMLHGESQAQPCSYFYAQQFHGVDTCTPQGDQEKERPHTQTAAEPVQHPAQEGLLQLRNTEQVVASHNNTLPATPCQLLQCQPLVRAGCLGLSPPTTKTTTALMVPYTPERDRGPGREGALPHTLRALANLQGVSLHAHPIIWRLLDQRQIVQHTQMLAGITNDDEVLLSYVCDGFAGKGRNATIPGTGGRMKFSLYHNLYFHNEVIIQEYCFGILDKRGHYTGNLENHTGLTVL

SEQ ID NO: 934957 - protein, 332 aa, Homo sapiens
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPHLDRRGAVIQSVPGFWANIANHPQMSALITDEDEDMLSYMVSLEVRPGRLGLEGLAGEEYRASHSTPIEWYPDYEVEAYRRRHHNSSLNFFNWFSDHNFAGSNKIAEILCKDLWRNPLQYYKRMKPPEEGTETSESMRSKAENHSVQSVALDSTAVNPTGSHPANPMRLGSLNMKQFQHEHPC

SEQ ID NO: 934958 - protein, 285 aa, Homo sapiens
MEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANIANHPQMSALITDEDEDMLSYMVSLEVRPGRLGLEGLAGEEYRASHSTPIEWYLDYEVEAYRRRHHNSSLNFFNWFSDHNFAGSNKIAEILCKDLWRNPLQYYKRMKPPEEGTETSESMRSKAENHSVQSVALDSTAVNPTGSHPANPMRLGSLNMKQFQHEHPC

SEQ ID NO: 934959 - protein, 309 aa, Homo sapiens
MPSSRRLGHLFEEQKRVQSGRGFSVNKAIFKGIANHPQMSALITDEDEDMLSYMVSLEVEEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSESMRSKAENHSVQSVALDSTAVNPTGSHPANPMRLGSLNTSEALERESCPPLTTVPLTHKHRRNRCSKQIILKTVGTLWPPQAALYPTVCMSKTLWSNRAELYRLCNASSTEYPYTWATDAKGTDKFAPCLSNSEAHL

SEQ ID NO: 934960 - protein, 279 aa, Homo sapiens
MEAVQEGAAGVESEQAALGEEAVLLLDDIMAEVEVVAEEEGLVERREEAQRAQQAVPGPGPMTPESALEELLAVQVELEPVNAQARKAFSRQREKMERRRKPHLDRRGAVIQSVPGFWANIANHPQMSALITDEDEDMLSYMVSLEVRPGRLGLEGLAGEEYRASHSTPIEWYPDYEVEAYRRRHHNSSLNFFNWFSDHNFAGSNKIAEILCKDLWRNPLQYYKRMKPPEEGTETSESMRSKAENHSVQSVALDSTAVNPTGSHPTNPMRLGSLNVRSQ

SEQ ID NO: 934961 - protein, 243 aa, Homo sapiens
MEAVQEGAAGVESEQAALGEEAVLLLDDIMAEVEVVAEEEGLVERREEAQRAQQAVPGPGPMTPESAPEELLAVQVELEPVNAQARKAFSRQREKMERRRKPHLDRRGAVIQSVPGFWANIANHPQMSALITDEDEDMLSYMVSLEVRPGRLGLEGLAGEEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 934962 - protein, 298 aa, Homo sapiens
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPQLDRRGAVIQSVPGFWANIANHPQMSALITDEDEDMLSYMVSLEVRPGRLGLEGLAGEEYRASHSTPIEWYPDYEVEAYRRRHHNSSLNFFNWFSDHNFAGSNKIAEILCKDLWRNPLQYYKRMKPPEEGTETSDETVPTRASMLTTRY

SEQ ID NO: 934963 - protein, 197 aa, Homo sapiens
MIWWTGQIGRDRSGSGSKPIPPMPRNVEEGSDLRETRAFTCMTLEPLDCSGASRPVSWRETSQEGARQAQLPRYYPLYSSGRMPTQYSLQLLSSIMEAKVIWTKPPVLVHFHAAEEDIPETGNKRRFNWTDSSTWLWRPQNHGIRIKALLTWQCQERMRKNLRQKPLKNPSDPEESFISLNIYETIQIIYVFLYQFY

SEQ ID NO: 934964 - protein, 141 aa, Homo sapiens
MKLPLHSPVSPSWTGRWRNSATLNTRGRKKFAFHHNIYFGNKVTTKEYCFPAGHCLSFFSWLSDCEGPGYGTIAEVGQLWGIMAKDLLRHSLASEELALNQNLTCHDQFAQSTRSSARACGSIFCSTTQGILVRTPSVSWP

SEQ ID NO: 934965 - protein, 146 aa, Homo sapiens
MEAKVIWTKPPVLVHFHAAEEEIPETGNKRRFNWTDSSTWLWRPQNHGIRIKALLTWQCQERMRKNLRQKPLKNPSDPKDSSQGLGTTHEKSLIADSLPVDLDSTGLYLHSKGETEANPFLFPSSRNFGQSSLGAEQNKEANRKDL

SEQ ID NO: 934966 - protein, 136 aa, Homo sapiens
MPFRQCACLCAHAQGQETLGVLTNTEVGLNIQPDCLLETHGMSCSVLPSLHISSPVSPVWSSRFPVRWPAFFGVGSCWVNEDGGGNQVCQWSVVSSKRYLAGLGESFWEDADLERPQVGICVEGERSLVEPKLNPR

SEQ ID NO: 934967 - protein, 166 aa, Homo sapiens
MRPEFPPTHRLQKGQRRVPVLWVGLHRRWSMGVRRRTPSSGCTVFTLPEAQREEATLKQETVLVLDDIMAEVGVMAEEEALVERQKDQRAQPGPGPMTPESALEELLAVRVGLELVNAQARKAFSRQREKMERRCKPHLDRRGAIIQSIPGFWANVVSFSVFLLPF

SEQ ID NO: 934968 - protein, 145 aa, Homo sapiens [sequence omitted]

SEQ ID NO: 934969 - protein, 320 aa, Homo sapiens
MGVWTSWRSSNARIFLAAPLTNQNLSCSRMVDTFTTLSCAPGCLRPSITAVSSGLLYFPPSIEETPGVENVVAASGRSTQVLEVPWELAEEAMDRRTGEETRGKITEKDGKMQNEGNAQEEKIEQEEHSVCGDGREQDRKKKKEEQREIREVLTLPALKTAKHSIISASDWIQCMSALATDVQMCPEFLPSDGFVVSLTSRVKLQTFPVNVTALKGVTAPELFVPPAGFLVSLTSGMKPQTLRTISVIAFLQGLIAGDLPGIHVDYKILVDVQHGSVIVIYHVPRDLLLEFQPESTFLRSGPQYLIFMPNPGSHSFSFSL

SEQ ID NO: 934970 - protein, 142 aa, Homo sapiens
MVPWCPNLKIACSASMSGWSLALTMSEFIEIIQVPEKPGIMLHHLETMHIVIMVILFRMNIPLEDIVTVMATVRPMVEIILNIQVEVLTEMHFRDMRTAGHSLRNSGWSPKDVRVCYIPENKIVKVVNIQWLSVQIQSEHNE

SEQ ID NO: 934971 - protein, 220 aa, Homo sapiens
MNKSPADSKVAGPDTSYLHSHWTISYGEMEEPQVTLEVEECNDNCKQTFNTLKEKLGSAAAVGVPKLDELFFLYVTKKQSTGLGDIAATTFLAGKANKLTLEQHLQVFDPTSREDEAAKAPALKGSMKLMGVLASIHRTEPEHSEEEEKWARDFISVNLSKIEKPIQLTSFPQLGKDHSKDIGALQQTFNAKGLTNGYTCVEVKLLLILGAESEADGCGT

SEQ ID NO: 934972 - protein, 136 aa, Homo sapiens
MSQNRITSCGRPYAVKDPMNGISGLVKGSQGSLFSFHHVRTHLGGALYKEQALNRHPICHYLDLPFASIQTYESGPSAASLLEFTGGPLQTLFTWVSAAMAAEQWILVNRKCCCLMLPLEVLSQRSTQSCEVSVHP

SEQ ID NO: 934973 - protein, 147 aa, Homo sapiens
MRYRPFLGSKNRSPVKTRLLLSVLLHKGILRGKPHLVGPRAGALSVRTADSLYLGFHWPQPGTWALADSGPSWPLRRCQKPHLVLGCPSDCGSCLSGNTGNLSSMHGHLKPQELRTQGRHPPHCFQKRMLRVSYRLSLDLSSSWVCG

SEQ ID NO: 934974 - protein, 172 aa, Homo sapiens
MCNIVDGEARVGTGAACGACVPAGVPGGHGLCGPRTRSSQPALLAPGSGELSTRASGCGGCTGSPSSASPPALRSISHRALAAFPRGRARDLQPAMPEPPTHSMSSCAARASRTSTTPCSTAPSPIDHPRAEQCERTARDWQAAPPAAPVRDPLGEASWAPESGGDVESLYI

SEQ ID NO: 934975 - protein, 138 aa, Homo sapiens
MLEGEANTSFFTWQQEKEVLSKRRKTLHKTIGSCEKSLSITRTAWRLYRKHDAGICLASGEAFTVITEGEGQASKQQNLENRLTFLCSLSPVMKGPHSWASGQERNTTKGLGSQTTQKLHETSPHLCMELLERDYGIF

SEQ ID NO: 934976 - protein, 160 aa, Homo sapiens
MTLQICSQGTNPGVYLYISKKPQTRPAQQFLVFESFYEHINQELPEPSPLSRNLFVQLAESIASSLGISSCYVCGGTNMGDQWPWEARDLMPHDNFTLVAPSPKPMLTDRSIWLLKTSIVGMFCIACWGKAFTDPNFGEFKYSLEDSIGYFGFALCKWRG

SEQ ID NO: 934977 - protein, 152 aa, Homo sapiens
MWTLRFPSEDDCLGADDPPFTFSRFGHSEFFGHFLEPEVAIHFFQRVCGFLWLSWYGPAVVLQAKVLDMGIHMLLCPCKWELQSLQPQSQEDAAVSSTSHVLACFGRHAPRHGAHPCAGLGSLAAALRHPVRQLLPGGGQLALLRLPECGAL

SEQ ID NO: 934978 - protein, 140 aa, Homo sapiens
MNGLGHFHGNMHISQVLAVAVVGQAGGQDLRPVGNVLNMNNGSSSVGITVYVGECLWGSEDVEMLVLLGLKANYNQPPLVIPREIGSGVDLQQTPADLQQRGLTVRRKTNKQKGIASTSTQRTSTQKPHQKVTTSKTKGR

SEQ ID NO: 934979 - protein, 156 aa, Homo sapiens
MGPPWAQTVAGRRPTPFLDQPCGGKNALLPLQPGNLHILPLSVLAVAVVGQAGGQDLRPVGNVLNMNNGSSSVGITVYVGECLWGSEDVEMLVLLGLKANYNQSRKAVRDCAMRNSALQPRYYAFPMVFASHRPGDSLGCLCHQGPGFQAQNWVTI

SEQ ID NO: 934980 - protein, 188 aa, Homo sapiens
MFLSPDPFKGLGGPSSNHWYCACISFNENEPKIIKIQIQQIISKPEMMNNTDDILMEQQMNPFNALVYFVVPWRCESYEVFEMWQLVERAITNRNERLGYDKRWWRPKFYYADGASRKVETTQVKVPQLGASRLQVGLDLSAMYSGVDSCNFTAEGIERRTVQGPCQLDIGTEGCEIFTNTTFSVAIL

SEQ ID NO: 934981 - protein, 164 aa, Homo sapiens
MPRKAVRAQKPLPRYERMSRRAELQGTRQKSITWSGITSRDPSLDNDHLRLVAGPPLTNHRLLGFITRLQSRQAPKSETQSVTLEEVHYISENLLEFSNLYRHKYKEYVWKWILKVWDNGGRNIKFEQTKFIDMGSLSRDSTFNAVNQRVIKYFHSLFGWLTEA

SEQ ID NO: 934982 - protein, 175 aa, Homo sapiens
MKGKTKAWLALPPPNCRAPDIKPILPSRRNAQVKAGQQCCGPLTAETRSPQLEQQRLAAVGCVAHLHFPPTKVALGFINTLGGMHMCWASLLSLWPWSGKDLACGCGSCKGLVSDLWECALRGTHSHSCSVQMKVGQVHWRPKDDKAHLAGSSEVGELWGIKSVAVLYLICSYLC

SEQ ID NO: 934983 - protein, 155 aa, Homo sapiens
MPTRALLYEFELPGSFVYTVALKLPTQASAMADAPSPTKLDHPMWISDCCCAGSQNFKPVDLSFLGSMGVVKTVIQVQYLCRSSSGSDLDGFPWVAGGIPRTLVLPRVIVVSTDMQNYDKKIRNIRGKYYPLKTNKHHRESGLRVTAFSLKTRLV

SEQ ID NO: 934984 - protein, 162 aa, Homo sapiens
MGSRIHLTKHFGCPLVEGVCSTGGKLTHQGFPDSSELVGGKTKSPGLWRLRPTIPLGAQSQGDQSFVPEPLAGAVGVLAGSPCSGSVAATLPPKSSAGLESRQLQQCQSTESPNIAKRQKEGKLSLFLNWNIRLLLLDIDALGSQACGLQDLHQWIPQFSGL

SEQ ID NO: 934985 - protein, 134 aa, Homo sapiens
MVANLMIILIMKIIAAHQTQQLRLFNTSGDATNPDRMYDLVAVVVHCGSGPNRGHYIAIVKNGDEEFTGNWSKCLSCCALAKRLAASCLCPRDLWNFEFERDDLGYLAEETSKQQGIQDVTWLFINAYSHMHSQ

SEQ ID NO: 934986 - protein, 149 aa, Homo sapiens
MLREYLNPKGLHKFSLKVFLYIVNYNKWRYNPDDSLYLCQSPSFGQSNVANCSNHVQISQMPSCNQFSCFCTLLPFTVCHFPFSVHKSSSTMSLCWSPSACSSSGGCLIRESSIAQLNFFKFNLAEVFLLTVGIRSEIQSRASNDLQER

SEQ ID NO: 934987 - protein, 157 aa, Homo sapiens
MYNRLHILLYLPKAELPCLGSHPKTIDTIFLLRQVWCQHLQENNSEVRHPLLQNPNPDYSAQASVKVKHFTGVRAVRNNLPNHLTTRWTKAQMKKQPASYHILLGESTRRSTTFYRYKGQNHLIMGTSYQYPAGQQAILPRPLLPIPRNYPSGGHCH

SEQ ID NO: 934988 - protein, 146 aa, Homo sapiens [sequence omitted]

SEQ ID NO: 934989 - protein, 237 aa, Homo sapiens
MPREEPPTSQPLGQNQCAYYKQKGHWKLEFPKQPQLGLSKAGKPELLSHPNSKDGNLHLLLEVLSQQVSKSLQLENTGGCGSRLWLGGSTLSDSYFYWEAQKSTISKASMSPYVPEWQLCQGSKWAIKLPYYSLFFRGRAVSLSSSNVSIWMFQLKIVHYNNVKKNYYRKLVSSEKWGFALKIPENVEMTIKLDLLNGFDQNAEVQAEKVSDEDEELTANWVQYKGQMDCDTALRRS

SEQ ID NO: 934990 - protein, 153 aa, Homo sapiens
MGALLDQEHSEHPAGSREMEVSGGSVTAANSSRGQRAKAQNIHVHQENYNEELAHETVETKSHNLLNTNWNPKKANGVIQSWTKGLRTSGAKGGIISSLRIKENELKYWTLSGGHSQVALGELKAMLLSKSPFLLPWPLREPLSNDGVAGERG

SEQ ID NO: 934991 - protein, 143 aa, Homo sapiens
MEVITTIKNEKSKNLDVYLVFYCIAADLALTPQDGVFLILPSSFQRQSSHISWPTPLQAHGEYCQTTADVSKCLGSSAWNGGPQNCDQYPILLWLSSYLRCKTKSSPLFSLLSSVEKKRHLLEPQVVQPGARCGVMPALPHPC

SEQ ID NO: 934992 - protein, 172 aa, Homo sapiens
MTPKNVEYSAPHCLLACTVSAERSAANLMDFTFQAPLLQVCWHLLEVYFRPCLPGYHQQRLQNSKDCCLFLPLEASSQRGTHQMPAGAVPASRQKCLSPLKLHPQPPLPPGALSQGDGCFFYKPLTGAAAFLSEMPCPERKNLERQSGYSGFAELRWALSSSNFPAALFTLI

SEQ ID NO: 934993 - protein, 137 aa, Homo sapiens
MHQSALSSLLKSGRPRNYQKEETPDTSEYLKEQTLDTPSLRTLTLTAKVCSFIPEVNKTKNPPEGINSGHNFTSFHSYQQCKSVLFSPYPHQSLFFFIMSILAEVRLYCIVVFISISLIINDAEYFYMFVGNLRIFS

SEQ ID NO: 934994 - protein, 184 aa, Homo sapiens
MHSQRDGLKWELMFKKEAEHKGLENLQADHVVEKNNPCSWEEYKLAAEICISSEESNVNHQDNGAKVSRAFRRSSWQLFPSQAWRLRREKWFCGPGIWPCYSVQPQKLVPYIQATPASPMHKRDKHAAQAITSEGESPKPWQLPHGVGPVGALKPRVEVWEPQPRFERMYGKAWMSRQKSAAGA

SEQ ID NO: 934995 - protein, 143 aa, Homo sapiens
MESSSRCWDYALPSHNPGAGGELLQLQFLLDGKDCSQGQLGDLELIVEQQGPVCSTTKADIQVFGTSVSWMSSLNFPTLPVQRSLCRWGLWEWSSLLQAQADFQEFRAPASLVQQPELPHLSCADILVQGTHSTSSQGRLLGI

SEQ ID NO: 934996 - protein, 149 aa, Homo sapiens
MKTKYFSQNILFSEFHARPCEETTKQALCEHHGCLFHLGAGGLSPKRESAKGGGLSLVLIGFGIGDKVKSNVLRNWGIATKITENVEGALELGWLSGCNQNADKDMDNKVQGDEVSDGDEEDIGNKNKGLWVEETCLVSDETFDFGLRS

SEQ ID NO: 934997 - protein, 131 aa, Homo sapiens
MVCLRLHPNIILNCSFHNPHVLWEKLGGSQRLQEIWDYVKWPNIRIIGVPEEEEKYRSLENVFGGIIEEIFPGLARDLDIQIQEAQRTPEKFIAKRLSSSVVDPDICLVQPPPGVPHPCGTVKYNLFDSPH

SEQ ID NO: 934998 - protein, 139 aa, Homo sapiens
MLKGGQKEHLPIHRSQNDTDLSPMCGLGEGLHPSFTAWAGSAAIRGLAYDPVTSQPKWQTVPNEAKGAGTFHAIGIVPSSRACGGNFCMAECQHRQSPGRKPHHGHRSGTADSHDIGIAPLSLPDVVCMLITSKSHVEM

SEQ ID NO: 934999 - protein, 142 aa, Homo sapiens
MAHVYICNKPPQQPLLLPKAPLKKICVHQNHYQFQLEAPFACDPRMVFDALKFTIMVEGNGETGTFFTGQQDRVFDMTHGEQEKAGWCNGPPGSHTGQVHATKALSHNRPVQILNGHLAGDRLRLPSCWGEGWPLSRQLTAA

SEQ ID NO: 935000 - protein, 150 aa, Homo sapiens
MNLPLQGSSLQWVQTSSFSSEKFVITDFLKPTSVNSSKSFSVQLCSIAGEQLLSFGGEKTATLAVSKAPWVWDPLSQARGIISWCAVCCDHWKSTVLGWECPDFPGTVCHSFPWLGKGNPPTPCASQVRQYPDLLWLTLDGLHPLSNESQ

SEQ ID NO: 935001 - protein, 182 aa, Homo sapiens
MWDPVHVRRDAASMHIFLCVYRYLCVPGHVGVCLCVCAYACISGWVFTLPRATVMKLVAVFHVHLPCSPLEPIGRNIRGGGCLQISITLPTSEPQEQRRQHPNLWICKCGLCKNSLSITYAHLSNKDANSTPDPMEQKRRGLHSSQAMETSKVEEVLLVNILKCVFQLVSILPICFWYSTQS

SEQ ID NO: 935002 - protein, 180 aa, Homo sapiens
MEGFQKSFLKTQRKFDSGAQLASPSGSHTGAAGGAACQSCAVRSHSSALGWSMGLGAVEQGVVLIGEARAAQEPMEWVGGSGMAGCRSRALPHGKAGKARREIKRSAGGPARLGHSVHPPQPLARVLSPPLPGASRAGRLLRVWGPPSPRPPGTPAGPQARHTAPVPARASPSTPPCKLS

SEQ ID NO: 935003 - protein, 182 aa, Homo sapiens
MFLFISRSSKMRTHGHRLNTYFLNESMNGRYWKKDSGKDFQNPIKERRTQSSLGLWEESADLPHSKGKPPSHFISLLALHPSAENYHSIKPCTHSPSPRVRQSFRYTKAGSPGIQKALCLFNAAWDRSPTTCPNCSLGDGRNIYIVIKKIVILAENGTYFNVDFAELLLFATVDSRSYFNVH

SEQ ID NO: 935004 - protein, 172 aa, Homo sapiens
MYDMWANKGCAGEEGVEMDTFGSGGLVAGPEGQLVGRGFWWEQCDRGQVGLRGCHRGRVGQRGNREDVFQMKMYHLRSSSGITFRPQIGPEPCSAGRQLRPREKWSTAAAGPGGKPLTAWGLWAILPLQCGVHRSHAHPELALAHKHRAQPWFPLVIVVATVRAMVEIILNI

SEQ ID NO: 935005 - protein, 145 aa, Homo sapiens
MDKCDHGKPEQTFLHIVLTGGRSEASCSSLQDHVVLSDAPYFQNKVITEEYLVNVTGTGGSQDRASHSTPIQWYEDYEVEACGHRHYNSGLNLFNWFSDHNFTGSNRIAEVVSQYEGSHQCEKKWACKVYGGTVEKVTEACGKAV

SEQ ID NO: 935006 - protein, 138 aa, Homo sapiens
MGLFLQSLVLAHVRMCIGESILENQNIKTSKGITFVQFLLTDFHVKKERTRAKKMMGQRKGPAILPSHHSSPCLQKWPDSESLDTNRLGHTSDHFQKGGRLVNAVFCLGMVNGEHGICTDVAPNRSPKSHCDPTKILS

SEQ ID NO: 935007 - protein, 137 aa, Homo sapiens
MKTKHLFKKMFGLSYHPKQLFSSSFCILILEKLIIAELPGSSTVRLTSLCDLPTQLLELYQQGFSLAAMHPFVQPTHGQEKTPLEHIFRAILIKKTDSSVALSLHQCKLEFAVKGGTCLCSNLEFTHFLESCKHQAR

SEQ ID NO: 935008 - protein, 182 aa, Homo sapiens
MEWALHKGRRVTYCKARHTGEGTAFPEVHCELSLGQNPNNVETQPTGDIITYLWAYELGDVSLMPVPCHREHCDRALDIVSSLTEHKRVHTGTKPYKYKERGKHLHAPQPLFKHKRNHTGGKPYKCEECGKAFKYFSDLTNHKKIQTVGKPYKCEKCDKTLSLFSQLIGHKIIHSREKVHKC

SEQ ID NO: 935009 - protein, 138 aa, Homo sapiens
MYTFDRSKGKGRVLHKSIEPYPVVEVDRHCTGTGGGGNWHWVVGIEFEELQRERFIISLAFNSAIAPLSCTLRFKDYGYGELPGIQTTRSPSSTHHLLNTSVDRSIRAEERREGEQRRREVDGGKQDSKPLKERIPER

SEQ ID NO: 935010 - protein, 162 aa, Homo sapiens
MGYCWAQNPDNMTLMTVRNTRRFYIFTKLTEAYNTNLYCINSLVVENFMGLLMMNDSTHWVLPRRWNVTSHWRHLDIEWAVHKGSIVTYCQARPTGKDTLLPEPCPKDCILTYLWTYHLGVLTMSSYSLLAQMIYVHKFTGAEKHHQFGPQICVFDSLMSGE

SEQ ID NO: 935011 - protein, 136 aa, Homo sapiens
MTREQHLLLTSIRCSAASAADTQANRVWHRPPANANSPAAEGPVRRKTNKQKGHPHENLIYEWLIRITNAEKSLKDLMELKTVARELCDECTSLSRRFDPLEERMSVMEDQMNEMKREKKFTEKIIKRNEQNLKEI

SEQ ID NO: 935012 - protein, 137 aa, Homo sapiens
MGPVHQHGICIHMPGAQNLVVVVHQHENTSPGAYQQLYFAWLPDSGCLVVRTVHHILPSRGGVQVFAIVNSATINLSLEVQEECKLIPGKPTLPAPKSLRLLESPFPERADTCVFSPAAVLVTFNWPTISWYLAPEF

SEQ ID NO: 935013 - protein, 155 aa, Homo sapiens
MVVQRGQKIEQNNNPVRLVISVVYKDTLKKIVQQEISCCLAHVHYAKAIIGRHTAPEDKVSLCQKPPTRQSNNRTEGAWGKCQLMAEAHKGLLDIVKHLKAQGLVRKYSSPCNTPILGAQKLNDIKTVVRVPCTSLAFADYGSLNTARWPDHSRL

SEQ ID NO: 935014 - protein, 171 aa, Homo sapiens
MQLALWDLEAGCIGPEGGATLRLFLLLKFTFIFCFSGQWKIIFPQTRVAQGKKAARWTLLGVGTGVWDPKGTWWGGASCGSSVTGGRWGSEASMGTGWGSRDGGRASKDGSKSKSRDFAFIISENPADAKNAAKDMNGKVKKYSSFSLQIKEVTRVRPTFLIFLCLLENSP

SEQ ID NO: 935015 - protein, 139 aa, Homo sapiens
MSWLRVFQSTYLESSSTCRANKSPLEKQDSYLIYTVIVQVYLWKERDQECRLGSAKLCGSHREKCKVCINTEPSNEISSPRETVGSNFAGFAYQKKLFQLNTPWSPDVFKGHILATDSYRSVSGTLGAHTIASALVGHV

SEQ ID NO: 935016 - protein, 151 aa, Homo sapiens
MYKSPDFTLRLFSGKESQPQKCDESWFKCYQITCESKPSRATVQDSVSKQKQRQKNKEEGGEEEEEEEEEEEEEEEEEEEEEEEEEVGEGEGEGEGEEEGEGGGEEEEEEEEEEEEEEEEEEEEEEEEEEEEEEERRRRRSLNLGAGLCNM

SEQ ID NO: 935017 - protein, 160 aa, Homo sapiens
MPAVFFCESIVSDGFLLGYMALCSLFFCESLICGEYINGPGPPSVSVSSNKVSVDLPFPSWEIRSAPPQHCGTYFQACHRHRQPLTHCLHIICSSGRPVLFYQSQNPEKHTRLHSNPQRTLYLYIASFGNGVRRVVSSDHLTVSKHVLIQWEQTTKTAKT

SEQ ID NO: 935018 - protein, 134 aa, Homo sapiens
MRHSIDYQAKARHGSLLLILQESCSTPIKVVEQKLPWSSSVNWETFNMEDTEPDQGNPRLTRNMEDRKRRSKCGGHIPSCIYQSHFQVEPSRKALKLGVCQDGPSLHIKYSLHVGVLPPEHQAIVWTTCVIKDM

SEQ ID NO: 935019 - protein, 137 aa, Homo sapiens
MVCYLPTANARQGPTVPPFIQAYGAAPFEDIQGDFTEMLQCRGDCLWTKDWNVAPLGPRWKGPQIIILTTPMAGECVALGINGARLDPPVNILVQGEVYKHSPEQVCQTFYDELNVPVPKIPGKTRNLFLQLAEHTA

SEQ ID NO: 935020 - protein, 279 aa, Homo sapiens
MRVLLGRQLPQWNVSPEQCMAGPRRGSRQWLNTGKEMAKGFNGDYGVTMTPGKCRTYFEIDWSKLEVGWPSEGNLERSLVSKVWHKVTGKSGHSDQFPYIATWLQLVLDPPQWLRGQAAAVLVAKGQIAKEGSYSTRRGKSTPEVLFDPTSEDPLQEMEPVIPVVPSPYQGKMLPTLEPTVLVPPQDKHIPRPPGVDKRGGEASRETPTLAARLRPKTGIQMPLREQWYTGIDEDGHMVERYVFVYQPFTSANLLNWKDNTPSYTEKLQALIYLLQTII

SEQ ID NO: 935021 - protein, 141 aa, Homo sapiens
MVEADCPGKLSLVASIEKPVKKMLKEVFAKHGPLLEDDDGYTLDLNMSSSRGAIPVKRGPSSRSGGLPPKKSAPSAMARSNSWMGGQVIVMATMTPVVEIILNVHVEVLIDMYFRDKAEDPAAFCSVCVPGYLRLGSGDDS

SEQ ID NO: 935022 - protein, 156 aa, Homo sapiens
MSSITSTFSSHEGTSTLCALAGLSCRASKFNGVPPLEKKTHASALLADMFLRRCDSNLISDNGAHYCKYHTYRSKVGGQGRRRRMRWKRRRRRRRRRRRRRRRRRRRKRKKEGRRKEGRKEEEEEEEEEEQEEEKEENSKLLSLYICNTRSETQYS

SEQ ID NO: 935023 - protein, 145 aa, Homo sapiens
MTRTGPRGTGPKGKARSEKGHSLSHGPRRDKLLWFREDRKCSRPVSWQAPAYVITLTEPQVHLTIEDQEIDFLLDTGTAFSVLIFCPGRLSSRSVTIQGILGQPVTRPESQKGLQDIAKHLKAQSSLSKEMQQSLQHPNSRSTRK

SEQ ID NO: 935024 - protein, 137 aa, Homo sapiens
MYQLELKEDHIIRTNGQIEDERKNKGKAVSLQVELLAINVKKEELNQSVNCMKEFKMTLTVGAFCLLPGSQLLLTDAQIILDLGAVINNKKQTTTKKTQDNSSISDGISKMMVLNNLKSAFIWCLRPVRRECIAAPP

SEQ ID NO: 935025 - protein, 148 aa, Homo sapiens
MTGLGPRQRSLPLWPAPQLIHRGYFQSTADVHLNPKDSQSPFDEYYQAWNLPFRAVGSPLAQVMSINIDEESLGLDSGTPRVVVLYYYSSSGTQGSCSHDLIISKRPHFLTLGIRFQDFWGDTKFMPNQTVRMTKVEKYIRPYLYTYV

SEQ ID NO: 935026 - protein, 134 aa, Homo sapiens
MSENTRLATILEVARGHFGSDPPPSWELWEQGPPGNTLTPCLTYRAYWCKGCAPKALDSPTLVNFQVQPPQLLLTGSAAFPEAQCKLPAYQPFWDLEDAGPLLTSLLGNASVGTPGPPPLRVPSVGHQIQTENM

SEQ ID NO: 935027 - protein, 151 aa, Homo sapiens
MGHITVFQPMMDLICKGELERCSGRSTALFRASRQGRLSLLKLRPQPPLTPGALSQGDGSFIYKPLTGAAAFLSEMPCPERRNLERQSGYSSFAELWLPPLSSNFQAALITLCVPHLEIQKSPSSALILSEAADRRCSYSAILPAQKDVSY

SEQ ID NO: 935028 - protein, 193 aa, Homo sapiens
MARADAEAEEVLRASLLQVCWSLLEFHSRPCLPGYHQWQLQNSKDCCLFLPLEASSQRATCQMPASTLLYEVSVDPCWVVSPSQEAWRQESLSLLKLHPQPPLPPDALSQGDVSFIYKALTGAAAFLSEIPCPERRNLERQCDYSSFVELQLEVPCPERWNLERQSGYSSFAELQRAPLSLTCLAALVTLQKR

SEQ ID NO: 935029 - protein, 138 aa, Homo sapiens
MAYQWPWKFSYSHSLQMGTGWVHWETVTVDLEEAVPVHHLETGKPSADFEVDPYSSARSADQRPGVKRKSNLLVNGKVPNGKLREETQGLLESLQEEAQMQKREAARTLKYLGSGHKVHKVNLKYLVIPETIEMIKNH

SEQ ID NO: 935030 - protein, 166 aa, Homo sapiens
MLQPWLNGAKVQLRLWLQKVKDPHLGSFNMVLSLQVHRSQLIEVWEPPPRFQRMYAKAWISRQKFAAKVEPSWRTSARTVQKENVGLEPPNRVPTGSLPSGAAKRGPPSSRPQNGRSSVSLHHVPRKAIDTQCQPVKAAKRGDVSCKATEAELPKAMASCISVIWL

SEQ ID NO: 935031 - protein, 166 aa, Homo sapiens
MASTTLSNYAYIMFLRIHSANKPNRYLHLFQLKHYADAIGAHCKVSMELPFWGLEDCGLLLTAPLSNYQPQLTLNQEKAGPTLLQDWGMSALHILLLASLSQCPCLATPQECVDSVASTAQPGCCASPNYLPCSLGTLWIPQHTWYLTLLVQRIELRASPGTLGLQ

SEQ ID NO: 935032 - protein, 128 aa, Homo sapiens
MIIPTISALSLTKAQRFFLHTMHPLPSYERVVLAIPNYLSYLVNASFSDKKLKPGTVITQRIFGSYDDVYHHENTQKYKSSNKKEENKGLTFYHDRNPTDHNDNLVTAFLKHRGSESSIPLSETQGKS

SEQ ID NO: 935033 - protein, 138 aa, Homo sapiens
MIVRLPQPHGTVSPIKSLSFVNCLVSGTGASPSGHHHHQHTGNLPGNHYCSLNIPRALQSACGECRQAWDSLYSEIITPESQGMIIHTEEPVKGVRGNSHNDRGKQGERSIIEIEKGQSHEDSGPQCKISKRDEIPTE

SEQ ID NO: 935034 - protein, 149 aa, Homo sapiens
MPSKRQVLKSGIQRPHLCAIPLIENPFRCSSETGKPGEAQQTLTVEEICLGLSFHGELSPLSLSLSQLGTLSRQRLSTSQLQVTDWSYTQPDHAIEKKNPFLWGEIQAGHRICISNEKLNIISQANGKNVSRVCQRPPCQPSPIKGPEA

SEQ ID NO: 935035 - protein, 267 aa, Homo sapiens
MWESLELLRDLINGFDQNADNNMDNKVQAEVVLERDGKLVGNWSKGHCCYAKRLVAFCSCPRDLWNIEFVRPDLGYLAKEISKQQRIQEEAENKSLENLQPDHGIGKKIPFSEEKFKPTAEICISNEELDVNHQDNGVNVSRACQRPSQQPLPSQTPRPRKEKWFPGPGPGTHYSIQPWDLVPYIPATPGMAIRGQRTAQAIASESVRPNPWQLSHGVGPVGAYKSRIEVKKPLPRFQMKGFSHNSESWLKSSNGKLSFQEPHNGNI

SEQ ID NO: 935036 - protein, 149 aa, Homo sapiens
MSSKISLKESKRCDNRNTQRKKWEKDANIAGFVDGGKTQKPRNPGIIHQCRSYDAETLGTQGCPASRHYQAGASVAASITRDAQARLVLSNGQDCSTEFRFDSSPSAKVFYGNKLSLITGSGLALLSEKITKLENTDKILSADVGKHVA

SEQ ID NO: 935037 - protein, 204 aa, Homo sapiens
MQSGTGAHLKAETSGECSRVAQRRPGNGAPHFSDGGAARERRSLLPRRWRSGAEALVKCGRQAEAHLTSQAGPPQGRGASHFPGRTATGQRRSSLPRRCGSQAEALLTSQTVGHPGRGASHVPVGAAAGQRVTSLPRWWDGRADVLPTSQTVGQPGRGAPHFPDDGAAGQRGSSLPRWWGVWAEALLTSQMDATIAIEEEEPEG

SEQ ID NO: 935038 - protein, 217 aa, Homo sapiens
MRSQMLIPKTTGKMSPGHVTVLRDSLSHYRPVGLGGKSGFIGWAQGPHAVCSLWTWYPASQPLQPWLKGANIELGLWLQKVQTPSLGSFHLVLSLVPTVAPPSGAVSKGPQSSRTQNCRSTDSLHSVAGKAAYTQHQPMKTARREAVPCKATGVELPKTMGTHLLHARHGIKRDNFGALRFDCPGGFQTFMGPVAPLFWPISPVWKGCIYPMPVPPL

SEQ ID NO: 935039 - protein, 139 aa, Homo sapiens
MCLLPLHTSAMTAKFENKQTQTPLLCFLSGSSGILQKGHLSNQQVSPCAQLCPKLNEFTFCVEAKTAVGEAGFSASKDALTFISTPTSIWPHFISLPQPQSKAQNLGRQSQRRSYNHGYINVAMGEKAGMTPNILIKEI

SEQ ID NO: 935040 - protein, 148 aa, Homo sapiens
MEAKVIWTKPPVLVHFHAAEEDIPETGNKRRFNWTDSSTWLWRPQNHGIRIKALLTWQCQERMRKNLRQKPLKNPSDPKDSSQGLGTTHEKSLIADSLPVDLDSTGLYLHSKGETEANPFLFPSSRNFGQSSLGAEQNKEANRKDLCP

SEQ ID NO: 935041 - protein, 148 aa, Homo sapiens
MKPPEEGTEISDEPLNSLCSGLPVWGVGSCWVNEDGGGDQACQGSVVSSKRDVAGLGEPFWEDADLERPQGSPIMKCGYYSSLMGLSPPAHDGLSLFTAVSSLSLGFSMCVLTPGPTGLSTPSPGLLPWPLLCSLSEGLTPLHSAAEY

SEQ ID NO: 935042 - protein, 170 aa, Homo sapiens
MCSLWVNGLPHSGCQLGHRAHMPTFPKVTQPACAWMQRYLALALRASQSRLTPGGWDCRPALVGAAQGDAHRLALIGRRGRLAVLARLQVPFECSPLGGAWKPGACALRPAHPQATERAAQGSCAMGRAAQAVVYGSPEKDTVFRVHRLHSARGAEGGGNLEAGDSAGVG

SEQ ID NO: 935043 - protein, 151 aa, Homo sapiens
MINLPKKLMYNWFLQQCRDKFKWKWHRNGEQRRNQIAFQGKNYFTQAKRTTSREEVNKFYCEKPRGHRTIVNHSLNQTTLQQKAKEKQIHGFTGQLAQAHAGELPFIKPSDLMRLIQHHKNSTGKIYSHDSITSYWVPPMTHGDYGSYNSR

SEQ ID NO: 935044 - protein, 138 aa, Homo sapiens
MSGHDLNGKLKKEGLDLFESPGETAGVPKRQTANILSILQKLIPQRTRSSMKRTVTLGNAFGGCLGNCQGQSTVRSVHTDAPTFFSGLNRDEETAEFLRSCIIPEDLAFSRGHPYGTGRTQTIKATLGQRKCKQSTNH

SEQ ID NO: 935045 - protein, 138 aa, Homo sapiens
MPVHQLLQTAGEVMHVQGSCDAGTIRCMLSSLANFKNFSVELGSHYVALGSGYPPTSTSQSAGMTGVSYHAWDSCFFLKLYFNILFMIKKKRRKESWMQSQTRKPIGIRMLLFLGNFQGNCWLQMLHLPYISSDFMWI

SEQ ID NO: 935046 - protein, 48 aa, Homo sapiens
MVHITGLCVDTPKYPGATVALLDGKSPRGEIEITTTFGSENPIPGGNW

SEQ ID NO: 935047 - protein, 62 aa, Homo sapiens
DIPECRRVAALYDILVCRRVAALYDIPRYVTFRCAGVRPRYMTFRLYDIPRYVTFRCAGVGR

SEQ ID NO: 935048 - protein, 86 aa, Homo sapiens
EIPPSGALKACGMNNSSSSGPVPRYKCTEQQDEQRQEESWLEDTYPLKIKREVALVLHSSHVRLGQFLFTEDYKTPAPSSLGLMPF

SEQ ID NO: 935049 - protein, 39 aa, Homo sapiens
PGVGTQRCWNFVACLPVRAIRPQTIIPNKQPKAMGPTPP

SEQ ID NO: 935050 - protein, 128 aa, Homo sapiens
RGAWLSPLSAMACARPLISVYTEKGEAAGKNVTLPAVFKAPIRPDIVNFVHTNWRKNNREPYAVSQLAGHQTSAESWGTGRAVARIPRVRGGGTHRSGQGAFGNMSRGGRMYAPTKTWRRWHRRVNKT

SEQ ID NO: 935051 - protein, 71 aa, Homo sapiens
GLRNSLKKGGTQGAIAIVEAVKALSSGSPCYLAANKETCGENVEVKRICCIKHMIYSCDGAFIWNMFCYLR

SEQ ID NO: 935052 - protein, 129 aa, Homo sapiens
LSVPELQETMEKLTWLASERRMSQEGESEEENSQEENSEPEEEEEEAEGMESLQKEDMTDEAVGDSAEKPPTFASPETAPEVETSRTPPGESIKAAGKGRNNHRARNKRGKSGSGQQGHLPSCCLLVID

SEQ ID NO: 935053 - protein, 151 aa, Homo sapiens
EVIRFQDGTLNLLVATSVEGLDIPHCNVVVRYGLLTNEISMAPGQGVAGRQSVYAFVATGSRELKRDWFNEALTLMEQAVAAVDKWTRPSTKAKIRDLQQAADQAGGPGSHSMNQRHSFPVEHVQLLCINCMVAVGMASDLRKVEGTTMSM

SEQ ID NO: 935054 - protein, 101 aa, Homo sapiens
LQEHTCVLHSISGLGGAPWDAGRAWRVPPVTLTPTIPRARMSESLFKDEAAACYHHPGLPSPGSLAEVLILNSDCSATQGAEPEASPTRSSSDVGLPEPPS

SEQ ID NO: 935055 - protein, 82 aa, Homo sapiens
GTLAAEIRALREAYIRDGGRDPVWARYVCRWRRLHWSCSGSRRLPPSSSVSLVCELQVWQGLAWAEGTTAKVGSHLDYLTKI

SEQ ID NO: 935056 - protein, 145 aa, Homo sapiens
KGRTIFSPHFGKVVIVAMCPDRLERRGTTGESVREPAGEKKKQQFNSRRPPVPACSGCSSESAAALHFSPAKPPLLLLPPSSLVVATVLQAPGFISVGGAPTWIPQSFGPNGVWEEKTTNRFNRLGPILGSTPEGKKNWLGRGTI

SEQ ID NO: 935057 - protein, 143 aa, Homo sapiens
SNEGPFSKPPKNSFNLPRKIRPWHGCLKIRGFVSFPNASKFPCKTCCSGKNQASDCRVHFQPPVDTSEGGLQQQGPSFLGREERGPGVPFQRGQPFEVLIIASDDGFKAVVGDAQYHHFRHRLPLVRLVEVGGDVQLDSVRIF

SEQ ID NO: 935058 - protein, 106 aa, Homo sapiens
MKSFLVSKETPRNESKLDAQKYKLPEVMRPYYSLGVQYRRSSLFRQLCCANGGEENFGSSQDPGSAGAGPVPARRINRQLLENDNFQGPHAGFPQLGKRLPQFDDD

SEQ ID NO: 935059 - protein, 60 aa, Homo sapiens
GSGNRSGNATSSAARRLGLQALGCSAGLVCSGATTAHGSLSHPDVSDLVPTSASSSGSRI

SEQ ID NO: 935060 - protein, 85 aa, Homo sapiens
EGVVGQSPEELGPAQAHRAGHTQRPPSHPWGHALMPGAGKLHVWCLSVFVFQEMIQIAAWILKFTVTVSVHVWDPVSFLHQFGKN

SEQ ID NO: 935061 - protein, 105 aa, Homo sapiens
VRRQVERQYGFTCEGCKSFFKRVRNLIYTCRANRNCPIDQHHRNQCQYCRLKKCLKVGMRREAVQRGRMRRTQPTGQFALTNGPLNCHSYLSGYISLLLRADPAH

SEQ ID NO: 935062 - protein, 72 aa, Homo sapiens
RAVSTPRSMPGASQIPALPPVGRTLSGLLESLIPELDSWMTFLDLLWAREETTSLKTQRSHYIAQLELLGSN

SEQ ID NO: 935063 - protein, 58 aa, Homo sapiens
GISSQSPVSRLSPRRAGPSCHLSALFLSLPFPNGSGRSGIAEPGTRALGTKCPWAIPQ

SEQ ID NO: 935064 - protein, 77 aa, Homo sapiens
LSGDILVILEGEDGWWTVERNGVVRPWFLPGELRKARSPWTCLPVEPPQHCPTLGPEPSVPQPDEPVVSQGIKECVL

SEQ ID NO: 935065 - protein, 80 aa, Homo sapiens
RHRMFGAGAPGRFLVGRWRGRSFCKARDGGAQAALFRALRSSISLWIPPLGPGCPAPEHPPALPSQSHAEAEVARGRPRL

SEQ ID NO: 935066 - protein, 79 aa, Homo sapiens
ANSSLLSSLMNMSQGNPGLGSLLNIKAEQRGAPLRLALPRQGVEGSEVGRAWKVYLRRFGTKDFCDGQCDFLHKAHFHL

SEQ ID NO: 935067 - protein, 58 aa, Homo sapiens
MSPPIQATLPENATHPARVLSGKIFVLLTLAFLPWSGLKESTLGQGGRGAQATGSPGG

SEQ ID NO: 935068 - protein, 131 aa, Homo sapiens
QGLANPVTFKTFWLRKRPAWARSREALVFHSCATFLNDSPGKTDLAWGVQAGPGSPDGLLAGMDPLVVEEGRALTEAAATLRRRLLARVNSPVAEQHWPLAKPCHSPRSGRPLARVQELVLGEVGAVAQRG

SEQ ID NO: 935069 - protein, 70 aa, Homo sapiens
CLLVTLAAHLPAEFTLGALPKFLASVSTVPPNTVKLDLGAMLSLASPQPLLPFLHPYPRGLLIKSEWAAK

SEQ ID NO: 935070 - protein, 74 aa, Homo sapiens
LGGPGQLQAPKPLPAGDPGAHLPAEFTLGDASLDKFLLSVSTVLPPNTVKLDLGMLLASPQPLLPFLHPYPRGL

SEQ ID NO: 935071 - protein, 87 aa, Homo sapiens
MRLFVSDGVPGCLPVLADSRACPGLCFEVLISTVGPDDCVVPFLTRPVPVLLDCGYLFSTSAICRYFFLFSGWELDDLSFLWLVWDA

SEQ ID NO: 935072 - protein, 99 aa, Homo sapiens
MGYHYAQAGLKLLDSSYLSALASQSARITGMSHCAQLVAYFLSDLMVTSVLRGHFLGYGGPSVIKRLYNLCNTDANLSSVQYHHFHFRYYLQPEKTKAY

SEQ ID NO: 935073 - protein, 114 aa, Homo sapiens
MDKANYRNNCKNEKIRPCSSSNLERVSPDSLFGDWFSFFRGFKTLIAVVLAVLGSCLILLCLLPLLARSIQSAIEAIVARQTTTQLTALHKYQPLPKEENLSLDAELSNSEAFY

SEQ ID NO: 935074 - protein, 153 aa, Homo sapiens
IVPYSSNKDHPPAHCDSHHEGPQPSLSTTAPPTVSDIVLLLVGQESLLVVEGLATDGTAEGVPDVALAGDEVGLLAEAAVAVGTGVGRSPVWMRRCDTRLDFWLKLCRSRGRREASRRCGMPVRQVGFVAEALPQSGHTKGRSGAWIYAQMAA

SEQ ID NO: 935075 - protein, 102 aa, Homo sapiens
FRTRAHGSRAACLSSFWRPRSPRWTPILGFARFAAELPDLEGRWLEQRVVCVLSPLRGDPKVRGSEEVTRGASRPWPCPHSPSLPGVSSLSVTMSAAWIPAL

SEQ ID NO: 935076 - protein, 64 aa, Homo sapiens
QVCVRWCCRSLRSRKPFRTRRRGRLAAVVRLVCRSPATRTKPCRSRDRRVPCARVDLQVLGQVG

SEQ ID NO: 935077 - protein, 55 aa, Homo sapiens
SRAPEYMSSRASVCLLWDMYLKNRVRYIWCASEYSPFSTGAQLALHTLAQHAVAA

SEQ ID NO: 935078 - protein, 118 aa, Homo sapiens
RSKSEWKDLGENLRGTGLGASAQATQTGAGCYSESANPSRCRIPSPPPWPAYKLVLIRHRAWNLENQLQAVRRRPEPGEEANAGGQALRDAGYEFICFTSVQKRADSDPLGQVAKMPI

SEQ ID NO: 935079 - protein, 78 aa, Homo sapiens
GLRQPLRQRNRSAAPGWAAGSRLAGLVCSGATTAHGSLSHPDVSDLVPTSASRVVDLGSGFQHVAALGLPLLPCVGEA

SEQ ID NO: 935080 - protein, 60 aa, Homo sapiens
MAAPRRSLRRRKTGYSDPEPESPPAPGPQISGPSPHGHLLADPDRAPEGPSFVYFVAFLC

SEQ ID NO: 935081 - protein, 50 aa, Homo sapiens
DVNFSLPKKRLNINYIANMSKVFKKTSSNGKLSIYLGKRDFVDHVDTVEP

SEQ ID NO: 935082 - protein, 30 aa, Homo sapiens
PFYESVISNPFVAESEGTYDTYQACSQWKA

SEQ ID NO: 935083 - protein, 83 aa, Homo sapiens
SRKRDPAPVPHLGGRQRAPTRPDLRASSLTARARSPAVTPRQDPSLAPGRCGGAGLRPSGLRETEPGRAQIRALTALPLPGDV

SEQ ID NO: 935084 - protein, 160 aa, Homo sapiens
YQSEVGPKLGVTKSTSPPVLSKVSSGRDRQEVWMHFSVLDKILSTFPFPIGCSHQDSVSGSRRAIRPPPTREAAARRMGDHFGYPNKRSKDGVFQGMAAKFAIIPFEEWPFCSLGWVGIQLPLVDHIQEAFQGCNAWSHRTGTASRFIADSLLPKNRKKQ

SEQ ID NO: 935085 - protein, 116 aa, Homo sapiens
KTISKYLYILNIRKGDSKNTAFGQGAGCHARNPSTLGGQGGRITRGQEFKTSPTNMEKPRLYQRHKTSRLRWRKPAIPATREAEAEESPEPGSGGRGEPRPHHCNAAWATRAKPRP

SEQ ID NO: 935086 - protein, 38 aa, Homo sapiens
MAEPKQERVARAKHQRSETVRGYDWGLDISLVTLLRSF

SEQ ID NO: 935087 - protein, 84 aa, Homo sapiens
QPKRCILTLTQGQRLQRRIKGPKSFSSEGIKDFFSMKPEWENLNQSNVRRMHTVRLNEVIVKKSRDAKLVLLNMPGPPRNRNGD

SEQ ID NO: 935088 - protein, 72 aa, Homo sapiens
SHYGAAEPGFEPSRSPDPDWSTRGPAMVPWVLMGKAVSSPEMNQFRDHSLERVRANEVSIQLCWTPSNTKLF

SEQ ID NO: 935089 - protein, 62 aa, Homo sapiens
SAQGLEKGGGGRRVERGSGVPVEIRGGRQIRWLPSPLLCIGLKTTTNISHERSKSQQYQPHQ

SEQ ID NO: 935090 - protein, 91 aa, Homo sapiens
PVAPEAILGWLWLFLSQGLKKLLPDLGVRARQAAGGGAGGAAWKVLQVLALLCRASPETTIAHPTLEDQPQRVLLEPAVCGDNGGAFVRDC

SEQ ID NO: 935091 - protein, 92 aa, Homo sapiens
IRHAIETLYSGPEAQAAASVTDEFCKKMPGRAPQGLEAHRKGSGLSAFTKYMFTLLGVCRGVAKTATWLRCGMKLDQVEAEGPASPGRRERM

SEQ ID NO: 935092 - protein, 83 aa, Homo sapiens
EFPPPPPPPMGICKFLLVPTGTFIGAIPALWKPLVLTPSHVSDKSSVNMSHPPRGLPDHPGIKHSPLSLSDHYGDGRLALVNP

SEQ ID NO: 935093 - protein, 53 aa, Homo sapiens
PLPERYAQSLVVVASGEHHRQPGIQGLDCVNSRPLMPGMEMSENTILKAFRVG

SEQ ID NO: 935094 - protein, 33 aa, Homo sapiens
FISPSFLEQGLRPCHISYAPAIHASFAHQRIDA

SEQ ID NO: 935095 - protein, 76 aa, Homo sapiens
RSPQTALQPGGARPPPPAAATGPSSSSFGSQDEETESQRGEDDLPKITAIITSPWAPRPSSQQPPPWAMSSSDEET

SEQ ID NO: 935096 - protein, 99 aa, Homo sapiens
GTRRSCWEEKFLCSGAGVHPPGKEATAKQILAQEENKFEKNNYDTVYTIEVPFHGKTFILKTFLPCPADSVVPGGDPAAREMVLWDRVTACQLAAEKDN

SEQ ID NO: 935097 - protein, 136 aa, Homo sapiens
MGLEDEQKMLTESGDPLEEEEELVDPLTTVREQCQLEKCVKARERDLCDERVSSRSHTEEDCTGGSSWTSLACEGTIWVGPQTSLFENKWWWTLISPPVFHHLGIRIFPYGFGCTIWFLICVTVSSHEPHGFGLGW

SEQ ID NO: 935098 - protein, 67 aa, Homo sapiens
RQSLALSSSLKCGGIIMAHCSFHLVGSGDPVTSVSRVAGTVGVRHHAWITKKIFFIDELSLCCPGWS

SEQ ID NO: 935099 - protein, 57 aa, Homo sapiens
SLSSGRRGRRGRDDEIAKAQARSAWDTIFGKIIRKNIPAKIIFEDDRCLAFHDISPQ

SEQ ID NO: 935100 - protein, 56 aa, Homo sapiens
QFSFKDLNFRMFDVGEADSEKWIHCFEGVTCIIFIAALSVPDMVLVEDDEVNRMHE

SEQ ID NO: 935101 - protein, 74 aa, Homo sapiens
LSTVPGQGKASLADLGWRGRRLRARSLSQWGAGGQHPCAPNTNRANSGAQGFRVPSVAPALPRFVGACSCPRHS

SEQ ID NO: 935102 - protein, 127 aa, Homo sapiens
GVSSASEAVVRRQQRFFIHALRGDKLRRLTVTECDGAGFIQQQNVNVTCRFNCTSLVAITFAPSIRLIPATPIADNRPPIVVGIRQTSSATSTVTLTALPHAENGHSVVASKKTVSQGNQQNGQGIS

SEQ ID NO: 935103 - protein, 81 aa, Homo sapiens
TALTNFVQMLAIFLIPTALCFAFGEVMGDRRQGRMLLWAMSVIFVICVGVVMWAEVQGNPHLLALGTDSSINMGKESRFGV

SEQ ID NO: 935104 - protein, 55 aa, Homo sapiens
RVQRVGCWMAEPQAESEPLLAARGGGDWPAGLTTYRSIQSALVPQARWDLLPVFE

SEQ ID NO: 935105 - protein, 118 aa, Homo sapiens
SPFSRFPSLNHSWYQLEAPNTWQAPSGLYWICGPQAYRQLPAKWSGACVLGTIRPSFFLMPLKQGEALGYPIYDETKRKSKRGITIGDWKDSEWPERIIQYYGPTWAEDGMWGYRTPV

SEQ ID NO: 935106 - protein, 110 aa, Homo sapiens
LRRGKLRPARREAESGDQAAPSLLSGPSPPCACSYGLGRRPSPAGSGAQACAGGASSSAPSPCSPASLSSELSSSKYGNLPPCAGAAGCGASRGHPRRSFCSIRREETAV

SEQ ID NO: 935107 - protein, 50 aa, Homo sapiens
SARRNKLEEMINELAVAIDSCKRTGIHGSPGENQSHRHPNSRVVLSLFEA

SEQ ID NO: 935108 - protein, 42 aa, Homo sapiens
ATSAARAMAYVPAPGIPATYNPTLPYYQPIPGHQRGNVCLTE

SEQ ID NO: 935109 - protein, 71 aa, Homo sapiens
MGQQCQAFEAKGKAVLVGTTWPGTSKGPGVRYTQSWGLNAKIALPKHRLKPSSQRGVVGDLLYLASFSLFF

SEQ ID NO: 935110 - protein, 126 aa, Homo sapiens
PNRRKQVKKLITADIREAHARGEQAMSVVLRALLPRPVKERIYWVLPSPNVMNDPGNASVPDSVPADKTESQRIRKPSLPSCRKQFTELVHSDGSDEGKQSLEQGAMQPSFKSVTGKGGIKVIGSV

SEQ ID NO: 935111 - protein, 49 aa, Homo sapiens
MSSKVSADTLYEAMREVLHWNQRRKFLETVELQISLKNYDPQKDENFSN

SEQ ID NO: 935112 - protein, 104 aa, Homo sapiens
RGETRQMSRGCAPSIYPRKPVKWRIYWVLPITECDESIPVNGVRARQRASRQNRKPSIRETIIAQLPEGQFTESLPQLMEKVMKEKSLEQGAMQPSFKSVTGKG

SEQ ID NO: 935113 - protein, 73 aa, Homo sapiens
EHSRTRVCASVVGVPPAHAPGAAGGGRRWLQKKGSCPQSNTEATALADNILNSDGVTLSASVTSIRRPPRLGP

SEQ ID NO: 935114 - protein, 71 aa, Homo sapiens
PYAASFAHASARTSPVEIGKEEFITKTTAAATGTAFGAIFFDENLTERRTSERDIRRLALPSVGRNQNLIS

SEQ ID NO: 935115 - protein, 63 aa, Homo sapiens
GVRPGTYAAAMEAPGFAGDWNKIGIIPTDAPTILMDHTHSWMLKSRLGSGAAFRGSWDPKGVQ

SEQ ID NO: 935116 - protein, 114 aa, Homo sapiens
FGDTKKKGKGERKKNLPEETGRGSASPAGQEIALRRHDEEERQQQEEALRLEERRREEEERRNEELLLKQEYGLQNGPGKKKNPSVRLEEEPGLPDWKEEASQTPGIEGKNEPE

SEQ ID NO: 935117 - protein, 84 aa, Homo sapiens
SCVECAVYTSALFHTHCKFLLGLSGAKALFSVLGSTASEQRRQYSLLTEIDKIWASFELDNTFPWTIGHLSTLGYTFVPVSSTD

SEQ ID NO: 935118 - protein, 129 aa, Homo sapiens
CQEFRHKIVHMLLAIQGEVSDLLDLRTKWNGIAIRTECNGMEWNGLEWNRVEWNGVEWNVIKWNGIKWTGIELNCKEQNGMGCYQKISNGMECSGMDLNGMDWNGMESNGMEWNGVDSNGMETNGTGME

SEQ ID NO: 935119 - protein, 115 aa, Homo sapiens
KLSHVAEHQGEVSDLLDLRTKWNGIAIRTECNGNGMMDSNGIESNGMGVEWECNQMENGNQMDWEFEFKLLREQNGIGVFIQKISDWDWDCQLDWTLIGIGPWDWELGRIGNWEL

SEQ ID NO: 935120 - protein, 106 aa, Homo sapiens
ITHFSRSYDRSCQMKKPPLPLTQLRMRQHTAWPCCEKLMCSYDFIANDKNLVAIACHKAAKSACCQTVALGLCGVLRITSLVRSLNNAANSCQSTRKCGGCSATLH

SEQ ID NO: 935121 - protein, 62 aa, Homo sapiens
SNGMEWNGMENRIEESGIEWNGMLSNRMEWKGMESTRVEWNGMERNGMEWNGYGIEWNGTKW

SEQ ID NO: 935122 - protein, 141 aa, Homo sapiens
RRLEHILLLLTTGIIDNRHNPIFTAAFEDPTFCNGVIDKTIVANQQYRALIAVDQFFQQFQRFDIKIVGRFVKNQKVAWFEEQTRQQQAVPLTARKRTYRRHRPFRMEQKVLQIAQYVAWLAVNHHLLLTSARLSITVSSG

SEQ ID NO: 935123 - protein, 65 aa, Homo sapiens
ADVIVHGYRAGAKLGYGAEQLRALSPGLIDVCLNAYGGQVHGVEDVVFDSLVQMSCGLAESGMAW

SEQ ID NO: 935124 - protein, 126 aa, Homo sapiens
MQPGVKELKKKDYVEGTMRRLKHKCHQYLRRKSAEHRGADRGEKQIVGVTAEIIEAKRLDNNTFKVLRKKQLATRNYIPAVPPGFKRFSCLSLPRCQPPHLAHFCILSRDRISPCWAGWSQTPCLK

SEQ ID NO: 935125 - protein, 118 aa, Homo sapiens
LAVGGSRGGDPAGMQRRRGVGAGPRGQEAVPAGAAEFLHLQPALLAGIGETSQCQVYKRVQNWWVSLTSRMKPLDPPGNSPRCFEALGFPTTSKSCKTQGRAREPWPALPAPKPLASP

SEQ ID NO: 935126 - protein, 65 aa, Homo sapiens
VGDVSRGRVRVGTLGAEACLISIRTHEAAGPSGTASVGPWLITRATEPTVGTGPGQPRIPPPLFR

SEQ ID NO: 935127 - protein, 113 aa, Homo sapiens
MAPDEQLLAVERQTNFLLNNALSKIAPKVAVPIPPNVKPPSVRAKSPAPSTKVTATIIKLPFWLKSTRFCTHILAPATAISPTTIDAPPIRGRNGMNQAHQIFGEKPNRHGRV

SEQ ID NO: 935128 - protein, 48 aa, Homo sapiens
MPISPILRPTCLVGQGKVAGGSGGQPPVAATSTILVVFAFPNKVTMFQ

SEQ ID NO: 935129 - protein, 81 aa, Homo sapiens
RLRATEGGDALTNAVAVDDMPNALSALSDLHAHKLRVDPNFKLLSHCLLVDPGPPTSPPSSPLRCTPPGDKFLGFLLRHRV

SEQ ID NO: 935130 - protein, 54 aa, Homo sapiens
MRSRTSAHPQGLGAGHDAIPALGWATAAHAGTEVEVDGLTAYVAGEPDPLGPRS

SEQ ID NO: 935131 - protein, 39 aa, Homo sapiens
MAKEKQCYLQQVKQFCIRVENWHRVYLGNSSASGLEFVH

SEQ ID NO: 935132 - protein, 63 aa, Homo sapiens
DCKYKLKCSHFHCTFVCRNTVVGMSQMDSHKRKHEKQDASPRQRPAPGPPISLDGSLSLGAEP

SEQ ID NO: 935133 - protein, 88 aa, Homo sapiens
GKGFRGKSSGAVAAPAHTHAERPYRCPHLGKASGRAPTCNTTCASNGERPYACSHCSVGQSSALLQHLHVHSGERPYMLSALRASSLT

SEQ ID NO: 935134 - protein, 42 aa, Homo sapiens
MRFLNHFSGNPQRCIAHVNGVARFQVKQSIRRGASNTLPAAV

SEQ ID NO: 935135 - protein, 103 aa, Homo sapiens
SIIPGANFPAAEKGGEHSLRVRGRGSGGRPDSWRGRTVTTRSVQQGTTRRCAPQPPIGAPQLGSRDLRGPGPPFLPPCTRAHLAKAPGIRPGRRGLGLVPRAR

SEQ ID NO: 935136 - protein, 36 aa, Homo sapiens
FPPVHNGPGSFYPSMFLPPLGGLTLPVPSIGKDFRM

SEQ ID NO: 935137 - protein, 87 aa, Homo sapiens
VRPLVVSQPAIQFQCMQTTGHCMVPEPTKHYVQHVHRACNYDHVNQLLNWNFSLLKSTFSSDLVPPGQLETGVILMRQSAHRGSGFR

SEQ ID NO: 935138 - protein, 91 aa, Homo sapiens
VEQIATQHQQQSSIKESENAKADLTLTTADVTGGYPRRRGSDFSVMRRSTFSSIQPSTPHSKASTYRARQHRPKQHVATHSGEQQHNHHTD

SEQ ID NO: 935139 - protein, 32 aa, Homo sapiens
ATSSIKCLQIPEKLELTNTSENPTQVTMVFTV

SEQ ID NO: 935140 - protein, 137 aa, Homo sapiens
PPRPGAAPGHTLVLSRLQLSAQKSPGAMYYSYVKSTKLVLKGTKAKSWVLQLQRLLSSFRMHSTPANPVEAVVRRAGFVASQVSRPPRFRPDPVWAGRRLDLRFLAPVQRGAASRADDPVNRIDGRVVAPYPRVWVR

SEQ ID NO: 935141 - protein, 43 aa, Homo sapiens
MYESLSRLSNYYHYPRPRDTSFSGLSWEYKPDPVHKPLERALR

SEQ ID NO: 935142 - protein, 70 aa, Homo sapiens
MHQYPVQCRHKSRGKMAGAALTNNVQKEGSTLIALARRLTRPIPCCNANCGSQPPTTHGRQHLDATPALV

SEQ ID NO: 935143 - protein, 136 aa, Homo sapiens
TLYCKVRKQPLTVKNSSGLQQLALPCEIRRYRGVLESADPSGGETRSTESSSKNVKGPKKLFPDLPFGNMDSDRVEARKSLLESFLIGGAIPINGVQEFLALNTDARIAFVKKPFMVSRIDKVLPIWKLEITFLLK

SEQ ID NO: 935144 - protein, 153 aa, Homo sapiens
SYLVDQWRWRVFDGSITKENYNQELVDLRLKYPASPQCPGLKGDFDPGAKVPHSFLACLTIRYFVSFIIQFQFHEALSRQHATRAPMHKCDIYPVQGGQGKRLRPPMKLGFSEAVAGSHAADHGQPNMSSAMLSYFKPLLELLRTENELHGEK

SEQ ID NO: 935145 - protein, 38 aa, Homo sapiens
DKSYFPSIPKLLRWCPRTLSGSSPDDWKRSIVAYFNKH

SEQ ID NO: 935146 - protein, 136 aa, Homo sapiens
PGPPFPPDHREFNEGDGRGAARGPQGKAADLEMTASGILMTRDFEGAGKRALEEVLPQDTKGRAPPRGRDNFPGPDDFGPEEGFDASDEAARGRDLRGRGRGTPRGGSRKCLLPTDEFSPLFKEDGSQTSMIESPG

SEQ ID NO: 935147 - protein, 77 aa, Homo sapiens
GPVIECDIVKIMPLYTWSGQRMRWRPIRGLDNTEFQGGMCVAEIPKLRLCMRNTTLRGAPSSGDVLGSVSVPRNRGP

SEQ ID NO: 935148 - protein, 100 aa, Homo sapiens
KIYKAAVSVHGLLSDLFCVPHNLGLTSYTWNISWSPIYTSGLGPWINPGSWCAAKDRVSTPLLGFKNLERGHAMCDTANPKMLGPHDYFIPCPENTKLGA

SEQ ID NO: 935149 - protein, 103 aa, Homo sapiens
EQLCSSFPGSGGSGSSSGVGSSSRAAMEGSALDPSVQRHSPGHITFLLSLGGSHRNSASQGFSHLSSHHTQGNSYSSALPQPSSTSNSAATTDGNDHANIQTT

SEQ ID NO: 935150 - protein, 144 aa, Homo sapiens
SSVAGAERGRWEPDSTLRTGGRNTSSWADGAACHRPPGQKLLIIRSAPATELLDTLGGGTARCSSWPHRRQPSLGPAGPGSSLPDGASGPRRAWAWCYDPSLPSRLSRLYPQSSWCTRFEEAVIPLPPRTETPTHQPGREQGCR

SEQ ID NO: 935151 - protein, 71 aa, Homo sapiens
ARLTTRKREPKRLMKTISNSSLMDCMEGPVANPRFGFLLCYVFQDRVALELAKAQALVQYLEEPLTQVAAS

SEQ ID NO: 935152 - protein, 89 aa, Homo sapiens
FLKSSAPSAWEKMVNVLKGVLIECDPAMKQFLLYLDEANALGKKFIIQDIDDTHVFVIARAGQQSSRSEGELMDQNAFSLTQEVKKRWC

SEQ ID NO: 935153 - protein, 83 aa, Homo sapiens
LNAGGSRGSSGHWGSRTTVGGSQDREALVEGAVTREGCFLQQPLSLCTENNLRTRTVAWLEWLGLLRASVVQLGLHLRLTPGL

SEQ ID NO: 935154 - protein, 95 aa, Homo sapiens
PERCALNARPQDVRNINMNRFFPVNRRHNAASKKAALFRTIDRNIAILIMFNGKRDRCRDFRVYGIATVGKIAPHSVGEKLVVRGIGPVFHMQRM

SEQ ID NO: 935155 - protein, 67 aa, Homo sapiens
EEGGGEVLHTFQLDLVRTHYHKNSKGEFCALIQVTSHGSSSNSGDYNFDMRFELGTQIQTISVSLKQ

SEQ ID NO: 935156 - protein, 111 aa, Homo sapiens
MFKHWQGNTCYIVFLCSDLHLGFIYILDNCGAEVPCCEFASANEKAASLITSPISILVSIIFFRICRNRRVKASDFFFRRFRPVCAPFNRAFMMVCAIREGKISIRSLPDI

SEQ ID NO: 935157 - protein, 84 aa, Homo sapiens
EPAKSAPAPKKGSKKAVTKAKKDGKKRPQESYSVYVYKVLKQVHPDTGISSKAMIMNSFVNDIFERISASRAQLQQSRSTNHVR

SEQ ID NO: 935158 - protein, 106 aa, Homo sapiens
SDHEIDRLELQNGRCWESQHAGDLEAAHGSEATLELLGRVLLDMDLLGCLEDIEEAALPTRPRPVFSDEAAPCGSFLRTVLRDRLPTPLFSWERRPRGKQELAAAY

SEQ ID NO: 935159 - protein, 31 aa, Homo sapiens
MAELKYISGFGNECASEDPRCPGSLPKGQNN

SEQ ID NO: 935160 - protein, 80 aa, Homo sapiens
PFDHADPSIFTVLTAKSLRPGVAIADFVIYPPRWGVADKTFRPPYYHRNCMSEFMGLIKGHYEAKQGGFLPGGGSLHSAL

SEQ ID NO: 935161 - protein, 56 aa, Homo sapiens
HERTERAVEPWTEVDEEGKFVRLQNKSNEDQSMGNWQIKRQNGDDPLLTYFPPKFT

SEQ ID NO: 935162 - protein, 117 aa, Homo sapiens
GLVPGCPGVGLQVLSVFVLCPAKAVELVRAGRGLSEEPHAHPMVHLTTLLCKAHRGATFNHPPCPGVAAPIGRSTALWLLTTSVPGDGPFRRSSLGFLLIHLPNSSWEKNSFAKRTG

SEQ ID NO: 935163 - protein, 89 aa, Homo sapiens
STGIKLYSIQQDLGCASGVISDNLLVTGGQGCVSFWDLNYGDLLQTVYLGKNSEAPARQILVLDNAAIVCNFGSELSLVYVPSVLEKLD

SEQ ID NO: 935164 - protein, 35 aa, Homo sapiens
MGRLQPWRTPSEREQPGALSSPPLLTGSDHTSLTV

SEQ ID NO: 935165 - protein, 154 aa, Homo sapiens
PGGLLIGCSPGFMNVPKIKGTHTAMKSGSLAAESIFKQLTSENLQSKTTGLHVTEYEDNLKQSWVWKELHAVRNIRPSCHGILGVYGGMIYTGIFYWILRGMEPWTLKHKGSDSDQLKPAKDCTPIEYPKPDGQISFDLLSSVALSGTNAMNMT

SEQ ID NO: 935166 - protein, 42 aa, Homo sapiens
YGLAATMIQEGLTEGFQTAEGCIPTVWERLGLAFQTQRHTAA

SEQ ID NO: 935167 - protein, 126 aa, Homo sapiens
PSMQKDASLSGFLPSFQHFATQAIHVGQEPEQWNSRVVLPISLATTFKQDFPGQSSGFEYSRSGNPTELLGKSWLRWMGQSTLAFASGLAATITITHLLKAGDEIICMDEVFGGTNRYFRRVASEF

SEQ ID NO: 935168 - protein, 147 aa, Homo sapiens
FFSPAHIMRLLEVIPSRYSSPTTIATVMSLSKRIGKIGVVVGNCYGFVGNRMLAPYYNQGYFLIEEGSKPEDVDGVLEEFGFENGTLQVSDLAGLDVGWKVRKGQGLLDRSLPPGTPTRKRGNTRYSPIADMLCEAGRFGQKTGKGW

SEQ ID NO: 935169 - protein, 43 aa, Homo sapiens
MSPVPPAMSSSWVPGSGCIFLISKSFQARWMPRLIMSFIRSYF

SEQ ID NO: 935170 - protein, 96 aa, Homo sapiens
PKMYKTTPDVIFVGFRTHFGGGKTTGFGMIYDLDYAKKNEPKRLARHGLYEKKKTSRKQRKERNRMKKVRGTRRPMLVLAKRSEWRLDTAKGVDLR

SEQ ID NO: 935171 - protein, 109 aa, Homo sapiens
MCGYVHLSVDRNYLMWVVGPEFGSSVISLDLRLYKILSDTEQNFKEYQSLGPCQVWWHTPIISGFGKLAGEQLSLGQHRLYWETMSQTHKAGRTAERRCLPQAHSGKRN

SEQ ID NO: 935172 - protein, 99 aa, Homo sapiens
HLVVMDPSFGQHKYEHDFRGCSRRLLSDEDDDLEKVKLEPCGQKSSFIGNCPVMSAVQRVCHLYLAKQIVYFIGMLKEMNGLRVNVAVKHTFIFVDLHI

SEQ ID NO: 935173 - protein, 32 aa, Homo sapiens
SSSRTGAETLLEGSAAMAQGEPQVQFKLVLVG

SEQ ID NO: 935174 - protein, 67 aa, Homo sapiens
RPEPKRAVVCRERGWWRRFWKRPGQAAMGTESAAWCSPVPSTRRTGRAPGPGLAGGGSRCGAHFHAI

SEQ ID NO: 935175 - protein, 120 aa, Homo sapiens
MGPHSILRTVHCRTKTPPEPSGESHPLSFLSSNTSLAGTSLGRDLPGGPPSGQTPRNPESSRLGIPEGECAVLPPHGAREGQAQPAGVRGGSAVRLRTPPPGRLRWGHGGRARPAYRSPQ

SEQ ID NO: 935176 - protein, 140 aa, Homo sapiens
FILLLILSGELYAEEKQCDFPTVENGRIAQYYYTFKSFYFPMSCRQKTIILLFGWLCNRKWEARRANQVHSRRLVSKPKVLKKCLKPDLRNGYVSNDKVLYKLQERMSYGLLFRDTKPLGGKDEGGGSTVFLQGWVFLNR

SEQ ID NO: 935177 - protein, 74 aa, Homo sapiens
SWSLPVPLLYWLAFLLETVSFLLSPIYRYIPPFNRHLVTLSGSTFTFSYKKAQRDLGYEPLVSWEEAKQKTSGS

SEQ ID NO: 935178 - protein, 116 aa, Homo sapiens
MDFNPEWNGKEWNQPRVACHGMEWQGMEWNGMEWNGMVRNRRDWNEMKWNGMEWNGMEWNGMEWRMERMWNGINPSAMEWNRMEWNGMEWNGMEWNGFPNGMRNEINPSGMAWNGI

SEQ ID NO: 935179 - protein, 38 aa, Homo sapiens
DSEFTVQSTGHCVHMRGLPYKATENDIYNFFSPLNPVR

SEQ ID NO: 935180 - protein, 111 aa, Homo sapiens
LGGGVLKTLAVQAFGERGACCAPGSPGAAADGPASRIVVGVGARRDEAAVGVPALGSDVVTPPREGRADQIFLGPGTGLRGKGLTLSHPHSFGLDLPASPPDFPLLGHDQI

SEQ ID NO: 935181 - protein, 75 aa, Homo sapiens
KIRDQDRNTRRMRRLATRPRLGNQPISTRLPRSQKIGPPLLHLLARTEARGQPSAILRIGWESGFQVALPTHSIC

SEQ ID NO: 935182 - protein, 122 aa, Homo sapiens
VRNSATREAPNPSQSKSLTGYYPEFYYVPPIPFSPMESRRARPTLFQKPYKLEVDNSDVNFMGKPLYLTCEPLRTHQNVRHHNNSYSNCKPGEQVDDFTLWDSFSKDVQNKTSPFMIRPTPL

SEQ ID NO: 935183 - protein, 120 aa, Homo sapiens
PSTEESPGIDYVQVGFPPLLSIVSRMNQTTITSVLEYLSNWFGERDFTPELGRWFYALLACLEKPLLPEAHSLIRQLARRCSEVRLLVGSKDDERVPALNLLICLVSRYFDQRDLADEPS

SEQ ID NO: 935184 - protein, 85 aa, Homo sapiens
YTHVRGWYLPVLPDASPYTHVRGCTYLSFQTCLHARTQAVLTCPSRHPDTSPCMHVRGWTHLSFQTRLHRTCAAGLTCPSRHVSM

SEQ ID NO: 935185 - protein, 67 aa, Homo sapiens
PQPQIPGQAEGLPRGKRGSERPALDPAGLEELSSKGFPLSPPNIPWHNLTGRSRAQCPAQAVTTFSS

SEQ ID NO: 935186 - protein, 38 aa, Homo sapiens
MVNIEIWIWINILEEAEVAVVEIMPFYSSLGNKSETPS

SEQ ID NO: 935187 - protein, 51 aa, Homo sapiens
MEQRHKFIHWILPHWVQRRPFVLGLSEGGGPGYPNFGPIVEVVFTISLGRR

SEQ ID NO: 935188 - protein, 49 aa, Homo sapiens
LDNWNVSVWEIWMPNEIGAMQGLCGGYVVDVAEGRAGDFVIATGEVHVR

SEQ ID NO: 935189 - protein, 98 aa, Homo sapiens
LLRGKGPGLARDLDIQIQETQRTPGHFSTKRSSPKHVVVRSKLKTKKRILRAVRQKHQVTSKGKPIRLTGVFSAETLESIDGIQALSSALLKQITYQP

SEQ ID NO: 935190 - protein, 90 aa, Homo sapiens
SHHHPLAAPSLGEAAISFQSLACSPGLPAADRLSYSGRPGSRQELQHGDSAVLVLPPSPGPRSSRPSMDSEGEKLLLDEDSEVFKMLQEN

SEQ ID NO: 935191 - protein, 37 aa, Homo sapiens
EKAHMMNAIKKYQKGFSDKLVFLEGDQKPLAQHKKAG

SEQ ID NO: 935192 - protein, 73 aa, Homo sapiens
TVKIVLKEKHKKACVHGGKTYSHGEVVAPGLPCLRPLPCILCTCEDGRDLPACDLSHRVPPARHPREKWPGKC

SEQ ID NO: 935193 - protein, 65 aa, Homo sapiens
PSAKARKHLSNLQSGGTAEDVIGSRRQPRAPKEKAQPLGRSGQLPRALSNTRPHLRELGKWVLLD

SEQ ID NO: 935194 - protein, 159 aa, Homo sapiens
TESSQSSSTFSDNEHIRHTSCASSPGSQKIPTNLPNVPFTPSLPSQTSRTCLPHLASFLRASMPSFQGQSICLDGDYLLTSSTSFSLRKHRHAARFLYPSPSEVRVWFDLSFIILRAQGGGAVRVAGVEGWGARSGQARAPGSAKGSREGELRHWPAAR

SEQ ID NO: 935195 - protein, 160 aa, Homo sapiens
MGSNPVHGDLQCLQSYSHHRKLVNTLERDDPKSNEENVIINCTELVTYDLMKGALVNNKILADDVPCHLLSALVAGFCTTLLASPVDVVKTRFINSLPGQYPSVPSCAMSMYTKEGPTAFFKGFVASFLRLGSWNVIMFVCFEQLKKELMKSRQTVDCTT

SEQ ID NO: 935196 - protein, 68 aa, Homo sapiens
PASGEGKCGEPVESGDGKGGQSSPEAAEVMNHEPGTKEGKLKEEEPKPIYACQWMMGMLVPSETEAGL

SEQ ID NO: 935197 - protein, 96 aa, Homo sapiens
NPFTERIVLTWSNPEPEQVSVNSLTQVITYFVKLHFQVISKIHPCLKLEGKHYLLRIFRTDQLYVKGLKGNVNFSLLWHEVVSCTLILPPVPETFW

SEQ ID NO: 935198 - protein, 84 aa, Homo sapiens
EDQKIEDHFEEPEINLRNIVTHSEYTQYEHEEYEEKPPDSNFLTSVEGYMETHTVNGPSECEVCLKSYGLYHLTYKWPITTMKQ

SEQ ID NO: 935199 - protein, 81 aa, Homo sapiens
PAESSPDVKTPMANEANPCPCDIGHKLEYGGMGHEVQVEHIKAYVTRSPVDAGKAIVVQDIFGWQLANTRYMADMIARKWI

SEQ ID NO: 935200 - protein, 94 aa, Homo sapiens
VPACGIDRGPWRHLPDPPALAPGGSLRLSFGLRSDSGLEIKTRSVEQTLLPLVSQITTLINHKDNTKKSLKLLQAIQRVGKLFNLGSWEGFFKV

SEQ ID NO: 935201 - protein, 37 aa, Homo sapiens
DPITSSGIKFANDENVKHISCPLLILHTEDDPVVPFL

SEQ ID NO: 935202 - protein, 99 aa, Homo sapiens
MGAHLTRRYLWDASVEPDPEKIPSFPGTSAFPERKERVMVATQQEMMDAQLTLAANVTTCCPLHPGCLKVARDKLSPTFLALQSTEQHRLGTTCEATWG

SEQ ID NO: 935203 - protein, 128 aa, Homo sapiens
ASSVLRCGKKKVWLDPNETNEIANANSRQQIRKLIKDGLIIRKPVTVHSRARCRKNTLARRKGRHMGIGKRKGTANARMPEKVTWMRRMRILRRLLKEIPGNPRRLTAIMYHSLYLKVKGNVFNKRIL

SEQ ID NO: 935204 - protein, 135 aa, Homo sapiens
MSRKIGGSVVEMQGDEMTRIIWELIKEKLILPYVELDLHSYDLGIENRDATNDQVTKAAEAIKKYNRGAVKCATITPDEKRVEEFKLQMWKSPNGTIRNILGGTVFREAIICQNIPRLVTGWGKTIIIWPTCLWG

SEQ ID NO: 935205 - protein, 104 aa, Homo sapiens
MESRVEWNGMEWFGMECSGIEQNHSDWNGRECNPVEWKGMESTRVEWKGMELNERKGMESTRVEWNGMGMGMGMGMGGGIIPSCNGMGLGFGLDWIGLGLYPDW

SEQ ID NO: 935206 - protein, 98 aa, Homo sapiens
MTLIPKTEQIHNNKKENNSPIPLMNIDTKILKKILTNHIQYHIDKLIHHDQVGFIPGMQGWFNIGKSITVIHHISRIKNQNHMIISIDVEKAFGKIQH

SEQ ID NO: 935207 - protein, 104 aa, Homo sapiens
CRGMEWGMECNGIESTRVQWNGMDWNGMEWNGMEWNGMIRNRMEWNEMEWKGMEWNGMEWNGMEWNRSEWNRRECIRVEWKENGKNLSGIEGNGIEWKLIERIN

SEQ ID NO: 935208 - protein, 149 aa, Homo sapiens
ASSKISCLSFALDDLDDQADAARRAGKPGQEPRRGHQLPARPRPEEEENRLREGSQEWEAQARKVKDEEMEVTFSYCDGSGHRRTVRVGNTVCKQFLKKALQGLKDFPGAALPALEQLMFHQGGPHPCRSYHTFYDFIIARARGKSGPL

SEQ ID NO: 935209 - protein, 97 aa, Homo sapiens
EVHCCCALPDPGLAGAQGLQPAVRRSAVYEVDATEDFPNCETHEKIHCMVVMGWSMYSPAEQHSSYPRTLEHQATGGHYGSEADLSAHVFNDRLCVG

SEQ ID NO: 935210 - protein, 97 aa, Homo sapiens
TLIRNVKPEDIKRVASKMLRGKPAVAALGDLTDLPTYEHIQAALSSRNGHLPRSYRLFRESPLELAVECLCACYCWCRHCIRLASCVNSANSETLET

SEQ ID NO: 935211 - protein, 117 aa, Homo sapiens
MLKGSLPTGPGAAPLKLKFSNLMPVDFLARFNVRSQSSRCRAGGTVFNLHPQPLSWETYVDAFRQAGHAFEVSVAYWQRYLHTVDRNALFGVLGFYLNGVGEDIGDTSMIRHDRRRG

SEQ ID NO: 935212 - protein, 154 aa, Homo sapiens
LQAPENGGSSSGDGIVLAAHQCGLRPMGYELNPWLVGLARLHAWRAGCSASVCYHRKDLWKVSLRDCHNVSVFLAPSVLQLLEDKLQAELPVGARVVSGRFPLPTWQPVAVVGEGTDRVWAYDVHGSGPTVSSCGVPIKAIPESSSTLVPRAPV

SEQ ID NO: 935213 - protein, 118 aa, Homo sapiens
MDQDDPAEALTELRKRWAAGDSASGGRLGIGRLYYMGAAAAPGFRRVPLRLQVPYVGASARQVENVLSLLRGRPGKMVDLGSGDGRIVLAAHQCGLRPAMGYELPCLLDFTLHAGEPV

SEQ ID NO: 935214 - protein, 151 aa, Homo sapiens
QKQLAAWCSLVLSFCRLHKQSSMTVMEAQESPLFNNVKLQRKLPVESIQIVLEELRKKGNLEWLDKNKSSFLIMWRRQERMGETHLPMGFQEVAKNNSVVYSVMNLTSGEDTEDEEFHGLDEATLLRALQALQQEHKAEIITVSDGRRVFF

SEQ ID NO: 935215 - protein, 76 aa, Homo sapiens
FGIGFTTEEEVDYTAEKCIHHVKRLREMSPLWEMVQDGIDLKSIKWTQHSEEWAVTLCWPGCSGLTDLCTARNLTA

SEQ ID NO: 935216 - protein, 124 aa, Homo sapiens
MVISGGLDKEKVVRIHYRILYSHKKNKIMSSVSNMNGAEGQYPKRNNAGAENQILHVLTYEKVLNIEYTYDMKEGNKYTRAYLEDGRVRREGGGFENYLICCYYCFIYLGNGINSCYHHIPHQN

SEQ ID NO: 935217 - protein, 134 aa, Homo sapiens
SLPISTMNPSAAVIFCLILLGLSGTQGIPLARTVRCNCIHIDDGPVRMRAIGKLEIIPASLSCPRVEIIATMKKNDEQRCLNPESKTIKNLMKAFKKGLKGLLNWSEATHTPRCCDGWTAESLSPSLPFTQWMG

SEQ ID NO: 935218 - protein, 91 aa, Homo sapiens
MSFLIELWCRGSTVCCEPGAQHVYPQKVKGPAWSQKPEGPDVEGETAEHLNNGCQKDHILKVLCHALLHVEVHATSIKGPISEKDAEHRAG

SEQ ID NO: 935219 - protein, 78 aa, Homo sapiens
NKSLLADEEASERERDSGVNITAKGIPVHGFKIGDRVEFLSLLGLWSVMLGSWAGMIANSDLGVIRGSSAFRQPDDDA

SEQ ID NO: 935220 - protein, 100 aa, Homo sapiens
SPEASSLWQVLGYSHPFNPSTLKTKTAPSGDHWPSLIFFLRSGLQIPAGRSEDTGLPSVNSVLTYSEQLLTPTAKALTKWSVRQGAGNPGGLPAKGSISS

SEQ ID NO: 935221 - protein, 119 aa, Homo sapiens
PKLGAHLVHLLPQSAPWSCPRQGGCSPWDNWREILDSKARCAAGMGDPRAAAGAKGRPQGPPQSRVGAASCMASGPVEWSRQIPLSAVNGPAQPPGTSREAVPGPWLAWKYSGKTSRDL

SEQ ID NO: 935222 - protein, 103 aa, Homo sapiens
DPTQVWIYNEDHELILNNLLCLDMSETRSSDPPRLMKCHGSGGSQQWTFGKNNRLYQVSVWAVLRVMDLMDQKGYVGMAICDGSSSQQVASKKVKGGPWLDTT

SEQ ID NO: 935223 - protein, 67 aa, Homo sapiens
VTLHADAIHRGGGQIIPTARRCLYASVLTAQPRLMEPIYLVEIQCPEQVVGGIYVLLNRKRGHVFEE

SEQ ID NO: 935224 - protein, 36 aa, Homo sapiens
TELVRGCRLHCPVVGLLPLGLRPALPGTRPKGCSDR

SEQ ID NO: 935225 - protein, 133 aa, Homo sapiens
MSRYGRYGGETKVYVGNLGTGAGKGELERAFSYYGPLRTVWIARNPPGFAFVEFEDPRDAEDAVRGLELGKVICGSRVRVELINRHASGDLVLIGHLPVRPFDPNDRCYECGEKGHYAYDCHRYSRRRRSRSR

SEQ ID NO: 935226 - protein, 85 aa, Homo sapiens
PRAAVTMGREFGNLARYGNVISYRLSPFEQRAFPSYFSKGIPNVSPHSLHSRAPPFVVVYLIYTWGNQEFEQSKRKNPAMYENDK

SEQ ID NO: 935227 - protein, 83 aa, Homo sapiens
IFCPRAAVTMGREFGNLARIRHVISYSLSPFEQSQAIYSKGIPNVLRRTREFLARLFVVVYLIYTWGNQEFEQVEKERIQPCM

SEQ ID NO: 935228 - protein, 98 aa, Homo sapiens
ANAERFKVDLSPYPTISHINKELLALEVFQVSHPRRQPDTPAELRTYSQTMPIGTGKGVGPDCWVFYCCEETPTMATLTKKDVQLAYSFRDSVHYHDG

SEQ ID NO: 935229 - protein, 81 aa, Homo sapiens
ARRSDTGPCCEQSETSKPTPRDTTSSKKATPPISATPYMPFYSNQNRPRNECIIAEDLNLSSFLRKQQIHGVQAISSRSPY

SEQ ID NO: 935230 - protein, 116 aa, Homo sapiens
DAVREILKYDDVTEKVNLQNNPGAMEHFHMKLFRAQRNLYIAGFSLLLSFLLRRLVTLISQQATLLASNEAFKKQAESASEAAKKYMEENDQLKKGAAEDGDKLDIGNTEMKFRGE

SEQ ID NO: 935231 - protein, 84 aa, Homo sapiens
GGRLINYEMSKRPSAERYKDQLLKETVLQPLLQPQINVSMSSRAEGKTQNAILMTMPTLLNSRESLNPLSAALSMLNLICLHQE

SEQ ID NO: 935232 - protein, 87 aa, Homo sapiens
AMTWGKLPLRGLSFWVELKPKVLAAHRAGLKQIIIPQRNEKDLEEIPSNGQTGSKFCYSKLLDEVLNAAFDGGFPVKTRPGLIDSKL

SEQ ID NO: 935233 - protein, 105 aa, Homo sapiens
ELEVSERLSQPGVAIGLAWTPLGGKIMFVEASRMDGEGQLTLTGQLGDVMKESAHLAISWLRSNAKKYHLTNAFGSFDLLDNTDIHLALPSWSLSQKMDHLLVLP

SEQ ID NO: 935234 - protein, 128 aa, Homo sapiens
LLKRKPSLDDLKELMPAVGRSMQQLLDYPEDDIEETFCLNFTITVENFGATEVKELVLNGADTAVNRQNRQEFVDAYVDYIFNKSVASLFDAFHAGFHKVCGGKVLLLFQPELQAMVIGNTNYDSERT

SEQ ID NO: 935235 - protein, 101 aa, Homo sapiens
LTILSCLCRERGRKKFGTSLKLPVHRVLPSSLVGYSLEGTVTPPVSAWLPPTLADREHPLTCVVTPQDGETVSTNDRRKSELSWPFKYYYSVKQMRTRAVV

SEQ ID NO: 935236 - protein, 103 aa, Homo sapiens
MDRPSRSQICFPRKTRALKAALPTDLYSMLEEERQQRQSSDPRRGGVPKLVRAVTGVAKQGRRPVGLVGSKPTQRPRRHSPSLVSGPVDGGGQARDPQGWASF

SEQ ID NO: 935237 - protein, 93 aa, Homo sapiens
MSFFVLTEDCREQLSVMESQGCLPGHHRQPHRQHRFILSSSAGWKSEVEVPTGSVSGERLLVQRHPHVRGLWCHLFPCEGPESHDPYPIEAKI

SEQ ID NO: 935238 - protein, 31 aa, Homo sapiens
KTIVHESTRGLKTCFALYDLSISRAAAFSDA

SEQ ID NO: 935239 - protein, 102 aa, Homo sapiens
CWGVQMGRLRLGEPEISVAHWCVAAVHRPLGEVRTGLQSGVLLFCPLLKFNMLLIIRKLSSWARWLLVIPALREAEVERSIEPRSSVPALGNIARPCLYQNF

SEQ ID NO: 935240 - protein, 74 aa, Homo sapiens
RDGSLWASLSPSLARVGSKQPRMECPGVFAEAGLSRARRHAPGGADWLTVVDVINPIGRLLWYKWYRTQSSRPE

SEQ ID NO: 935241 - protein, 30 aa, Homo sapiens
GRDVISRAAAPHSRPPQDAALQPERSPPRP

SEQ ID NO: 935242 - protein, 44 aa, Homo sapiens
TRSPPGLAVWGPGGLGCPGGPRLGNRRPRGLEDEDDVLLVPLAE

SEQ ID NO: 935243 - protein, 41 aa, Homo sapiens
MVAACQCAMSAAVVRGFQLWVLPVKASGSDCWFLSNKIDHG

SEQ ID NO: 935244 - protein, 108 aa, Homo sapiens
HLEPQVSSVPLCQEECAGHSQPGSTVCPSPRPRSDSTAMLRGVRITLQLLSIFIYINTYKYILFKNNLEILPKRYAEYTFQYECTSVLSRQNRSLDEWRLHQQSGTCS

SEQ ID NO: 935245 - protein, 115 aa, Homo sapiens
QTSVVSRYPQRAEGRLEASPQDRNPCKSWQLRWMSHADVRGSALSLHLCTQNVLPEAPQPIPSGYHHHQHHHCLGATARSISVEGDLECLVCREPTTVLGPPSCLAVSTPSVPYA

SEQ ID NO: 935246 - protein, 45 aa, Homo sapiens
KLHFTPVPRRYRYKKKWATTEPQFTGQSAALQNFDMTYSVQFDLW

SEQ ID NO: 935247 - protein, 154 aa, Homo sapiens
GVYRVQTVPSARRPVVKFCHRPSGLHGDVSLSNRLALYNSRFLNLCSEMDGRVRPLVYTLRCWAHNGLSGGGPLLNNYALTLLVIYFLQTRDPPVLPTVAQLTQRAGEGEQVEVDGWDCSFPKDASRLEPSTNVEPLSSPAGPVLLLRILLGSF

SEQ ID NO: 935248 - protein, 152 aa, Homo sapiens
ILVSNAAVNPFFGNLMDVTEEVWDKVLSINVTATAMMIKAVVPEMEKRGGGSVVIVGSVAGFTRFPSLGPYNVSKTALLGSYKNFAAELAPKNIRVNCLAPGLIKTRFSSVLWEEKAREDFIKEAMQIRRLGKPEDCAGIVSFLCSEDASYI

SEQ ID NO: 935249 - protein, 96 aa, Homo sapiens
IGVLQANSQGFTPPGDRSSPDNSPVHWDVTVNHPSQLGVNIPIITELVNDTNVHVFGTNADDDDPDTELYLTAALCLWDSICSVSWTHSMSATYFN

SEQ ID NO: 935250 - protein, 69 aa, Homo sapiens
GLKSRRSPGGVLGNSADAVPAPVIASEAAAAAASAHAMDRCTSTARPSNSLPANLCFQRQEGVIIATCK

SEQ ID NO: 935251 - protein, 114 aa, Homo sapiens
TELIYQGENNYACTNPEILEENQPKLLSKCVMKLLITDILPFKSYVLKMQSWQPGTNVQWMLQVEICCIGMRFGETANVTGLCSFLVINMSGPRGSISVKPFFLVHVKHTLFCN

SEQ ID NO: 935252 - protein, 55 aa, Homo sapiens
SCIDEIRISFVFKWAAQAQDSIFTLKMNSHVGTDEVAGQKRNPNTQVSVHAVLKL

SEQ ID NO: 935253 - protein, 142 aa, Homo sapiens
AFFKAILFICSGSIIHSLADEQDIRKIGNITKIIPFTSSCLVIGSLALTGIPFLTGFYSKDLIIEAINTCNTNAWALLITLIATSITAMYSIRIIYFVTITKPRFPPLISINENDPDLINPIKRLAFGSIFAGFVISYNIPP

SEQ ID NO: 935254 - protein, 78 aa, Homo sapiens
SPESASQKPWTKKAQLLRGVASHWGPAWIHCTRTVSAKSRCSGGKAKCSQFCTTGMDGGMSIWDVKSLESALKDLKIK

SEQ ID NO: 935255 - protein, 137 aa, Homo sapiens
SSCGWVHGVCFSASGSRVAWVSHDSTVCLVDADKKMAVPWPLRHYWPTFITENSLVAAGHDCFPVLFTYDKCCGDIELRWPAWNVPKQEPSVAMTSPERFQEWDKEGPALEGGLQATWGPGLGIQLQQEQVVKPNSW

SEQ ID NO: 935256 - protein, 121 aa, Homo sapiens
LSKEYGFVLLTGAASFVMVLHLAINVGKAAKYKVEYPVMYSTDPENGHMFNCIQRAHQNTLEVYPPFLFFLTVGGVYHPRIASGLGLAWIIGRVLYAYGYFTQETLASGIEEPWLFALFCP

SEQ ID NO: 935257 - protein, 98 aa, Homo sapiens
PTRRNSFLAWAWPGLLGEFTHMATTQETLASGIEDRGLSCPPPDGHHRVLCFPASRLDQTRLRLRVILPPLRCGGPSDSHSPPATHPDFQLHWFFFFF

SEQ ID NO: 935258 - protein, 87 aa, Homo sapiens
CEDGVAENKKNEARLRIAKTLEDFDLGTTEKCVRINSVSSGLAEVDLETFLQARVLPSSLMLPKVEGPEEIRWFSDKFSLHLKGPKT

SEQ ID NO: 935259 - protein, 88 aa, Homo sapiens
VERAGTLATFLCYLQLIGKGPMELPEASARKMSPHFSLSSSNVGQLPELTCMHKADIMGIPTHAMMSPFTFVHLPCLGSALISWTPED

SEQ ID NO: 935260 - protein, 85 aa, Homo sapiens
MSKEWGLRLIPAGVSAPALLACFLLETVSFCYVQSTTIDHHLTASLITVLNSVFTFSKKAQRDLGYEHLSAGRKQAENLRVDRDT

SEQ ID NO: 935261 - protein, 100 aa, Homo sapiens
GLETAAGNGRRLHLGIPEAVFVEDVDSFMKQPGNETADTVLKKLDEQYQKYKFMELNLAQKKRRLKGQIPEIKQTLEILKYMQKKKESTNSMETRFLLAR

SEQ ID NO: 935262 - protein, 123 aa, Homo sapiens
RGREKGVLHLLPHLQLSHLGLPCSLGSANHSGCSVLAHIAFFSHWVQQLRRGLGDCFLLNVANSQENTVHIFLSALPVTKYLRGSFVQDIKHRGQHLIKSLQNCLLTVLNVRHLCNLNVRYRF

SEQ ID NO: 935263 - protein, 112 aa, Homo sapiens
KNPCIFFEPKILYRASSGTGPSENPTRSPCLRLKSIQEGSDVTLVAWGTQVHVIREVASMAQEKLGVSCEVIDLRTIVPWDVDTVCKSVIKTGRLLISHEAPLTGALPLRSA

SEQ ID NO: 935264 - protein, 86 aa, Homo sapiens
NTELTEDCEIKHLGQSLDCNANVYMRPWENKVIPTVKCQALDKTIPIRRGLQFSFPVSQSTRKSRNNAPTRVHVQGQTLKGRGTAR

SEQ ID NO: 935265 - protein, 86 aa, Homo sapiens
MVASALETGFRKGVLEHPEEFAKLVGMSVLLAKERLLLAEKMGHLCRDDSVEGLRFYPNLFMTQNKNFVPEMLYVNKLAFCQGLTT

SEQ ID NO: 935266 - protein, 103 aa, Homo sapiens
TILHLLSSVTADYQKRSLMKCHKHTWKHMDLRKERKERTLFGVCCCCWFALLALLFLPSVPLGPLVLAVLKYKPIKPRADKCPALGAHHCNFFPDFALRSVSM

SEQ ID NO: 935267 - protein, 154 aa, Homo sapiens
ADSFSLNDALAGSGNPNPQGYPGAWGNQPGGATQGLLILGPTQDKLLQGPTQDRLLQGPTQDRLLLVPTPAQLPLELILAQLPLELILAQLPLEPSQGNWGTWGLPQCSWRLSCCWPYGVPAGPLTVPYLPLPGGVMPRMLTIMGTVKPTQTGL

SEQ ID NO: 935268 - protein, 155 aa, Homo sapiens
AVPASRGITAFIVEKGMPGFSTSKKLDKLGMRGSNTCELVFEDCKVPAANVLSQESKGVYVLMSGLDLERLVLAGGPLGIMQAVLDHTIPYLHVREAFARKIGQFQLMQGKMDMLHPPHGKFDSTSTMSPKPVTRGHIIPKDCAGVILYAAECAT

SEQ ID NO: 935269 - protein, 117 aa, Homo sapiens
GFLHLECDDLDPSKVASDRYPTPFLGQTSGRVPFLFKGNRGITPFSCQILVVSFLEEKAKAISFLTVSPRARQLQKYGRPRKDRVHSPGKTTQKIGSLVYLSLSASLCHRLALGLLM

SEQ ID NO: 935270 - protein, 84 aa, Homo sapiens
LVNEILWLILTHHNTIFLVVLLNVDHRFANNPITTSKVPVLNTGASSVDEEGGPSEHVTWSIQAKVVTLLSSSTYRFKIHSNKV

SEQ ID NO: 935271 - protein, 146 aa, Homo sapiens
AQRSQVTNYLGIEWMRRHFAPDYRVHIISFKDPNPMHIDATFNIIGPGLVLSNPDRPCHQIDLFKKAGWTIVTPPTPVIPDDHPLWMSSKWLSMKVLMLDEKRVMGKMPMKFQFKRCFEKLGISTIKVNIRNANSLGGGFHCWTCD

SEQ ID NO: 935272 - protein, 99 aa, Homo sapiens
LSPPLGQEQDPSASVPLDPSPGATVAGWLLGIILQILKDVSQPFFIVGSIRAETVFICNTNSYLNEGGFQFDLLCLFKIGSSLGSLVLYVSISVECPQP

SEQ ID NO: 935273 - protein, 81 aa, Homo sapiens
MPGEMRRAQRHAKKCLVCAHNQAVIGAGFFRTRVSVSCNLGHLAGQSAIAAKSHRQTPSLPKFDPCLHNRGLRVKVGFQPT

SEQ ID NO: 935274 - protein, 66 aa, Homo sapiens
MEQAMLKDAGFVWVLGNALLGVPQGFPVYDYDPSSLQEALSASVAKVNSQSLSPYLFLGDRSSLKR

SEQ ID NO: 935275 - protein, 89 aa, Homo sapiens
LLSHETVLDGCSPEWAQTKVRPALPALVPPTDLSLLRDGSSSPEKNDTASPRDMTEFHLLKPDSTSCAFLLGKKEFFFRNSAKNDINYF

SEQ ID NO: 935276 - protein, 75 aa, Homo sapiens
TPEEIRKTFNIKNDFTEEEEAQVRKENQWCEEKMNCCACHCNTRRVVPNASCTALFIIVNIRDQKTNIALSSLHV

SEQ ID NO: 935277 - protein, 135 aa, Homo sapiens
DALADGGVKMGVPRRLAVRLGAQALLGAAKMLLDSEDHPGQLKDNVCSPGEATIHALHFLESGGFRSLLINAVEASCIRTRELQSMADQEKVSPAALKKTLLDRVKLESPTVSTLAPPSSGKLLTRNPAQGSKKE

SEQ ID NO: 935278 - protein, 141 aa, Homo sapiens
KNGELKSLRRRSSRSDSQVRLREKLDELRRASLPYLPYLSGLLPPSHEPPKLNPVVEPLSWMLGTWLSDPPEVGTFTTLQPFQVPGRKVHISHVGPMLNFSFNSFHPETHKPMHRECGFIRKPDTNKMAFVSAQNTGDCGS

SEQ ID NO: 935279 - protein, 85 aa, Homo sapiens
MVCGGGSRNPLLMALSGITARHRSHHHLVGISGDDMEAIVSPGLLADAGGITRKSAFRLAQARRRYWGLFSPLTRDIRVELNFSY

SEQ ID NO: 935280 - protein, 102 aa, Homo sapiens
TEFNLVCGDAWKVDLFQSCVNLGFFLGSLVVGYIADRFGKALPLILFGVLGLSAGAVTLLLPETKGALPETIEEAENLGRRKSKAKENTIYLQVQTGKSPHT

SEQ ID NO: 935281 - protein, 162 aa, Homo sapiens
SCSRSHGLRNAIGKSAPDFTATAVVDGAFKEIKLSDYRGKYVVLFFYPLDFTFVCPTEIIAFSTMLQDFRKLGCEVLGVSVDSQFTHLAVDQYPTEGGRLGPLNIPLLADVTKSLSQNYGVLKNDEALLTVSLSMGCLGRSQSMTYLWTLCRRSPLVQPLSI

SEQ ID NO: 935282 - protein, 80 aa, Homo sapiens
GNKCDMDDKRVVPKGKGEQIAREHGIRFFETSAKANINIEKAFLTLAEDILRKTPVKEPNSENVDISSGGGVTGWKSKCC

SEQ ID NO: 935283 - protein, 98 aa, Homo sapiens
ARYQTIEENIKIFEEDAVEFISVPVPEFADDPANIVHDFNKKLTAYLDLNLDKCYVIPLNTSIVMPPKNLLELLINIKAGTYLPQSYLIHEHMVITDH

SEQ ID NO: 935284 - protein, 116 aa, Homo sapiens
PAAVAQSAPPLQSRAHELRQGAIRTPASRDPSLRRRRLGPQHHGEGDVQLGAWPEGGKKDERKSSEEALIVLDAVRWIQGPGGRGSGWTEESVVLVHVFRTWLHAWRHPRRGVLYK

SEQ ID NO: 935285 - protein, 48 aa, Homo sapiens
KLLESGDLSMNSIKVDGISMSFQNLLAKICFYHHFSVVESRLLCLHVQ

SEQ ID NO: 935286 - protein, 86 aa, Homo sapiens
VAILQSGAAGLSVPSTVIVGSAGSAVVASVMNICESFYPFLMGSEVADMATEVADMAIEVADISTEEHCPTCLTQRRINYPQATIS

SEQ ID NO: 935287 - protein, 73 aa, Homo sapiens
YIKYLAVKQTRRTGRYPSSSAEAPWNRIPISDRSILRSSLSSLLFLQEKKVDPNDFSPCIKQKTIITVEFIFF

SEQ ID NO: 935288 - protein, 63 aa, Homo sapiens
KGFSWNWQDMLLVGLCILVPVVHRERQHLRFYTSTVNSSMPALAAFQDPHPKTEHTNAQTLQW

SEQ ID NO: 935289 - protein, 156 aa, Homo sapiens
MLGHIRANNPHGNPQYLPFFQKLGESTPIPCDGPTDGGPFRWQPSTMMSFCCGEVLAKTISVWYRKMSSSSSEVMSFRSLPWTTQALASSGVHLVHWNVEAGSNVFHSLIAFSDNAYPLGNFAVIGWSPVTMMTLIPALRHLPTASGTAARGGSIM

SEQ ID NO: 935290 - protein, 71 aa, Homo sapiens
GWTPIPVEQLIPYVDEDGSRNDDRAGPPRFAAEERREIVEVNKKLKQKNQQLKQIMDQLRNLIWDINPCWQ

SEQ ID NO: 935291 - protein, 126 aa, Homo sapiens
LREHRRKGGNRKREDAGDDDDKEGAIGVRNKVAGGKMKKRKGRYCFRKTSARLLASCEILSRDHSASWEKFLGIAVSLQWDNFYSVDTGLAALQLAFLTCDTSAVCSSCCTSAFPPASHGLADGER

SEQ ID NO: 935292 - protein, 30 aa, Homo sapiens
DSPSGALQTAAEEEETKTFKDLGVTDVLLG

SEQ ID NO: 935293 - protein, 138 aa, Homo sapiens
VHTGASKTLTPSGDLQTFSGMDQVKVMKRIAEMTDIKPILRKLPRIKKYLLNCDNMRCSVNATRQQMPQKKRWKTSLEMLAEAKRGSLSARIFVEKPTPSGPSGAAHSGVPDRQKIGDRPHLQTLPDEDTFCAALPCE

SEQ ID NO: 935294 - protein, 101 aa, Homo sapiens
SRGSRRPVSRSHRRHFYCKHGQRTKNPKTFCKKCGKHQPHKVTQYKKGKDSLYRPRKAALRIASRVATVGRQSQSFRPKPRLCSGLSVLSPTAESKEDAGH

SEQ ID NO: 935295 - protein, 77 aa, Homo sapiens
FDVQRNNIALALEVTYRERYMKAYKEVKNRLDYHISVQNMMRRKEEEHMIDWVEKHVVKSISVQQEKETIAKCIEDL

SEQ ID NO: 935296 - protein, 70 aa, Homo sapiens
SMPEGCAVWEKCLLTTVGRFLDEPCQPSQDRFLDDFETMLNSNINDLLMVTYLANLTQSQIALNEKLVNL

SEQ ID NO: 935297 - protein, 140 aa, Homo sapiens
EVTNCFSVPHNESEDEVAVDMEFAKNMYELHKKVSPNELILGWYATGMDITEHSVLIHEYYSREAPNPIHLTVDTGLQHGRMSIKAYVSTLMGVPGRTMVMFTPLTVKYAYYDTVNALEFDLIMKTCFSPNRVIGLSSDL

SEQ ID NO: 935298 - protein, 141 aa, Homo sapiens
DTNLRDKNCLQPVDGTMSLDMKEHPDAEVQKNQVLTLEDWKEKWVTRHISFHQEQGHQLLKKHLDTFLKGEWTASVFPPLWKSPLRKMVRRSGPHCVGVEISEIGIREFFAEQNLSYTEEPLAEIAGAKVFKSSSGSISLY

SEQ ID NO: 935299 - protein, 125 aa, Homo sapiens
MDIKLHGGTPANFLDVGGGATVQQVTEAFKLITSDKKVQAILVNIFGGIMRCDVIAQGIVMAVKDLEIRIPVVVRLQGTRVDDAKALIADSGLKILACDDLDEAAKMVVKLSEIVTLAKEAPCGW

SEQ ID NO: 935300 - protein, 69 aa, Homo sapiens
SGGIMLHSQDNPDGPDPNATPKEILLGKYSPSCCPPTIMGGFNPSGRKAPNAAHDGIDLIPGRQSKQTI

SEQ ID NO: 935301 - protein, 96 aa, Homo sapiens
KTPQQPVPKQNQLQLQSRATTRATVAAGKKEEHYALCPLKSLPARPVASVCLTCVAMGGDWSALPPPTVPSLPGAWEESRVPYIQLLSLLQGCPFI

SEQ ID NO: 935302 - protein, 232 aa, Homo sapiens
MWLLYLLVPALFCRAGGSIPIPQKLFGEVTSPLFPKPYPNNFETTTVKQSPREYRVKLVFQQFDLEPSEGCFYDYVKISADKKSLGRFCGQLGSPLGNPPEKRNLMSQGDKECCLTLHTDINRGEGPTMFNKGVPANIQAVDEERAFRSKIREEEAPPPQPPLHTPTLYFSCPGYELQEDRHSCQAECSSELYTEASGYISSLEYPRSYPPDLRCNYSIRVERGLTLPPQVP

SEQ ID NO: 935303 - protein, 126 aa, Homo sapiens
MNSMAPMSPMNELPSRSYPLRGSHSLDDLLDRPRQSHSVLEYWDSQSRSRPRAVSPAVPPAPHPRPYPGSMAAVVGMHWGAATDVKKLMSWEQNPPELFPRGTNPFATVASSHSHQRPVSTPHPLR

SEQ ID NO: 935304 - protein, 116 aa, Homo sapiens
NTENEGSGLTNIKTEEISEVKMDAEFGHDSGFEVRHQKLVFFAEDVGSNKGAIIGLMVGGVVIATVIVITLVMLKKKQYTSIHHGVVEVDAAVTPEERHLSKMQQNGYENPTLQVL

SEQ ID NO: 935305 - protein, 139 aa, Homo sapiens
TFTTYSDNQPGVLIQVYEGERAMTKDNNLLGKFELTGIPPAPQWVPQIEVTFDIDANGSVNVSAVDKSTGKENKITITNDKGPLEKEDIERMVKKPEKYKAEDEKQRDKVSSKNSLESYAFNMKATVEDEKLQGKINDE

SEQ ID NO: 935306 - protein, 32 aa, Homo sapiens
SEAAPAAPAAAPPAEKAPAKKKAAKKPAGVRR

SEQ ID NO: 935307 - protein, 78 aa, Homo sapiens
LTDKGTAVLQFLTSLFKPFVESYQLLCRYLLHEEDYFGEKEYLVAARKFTRQLLDQGSSQCYDALSSELQKNALSSFP

SEQ ID NO: 935308 - protein, 96 aa, Homo sapiens
GVRVAACCRGPAAWAEGYRPEEGSSEVKTEDELRVRHLEENRGIMVLGIRAYGKNALSKNPPQDVIKKPVDALKSDKKVRTIIIKVKSLGYSVLGV

SEQ ID NO: 935309 - protein, 138 aa, Homo sapiens
SLSTPINEAPVSWRVRIALALKGIDYEIVPINLIKEGEQQFTEEFTLNPMKQVPALKIDGITIVQSLAIMEYLETRPIPRLLPQDPQKRAIVRMIFDLIASGHPAPSEPVCPEASGDRRNQMQWGPKGLLLALTALGE

SEQ ID NO: 935310 - protein, 137 aa, Homo sapiens
SGVAGGILLVVPNVMGMMCWSPPLDKMGNSVKGIHFCHDLVSLCNFHNYDNLRHFAKKLDPRREGGDQRVKSVINLLFAAYTGDVSALRSLLCQPWTWSSGIMTPEQPSMSQQQRVMLKLSSFCWLQSKPFPQGQVE

SEQ ID NO: 935311 - protein, 125 aa, Homo sapiens
HFHQQGNRSLARLPVRASTSLPVRRHLCPASSAGSFGPSSTCGLRFEVSGQKKLEVDGPCVIISNHQSILDMMGLMEILPKRCVQIAKREFTGPVGSIMYLGGVYFINRQQARTAMSVMADLGDL

SEQ ID NO: 935312 - protein, 123 aa, Homo sapiens
SLGPGNRKPFLAQAFRSRTLCNFPPQACASSIQMWPSSKVELAHKTTRHLGVHNTLPKAHPIVQDKCSETKQCLYQAIMKRRNLVSQSQGSLAHTAPEAEPAARTVRRPQSQITAVFGSFSIN

SEQ ID NO: 935313 - protein, 132 aa, Homo sapiens
MDLRSVVLLNECSKVVIDNVHGCPFKVLISILQSCRDLRYQNEDLFKSIAEYVATTFDIWKLKQVIFFLLLFETLGFRPPGLMDKLMEKVVQEPGSLNVKNIVSILHVYSSLNHVHKIHNREFLEALASALT

SEQ ID NO: 935314 - protein, 49 aa, Homo sapiens
RASKLSRAFQAHVQSQKSSMAAAAANNLSLVVHGPGDRLENYPIPEPGP

SEQ ID NO: 935315 - protein, 118 aa, Homo sapiens
MNGRVDYVTEEEINLTRGPSGLGFNIVGGTDQQYVSNTVAIYVSRIKEDGAAAIGSKEGDKILSVNGQDLKNLLHQDAVDLFRNAGCAVSLRVQHRLPVQGPKYIEVKGEPSGVPVYG

SEQ ID NO: 935316 - protein, 53 aa, Homo sapiens
MERFWKKNTKFKPSSVSPFDIYKWSLPMALSVCHRGSWNSLELEGSLFLACRH

SEQ ID NO: 935317 - protein, 70 aa, Homo sapiens
LSRLGRELSQSDHRGQFLLPPTSSILRMQCPCKSWFDDMTDTELLDLIPFFEGLSREDDVYSMLHRLCSR

SEQ ID NO: 935318 - protein, 136 aa, Homo sapiens
VEIDGTIHQVYVLKRPHVDEFLQRMGQLFECVLFTASLASMQTLLPTSWTSWGVFRARLFRESCVFHRGNYVKDLKIAWDGKLSKSDHRGQFSCLPTSSILEECKCPCSPGFDDMKDTEACLDLIPFFEGPEQGKT

SEQ ID NO: 935319 - protein, 98 aa, Homo sapiens
WDHGTFKHRKVTLMEEGLQSPRSSKDTLYFMDDAEKTFVPMTENIYNAIIDKTLKLWIFPGGLAHDISRKKLDRPRRATSYVESNFNLIEDYKVRFYF

SEQ ID NO: 935320 - protein, 103 aa, Homo sapiens
LNSVSQKKNLWVPLKTMGGRAWLTSVISALWEAEAGGSPEVGCSGPAWPTWQNPVSAKNTKIGQAWWFMSVVPAAWRLGRENRLNPGGIGCGESRSRHCPPAW

SEQ ID NO: 935321 - protein, 146 aa, Homo sapiens
LKNLSQTGVLFMASFGEGEEGEEEEKKVDSSGEAEKRDFRAALRKQHAAELHLGDFLVFLRRVVSSKAIQSKMASPKWTEVLLNIASQKCSSGIPLVGNLRTRLLALHVLEAVLPACESGVEDDQMAQVVERLFSLLSDCMWETPI

SEQ ID NO: 935322 - protein, 113 aa, Homo sapiens
NSSSVALLHKHLQLLLPHATDIYSRSANLLKESPWNGSVGEKLRDVIYVSAAGSMLCQIVNSLLLLPVSVARPLLSYLLDLLPPLDCLNRLLPAAALLEDQELQWASSWGGQK

SEQ ID NO: 935323 - protein, 84 aa, Homo sapiens
GRSAVQRQLQGYSVEYQLLNGGDCIVLNIPNPASLVVEDLLPNHSYVFVPKSQEGWGPIVRVSSPFEPRCTRKIPLVSPCQGSA

SEQ ID NO: 935324 - protein, 118 aa, Homo sapiens
RGGVGSLEPGSATAEGGRRRQDGVAPGTTGGFTAWCRDPAETPRDAKPPRRARPPETSGRALPPGARAARVRLNPRRRRQAAAGAGVHWTQEVTHPSHRTPSFMQQKAPNQNSSRNRA

SEQ ID NO: 935325 - protein, 139 aa, Homo sapiens
VAFVAGEVGALRVGSLAHDGGAVRVGGFVDVDQWQQGGQRGDDGGQGRRRAFQGQRPFCGPTSGFLNVPFAYRAAQGDDAGLGTGATSRSRVSLARLTLPVTFTTAVSVFEHEAGARRPGRFHGKIAGQAVMDLLVAEN

SEQ ID NO: 935326 - protein, 45 aa, Homo sapiens
NNLGLCCFYAQQYDMTLTFGLNALSLAENEEEAVMSGTTWGHIAV

SEQ ID NO: 935327 - protein, 100 aa, Homo sapiens
MISPVRKRFTPRLAHFAVPSTAALKDPQALLPRPLETSSLLRVIFMAQFFRSNPAGRCAGPPMTYTPQEALSATVSTNCIDQVANAAPHHFQRRKYPFNG

SEQ ID NO: 935328 - protein, 48 aa, Homo sapiens
ARGTFLQSLKSPRGDKLFGPDLKLVPPMEEDYPQFGSPKLRGRGCGIQ

SEQ ID NO: 935329 - protein, 115 aa, Homo sapiens
ELIMKSIIPVVMAGIIAIYGLVVAVLIANSLTDGITLYRSFLQLGAGLSVGLSGLAAGFASSEMLVFGALPAASLFVGMILILIFAEVLGLYGLIRGPNPLHKVVLFHHQSQDRM

SEQ ID NO: 935330 - protein, 67 aa, Homo sapiens
TSSFAEVLGLYLIVALNPLQQKKSFPTHPVNRIGCKRSPPPHSKNEQPDTCQRQLPLSSWSCKCAVS

SEQ ID NO: 935331 - protein, 84 aa, Homo sapiens
SSQAGVQGEVCRSSTTSLKLRAAEGAVPPANCSACDPQNIRELWIIALNMKTAIFQVTSFYQWSYRINSIFNYWFITLQETLCK

SEQ ID NO: 935332 - protein, 79 aa, Homo sapiens
GANAASAFKVTSLPTDPALRVEEQLSVSQKASLFPLEQIGAPGRFGSCLAKDTDLAGGVWPLTLAEPWGGVLGREQGWQ

SEQ ID NO: 935333 - protein, 84 aa, Homo sapiens
ASAHASEKGPDFWLLLKNRKMWPGAVAHTCYPCSLGGRGRWITRIQEFKTSLVGESLEPGRRRLQWAEIAPLHSILVNKSETPS

SEQ ID NO: 935334 - protein, 105 aa, Homo sapiens
SAASPSLAMEKTELIQKAKLAQLSAYDDMATCMKAVTEQEPELSNEERNLLSVAYKNVVGGRRSAMEGHLSIEQKTDTSDKKLQLIKDYREKVESELRSICTTVL

SEQ ID NO: 935335 - protein, 161 aa, Homo sapiens
RNVSRRAAAVLKPEQGSYTYLSLGFFFDRDDVALEGVGTFFRELAEEKREGHPRVSEDIGGRALFQDVQKPSQDEWGKTQEAMEAALAVEKNLNQALLDLHALGSARADPHLCDFLESHYLDKEVKLIKKMGNHLTNLRRLAGQNQRRLAAPGSLGEYLFE

SEQ ID NO: 935336 - protein, 114 aa, Homo sapiens
GLLPEAKKPRLLHGTLIMKDSNFRLVSSEQALKELGLATNFSFTCRVHLQDTRKEQETALRVYSHLKSTLKDHCVQHLPDGSVTVESILIQAAAHSGGPLVKVANSPGTLPGLK

SEQ ID NO: 935337 - protein, 66 aa, Homo sapiens
DPYENYRRNKSYSFIARMKARDEFSTFGTRKEEKEDDHRLFAVWRACPAFALEEVLQNYSQCPDSK

SEQ ID NO: 935338 - protein, 123 aa, Homo sapiens
MTNEEFRQVVNGYRTKKHKKGRLFQEPLMLKIPKSVDWREKGCVTPVKNQGQCGSCWAFSASGCLEGQMFLKTGKLISLSEQNLVDCSHAQGNQGCNGGLMDFCFPVHLRKMEVWDSGGVLPL

SEQ ID NO: 935339 - protein, 96 aa, Homo sapiens
AASMSKAMQFGQLLTHLDTTPADDGQFLKDNTALLTQVQTTMRENLATVEGNFASIDALDEEAGKVSITGSWGAGMTLAPELCQTLPQGHSQPQPT

SEQ ID NO: 935340 - protein, 129 aa, Homo sapiens
MAWNPCQSLTTSSFDDVGVLQKKLVPFLTELNMHLAQELEKLKDDPGEGGAAAGLAAGTTAHTNEVIYQIHGNVWNCNNAWCPSTNLPKFKNNVLLLHFRPPGYPSKMSLVGPSLLGESSRENIAFTQG

SEQ ID NO: 935341 - protein, 137 aa, Homo sapiens
WASLVGDHLDNIAHMVAKGAAVPGISDHVQDQCTQCTGGGDNPFYKKECYMVVNPFTTTSLQKPLDRAVFWVEFVMRHKRAKHLRSLGHNLTWHQYHFLDVIGFLLSCVAVTIVLTVKCLLFIYRFFVKKEKKIKNE

SEQ ID NO: 935342 - protein, 93 aa, Homo sapiens
VSNNMSNYNMSNDTMSSYTGSSYTMNNYTVSSDVVSYTMNNTMSNMSSYNMSNDTMSSYTVSTYTMYTVSNDIVSGDTVSSYTMNNTTSNGMS

SEQ ID NO: 935343 - protein, 124 aa, Homo sapiens
KTPATLGHNTRVYKWLPQNDLLGHPKTKAFVTHGGANGVYEVIYHGIPMIGIPLFGEQHDNIAHMVAKGAAVTLNIRTMSRSDVLNALEEVIDNPFYKKNAIWLSTIHHDQPYRSPWTGLVFWG

SEQ ID NO: 935344 - protein, 64 aa, Homo sapiens
CPPQVKEAATNLIFQNTAQSLNASRRASSSRLRKRAPSRLLTGYRGVFNDSKQRMILPVSKAAY

SEQ ID NO: 935345 - protein, 151 aa, Homo sapiens
ILTQGLAPRPKPQGNWACWGESPETSGSPYSPVLDTRNVLTSFQICFNRSLSTFLLGEDEEEDTTGETDGPGYPTAFMGFLPLFLGMYSSSGERGSGSSLHSGELWLCSALVLFWEALLAVAPERIPRRTRAFLAPALQRRSSYRPPPMFG

SEQ ID NO: 935346 - protein, 121 aa, Homo sapiens
MNEDTRPDSCATTSEWKKAGVEQLRLSTVDMTGPTLANLHKGVQFALKYQALGQCVYVHCKAGRSQKVPQWQPNLIQVHNWSPEEAIEAIAKIRSHISIRPSQLEVLKEFHKEITARAAKN

SEQ ID NO: 935347 - protein, 29 aa, Homo sapiens
MTTASVGVSSPGRVIFGPPSNMPCCNISR

SEQ ID NO: 935348 - protein, 119 aa, Homo sapiens
GLCAPTAASFPRHCLPHQYRGSHYNPNCVATPGGYDPFRFNPREHQGVTSGFSLLAGPNCIGAFAMAMKVVPLTLLHFRSCRPLNPAGNPSWYCAQRVDFGCGWSPWVRTHSDCPTHPP

SEQ ID NO: 935349 - protein, 148 aa, Homo sapiens
MASSSGNDDDLTIPRAAINEDDQKRLFLMSGWPTIARELVVNCCTEFIHLISSEANEICNKSEKKTISPEHVIQALESLGFGSYISEVKEVLQECKTVALKRRKASSRLENLGIPEEGLLRQHRDYLPKLAATSRLPQEWLPMQQQLQ

SEQ ID NO: 935350 - protein, 75 aa, Homo sapiens
RGGEKALLDKLHAAAFEKMQEKRQMERILKKASKTHKQRVEDFNRHLDTLTEHYDIPKVSWTKYTCPWCKKAEGG

SEQ ID NO: 935351 - protein, 65 aa, Homo sapiens
PHLYPPAGAESLRTTYVNGLSNASSLNSPCNPPRTHQTPGAVLQIRTIFQSSPDALVNSKLLGNL

SEQ ID NO: 935352 - protein, 96 aa, Homo sapiens
PANSEWANARGTLLASNNVNQLFQPICTTYVSDNFHLSFHLSKHMDETHKQSRMGASFKAEQENEGGRLSRGSVHPQGTLTSKSGFKKSQLCEDPE

SEQ ID NO: 935353 - protein, 97 aa, Homo sapiens
FRGAVCVSEQKWELGQAGRWSLGRSRGAQMPWSQVPGTGEAAALDVVVAVALEKDLGGGGGLGGDVVVAVALEKDLGEEVGVWVVTWWWQWLWEKLG

SEQ ID NO: 935354 - protein, 78 aa, Homo sapiens
RKFGNEENNNTTHARLFFPYFWWWGFNMLAGLVLRLLTSDDSPCLGLPRVLGLQVGATVSGPFLFTLKLIPRLGGSCL

SEQ ID NO: 935355 - protein, 101 aa, Homo sapiens
LTIYPCILDLGRALTIYPCILGLGRALTIYPCILGLSRALTVYPCILDLGRAPTVYPCILGLSRALTVYPCILDLGRALTVYPCILDLGRALTIYPCILGL

SEQ ID NO: 935356 - protein, 118 aa, Homo sapiens
MAVGGERWQFILSFFQPSMRTGNLLIHSFEGQSALPEELGSLVYREGYLAGHRACLQLVVQCLQPSERLPGQEEREASAASLRQSSRLCGSPSRGENTLFVSSRFFLEKGEQWFMGVT

SEQ ID NO: 935357 - protein, 67 aa, Homo sapiens
PLEGTPRLTPCLLDMTTQLACHPAVHLPMALGSLTPSGAQIELQLVGGSYVGCQRSSVLYQISAPSF

SEQ ID NO: 935358 - protein, 178 aa, Homo sapiens
WLMYLPANNGPGAVKKGSSCSNLASLENCMKLSQMAVQGLQQFKSPLLQLPHIEEDNLRRVSNHKKYKIKTSQDLVSLKESDRHSLLHFLEDEKYEEVMAVLGSFPYVTMDMKITGLDDEDSNNITVGSLVTVLVKLTRQTMAEVFEKEQSICAAEEQPTEDGQSDANKIKAKGGWQQ

SEQ ID NO: 935359 - protein, 108 aa, Homo sapiens
KIGNDEVALLNLALGTLAPNSGGCIYVLSALLLYVSTLLYSTEKSVQGLFELEGSSFCSLLWIMMVCFKITGMSARRKCTPVVPAIWEAEADGSRGQEIETIPGPRLY

SEQ ID NO: 935360 - protein, 159 aa, Homo sapiens
LHLSGGKFMTMGRQRQKLFEHVTSEIGAEAEEVGVEHLLRDIKDTTVGTLSQRITNQVHGLKGLELPSFLDIRSFTWRRYQRKLPINHQIIYQLQDVFNLLPDASLQEFVKAFYLKTNDQMVVVYLALIRSVVALHNLINNKIANRDAEKKEGQEKEES

SEQ ID NO: 935361 - protein, 165 aa, Homo sapiens
SNSFAVPFDEDDKDDSVWFLDHDYLENMYGMFKKVNARERIVGWYHTGPKLHKNDIAINELMKDTAPTQVLVIIDVKPKDLGLPTEAYISVEEVHDDGTPTSKTFEHVTSEIGAEEAEEVGVEHLLRDIKDTTVGTLSQITNQVHGLKGLNSQLLDIRSYLEKVA

SEQ ID NO: 935362 - protein, 123 aa, Homo sapiens
LDPYITYNMWKEVRFGRLCLKVRVGSVCTARVLPPLMFMAQEPQMPSLQDLRKVKVESTSFLILIKASNTIGPHLFRSTSYVCIRGFISSLVWVPSVNGKFFDSGCSSSCLCPSTGLKLQAHL

SEQ ID NO: 935363 - protein, 115 aa, Homo sapiens
VASGIPAGWMGLDCGTESSKKYAEAVGRAKQIVWNGPVGVFEWEAFARGTKSLMDEVVKATSRGCITIIGGGDTATCCAKWNTEDKVSHVSTGGGASLELLEGKVLPGVDALSNV

SEQ ID NO: 935364 - protein, 144 aa, Homo sapiens
KTPSDTHNKDCSIAATGKGHLPASPTSGRRGGRWMMGWLREGAAIQHICDAVRPERGLGPVQEHATVPNLPRLDANSPSVRDVNALPAPPLPPLPEDEEGSEVTNSKSVDVYKLARQPTPPGANRRMPADSRIPSLAALRCRAP

SEQ ID NO: 935365 - protein, 153 aa, Homo sapiens
YINKDSKHEELMLGDPCLKDLKKGDIIQLQRRGFFICDQPYEPVSPYSCREAPCILIYIPDGHTKEMPTSGSKEKTKVEISKKETSSAPKERPAPAVSSTCATAEDSSVLYSRVAVQGDVVRELAKKAPKEDIDAAVKQLLTLKLIERNWAGV

SEQ ID NO: 935366 - protein, 69 aa, Homo sapiens
LHLFDSLKPPSQVELIFYILSFCKSATVPFASVSLIPYCLAQDPGTDTQEVFVRHAESLVFKVNRHAKD

SEQ ID NO: 935367 - protein, 105 aa, Homo sapiens
IPYSLYTRFAETLSTKAAVNFQNILHFSPSAKKINHSVNYVVLLSSLAGVRPRSWRLANHHREKVPVLLRPLSYKLSKECLHLISLRYHRGGGGGYDSINFHKLL

SEQ ID NO: 935368 - protein, 178 aa, Homo sapiens
AIVQPHGSQRWVTSRMGDKPIWEQIGSSFIQHYYQLFDNDRTQLGAIYIDASCLTWEGQQFQGKAAIVEKYLAFRSRKFSIASRRRTTKPTPDSCIISMVVGQLKADEDPIMGFHQMFLLKNINDAWVCTNDMFRLACTTSADLLLATVTLFPPPLSILAPPDAPISSQRAGRADGVQ

SEQ ID NO: 935369 - protein, 167 aa, Homo sapiens
EVPELPLVVEDKVEGYKKTKEAVQLLKKLKAWNDIKKVYASQRMRAGKGKMRNRRRIQRRGPCIIYNEDNGIIKAFRNIPGITLLNVSKLNILKLAPGGHVGRFCIWTESAFRKLDELYGTWRKAASLKSNYNLPMHKMMNTDLSRILKSQKSKEPSEHHARRIAES

SEQ ID NO: 935370 - protein, 125 aa, Homo sapiens
SVPALSGRQGQPSLATNSPFSYLEEDSAIPITVPGRLPVSLAGHPVSPQAAAVQAAAAQAAVANQAALEQLREKLVCRASGEEDGPGERIEQQRLDCNVHFQQKLSWAMAAQAPLRHFFNSQGNT

SEQ ID NO: 935371 - protein, 104 aa, Homo sapiens
RSALPSERNTGQTEKASSWEAGSRDTRLQLQVVNSLKANEWPETGLGGLSTHVGAWGQGFLLSLWLAPPPLSHIPGQSRNPRTLTPLPLLYPGTPSLVLLLLLP

SEQ ID NO: 935372 - protein, 71 aa, Homo sapiens
KRKSRGWKKTELKAAPQIKLYLYTSTTDIKTDDQYKYILVDTTGPPSCVLETDFTCVSSYLNVTALEVSAL

SEQ ID NO: 935373 - protein, 83 aa, Homo sapiens
MEHLCGGTPASLSNADPESAPGVGNFSQLERLHQSSCLGRPLLEDPNALFKRREENLAILGPEILKLLVKIFFWEICISIFLE

SEQ ID NO: 935374 - protein, 103 aa, Homo sapiens
LSALLSSTGRPIAFVRKIPWTAAEELREHFAQFGHVRRCTVPFDKETGFHRGMGWVQFSSQEELQNALQQEHHIIDGVKIHVQAQRAKALHGAQTSDEERFLR

SEQ ID NO: 935375 - protein, 149 aa, Homo sapiens
ASPFEHCHVVTTTTHKTLRGCRAGMIFYRKGVRSVDPKTGKETYYELESLINSAVFPGLQGGPHNHAIAGVAVALKQAMTTEFKIYQLQVLANCRALSDALTELGYKIVTGGSDNHLIPMDLRSKGTDGGRAEKVLEAVLIACNKNTML

SEQ ID NO: 935376 - protein, 37 aa, Homo sapiens
RSCPTTARLDTTEKKTEQQRRRVEGCAQAAGTAGRVG

SEQ ID NO: 935377 - protein, 91 aa, Homo sapiens
MEWNGINTIAIDWNGMERIKWNGMEWNGTEWNGMERNGMERNGMEWNGMEWNGMEWNGINASVGEWNGMECNGMEWNGMQRNGINPSGIAW

SEQ ID NO: 935378 - protein, 84 aa, Homo sapiens
ECPIVVFLSLWGHKTERLTLPESLAPFTVIPYPLSVMDRGGPGLDKAPAAPCTNLHAFPRSKARIYRVHAAGSRIPSCGTERPF

SEQ ID NO: 935379 - protein, 101 aa, Homo sapiens
PGRPRMEWQSRRIHGMSELVTPDSSREKKRTLLQFLSDHFQDIQTLREYLLQKQISKVNRENRLSMLEDSQGQPPGFQHFTVWPACSFLSFEELSHSSGQL

SEQ ID NO: 935380 - protein, 94 aa, Homo sapiens
VNHDAHYSFQVQCGLIVVAYKDGSPAHPHFMDEELCSKYWAKWFSTRRIYRKAKEPERSRASVEARDCLAMLRGDLCLGDALLSTEFLKRNAGN

SEQ ID NO: 935381 - protein, 177 aa, Homo sapiens
SKGDVVCYYGNRGEPEPIVLTQADLLPIGTYGLSNALLETPWKKLCFGKQLFMEAVEQLPKDVLVTQLLDVLNNEEAQLPDPAIEDQGQEYVQPILNKYAAVCVRCATYGTRTNTIILVDANGHVTFTERSMLDKDTLAGRPTPYEFTLQSLPLPGSKDAVLKGNVDRNFHGHSASL

SEQ ID NO: 935382 - protein, 107 aa, Homo sapiens
MISNHGKPDRPTPPHPSVCFRGQLLSQDFYPSGNKLNHAHDLSVWCQHSGSCYGMQRTTHIPVSNRMHRRDLKQQQVTRFTKGDSQSSLTHCLGCRAQLPSSPGNIT

SEQ ID NO: 935383 - protein, 72 aa, Homo sapiens
GKAVYRCWRFKSSPSAMGLTIKHEETGDKRGPLIQKGNLNGQLRGCTQRVVMSPADLRRMAPNPPSDWPPRF

SEQ ID NO: 935384 - protein, 71 aa, Homo sapiens
SRLAQVSAVPSARSRGPATAFLLPAPWQLQLRCGVEWIAAVTFAAGTALSVYLAYKKFYAKENRTKAMGES

SEQ ID NO: 935385 - protein, 108 aa, Homo sapiens
MAEQAVKHPNAARCSCGWPPKSKACLGRPYVAKPLWPIAKTAANLNLDSLNWVGLVKDVSVPGSERTELGVMRQPPPGDGFDRRQPSLTWLAATSAATVRGVPFSVGA

SEQ ID NO: 935386 - protein, 124 aa, Homo sapiens
GKAHKLDADLVFVGYGTVAPEEGGWNDFKGMNLKGKVLVMMVNDPLPTATEPNRFNGEGLTYYGRWTYKFEESGAPRAPAANPLPPDKVGLVRLERCEQLGQLALPAHRSKVGTGLQGWMTDDT

SEQ ID NO: 935387 - protein, 130 aa, Homo sapiens
HSDVGSLTLVRAEFGVIPVYAEHIPCPLFSNIQPSPFRPSVRLHNRHPQLLACDLSGPASCLMEEVLKQELGNLTVLEEARSLHHGATHPDLRKPGELHTESTLAIIVTVSSIDRILSISRVLEAHEGED

SEQ ID NO: 935388 - protein, 87 aa, Homo sapiens
SHPAARPLYAHGKMSTPIPQCKVTQQPPMSLYAHGKISIAPPHSPVQSHPAVTRPLYAHRKMSTGPIPQCNLTQQSPILSMHTGRYP

SEQ ID NO: 935389 - protein, 97 aa, Homo sapiens
LTAHCDVSVMVPSALHSVHCDASVTVPSAPHTCSLSTVTCLSWSPRPCTRVHCDASVMVHSALHTCPLCRICHGPLGPAHVLTVHCDVSVMVPSALH

SEQ ID NO: 935390 - protein, 102 aa, Homo sapiens
EFWILPLTPYFSSWLDDTPSTSILLNIFNILILQYTDPSNTKASNYINSSPPMAFLSSFLSHYSHGHTLDFTCHYQKLLFLNFMHLTLWPLYSSLPVQSLIN

SEQ ID NO: 935391 - protein, 69 aa, Homo sapiens
ERHKQEQGKLPYKSVRPRENPLSRKQHGGNCPREPITSQLGITIRDEIWVGAQSLTIITTSLLRTQAPI

SEQ ID NO: 935392 - protein, 95 aa, Homo sapiens
TQDLMPLTKPQCPPVPPPDASSSAPVKMPSRLSFHTHCLSLPSVPQPFPLVLYSVAIPSPLLPPWHPGWGAPRETSAVPPTSVPSSGKGWGGPVL

SEQ ID NO: 935393 - protein, 67 aa, Homo sapiens
SHLKAYWGWRILFQDGVLKMAGKLVLVVGGRPQFLLYVGLFTGLSVLMTWQLHSPDRAMQENKTEAS

SEQ ID NO: 935394 - protein, 70 aa, Homo sapiens
GGPGPRAHGISAMLQLFPKPVFNTSSNVCQFSTFLHPRGVMRMPLISVYRFASQKHFFLEGHNLKMCTGA

SEQ ID NO: 935395 - protein, 42 aa, Homo sapiens
TDTGANVPPSAKVPLGLCCRRPHGAVEPGAGGGGCPLGFSCC

SEQ ID NO: 935396 - protein, 97 aa, Homo sapiens
AAVNLHLELLVHTVDLRGERGAEQSQFAFVEFEIRQPFLEFGLEFRDFGNVVQAIAFISGSQFQGGKVGQIIPRQMSLPEAQFCWNARIRSYICVTI

SEQ ID NO: 935397 - protein, 86 aa, Homo sapiens
DASSSTLAPTSFLLGPGAFNAQESGQGSRAPPTAPTPGDGGPGTPSKVTCFLPMDPATFWCKRPESVGDLELPGSTVIRVPPNTKT

SEQ ID NO: 935398 - protein, 35 aa, Homo sapiens
MEHRENTDEQALWPFKDTHCCLQLQQGKWSDMKFP

SEQ ID NO: 935399 - protein, 38 aa, Homo sapiens
MANRISVEKSLNDLIELKTTAQELCDKCTSFRSLFDQL

SEQ ID NO: 935400 - protein, 83 aa, Homo sapiens
VPSGAILDPEKALNKTEFLSPDSLHSGGERQASEPVNRQYILWGISSVDACKEIATTLPRVSKEGLSTKVSPFRKSEEVSGEA

SEQ ID NO: 935401 - protein, 57 aa, Homo sapiens
PTGSLGGGQEHPVGVDKYFCECCRELLDTVDNYAVLQLDIVWYYFRLEQLECLDDAE

SEQ ID NO: 935402 - protein, 41 aa, Homo sapiens
LFTFREDLAVGFSDSDAKMGKSFANFMCKKDFHPASKSNIK

SEQ ID NO: 935403 - protein, 81 aa, Homo sapiens
ALQPIPKSCPVQGGAGIPQGCAALPQNQSTVGTPGCLPTTHLGTHAADRELVSIFGGLLVPCPGLEHISRLILKRPKPEAS

SEQ ID NO: 935404 - protein, 144 aa, Homo sapiens
KLCQAIGFAVDPPRRPCGQTVLNQASTPGKVTDPGGKAGPWGLIRWAQGFLNSSSSTRFDELLQQLEKLPGGIRPETAGLGSSKPAHSSIGELADASKASLKQGSELFEEQVVMAETLDAHGKASTTRQHVDGQDLPPDEALTF

SEQ ID NO: 935405 - protein, 42 aa, Homo sapiens
MNRLDLFGIEVQPLFSVLFPVPMVGPPTTYLGARFLGVEFSR

SEQ ID NO: 935406 - protein, 96 aa, Homo sapiens
MYLGKKLDRKMIHHRTMSQSDCEEDPEVEFLKSLTTKQKQKLLRKLDRLEKKKKKKSDKKKKKLQKSKLKHKKRKNKSPSSSSSSSSSSSSSSSSS

SEQ ID NO: 935407 - protein, 118 aa, Homo sapiens
LPAFDVTELAGDAGPVSQIMQSVAFLHQTGSQAQCNLPLQAPGRVAHYSSPLLSVQGDAHQAGIGPIAVLAAFGVYRETPADIRNVPAGVMTDATVPLVFAGAVSERFGTSGMLGGIS

SEQ ID NO: 935408 - protein, 191 aa, Homo sapiens
EGGAAPNQTVWGTPGGGTTRAKRPDSLGTHPVVQTSRGEEKFFTPPTGGPPGGPGNRAWVGRGNSFFSPHNLGRRPPSHTRGCFYPPQKRARFFSHREKVLGRKGDFRKTPWDTHPPRARVLLPWNFFPPSPPRWPVTFCNKTSPRLKYKRAPIFLHGTMGRRYIGVLLTPGDGPALLARLGSTSPILSWL

SEQ ID NO: 935409 - protein, 127 aa, Homo sapiens
HGFCTAPKPASFSARQLPSCVPASSANGWWWPGPVGVCGSTGRRLPSALGKPAGADATSETVLSRNSGSYLVMTSSAGGVEALWPGSSRSRGQSRLFRHGRSACRKPSSSDMAFVPDPARARERRPR

SEQ ID NO: 935410 - protein, 143 aa, Homo sapiens
QNTGQYDVISCLNLLDRCDQPLTLLKDIRSVLEPTQGRVILALVLPFHPYVENGGKWEKPSEILEIKGQNWEEQVNSLPEVFRKAGFVVEAFTRLPYLCEGDIDNDYLCFLDDAVFVLQTSINTWRPKSSESPLQPTLPEEEM

SEQ ID NO: 935411 - protein, 84 aa, Homo sapiens
YAMTSALTQGLERIPDQLGYLVLSEGAVLASSGDLENDEQAASAISELVSTACSSCTMARTSLSNACLWSLVNTRLLGDCFKDR

SEQ ID NO: 935412 - protein, 87 aa, Homo sapiens
EVEVSSLEPHQALGTRATETVYSEIRKVDPNLMENRYSENGKAPLMEKTVKAVHVPGRSSMSREEQPIPGLRKSCARIYEACPHRKQ

SEQ ID NO: 935413 - protein, 105 aa, Homo sapiens
MNPSNLHLFISAYNSRRDLEIERPMPGTHTVTLQCPALLVVGDNSPAVDAVVECNSKLDPTKTTLLKMADCGRPSSDLSAPPKLEAFKYFVQGMGIHGFLQHDSA

SEQ ID NO: 935414 - protein, 137 aa, Homo sapiens
MTVAAGGPGAVGMDGERGGFREVSAVASGAGVTAVWGREADSARQGEDKEWMPVTKLGHLVKDMKIKSLEEIYLFSLPIKESEIIDFFPGGLSQGLRFSRLCQFKKQDPVPANTKVQRHFVCYPGTYNGHVLGVFKC

SEQ ID NO: 935415 - protein, 68 aa, Homo sapiens
GGKSAVGERLGSEGNPAGIRAIRTATMTVGKSSKMLSILITGRGASCRTGRIFIGTKLFDKHMNFDPL

SEQ ID NO: 935416 - protein, 121 aa, Homo sapiens
SWLLQLSTTVIKRLHPVQDRDRNLSALPHLQPDVLPTGHLRREKVRIPDSAEIPAPVSTSTLGFSIASGTTLSLKKTDARAGGVYFYENDLTDDPDATAEQPLLFNRLDVGRPHHAFLPHH

SEQ ID NO: 935417 - protein, 72 aa, Homo sapiens
GLEPDVEAFVIDAVGTKMVYCKIDQTQRKVVVSHSTHRTFGKQQWQQLYDTLNAWKQNLNKVKNSLLSLSDA

SEQ ID NO: 935418 - protein, 65 aa, Homo sapiens
ARKKLLADQAEARRSTKEARKRREELQAKKEEIIKTLSKEEETKKKASLVSVHSGLAVASCGSVF

SEQ ID NO: 935419 - protein, 151 aa, Homo sapiens
GSPIRPQVRLPFAREPKQQLRLRQKCQRSLSISTTLWAGSWVVELKFALVLLAGPWWVGQEGVLCPHRQHSIQNYSHRVESLCSSPEVQSDSDGSFLPLNTAQPLSDHVLVTVFAAGTVSDEGLWEDGHSLPLGKAGALVSWEFKLHSRIE

SEQ ID NO: 935420 - protein, 87 aa, Homo sapiens
ETARPLSPVNPKLEKSDQSSTEDSGKPTGGNSGKPTGGDSGKPTEAGSNKATEDDSGKSTKVDLDKPTSKISPDTGDFRRLDKVQPT

SEQ ID NO: 935421 - protein, 83 aa, Homo sapiens
DAKDAVDLMKALQFKQVSLLGWSDGGITALIAAAKYPSYIRKMVIWGANAYVTEEDSRIYQGIRDVSKWSEKARKPLEALVWI

SEQ ID NO: 935422 - protein, 119 aa, Homo sapiens
DVAAQLGEYLEELDQICISFDEGKTTMNFIEAALLIQGSACVYSKKVEYLYSLVYQALDFISGKRRAKQLSLVQEDGSKKTVNSEDSLVKQRMSSWSLGRLPLTPGLNVGSGKMIQGIQ

SEQ ID NO: 935423 - protein, 86 aa, Homo sapiens
SPAFTMSVPAFIDISEEDQAAELRAYLKSKAELSEENSEGGLHVDLAQIIEACDVCLKEDDKDVESVMNSVVSLPVDPGTRQAKKH

SEQ ID NO: 935424 - protein, 108 aa, Homo sapiens
FSRAFSDTNRTSPESNEGPENEMVSSLALQMSLYFNTYYFPLWWLSSIMMLHMKYSILPDYYKFIVITVIILITLIEAIRLYLGYVGNLQEKVPELAGFWLLSFYCSY

SEQ ID NO: 935425 - protein, 68 aa, Homo sapiens
LHHVDPALPYISDTGTIPPERCLFGVMLNIAAVLGIATMYVRYKQVHALNPEENLIIKLNGWALYLGY

SEQ ID NO: 935426 - protein, 105 aa, Homo sapiens
DLVPVSELGGPDGATAPIRSPTMAGGLAMNRQYFNDLGQYDSGMDIWGGENLEISFPDLDVWRQFILPCSRVGHIFRKRRPYGSPEGQDTMTHNSLEDWHMSGLG

SEQ ID NO: 935427 - protein, 73 aa, Homo sapiens
EVCWGQRGEDGMCMGPLDLPSLLMTAAAAKAAGVPVQTVPATWHPGPSARLHRVRAIHSGTQAPLLLGKSPDE

SEQ ID NO: 935428 - protein, 113 aa, Homo sapiens
RLAYLSDEMNEIESGKIIFSEHLPLSKLQQGIKSGSYLQGTFRASRENYLEATVWIHGDKEEEKEILIQGIKHQTELCNEDIVAVELLPRSQWVAPSSVVLDDEGQNEDDVEK

SEQ ID NO: 935429 - protein, 121 aa, Homo sapiens
VDRLAFSCIWEMNHNAEILKTRFTKSVINSKASLTYAEAQMRIDSAAMNDDITTSLRGLNQLAKILKKGRIEKGALTLSSPEIRFHMDSETHDPIDLQTKELRETNSMVEEFMLLANISVA

SEQ ID NO: 935430 - protein, 119 aa, Homo sapiens
DKKPKKSTWRFHLDLTHPVEDGIFDSGNFEQFLREKVKVNGKTGNLGNVVHIERLKNKITVVSEKQFSKRYLKYLTKKYLKKNLTVIGYVWVRILTKEDLRTSVISQIKSKMEDGFQKS

SEQ ID NO: 935431 - protein, 68 aa, Homo sapiens
FTLNRLRIKITVVSEKQFSKRYLKYLTKKYLKKKISVIGYVWSHLTRRLTELRYFQISQDEDGSESED

SEQ ID NO: 935432 - protein, 65 aa, Homo sapiens
EDLSSWTAADTRQITQRKWEAAQCDRDRAYLEGLCVESLRRYLENGKETLQPRPPKTHVTHHPIS

SEQ ID NO: 935433 - protein, 42 aa, Homo sapiens
KALQTTYGTNAPRMTSAPALVYHHSQLQGTRGRSNRWAMSKF

SEQ ID NO: 935434 - protein, 70 aa, Homo sapiens
LTLPRAARGFGVQVSPSGEKITHTGQVTAAARHAWNPRHDGSRERVYDEKDYRRVRFVDRQKEVNENFAK

SEQ ID NO: 935435 - protein, 75 aa, Homo sapiens
MAMKAVCVLKGDGVLGTIHFEQEGKRVNQLCCQDKFTGINLKGKHGFKVHQYGDNTQGLYLQGPSFLILNSENMG

SEQ ID NO: 935436 - protein, 92 aa, Homo sapiens
PDVCQAFNEKNVCVLSEKEDRKQIRSVKSQKENTAGYTKMEHHGEVVRPGTASSEELIDESSAGSEQGALRGPAGVEQQGPVPLLSQRNNSE

SEQ ID NO: 935437 - protein, 74 aa, Homo sapiens
MSPDFTVFMIKYLMTLIVGITSGFWIWSGKTLNSWRKFYTRLTNSKQGETTVCNPDSYRYPFFGPIRSHRPGKG

SEQ ID NO: 935438 - protein, 72 aa, Homo sapiens
TLQKQSSVYGGKSTIRRSSGTASSVFTPLQGLEIVNPQAAKKVAEDNQKYSSMAEFLKVKGEKSGLMSTLND

SEQ ID NO: 935439 - protein, 69 aa, Homo sapiens
QAGEPRALQGDQNKGANLYRRGSGFPWTWVWDPEKRKLGQLSSATPVGGGLQGGSLLPGEGRRGANFSK

SEQ ID NO: 935440 - protein, 51 aa, Homo sapiens
MAWGRPLLAGLGGRALKRSGRVVIFHSEVRKAPTSPSLWWLLSALYSPAHL

SEQ ID NO: 935441 - protein, 52 aa, Homo sapiens
ASAINSIVYIISAPMSPLFGLLVDKTGKNIIWVLYAVAATLVSHMLAFTFNP

SEQ ID NO: 935442 - protein, 83 aa, Homo sapiens
ALEACRALRLAMPSVGERIELGTATKSAKQTLLGWKTVSAEGQNASDMRNKKLKYCANGPIEAKADTENFPLALLLLTLGISS

SEQ ID NO: 935443 - protein, 30 aa, Homo sapiens
MKPSVSDDEATVPLIVEGTRHFPVSQNLDI

SEQ ID NO: 935444 - protein, 61 aa, Homo sapiens
LGPGSSFCMLAMSCRTEDRRKREPSRDGPPVVDSAAHASQGGPTGVTGHQWTSAWARSKFE

SEQ ID NO: 935445 - protein, 78 aa, Homo sapiens
MLCSVLSQMSGISSVVFPADRINGFSEVIVKTQQLEDKTQFEVRLQRSFLPAAVEDGRGNAKRYSSYGHLVIYVSSLN

SEQ ID NO: 935446 - protein, 126 aa, Homo sapiens
QTPLFPFEPIPSWRVSYNQGIWLRGTSLPKAYTFFIDILLEYSRDEIAGCIEKAYEKILFAEATRILFFSTPKKMTDYAKKRGWVLGPNNYYSFASQQQKPEDSTIPSTELAKQVIEYARQLEMIV

SEQ ID NO: 935447 - protein, 68 aa, Homo sapiens
MRLRFRDTNGQLLCSVEVEAGWLDRGIRGNSWYLEDVNLDSYLCHQSSNGFSTPQLLMIEKKANDKEI

SEQ ID NO: 935448 - protein, 95 aa, Homo sapiens
EFSGVLHQCHILASEMVHFIHQMQYYITFEVLECSWDELWNRVQQAQDLDHIIAAHEAFLNTITSRCLLDSNSKGAFKPTEEPCLTKSLNFNAGR

SEQ ID NO: 935449 - protein, 107 aa, Homo sapiens
AIGCVSRTDTAIYRRFLYLKSYCSLACKKKEKQKERKRRKEKRERKEKMRFQPLFWVFFIFAMSLLFISEQKPVNFPKEKKTIQTQLLSQEMHSTSFSECPSHGENL

SEQ ID NO: 935450 - protein, 69 aa, Homo sapiens
GKACNPKPIPENIKRIPQQLKSLLNVAPLVSYGFAFPQFVTLQQLQFKNIKWKIPEIKNFKSQMVCPSE

SEQ ID NO: 935451 - protein, 116 aa, Homo sapiens
PLGDLVAFSIFCLVSVWCLSLLPLSCPPILLCCTHLPSVLEQNSVTYVPIVKTSGLTNKCLSFLLGRAASFASCPENAIILWVSIVGSLCSEEQAANATKGLAAVASGACGEPTLP

SEQ ID NO: 935452 - protein, 126 aa, Homo sapiens
TLEKCGHNKGYKGLDNCRFCPGSQCCVEDGPESIDSIIDMDAVCKRVTTLGLDVSVTISQDAGRYLCDFTYYTSLYQGPRRSAFVHVPPLGKKPYNADQAKAGRYEAIIRGDAGCPWSKPKGDISC

SEQ ID NO: 935453 - protein, 120 aa, Homo sapiens
YSFRALFYPIEGYLEHDPYALLNQNQTWCLNTVHMDTVALQEYSFSSRLPSEFMPRSVIKADTERHACYGITSTKLKSTTVSLPRTYLYAGRLGKAPTIRIDLYGYDGILTQAYPTIDPM

SEQ ID NO: 935454 - protein, 58 aa, Homo sapiens
GGVDYVEDEEVGYNTCSFQLYETGEREKQQFDLTVEDDGCMLLIVYVSIFVINRFNKA

SEQ ID NO: 935455 - protein, 129 aa, Homo sapiens
STPAEAAEDVIMAMFEQMRANVGKLLKGIDRYNPENLATLERYVETQAKENAYDLEANLASLKLYQFNPAFFQTKVTAQILLKALTNLPHTDFTLCKCMIDQAHQEERPIRQILYLRGPCWKTLPLFKA

SEQ ID NO: 935456 - protein, 56 aa, Homo sapiens
AQGTEGGIYNGFSRSATLIIFWLVFVSSKYLDGRKSLDTILTSQGLMFVCIDGPDF

SEQ ID NO: 935457 - protein, 141 aa, Homo sapiens
KAINIQTKESHFKNPIHKKQPPGTFKQQSGGKNVSIAQFSSKYAREYNPITATIHRIQCFLETLRFTVGSFQVAACAAQKGQRRAALEELSLLENCSAPKESPRKAGPWAHNFILSPGSSSSTSLEVNVVHREAHHPLPSQ

SEQ ID NO: 935458 - protein, 136 aa, Homo sapiens
TGTLHQRSIAELVPKCHPLSSFEQMEAVNIAQTPAELYNAILVDTPLAAFFQDCISEQDLDEMNIEIIRNTLYKAYLEAFYKFCTLLGGTTADAMCPILEFEADRRAFIITINFSGTELSKEDRAKLFPHCGRLPE

SEQ ID NO: 935459 - protein, 72 aa, Homo sapiens
AAAAAVAVPLAGGQEGSPGGGSSEPGDHHGKEAEKASVIDSGHRGQRQTENLDQELLSLAKETVTLEEKEPC

SEQ ID NO: 935460 - protein, 135 aa, Homo sapiens
RRRHRQRSLERRERASRLCPDLGAYEQAATDRYTIHSQLEHLQSKYIGTGHADTTKWEWLVNQHRDSYCSYMGHFDLLNYFAIAEEREQKPACVFNLIGENAAAQRAARGQSPRRTGGERCPVFPVCRLRAFLCS

SEQ ID NO: 935461 - protein, 131 aa, Homo sapiens
PNCFLHGPNLDLPSTYFAIARERRAKPVRFQPDGEKLLAQRAARGQSPRRTEVSAAQSSPCAGCEPPCSCISTIPCWLCRLTCVPVEDSEQVMERLSGSAPCELCRRSDPSIGKRGRRLHESDAHFESAFR

SEQ ID NO: 935462 - protein, 95 aa, Homo sapiens
STVMLTGETKKRNGLIKKMLVLNRTRYRCLGRPVHANDRAPATEAVKMRLKVSNFTQHAFREKPFSVKKSAIPATVMEYRQHTPQFCQRIQLSRL

SEQ ID NO: 935463 - protein, 102 aa, Homo sapiens
LPELFETSKKLLEDVEVATEPTGSRTIQDKVSKGLELLEKAAGMLSQLDLFSRNEDLEEIASTDLKYLMVPALQGALTMKQVNPSKASRSFAAGSRTLPYIS

SEQ ID NO: 935464 - protein, 77 aa, Homo sapiens
AKPSADFPKSSSASRKIKSKKDEESEEKALHRMREWDGLEGHPSQGLRQPTEHGLVIQKKGQRGAHLHTKDNFRRVQ

SEQ ID NO: 935465 - protein, 70 aa, Homo sapiens
KIELFADVVPKTAENFRQFCTGEFRKDGVPIGYKGSTFHRVIKDFMIQEVEILLMMVLEVPSIYPGANFA

SEQ ID NO: 935466 - protein, 100 aa, Homo sapiens
MRAMNGESLDGRQIRVDHAGKSARGSRGGAFGGRGRSYSRGGGDQGYGSGRYDSRPGGYGYGYGRSRDYSGRSQGGYDRYSGGNYRDNYDNLRLGHAHKI

SEQ ID NO: 935467 - protein, 47 aa, Homo sapiens
TPRSPLQAAPWPTRQSWGSAEPPAPLLPNEASDDEALLAVLLGSLVT

SEQ ID NO: 935468 - protein, 116 aa, Homo sapiens
IFKPISVDLFTHPVCWLYWAIVSFPKEKLAANCSYALSNSGHGLLGCLALAYQITPFACQYWGIRAQCVCLSGWEGSSRLVEGVLGMEEMPYFLSRERCFFFNCSKWTCLLNSFLY

SEQ ID NO: 935469 - protein, 108 aa, Homo sapiens
ELCGYRMEGSPCPQNLMTFEGGSKCLISVPQSPRQVCPQIRLLPVGDLEPVWPSPTFHPPTEVRSAPCLPLPRRPNIYRNSYSAQLLCNPDPPGSQIFIPRHPRGQVS

SEQ ID NO: 935470 - protein, 112 aa, Homo sapiens
HEMVKKLHTATPPTFGVDLINEGREFWQVSKMVWSASPLSLSARLSLKTTASPWTSLLCTLMPHLLTLANDRVPNVRVLLAKTLRQTLLEKEYFLASASCHQEAVEQTIMAL

SEQ ID NO: 935471 - protein, 252 aa, Homo sapiens
MSDSHTNESEFLMGCTPLNLWDVFRNDGVPTPQVVVVTTNESPWPLGFKNRARPPRGRRYVSGVSREKWLSPRGPCGGRPKYFRGTPEGGNAQIGPTIPFYPGGATKLGLTHNARLRSQIIIPRRGGPQQGKEDKALACMSRIHRSISAQRVICDTFYGGTAPPQQSWVPNNTTPQQEMLGAPRPALAPNVSSTTPTAVPAGCPARVMRYNSPQGIYPPGPPSERCLDNTLGGKYMCSPSELHTEIVCVKLR

SEQ ID NO: 935472 - protein, 112 aa, Homo sapiens
NSKIHLPLLGAGTKGLHHTPELVNCLLILNLVLSALRKLKRLTGVVVAQVSSAVTSSKRMAWQWRLTNPKELCFLLAWNSLHRPDWPEESEICLLCLQRFPLVDVLIDRVCA

SEQ ID NO: 935473 - protein, 75 aa, Homo sapiens
SDGEIFEVDVEIAKQSVTIKTMLEDLGMDDEGDDDPVPLPNVNAAILKKVIQWCTHHKDDPPPPEDDENKEKPDR

SEQ ID NO: 935474 - protein, 40 aa, Homo sapiens
ANQSLPGSPHDISNSTGIKIHGQELVLKPKTCDDKVAALP

SEQ ID NO: 935475 - protein, 45 aa, Homo sapiens
GIRSFGESGSPAGPGLQRRFHRAQAAFSRPFLGGLRETWLGIGAP

SEQ ID NO: 935476 - protein, 126 aa, Homo sapiens
FINLSVLADILFMVQLNKMVMYFFPDCVPVYIYDSISYKSLNLLYPTYIVIKYVLPFAEAYSKSYSESKKEQKAIGNCYLKGSVLSFQTYFMSLGRLSCTYRHSNLFLPCQLLVHMCCVRNGTWMT

SEQ ID NO: 935477 - protein, 107 aa, Homo sapiens
PQSQKCNGKDNCGDGSDEASCDSVNVVSCTKYTYRCQNLLLSKGNPECDGKTDCSDGSDEKNCDCGLRSFTKQARVVGGTNADEGSGLGKVSLHALGQGTLCGASLI

SEQ ID NO: 935478 - protein, 116 aa, Homo sapiens
LEKKANPNLNTAVPLFDPLVPWPKAGVLLDLSRSSAASYDWYQAKQPAADYDADPRSGCEIQYANIYEYYKQHRYQTVIMGAFRKVEQILALAGCDRLTIAPNLLEQLKHQPVERN

SEQ ID NO: 935479 - protein, 70 aa, Homo sapiens
MLPFACHILGVKKNPSSPLYTTLGVITKGTVIEVNVSELGLVTQGGKVIWGKYAQVTNNPENDGCINAVL

SEQ ID NO: 935480 - protein, 41 aa, Homo sapiens
QREINLLAYHVACMGMVLFPTGSLLDLRFLSTFKPPAYEGC

SEQ ID NO: 935481 - protein, 30 aa, Homo sapiens
MSIWEPRIGLHETGRIVCLPFTFIWSPKYP

SEQ ID NO: 935482 - protein, 84 aa, Homo sapiens
AATICAGPSRDAEPRGHDLGRPRQCAPRMSWIKGTQVGDYFYSFGGCYWHASYLVAAARAILDKLVQSTLSDLRVYLGASTPDL

SEQ ID NO: 935483 - protein, 69 aa, Homo sapiens
KLKSFLPIEGALRNKLLSCHQKLQLVNGLQLHSHEMQNSHRKCHIKQSSGLIVFETRVLSDLGFISLVL

SEQ ID NO: 935484 - protein, 123 aa, Homo sapiens
LLYNTEDAYTVQLTDSTQIKMDILAQVLQIYLKSKLVLEDENANVDEVEKPDTLIKLYLGYKNKKLRVNINVPMKTEQKQEQETTHKNIEEDRKLLIQAAIVKIMMRVLKHQQFLVKSSSALL

SEQ ID NO: 935485 - protein, 144 aa, Homo sapiens
GLIHANPLRRRSVFKKPKKKNMAALPPDELKELMVAIAIASIKRTTRCLIEWQLHTMTRPAEAATTRWADIDIEKKVWTIPAERMKKRRIHIVPLTDQLALLLQQFKPYSGTPGSYVFPQTVNPWNPLATAKPTWELKRIGIWK

SEQ ID NO: 935486 - protein, 106 aa, Homo sapiens
QHFEFLDRYPLANLFGEQLHVVVEAKKTFTASQALFNVAQLRLLAWVQTVVTLHGQAVATQFVEAGNAPDVSTDVELFTQDDRFTDFTQDGAGAHQAARGRFLGVF

SEQ ID NO: 935487 - protein, 45 aa, Homo sapiens
RRFGRLLPLQASLSMDAPGSGIAPRGIFTSTRQEGDTPEQEGAEG

SEQ ID NO: 935488 - protein, 35 aa, Homo sapiens
MRKQRIVWQREAHKNIPARNVRLEKPERGVCRPGY

SEQ ID NO: 935489 - protein, 63 aa, Homo sapiens
STLQGEPRAPRHPRVLRSPGRGALLDEVARSTAAKAVPLLNFDLLAAPSVTREVEGEPAPRPN

SEQ ID NO: 935490 - protein, 40 aa, Homo sapiens
FLMKSYLQAQVSPGSIPQKPLPQSVMYLATPKTSQVPSPD

SEQ ID NO: 935491 - protein, 100 aa, Homo sapiens
GPRGTGSEYVRSDSAGVFRSLLEAAYKRLPTAGDGGVRHAGGGVHIEARYRQFPQLTRFPGVPERVLQRTHVVLDSLALFGMTQKRCWVTFRILIFPVDR

SEQ ID NO: 935492 - protein, 77 aa, Homo sapiens
HDMFTAYMEYTDPRKEIAMPVDTHPIRILSQRLSIAPFCEQDAVESFSCISPSLTRYMSWGALTKSAQVWGPVACLR

SEQ ID NO: 935493 - protein, 134 aa, Homo sapiens
KAAEEKKSLKRTFQQIQEEEDDDYPGSYSPQDPSAGPLLTEELIKALQDLENAASGDATVRQKIASLPQEVQDVSLLEKITDKEAAERLSKTVDEACLLLAEYNGRLAAELEDRRWLGCWWIHPEPERGFVKKK

SEQ ID NO: 935494 - protein, 109 aa, Homo sapiens
SNQASGDPPDEEQVQNFTSDPSALPEFSQLLRNQIETQVKPLSLPGISSIKDLQDLFHKTGQDVDGMLTYQELWNSLGSAMPRPESLRAFDSNGDGRYSFLELRLALGI

SEQ ID NO: 935495 - protein, 89 aa, Homo sapiens
GDLVEVRSTCSCDERRRLVWRLQGVPSLEPAQLFSFPLEPRWLTRYLSSFSVRPESFIRQSLTPKAPAHSVSLPGFLSLVPTPSFHFKS

SEQ ID NO: 935496 - protein, 133 aa, Homo sapiens
KPKGDDKDPSKNNSCQSSWAYWFVPIVGAILIGFLYRHFWADSKSSGGDLVEVRPAMRGGDLCGGCRVFPPWNLPVVFFPLGAKMVDQDIYPPSSVRPESFIRQSLTPKAPAHSVSLPGFLSLVPTPSFHFKS

SEQ ID NO: 935497 - protein, 100 aa, Homo sapiens
YQTTDKRVFNFHIKFCFADLFSPFSYHDYDMRVDDFLRRTQAVVSGRRSRPRERDRERDTAPEITEEIESETEVVIEKEREKEYVIRDRDPRGEKVVIRR

SEQ ID NO: 935498 - protein, 103 aa, Homo sapiens
KKLEEGEQFVKKIGGIFASNERWPWSKEATWVVDVKNGKGSVLPNSDKKADCTITMADSDLLALMTGKMNPQSAFFQGKLKIAGNMGLAMKLQNLQLQPGKAL

SEQ ID NO: 935499 - protein, 124 aa, Homo sapiens
PRVVPLQSRTRQPQGLPGVCFSATAVGLCVGLCLPFSLLSLSLTLCVLLSLCVCVCVCVCVSLDECALCVKKGCLLCGPVFGEPLSASLPGSCGQLSIVFAAVPLWVCAGLDNVRGCIGPGAME

SEQ ID NO: 935500 - protein, 95 aa, Homo sapiens
AILHKLDQLDASRRAPFCGQRGFKYEILVKKAGAAQVRGRGGVAGPPLLTGCAGLHPLGNESRRRRQNKGSFCKYCVKGSVCSLGMTSLSHSIVP

SEQ ID NO: 935501 - protein, 49 aa, Homo sapiens
MRPSETLVGLSGCPSGSARNGQRGSVFMDLAVLRDPEDKCHFQRPQCRV

SEQ ID NO: 935502 - protein, 97 aa, Homo sapiens
MAMLLRACELMMCDIIYAGEKAQFQAEILIGTIPGYGRHQVDSPVLLGSRWRWRSSPVTGSQPRDAKQAGLVSKILSFLRHWLEGSHPVLQKKFASF

SEQ ID NO: 935503 - protein, 98 aa, Homo sapiens
MDGSDVTQWTMPFSLYDGYTELSHPLKGTCTWVVLPEGILVPGSQGPPATLPIVMIGPDGTVLHGTAEQHLPVGRSEEQMMATHRTGSPNKLFSVVAH

SEQ ID NO: 935504 - protein, 43 aa, Homo sapiens
MAWWWAPVVPATREAEAGEWRELGKVELAVSQRTATALYPGRQ

SEQ ID NO: 935505 - protein, 114 aa, Homo sapiens
MRSRQRRPMPGHPTEGLSDYTPSCLTLHTNRLRQSHFSPSRGVKAHLATVMGIVGRGRERVRAPQSRGIRRMLGVYDALNHSKGCGLGIPGIFLSHLGSLPTHPSPKLGHDSLV

SEQ ID NO: 935506 - protein, 125 aa, Homo sapiens
EPLLSPFRFLAASLGKFTGHWRMCTATGLLLWRCHLGDSQFWRWVDFGVTAAAVIFLKRFNHTATIRKVEGNFNPFASPQKNRQSDENNLNRTLGVPSSTRSAKIHGLLFLSKASKIRIDCHRAL

SEQ ID NO: 935507 - protein, 80 aa, Homo sapiens
DPPGLQEFGTSKTHSLPSLAKTPTREYRFFTIDEPYIDTSLAGCWSHACNPQHFGRLRWVDTSGQEFETSLSNMAKPRLY

SEQ ID NO: 935508 - protein, 123 aa, Homo sapiens
SFVTRALLDSQFSYQHAIEESVVLIYDPIKTAQGSLSLKEYRLTPKLMEVCKEKDFSPCSIEKGKHQPFEHMFEEVPIVIKNSHLINVLMWELEKKSAVADKHELLSLASSNHLGKSLQLLMD

SEQ ID NO: 935509 - protein, 128 aa, Homo sapiens
GNVPMKVSPIDCKNPAIATTGNCKHGNWKPCSPPWPTGYKVHTGMQQLDFCWYPQPPPKAESTPARWPVPEVSEHRSCCHRPKEALCLAPPIRGLWLMDQELDPLMQQVPNLTGPDNKAGVLVPTPQT

SEQ ID NO: 935510 - protein, 88 aa, Homo sapiens
NTSKQQQQKHQYQQRRQQENMQATESEASPPLPEEDLSKLFKPHQAPARMDSLLIAGQINTYCQNIKEFTAQNLGKLFMAQALQEYNN

SEQ ID NO: 935511 - protein, 31 aa, Homo sapiens
KITVLHFTKDVKLLNQMRNFLVRASSLRLEP

SEQ ID NO: 935512 - protein, 127 aa, Homo sapiens
SSSELGMIFNERDQELRDLGYQKHAFNMLISNRLGYHRDVPDTRNAECRRKSYPTDLPTASIVICFYNEAFSALLRTVHSVVDRTPAHLLHEIILVDDKQLTFDDLKGELDEYIQRYLPAKVKVIRK

SEQ ID NO: 935513 - protein, 148 aa, Homo sapiens
EIDEDRIPNSLLKSTLSMSPRQRKKMTRTTPTMKELQTMVEHHLGQQKQGEEPEGATESTGNQESCPPGIPDTGSASRPDTPGTAQKSAESNPKTQEQCGVEPRTEDSSAHIATTGIPREPSFGSDRSWYPGDSPLQCGKFMDTGMFL

SEQ ID NO: 935514 - protein, 124 aa, Homo sapiens
EGYRFEKLRLQYRSDSFENPVLQSREPGSLGSDGSEQAVDLDIAPRLKQLNKRLGSLVDEFKELVYPPDYNLEGKSYQGGKHGLMEGSWEAKRPQGGEFFQEGGSLKDPTSSQGVRLGQFSLAP

SEQ ID NO: 935515 - protein, 111 aa, Homo sapiens
MSSSLEAVRRKIRSLQEHVAQERAGCSATDQERNWGNEADVASLNRRIQLVEEELDRAQERLATALQKLEEPEADESERGMKVIENSPKKMNEKMEIQEIQLKEAKHIAED

SEQ ID NO: 935516 - protein, 34 aa, Homo sapiens
QCANTSGEPAALCGSVTTGVVGLGEDLGATPRSK

SEQ ID NO: 935517 - protein, 98 aa, Homo sapiens
LYQPNCFAYPPHGAKPIYSPILNTSLYYPLLCSGSQTCFLYCSLAPLIPASLRFHLGLTLTSIKLSKLPRAVLPAKVSQDRPPISGQGPFFPSVYLWG

SEQ ID NO: 935518 - protein, 124 aa, Homo sapiens
APGTKSWREPHQHTIQALQELDSLRADNIKLFEKIKFLQSYPGRGIGSDDTELRYSSQYEERLEPSPPFSKRERQRKYLGLSPWDKATLGIGRLILFQQDPRTISFFYLFLHCLGLSGAVAGME

SEQ ID NO: 935519 - protein, 102 aa, Homo sapiens
SDRRASGGAVVVMSDKDPPESPVVTGVASTLKDENCEPVEKPEDKSQPVVSTRKRPETKPSSDLEASALPAQETASKDVPQTGWGYWGSWGKVSALLSLKLR

SEQ ID NO: 935520 - protein, 102 aa, Homo sapiens
HVTTRGHLFFQHFLQQETQIAGGGQGNDLIIAGDFCQRLIGTLIGTINAYGDAHQAWILLWQCKSSGETFNSCLGFASLQALNRGNLTGKEDFFLNMFRGFS

SEQ ID NO: 935521 - protein, 76 aa, Homo sapiens
SISQLVAAAATTDPATAITLNLGSDYCALHSQRLKSLVPAIENAQGITSLLTFPKTMERQLSPEFEEDRITACSRC

SEQ ID NO: 935522 - protein, 103 aa, Homo sapiens
MCYVKCARYIGYSLVWAAVFCIVANALLYFPNGETKYATEDHLSRFVWYFAGIVGGGCMLLPAFVFIGMDEEDCCGCCGYENYGKRCSMLSSVLAALIGIGSC

SEQ ID NO: 935523 - protein, 103 aa, Homo sapiens
EALEETRGFWRKKDPVPLFKVYVEELVQRLQEQVLSRPAVVQKEPVTTPEHWAQPPLWAVGEPHLACAEHTVPVVDFSENPSVPGPRGSLERSRCLSKLVKSF

SEQ ID NO: 935524 - protein, 168 aa, Homo sapiens
LIFLVMAPLVTVVSSPRARLFACFLRLGTQQAGPLQLHTGACCTRTTMRCVLGGGAGGITMATRMKRRVGAENVAIVEPSERHFYQPIWTLVGAGAKELSLSVRSTLSVIPSGVQWIQDRVAELNPDENCIPHRQWQGDLLQIPYHRSLESSWTMKKKGLPEGFAYPK

SEQ ID NO: 935525 - protein, 43 aa, Homo sapiens
QIQRQRDTREPTKTYTVGCEECTDPVTFPSGGAVLRCFPVYPP

SEQ ID NO: 935526 - protein, 30 aa, Homo sapiens
AEVQNAVTTLPVKAKYASTASQPRRPVATP

SEQ ID NO: 935527 - protein, 80 aa, Homo sapiens
MASNVTNKTDPRSMNSRVFIGNLNTLVVKKSDVEAIFSKYGKIVGCSVHKGFALAKYVNERNARAAVAGEDGRMIAGQVL

SEQ ID NO: 935528 - protein, 99 aa, Homo sapiens
MYGSSFDLDYDFQRDYYDRMYSYPARVPPPPPIARAVVPSKRQRVSGNTSRRGKSGFNSKSGQRGSSSKSGKLKGDDLQAIKKELTQIKQKVDSLLESL

SEQ ID NO: 935529 - protein, 142 aa, Homo sapiens
DHGGRVVPVAARRARIDVVLQTLEGREHPLESVGVERCHVAVSVDLEEQFRAADVGEDGVEGDLLLPRLPAQRTAGALKLVQRGKELIDRPGLLGDAAFWKAAFEYQNQPIAMDVDRDGVVSGPLTLTVLRIGAGSSLSQPP

SEQ ID NO: 935530 - protein, 103 aa, Homo sapiens
IYVSQDPKDQLLLGPTYATPKVLEKAGLTMNYIDAFEFHEAFSGQILANFKAMDSDWFAQNYMGRKTKVGSPPLEKFNIWGGSLSLGHPFGATCAGHGSCQQD

SEQ ID NO: 935531 - protein, 102 aa, Homo sapiens
WDSSMLSVTAQAKVYERCEFARTLKRNGMAGYYGVSPGPTWVCLAQHESNYNTPSLQTYNPWRPKHLTMGYFRSIARYWCNDGKTPRAVNACGINCSALLQD

SEQ ID NO: 935532 - protein, 119 aa, Homo sapiens
GEQRRLLVLIAHDVDPIELVVFLPALCRKMGVPYCIIKGKARLGHLVHRKTCTTVAFTQVNSEDKGALAKLVEAIRTNYNDRYDEIRRHWGGNVLGPKSVARIAKLEKAKAKELATKLG

SEQ ID NO: 935533 - protein, 104 aa, Homo sapiens
LCWVAEKESQLETKPVGSNCCLLPSSLAGKALVLPGPSSSWGSNPPPITAGLVALHAGLLLSHPVASLWAFPHCTSLFPCLPPQGLPILAGPLSFLHSPQALPT

SEQ ID NO: 935534 - protein, 93 aa, Homo sapiens
ARIHRFLAQPECEFVRHCIQKSQERVEGKVQVSVFKGQVYILGRESPLSLYNEELVSMNVQGDYEPIDATGFININSLRLKEYHRLQSKVTAK

SEQ ID NO: 935535 - protein, 94 aa, Homo sapiens
FGVVRWIVFPGIHCKVPVLSSVLRAWCVEGDGFSFLVRLWQFLEVDESGHTASAHVPCLTACSAVLKVYIGDVTIAALEIMKLILNIALLDMPF

SEQ ID NO: 935536 - protein, 65 aa, Homo sapiens
TGQSMSQVLNDPRGTPPDTPQLPLLGPWQLEVPFYVLVSFPRCLELLFYNVCSMNLSQYAMTLHN

SEQ ID NO: 935537 - protein, 127 aa, Homo sapiens
SSLPFPGTKRLVSGWIPWRSGNGEGRGRKLSSPGIPGAGHFAYPLQPRTPCWLLKDSHWNSDPVQLLPPAILSGWQALGVPGTLLQLGVLNSPFPFTSRPSFAFPIAGFASCFQPCWAKSPFFFPKA

SEQ ID NO: 935538 - protein, 32 aa, Homo sapiens
MAPSGMGLEAHFTRTGSGGGTWFNQPARKIRR

SEQ ID NO: 935539 - protein, 104 aa, Homo sapiens
WNAMEWNPSRNAMEWNGMEWNGINPECNGMEWNGMEWNGTTRMEWNVMESKGVEENQSECNGMEWNGMELNGMEWNAWNGINPSSTEWRGLEWNGIETTRMEWN

SEQ ID NO: 935540 - protein, 113 aa, Homo sapiens
WITAANQTSPSDHCFEHLKADTTYELPSVSALVSALHTDWCQPRKEDLQNKKHRFLVNLVKWMPGITDEEWLCLFTKFTAAREECSEVQEPESCFSPESSKTGDESQATEKQR

SEQ ID NO: 935541 - protein, 136 aa, Homo sapiens
KGATVTGHELNSHRSPHGLQTGRCPFAASPAVSGLKSHSPPAPHPTSTSAVCSLTLGPWRFPEPTAACHCPGDLEHSSAPAHSVPQQPGPGRACLGQPSPHSTDPSLCRAAGHTEMDVNHSLAQARAILEGIQGAG

SEQ ID NO: 935542 - protein, 116 aa, Homo sapiens
MYLDQSQGKTSEHHRMQAVQQTNEVQGASIQDVMPSVLSVHQSPPSSPHRLTTNKSLNLIRPVFLLLLLFPPLKHSSRGQRTPVHISSLPSLCRSLPRTGSAHRSLLAGLKGLYVC

SEQ ID NO: 935543 - protein, 132 aa, Homo sapiens
QSISRVSLLFFFKFSQNRRIHLFPGGKLVMPALPTPQVSVAGLCPAQVLLVLPSRVGRGLPPPNRPWPTSRSQGIPCLDAVPSDNTQPRNTSPSILQKYGAGQATLWTPPWPSLESQSRAQHLPASNLRVPG

SEQ ID NO: 935544 - protein, 129 aa, Homo sapiens
GVEEPDVCTVLPKAAVIGLTKSVAADFIQQGIRCNCVCPGTVDTPSLQERIQARDNPKEALKTFLNRQKTGRFASAEEVALLCVYLASDESAYVTGNPVIIDGAGACDREDPCWEDRPFLATEQSKLPG

SEQ ID NO: 935545 - protein, 124 aa, Homo sapiens
RATALQPWATERDSVSDKNQKTIKHRGAPRLHHGVSAATWAMGGTGQFPSAAQNRPTIVHSVCIQRLRILKCPLEEDGASASAPGRCPGGEDVPHHVAMARQCDWAPRSGCCMLGMAGDGARVG

SEQ ID NO: 935546 - protein, 137 aa, Homo sapiens
DARSPRPPRPALHARAAARPQRTMASGSMATSEEERSLRECELYVQKHNIQALLKDSIVQLCTTRPERPMGFLREYFERLEKEEARQIQCLQKTGIRTDSREDEISPPPPNSSGEGADGAEGAISAEVYTEGRIAAS

SEQ ID NO: 935547 - protein, 51 aa, Homo sapiens
MASSLVLLHWTACWLAESRAVTKVLPYPGIRSALTDSGWGWQQASSIGLNL

SEQ ID NO: 935548 - protein, 141 aa, Homo sapiens
LFIIIASEQFSSNHVKLSKIIQSMGKRFYIVWTKLDRDLSTSVLSEVRLLQNIQENIRENLQKEKVKYPPVFLVSSLDPLLYDFPKLRDTLHKDLSNIRCCEPLKTLYGTYEKIVGDKVAVWKQRIATSPVKNSLGVDDDN

SEQ ID NO: 935549 - protein, 140 aa, Homo sapiens
SSNVDKSLQESLQKTIYKLEEQLHNEMQLKDEMEQKCRTSNLKLDKIMKELDEEGNQRRNLESAVSQIEKEKMLLQHRINEYRKVEQENEKRRNIENEVSTLKDQFEDLPESKSDLTSLPNEKADHSYRSWKKRMFFGTE

SEQ ID NO: 935550 - protein, 140 aa, Homo sapiens
NWTHWASSVHFHHTVYFGNKPKACKEANCSCKKEEDQNHYHSITEVQDCTCCPRDLQFGEEVVYGVYQEVNSCEAAGKEGTPLPMVILCTEVKVAKKYSCFGTGNNQNDKHQKQETKHVIHLVGPNAIQNEEKLYKDAAK

SEQ ID NO: 935551 - protein, 144 aa, Homo sapiens
MSSISQLESLTELRERKNFREFQVTSRQGLLTSCKLYWKLSEETEGSDSEMIGDLQARITSLQEEVKHLKHNLERVEGERKEAQDMLNHSEKEKNNLEIDLNYKLKSIQQRLEQEVNEHKVTKARLTDKHQSIEEAKSVAMCEM

SEQ ID NO: 935552 - protein, 156 aa, Homo sapiens
RAESLLGVLGRSWKLTATFSNSQHAVGVGRPVSGAYAGPDEDDVVCGRRAPRFRDRFLACGLASRARAAPERRASSAESCGPPGRAHKNTCLLGTNVSCFHTQVDKPENGKADLYWKPGPNDIWCEMFLLFYKCCQPLKYFPVTSHNNINVLELPF

SEQ ID NO: 935553 - protein, 68 aa, Homo sapiens
RAIVASAVSWRHLCRALWSHELASPGFPTPGSPALPSCPPCLLPAQSPRHLCASHQPEQDALSGLVPH

SEQ ID NO: 935554 - protein, 55 aa, Homo sapiens
MYTLDHLTIHLHYTRNLILLRTLSLHLTCYEAKNTVAAWNTADCSRPYHAVQGLF

SEQ ID NO: 935555 - protein, 118 aa, Homo sapiens
DEKQRDKVSSKNSLESYAFNMKATVEDEKLQGKINDEDKQDFDKCNEIISWLDKNQTAEKEEFEHQQKELEKVCNPIITKLYQSAGGMPGGMPGGFPGGRSSPIWLVASSGPTIEEVD

SEQ ID NO: 935556 - protein, 123 aa, Homo sapiens
QRYLPAKVKVIRNMKREGLIRGRMIGAAHATGEVLVFLDSHCEVNVMWLQPLLAIILEDPHTVVCPVIDIISADTRYSSSPVVRGGFNWGLHFKWDLVPVSELGSLTAHGPNKVTYNGWRLVC

SEQ ID NO: 935557 - protein, 73 aa, Homo sapiens
PRCLKSSPTCLTTAGVREKADVLNPVITAVFLEASNSASYIQDAFQLLLPVLQISLIESKTESSTCEPQSRDL

SEQ ID NO: 935558 - protein, 36 aa, Homo sapiens
LPFGAEVVAKFLHKHDLDLICRAHQVVEDGYEFFAR

SEQ ID NO: 935559 - protein, 131 aa, Homo sapiens
RFTTLQSPSKGMWGGEGLILGYRYANNDKLSKRVKKVWKPQLFTREYEILDKKFTVTVTMRTLDLIDEAYGFDFYILKTPKEDLGSKFGMDLKRGMLLEACSPGPPLHPEEPLEPESKPIYDKYRSFCHPP

SEQ ID NO: 935560 - protein, 119 aa, Homo sapiens
IPTLFPQRTSQNLASSHTYDNFHSNSVLLQPVSLHTATAAAAANQRLPPLPSSHPVLKDGDLQPPNYYEVMEFDPLAPTTEAVYEEIDGYHQKEAQSHSDLLRYTKGQLSKRNTLIQQA

SEQ ID NO: 935561 - protein, 78 aa, Homo sapiens
FRTMVNVLGDAFGTGIVEKLSKKELEQMDVSSEVNIVNPFALEPTTLDNEDSDTKKSYVNGFAVDKSDTISFTQTSQF

SEQ ID NO: 935562 - protein, 30 aa, Homo sapiens
MLSEAVLPSMWPNVFRKAADDTWGANLPLG

SEQ ID NO: 935563 - protein, 66 aa, Homo sapiens
FFVGLSKWTNHRGAEIVADTFRDFAVSTVPVSGSSHLRGLCGMGGPRTVVAGARLPKSSQGNGSAD

SEQ ID NO: 935564 - protein, 67 aa, Homo sapiens
PGEEERRAGFNFLMFCLHSLPPPGVPASPRSAAAVALSPRRRVMEADSGLSAAAGAEALAGEERMSL

SEQ ID NO: 935565 - protein, 29 aa, Homo sapiens
IGVGNPSMTNICNIQYMQATSYCLPNYLR

SEQ ID NO: 935566 - protein, 94 aa, Homo sapiens
GKPNKQKGIAHPRQRPHPKSPTSNTEGRHIHKDGEKPAAKRPENSKSQNACCPPKDHSSLPAREQTWMENEFDELTEVGFRRWVITNSSKLKEH

SEQ ID NO: 935567 - protein, 79 aa, Homo sapiens
AYRIFKEHQIINVIGVQRILNALLIIIQNESCFRCHMAAPKTFPAHQKLTPPLSSVVNEPISTRIPCCRQINRQLPLIP

SEQ ID NO: 935568 - protein, 38 aa, Homo sapiens
KLQSLGASLINFRLYDEAFICGPAAMMDEETALKALGM

SEQ ID NO: 935569 - protein, 99 aa, Homo sapiens
RKTGPNTFRTLAPIPQIFGHPMPGSPGRRLPTVAILPVNLKFVPQPIYQDGQSVDKIGRLRVFIQVAEVGSFIRASQILMMPKTTSAAIQQLEHEMGAR

SEQ ID NO: 935570 - protein, 93 aa, Homo sapiens
FLRRHWFGTDEVGRDLFSRVLVGSQQSILAGLVVAIAGMIGSLLGCLSGVLGGRADAIIMRIMDIMLSDSFVGTDNGNCCRSRAEFVTMLAIA

SEQ ID NO: 935571 - protein, 123 aa, Homo sapiens
DQVRILEAKTFHVIRINSLRDPQPMIDSDGAVMPPLVLIADEPTTALMSLFSAQILQLIKVLQKEMSMGVIFITHDMGVVAEIADRVLVMYQGEAVETGTVNRFFMHRNILTPVRCELLFRNL

SEQ ID NO: 935572 - protein, 101 aa, Homo sapiens
PPNFTPGKVPVLVCANSGAVQTLQADHCPFGVFAQPQFHGLPAGPQRIVNRLPGQGLQFAQLGLQGARAQLQQRLPVLWQDVEGGAYLLLLDGQADQLVEG

SEQ ID NO: 935573 - protein, 148 aa, Homo sapiens
LWPRVLLFGDSITQFSFQQGGWGSLLADRLVRKCDVLNRGFSGYNTRWAKIILPRLIRKGPGMENPVAVTIFFGANDSSLKDENPKQHVPLDEYKRQNLRDMVQYLRSVDVPRERVILITPPPLLRTAWEKECVLKGCKLNRLNSVVG

SEQ ID NO: 935574 - protein, 119 aa, Homo sapiens
GPVLPAEPAEAANIIFASTGARAVTAQQPTAMGTMTVKMLAGNEFQVPEQLHVGVRAEQITQKIGVHHSSSVWLSTRAVWRCRTGSPCQPGLGPASTVLLVVDKCDDLLNILVRNNKGP

SEQ ID NO: 935575 - protein, 146 aa, Homo sapiens
DLRAMEERYRRYVDKARTVIQTLEPKQRPPTVVSPEFHTEVTALGAEPCGYGSMEMDYEKSRRGEQEEKLLISAWYSMGMAWSIGLGKSTLLPMPSPSWHNKDWPPMLAVDPWGPGSEPPPHLTSTDKTSTSCCLLGVFQFTFTQL

SEQ ID NO: 935576 - protein, 137 aa, Homo sapiens
VTTGAIFRCHLQDIFLPAHITRFHIQRRLAGAFSIASGGTTFARIECGQAATSGLHWVQSSSFQMGISSAILRFSQRVVPSARCRLNAERGGRHQARRASKPVTVFTKSGAASETTGGRLALLEFTGCNGTSSTDSR

SEQ ID NO: 935577 - protein, 162 aa, Homo sapiens
TIFLREYQDPTGPSASYNTQPYLNVQREKWDPSPRYVGGQEHFAHLLILRDTTYMLAFDVNDEKNWGLSVYADKPETTKEQLEFYELSTFRIPKSDSCNPIGKNCAPLEKQHEKERKQEEGNPSRTQPWIRTETLGHPLQPDMCTSAFPSLASIKLLCFEQL

SEQ ID NO: 935578 - protein, 66 aa, Homo sapiens
MTKGLMVEDVAFLLPEDLINWIEIPTPNLDSLKDHRGRKLHKEAYISGKRTGVLTKELKKVTYWFY

SEQ ID NO: 935579 - protein, 108 aa, Homo sapiens
MRVSSACGRASHHTMPDWPHCPHLHLLGTDEQGLQASLPQWLIWHGPRTSVPGFQAIHCYYSRYALEDLDSATPGLFYLFSLSSVVFSFAVKNLVCSPPTPACLLVLA

SEQ ID NO: 935580 - protein, 128 aa, Homo sapiens
GEESPTQKGQVGAWLLTPQVPHRAPSVAPACLPWLLFEGEKCKICTEKASPACLVSPGSRAAMGTQEKQEPFPKSPEIPGAKKSPRNLRGPKPRPCCLPQMHVMASPFPKLNISMRPQGLFRCMNLFI

SEQ ID NO: 935581 - protein, 76 aa, Homo sapiens
CERRLVKLRTPNMDLVTYDDVHVNFTQEEWALLDASQKSLYKGVMVETYRNLTAIGYSWEEHTIEDHFQTSRSHGR

SEQ ID NO: 935582 - protein, 66 aa, Homo sapiens
ARPCQEANCGLPVVLLLLLQSAQGVYIKYHGFQVQLESVKKLNELEEKEMSNPQPSEKWPPPCCVP

SEQ ID NO: 935583 - protein, 36 aa, Homo sapiens
HQGCGGANSDPLAKGPFADPPQRLCAALPLLSTIVF

SEQ ID NO: 935584 - protein, 72 aa, Homo sapiens
MSEEEAKEGVKTENDHINEWPGKTASVVQVKDKEATPLEQDEGLLREAGLVNEADQIQVRRAAINETDTPAL

SEQ ID NO: 935585 - protein, 70 aa, Homo sapiens
WKVGQERQMTHVKQIRGARPKRRSGPKAKFGTSSNNLVRCLTKLPYDNTSVRKFPNYRTYNPELWSSVEY

SEQ ID NO: 935586 - protein, 56 aa, Homo sapiens
MGQGLLSFLQPKYSPAPEPSIPPGAGINKSFPKILRYLLSEQHPQLFPTGPGSHAA

SEQ ID NO: 935587 - protein, 100 aa, Homo sapiens
TPKLWIIGTIFPYLAYQPWVSSWRLAGQPWYRCRTVALETGMQNTQLCSTIVQLSFSPEDLNLVFTFPLIYTVFQLVFAAVILGIYVTYRKCYGKNDAEF

SEQ ID NO: 935588 - protein, 114 aa, Homo sapiens
DRTGASVDLAICTAQAVMDNSSVCPPNATVCEGDSCVVPESNFNAILNTVMSTVLTILLAMVMFSMGCNVEVHKFLGHIKRPWGIFVGFLCQFGIMPLHKAFILSVASSFLYRL

SEQ ID NO: 935589 - protein, 55 aa, Homo sapiens
CTWTDPLPASAPGDVEWGGLAAEMPSLRGPIPDVTFELREGETKAVKLVAPPGPR

SEQ ID NO: 935590 - protein, 87 aa, Homo sapiens
SSFAMRKLQRLNSCETKSSTSSSQKTTPDASESCPAPLTTWRQKREQSPSQHDPASHPSEGTAHADGEAQGHRGMKKKMEALSARQP

SEQ ID NO: 935591 - protein, 84 aa, Homo sapiens
CCSCRTGCGTRGNLVWAMRMYCTTTSSQCPVAEFHQLSQIGVVAFQVVPKFGVRLEMVLAQLCCGFATSIVYLTWFRLTKHSFQ

SEQ ID NO: 935592 - protein, 38 aa, Homo sapiens
RGGSDMDRGEQGHAEDRAGEEGEDAVTMLSAPALTEEE

SEQ ID NO: 935593 - protein, 138 aa, Homo sapiens
NVTTCTTGFLQLEPLRVYVFGLCRRIHYGPTGRQSYCPDSLPLKGLDGHPALAFAREGAKVIATDINESKLQELESYRGIQTRVLDVTKKRQIDQFASEIQRIDVLFNVAGFVHHGTILDCEEKDWDFSMNLNVRSMF

SEQ ID NO: 935594 - protein, 111 aa, Homo sapiens
MKWMFKEDHSLEQQMKSAKIRAYPDRPVIVEKVSGSQIVDIDKRKYFGPLDITVAQFMWIIRKRIQLPSEKAIFPVCGQDSHSPAYLWDSFTRRKKDEDGFLYVAYSGENT

SEQ ID NO: 935595 - protein, 111 aa, Homo sapiens
MEPVQFEDGQKIVVQGEPGDEFFIILEGTAAVLQRRSENEEFVEVGRLGPSDYFGEIALLMNRPRAATVVARGPLKCVKLDRPRFERVLGPCSDILKRNIQQYNSFVSLSV

SEQ ID NO: 935596 - protein, 28 aa, Homo sapiens
MPGMCLISICLSEFASAPKTRAVKHVLP

SEQ ID NO: 935597 - protein, 98 aa, Homo sapiens
MTLFTLCECRLNDSFKPVNSGYMIPYICNYLIVNSKVTTDEFEKMITEGSNTASAEIDRVIDAGKCAGLSTMKIKPYRLPLKRVLPDIAAGSDVIHAQ

SEQ ID NO: 935598 - protein, 105 aa, Homo sapiens
HDGGGVCMGQMEPDQVYEGITFEDFLKIWQGIDIETKMHVRFLNMETMALPLTHRHLRGETALCNGSASRVLEQPRRTLLQGYIKARLTLCLVGYGMWDFAVFIS

SEQ ID NO: 935599 - protein, 114 aa, Homo sapiens
RIASTGGAALIADYGHDGTKTDTLRGFYGHQLHDVFNRSLEQQTLQPDVDFSYPAQNGTRKSSLSGVQWNSETFLKNMGIDVRLKFSLDKKVPSCGQAYFGRGMDMVNGIQKDW

SEQ ID NO: 935600 - protein, 118 aa, Homo sapiens
TWVKHPRWVTRHLIQEHFYWHQVGAPQGQRSQRKEWGPIFAVLQHPLVTSSGVGGTQIKGLEVNPQQTTAALQKRYLTVERKTESNNNINQKVPTENLILKVSSLQRFKLRTNSLEDE

SEQ ID NO: 935601 - protein, 128 aa, Homo sapiens
MSVICNCWVCGLLQPTLGTLTRKKVRIEKESRVLGAEEEGRAVYQTVRGESVWGLVSCIRRQRDKATELGAQNQVAAVTGAVPLKKEDPRLLWTEFARLTRCPFLLLHPRTQHSVTPTTPDSDSSPSH

SEQ ID NO: 935602 - protein, 68 aa, Homo sapiens
CNPCLITYPIPGNDDSPQAIQLFCKLFRTTINRAKEKRRQMEALHRLQSPKGSEGSGTSPVPDKSHSP

SEQ ID NO: 935603 - protein, 64 aa, Homo sapiens
VSEASGAVTTARPGAAEPSPDGTTGHTYNQYTQRYNQRTNTNVNCPIECFMPLDVQADRDDSRE

SEQ ID NO: 935604 - protein, 75 aa, Homo sapiens
SPCPLTLHPCPFFLPFLTEEGLRNTLERLQAGHGQLSPGCSFSLLAHVGAQQLPARRFFLCPPAPGVASTHSFQQ

SEQ ID NO: 935605 - protein, 166 aa, Homo sapiens
PFHGRRIFLGPKAKGFLADKAASQGIHGCLRRNRNAPERCCWSPFPLRLSWRNFQLGPETLLQDNPKLIYARLSGFGQSGIFSKVAGHDINYLALSGVLSKIGRSGENPYPPLNLLADFGGGGLMCTLGIVLALFELHTLCRGQVIDSSMVEGTAYLSSFLWKTQP

SEQ ID NO: 935606 - protein, 133 aa, Homo sapiens
PSPRLANGAAWRQGCGAWQGPGRFCGMVLADFGAEVVRVNRLGSTGENLARSASLAVDEALSGSHGVAAHVHRRVAGFRCGVMEKLQLGPETLLQDNPKLIYAKAEGFGQSGIFSKVAGHDINYLALSGVLSK

SEQ ID NO: 935607 - protein, 72 aa, Homo sapiens
KDPHNRQRRAQAEAAKDVTPTGKAGDSGTGNSFFSFSFSFSFWRQSSRSVAQAGVQWQPINGSLPLTLPRLR

SEQ ID NO: 935608 - protein, 110 aa, Homo sapiens
NFAPLEREMPVQFQVVELPSGHHLCKVRALNKGDANSEVTVYYQSGTRSLREYTLMELLVMHMEEPCFDFLRTKQTLGYHVYPTCRNTSGILIFCNCWDSGNQIQPETCL

SEQ ID NO: 935609 - protein, 61 aa, Homo sapiens
FTKRCSEAFVREPSKHSVGELQMMAECSKYHGQLTKEAAMGQGFDRHLFAPTVSGRQKGVN

SEQ ID NO: 935610 - protein, 42 aa, Homo sapiens
LFSDCPVSGKQGGKARAKAKSRSSRAGIQFPVGRVHRLLNGN

SEQ ID NO: 935611 - protein, 86 aa, Homo sapiens
QPNWKPVIAKVPQASWSSLHPESSLPVNLPGRQSWYSSLCVSTKSHQNGTLLTPAVRYGKHLRRQPVQFLVPCSVWLCNPLGPYDL

SEQ ID NO: 935612 - protein, 108 aa, Homo sapiens
FGGGMKQEDNAIIEISLKLANIYAAQNKQEFALAGYEFCISTLEGKIEREKELAEDIMSEETANTYLLLGMCLDSCARYLLFSKQLSQAQRDVLKKALQDLSRNSKGE

SEQ ID NO: 935613 - protein, 138 aa, Homo sapiens
WCSVSRLLGRSATGPYVEWRHGKRAQLACGRLSPSSSRSRGGSHMLNVYLKSHHGEHERPEFIAYPISASGPSVSWGDGNHTLFITSCESLPTGYEDEEENLDHYRAPGTTALVWTVTLHMQKKYIGLSSLLVSNDAG

SEQ ID NO: 935614 - protein, 67 aa, Homo sapiens
PSDVRRPLYKNIVLSGGSTMFRDFGRRLQRDLKRTVDARLKLSEELSGGRLKPKPIDVQVITHHMQR

SEQ ID NO: 935615 - protein, 78 aa, Homo sapiens
GNEKQYGYENTKRKIVVGLLKKDVGAQPYWLKTCNLSTLEAEMGGLLELMSSRSAWADTVRPVKNSRVQAILLPQPPE

SEQ ID NO: 935616 - protein, 104 aa, Homo sapiens
AKPKPPRRSVRFGPLFLPPVSTSPFPRMSTLKSLKAIPGPQRVKKDDEEEDPLDQLISALAVCLHFAVQEYMPNTRTGGNPTTRCRLQGFHYHTGERQRTSRGG

SEQ ID NO: 935617 - protein, 150 aa, Homo sapiens
LNMLNISPFSFGLVTKVFDNGSIYNPEVLDITEETLHSRLEGVRNVASVCLQIGYPTVASVPHSIINGYKRVLALSVETDYTFPLAEKVNLLADPSPLCCCPLCHHSCSLCSPAKVEAKKSRRSRTRIWDLLTNHQKATNLASFICKTRK

SEQ ID NO: 935618 - protein, 63 aa, Homo sapiens
AGEGGWAGQASRSPLAIAFCPQGENCTYKAVHNTAVLFLTERPCFASGAPTLKRLQELECCLP

SEQ ID NO: 935619 - protein, 80 aa, Homo sapiens
DDLRKEISKTMFAEMEIIGQFTGFTKLNEDIFIVDQHATDEKYNFEMLQQHTVSQCQRLIAPQTLNLTAVNEAVLIKNLE

SEQ ID NO: 935620 - protein, 55 aa, Homo sapiens
PIPRLPLSLVSFETEHSYLCTVTWSAGKGIQVELYSFPRDPEIEMSGGLVNWSSV

SEQ ID NO: 935621 - protein, 83 aa, Homo sapiens
IRHEALQDPRCRAGVGRHAPEILIRSECGLAAVGYSKADIPATSERERCPQERGHQALHPGPSQKGGLAFLFFKASIETCINW

SEQ ID NO: 935622 - protein, 67 aa, Homo sapiens
QTPSRDHQPDVRSYTITGLQPGTDYRIYLHMSWGPEKGGIQGVTLMKAPVFDDGKTIPRWEPRCKRE

SEQ ID NO: 935623 - protein, 102 aa, Homo sapiens
LSTRLPGPTFLPLFVSVSYFLFSVSCLHLARNTRCGRQAPFNTKKIYMGLDFFSLGKKIIIWPGANGAAVPALWEEAGGLELRSSRPVWTNMAKPRYLQSKK

SEQ ID NO: 935624 - protein, 60 aa, Homo sapiens
VTTGVRQSSGSLPQSPELKVPKWWDTVKLAKHKGLLLRETGSTRDCSTAGPYLRVGLGLG

SEQ ID NO: 935625 - protein, 33 aa, Homo sapiens
EWLCRSRFDNRYALCSMADQLITEQIADLQEVF

SEQ ID NO: 935626 - protein, 37 aa, Homo sapiens
MGLTTHHIHNTTPSFTREYHPHVHTPIRHSPPIPQPP

SEQ ID NO: 935627 - protein, 52 aa, Homo sapiens
RVDMISWPLTFSDDNATMQSPVCRGQFSQAFWKQGFRGGLHHLTEHSLMSPA

SEQ ID NO: 935628 - protein, 37 aa, Homo sapiens
AGNRNSLNYPARHDPSPNRPPSYDPLHTDEVNDPSLP

SEQ ID NO: 935629 - protein, 52 aa, Homo sapiens
PGELSSQGCVTSTEDKTESSRRPSKLFDRTSNGQGSLFKASLGLVQGPGKNP

SEQ ID NO: 935630 - protein, 69 aa, Homo sapiens
VSVAGRPLLSDVAARAMLSPSESFIVALGYKSKIFKSRELEESRRWPTSAGTSPATGLCVCCRAYYLKE

SEQ ID NO: 935631 - protein, 70 aa, Homo sapiens
KRSGDTCVSQIAGLCPVLQLDVTPVHSSTEHQPKKYALSQSYQHFRTRTSIKSVHLRPPISPDTDTACRS

SEQ ID NO: 935632 - protein, 42 aa, Homo sapiens
MAHEISYGSFGRSLLSTTLLFRQDRGRATGLEACRRNFGRMA

SEQ ID NO: 935633 - protein, 36 aa, Homo sapiens
RRVVYAECKRRFRLCSKDDRVETDKNQPVQRTPTHI

SEQ ID NO: 935634 - protein, 68 aa, Homo sapiens
VTHVRHMACGGPLRGIYAYGFENHQQSSNEQSRQDHQRGEMSSHSLSPGTGKTATFSISVPPVFGIFR

SEQ ID NO: 935635 - protein, 45 aa, Homo sapiens
SYTATMPFGNTHTTFRLITAQEEYPALSNHNHPHGQGPYPWTSTG

SEQ ID NO: 935636 - protein, 82 aa, Homo sapiens
NYTAVSSQDEIWDILKYQILWRITTITSVVFNICLLSLPVDVVVMYESALTDQIELFTSIRVDACKAAILDLVFLNRGDWSL

SEQ ID NO: 935637 - protein, 46 aa, Homo sapiens
EYFQESKLDPEPDELPENSIRAHPLFSKMVEILWKRRQTHPSPVNP

SEQ ID NO: 935638 - protein, 34 aa, Homo sapiens
KPQGDGGPFETQIWLKSDCHIKRIPCVQTLLQSL

SEQ ID NO: 935639 - protein, 38 aa, Homo sapiens
MASRPRHESLSERALINHPDRNSDQSKVKKEEKKFKEV

SEQ ID NO: 935640 - protein, 71 aa, Homo sapiens
LRHQGFCSPTWSTYGEIEDTHQKGFVLKKEADVKTTPSLTLHADYEEDKGVLATKRAGHITAVDPTRNSRP

SEQ ID NO: 935641 - protein, 30 aa, Homo sapiens
MSLPQGQPRNCLLQSTHNECQLIQEAAYQH

SEQ ID NO: 935642 - protein, 59 aa, Homo sapiens
MSRTGGTEEKPRCIFGNRRTCAGKGEVERAFRYYWPLDLYGFEKPPGFPFVDSRSRDAE

SEQ ID NO: 935643 - protein, 37 aa, Homo sapiens
EAMSSKDTRATPRYEAVREGPHGTQRKPCKFPGDGGS

SEQ ID NO: 935644 - protein, 75 aa, Homo sapiens
RHRDRERDRTTQIGVSLEANVILMDLHLLTFIRTKGRSVPTLPSSKPLTSVPDNQGITLDPTGLRLLRSPIHTLF

SEQ ID NO: 935645 - protein, 63 aa, Homo sapiens
QKPPVEQKGQEDVKPEKEAKMTDFDRFKVMKAKKMRTDYQDEVKSFKGSSPEASPKSTWYSGY

SEQ ID NO: 935646 - protein, 72 aa, Homo sapiens
IKPVQPVMKVAVKMLKPTARSSEKQALMSELKVMTHLGPQFEHVNLLGACTKSGPFTSSQGIASMKVGNYLH

SEQ ID NO: 935647 - protein, 87 aa, Homo sapiens
MLLMGTSQKNKLLFPFRELFDHGCDSLSTVFMAVELPIAVAEELILLVFFPLLLFGMFGVLLRSMADLCFRHVEIWKVDVTEIQIAL

SEQ ID NO: 935648 - protein, 58 aa, Homo sapiens
NTEPILSTAITIYWVSIYLLQASEYFGSPFTISDGIYGFTIFVATAFPRTSRHYWLTF

SEQ ID NO: 935649 - protein, 110 aa, Homo sapiens
RRRAYNGSVRKAVRLRFQGICEARRSIHHEQSSPSELKNLWTGGIIEIKCGRHVHGYCGDLILMTFDNECVRWRLVDTDNIGWWYTRNSIIMLEPWTSINNGCSAENHVL

SEQ ID NO: 935650 - protein, 64 aa, Homo sapiens
ATDIAIQAGGDHEALRGSSINIYAKDTNQASRYRVRHGEGPYMSPMEPRNLHFSKVLATSQDGE

SEQ ID NO: 935651 - protein, 99 aa, Homo sapiens
LRTREHASRKGSPSSLSEEERRNTRERLVQSPNFLIHGCEMPRMLEITTVFSHAQTVVLCVGCSTVLASLQEESRLTEDVPQRSSIKHFSQMSGTINNH

SEQ ID NO: 935652 - protein, 46 aa, Homo sapiens
RCRGIFYSETWNFIPGQTFRALDTQTPCDDLPGFNLFSYLWNQIWT

SEQ ID NO: 935653 - protein, 53 aa, Homo sapiens
TDFSAYEFSLMQGKGLYDKEETRHLRGGQWRLGSPWTSFIFFWGGEVPEKGGK

SEQ ID NO: 935654 - protein, 84 aa, Homo sapiens
GNSSTMDLTLFAAEAIALTASYLSTENELAEEPEALADGLCSMKLSLLQSPGPETLGQAGRVKTGAANSTLNAPYTYRPSRRIS

SEQ ID NO: 935655 - protein, 50 aa, Homo sapiens
GKHSAQPRGPSGESLSDQSPVRGQEFPKVLAHLLSVCSSEPLDMRQPDVP

SEQ ID NO: 935656 - protein, 98 aa, Homo sapiens
TKHLKRACSTEALDAGQTNGCICTSSIARSHKLRVMSSTDRFLGQLKYALTGDEVKKICIQRFIKIDAKVELISIPLFMDVISIERQVTFRMDLPRPV

SEQ ID NO: 935657 - protein, 43 aa, Homo sapiens
EIASLCRRFIDTTLAITSRFARCTEEASRPSPEDDKRQRTVTK

SEQ ID NO: 935658 - protein, 61 aa, Homo sapiens
GNVLAGYPIKLPKSQTPMGPFPQRRPKATIHKPCGAKVQMWKMLEGTPWAGSLIALPPGPR

SEQ ID NO: 935659 - protein, 276 aa, Homo sapiens
MPYSPPLFPGKTGATWNSNYFLKIIQLLDYYPKFFIFGSDNLGSKQMQQILIFLRGNSFFLMGKNTIIRKAIRGHLENNPALEKLLPHILGNFGFFFTKEDLTEIRDIFLANNFPSSSLSFSISPFYFTLPAQNTGLGPEKTSFFQALGITTKISMGTIYILIYVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTSHLLKSQGLLG

SEQ ID NO: 935660 - protein, 31 aa, Homo sapiens
GDHQLIQEALVFDNKHTNYTMEHIRLGWDLL

SEQ ID NO: 935661 - protein, 70 aa, Homo sapiens
VTRTLPIHVFRRYIKDPTALYLLGFYLSNTRKEKARLTLRLHERRTLPQFSKMEEEYIQQLFQDISTEAR

SEQ ID NO: 935662 - protein, 78 aa, Homo sapiens
SGEAEYIEKVVYTVKQSPEDVKKTLDGELDEKYKPRNFNSKKPEESADARRKAEMLQNEGKTFLAQANSKLPPLKGLD

SEQ ID NO: 935663 - protein, 33 aa, Homo sapiens
LLKVIILGDSGVGKTSFMNQLCLIRIQQSVAKP

SEQ ID NO: 935664 - protein, 84 aa, Homo sapiens
NKRQPFWQKGIQIQNAELQRMEQEAERRSSHNEAEPESEVEEKKAERRKRETMEEEEEQSKALSETTLRPSALSICFLCQCIAT

SEQ ID NO: 935665 - protein, 110 aa, Homo sapiens
GYSGKTPISTENIKVSQVWWCTSVIPATQEDEVGGGGGFSELRLCHCTPAWATRVRSCLKKKKKTKKERERSNYHSHPSLQQPRPWVSSHSTSRQPPLGKKILYKASVIC

SEQ ID NO: 935666 - protein, 44 aa, Homo sapiens
GALSVNKKAQALAYSVALWCVLMRTKIFYSVTKQGARTAKELMS

SEQ ID NO: 935667 - protein, 107 aa, Homo sapiens
MAICTDSGCTTTNFDAIGGGSSYINSECIRANLAKAPEAVSIIAIGFNGTVCSEIDNRVFLYVYPHGAVALNIQIVRSVAVKRAPLGVIAVETTDINTCTSIGRDFT

SEQ ID NO: 935668 - protein, 54 aa, Homo sapiens
YLKQLCSSVSSKHKEVSPGGGQLQLWRHGPPPQTHLMHTANPLPQERALGRSPR

SEQ ID NO: 935669 - protein, 59 aa, Homo sapiens
RKVMAVVRRLSGQDVGSFAYLTIKDRIPQILTKVLIHCIDIKVNFFETTGEEGVELKRK

SEQ ID NO: 935670 - protein, 38 aa, Homo sapiens
MTVDIPDHVDITLKGRQLSCRAHDDPRRDVITSVRLSL

SEQ ID NO: 935671 - protein, 68 aa, Homo sapiens
VHKNVARSLLMERDALKPQLAPDRAAHPKQLPSTSCSEQPASTLQNLSGGVLRQSHRVRVRRRPEHVC

SEQ ID NO: 935672 - protein, 32 aa, Homo sapiens
EVLRSWGCLGIHHSLFGDVKKLITDEFKQKYL

SEQ ID NO: 935673 - protein, 42 aa, Homo sapiens
RIGTKAAAVLPQFLAHLTMFPWSKRTNRSSSEHSAHMAATPE

SEQ ID NO: 935674 - protein, 60 aa, Homo sapiens
RAYHQKIDSNLDELSIGLGSSSGHSPGDADRIEEQNDILTADTKWQVDVTIKAQKKVDTL

SEQ ID NO: 935675 - protein, 53 aa, Homo sapiens
VGKTSALRKAAKREPRRKWLFHFTKKDWYDVKEATMFNIRHIGKTLVNRIHGP

SEQ ID NO: 935676 - protein, 127 aa, Homo sapiens
WDPKLLGPREEAWFWPQESSQKKFPFSYCVLKTPGILSPCSLPALESQFLRTSGSLLQNGGPCLPPKDLLRPNVPTAPQHLVSFNNKFLPDHRSRLCRMEYGRAPGQPSSMGRNSLTSPLNPPPFSA

SEQ ID NO: 935677 - protein, 34 aa, Homo sapiens
MAFKDTGKTPVEPEWQFTEFESPNKAARKFLEKV

SEQ ID NO: 935678 - protein, 72 aa, Homo sapiens
ACLSLPKCWDYRHEHHARPGMGHFSWYCSIHQRGLQQTLEGQSLRPERHRAASRWVWAAQDNGEGQRGLPCP

SEQ ID NO: 935679 - protein, 43 aa, Homo sapiens
SRGGLRAAPCTNSVARASGKSFPPEMLGEIKNQPDQLLTRYRQ

SEQ ID NO: 935680 - protein, 66 aa, Homo sapiens
QAKSCLFCKLGACRRGPAANSDLSGPHAVTRQSSQYSVNNGITACHRQHSKDLHSSEVSYMSPEHG

SEQ ID NO: 935681 - protein, 62 aa, Homo sapiens
TTASTPSSCMAFPETFAKGTVESIMRDKMPKKGGRWWFSWRGRNTTIKEESKEQLAGKAHST

SEQ ID NO: 935682 - protein, 85 aa, Homo sapiens
KEEKESEDKPEFEDVGSDEERKRRMVQEEEEEIRESTSIRGAHKQAIWTRIRRYTMRSTRSYRATMTGRSLALAFSVEDSGFRAF

SEQ ID NO: 935683 - protein, 80 aa, Homo sapiens
LPTRCQVSSRVYPASARLHPAPVPPVWPTGAHTPLTITLKHLRVRRGEEDSQPEEKKNPDELETDCPRIGQKMTSHIISE

SEQ ID NO: 935684 - protein, 54 aa, Homo sapiens
MPPLKAPGEGTQSTVITGVDIVMTITFRKQVSQKSLQESSRFHESFKGTLRQDR

SEQ ID NO: 935685 - protein, 66 aa, Homo sapiens
KKEASPLPKLKPKLKALKAKKAVLKGVHSHKKRRIRTSPTFRRPRTIRFRRQPKYPRKSASTANHA

SEQ ID NO: 935686 - protein, 117 aa, Homo sapiens
IAHRKGWLSLHTGNLDGEDHAAEQPVEDVFLRKFMWGTFPGCLADQLVLKRRGNQLEICAVVLRQLSPQSTTSRGSVNFAVYFTMSVRLTQLCLSVYSTLTSLFHQLSSNERGRLYW

SEQ ID NO: 935687 - protein, 64 aa, Homo sapiens
TGCGVCCYSRASQLPPKDDKKEEGQVGKSAKKDKDPVNESGGKAKKEEVVEGKVRDKLILSFVC

SEQ ID NO: 935688 - protein, 46 aa, Homo sapiens
CTFGIDEDFMRSFEFLPGWSLSRMRFCRYVMFRSRPVPASAPGAKA

SEQ ID NO: 935689 - protein, 45 aa, Homo sapiens
DNHLMGPIQDTSEYIIFMSSCWALMMDPYSSGVLDFYQCHSDRLP

SEQ ID NO: 935690 - protein, 67 aa, Homo sapiens
RNKAVGEKVVRDAFPEAIIVKPSDIFGGEDRFLNLLQYASVWSYTLGPWLETVNTSICVMIKNCNAV

SEQ ID NO: 935691 - protein, 47 aa, Homo sapiens
GIKNPVNKGTTTVDGAGFGIYRPAEFSKEDASIKAFPKRMMLAYRSA

SEQ ID NO: 935692 - protein, 64 aa, Homo sapiens
KRRRKLLPLLKLEAKAKAFKETKKAVLKVSTATQEEASDVDHLPRRDIDSAQPNISEASREQLT

SEQ ID NO: 935693 - protein, 52 aa, Homo sapiens
TNREAVEVTFADFRWGPLSIFQILMETNKSDGQYFFEFYKDFKHMSDELLKR

SEQ ID NO: 935694 - protein, 55 aa, Homo sapiens
LDNTLLMKTLQQTYDDSAPTRGLRHFMGRQKSRGQHTNDHLAAVAAPTGHPRESS

SEQ ID NO: 935695 - protein, 36 aa, Homo sapiens
TRGTGEFTFTHFVQMRAKNLIFNKSFFLQSFQGRSS

SEQ ID NO: 935696 - protein, 70 aa, Homo sapiens
MPPYTVVYYPVRGTLRRRIAAGRSGPELEGGGVTVETWQEDSLKASCLYGQLTKIQDGDLTLYQYNTSAY

SEQ ID NO: 935697 - protein, 55 aa, Homo sapiens
EKGRLGAQGPPGAPGPLWIAWDHCSTGSCRTTRHARSRGSLPSGVRVKWNQSYVS

SEQ ID NO: 935698 - protein, 38 aa, Homo sapiens
KTFGCVIDRNDSLTADPRYRGHALRQPTLKYRYGYLDS

SEQ ID NO: 935699 - protein, 63 aa, Homo sapiens
ALHDISEVDSTDEEQATRLERKIMLAAKKGLDPYTVLPQGSFRHQEGPNLVPSISTRRLVGCI

SEQ ID NO: 935700 - protein, 41 aa, Homo sapiens
TGRLDLDQIVFKMAKLGRRRKNVEPVKRPSTMAEENPVNGR

SEQ ID NO: 935701 - protein, 106 aa, Homo sapiens
SAISVARTLLVFEVKKPFLFVLWDQQHKSLSSWGEYMTPGPETCRIRLGERYLSLSSVPAAACLDLPLPPPASGVRYPPKGLLRVWEGPASISPSSLHQTTFCSFL

SEQ ID NO: 935702 - protein, 60 aa, Homo sapiens
ARKEAPAPPKAEAKARLLKARRQCGKVSTATKGGDPTRTTFRAEQLDSDSPISGDRSRRQ

SEQ ID NO: 935703 - protein, 38 aa, Homo sapiens
MLHRFKPCVQSLTTAVMPMYDRRLESTLLKIIHLLIDI

SEQ ID NO: 935704 - protein, 80 aa, Homo sapiens
MLRIPVRQALVGFLSLLKDVFEQLPQQQATCIRVFVDGQSLMAGTGTTFSKLVRRIGMQIPRFCYHEGCLVAGTAGRSLM

SEQ ID NO: 935705 - protein, 66 aa, Homo sapiens
QDLTRQLILKYVPLSGRVPFNHESGAYLCLSPVSGQTSSRQIFMINQRRGLMPTSHHQNVNTITSL

SEQ ID NO: 935706 - protein, 28 aa, Homo sapiens
DGLALSVALQPLNRERPVIVLYYLMAAM

SEQ ID NO: 935707 - protein, 100 aa, Homo sapiens
MGLEDEQKMLTESGDPEEEEEEEEELVDPLTTVREHASSWRMCKGPERKSSVMSVYLSITYREDCTQQLFDSCIEHMRATSLYTEYMCDLFTHLIIWHQI

SEQ ID NO: 935708 - protein, 38 aa, Homo sapiens
DLTFPIAFCRTYNVRASESARDRQHTEWLHILLSISTV

SEQ ID NO: 935709 - protein, 74 aa, Homo sapiens
KLGPLIPKRTPSSSLPNDTSDEIMTFSVSTKTVLVLSCLENVPNRKSLRRTLKSGLGDDLVQALGLSKGPGLEV

SEQ ID NO: 935710 - protein, 44 aa, Homo sapiens
MPSKGPLQSVQVFGRKKTATVGRTTNAAMVSSRYTGAPRDDDAA

SEQ ID NO: 935711 - protein, 44 aa, Homo sapiens
MPTSSQSPRDAELIAEAKLTASTQGRLGPGSIRRTTINSWDHNY

SEQ ID NO: 935712 - protein, 102 aa, Homo sapiens
QAIARAGTKRTSTQTPGEVRLVLNNISTLLQVWPPHSLLSSIPNKHLKPNLDSSVLKFVLWESPGYNSTAQLLNFANPLCRKWHLIVLIFISLLPNNEHLLI

SEQ ID NO: 935713 - protein, 93 aa, Homo sapiens
MVFRRFVEVGRVLCLLWTSCRKLVAIVDVIDQNRALVDGLALKLRRQAMLSSACSSLISSQFRTVPPEYVDSCRADIIQMAATDGQSLAERKP

SEQ ID NO: 935714 - protein, 127 aa, Homo sapiens
ADKACEPGVTMCTRPDWSRLAANTLRVHHAIEQTIKSARMRCRLDSSARYQPIKCREAERRTLPHVGSSDFWERSPTSAHHRDTWVSTGRENPRRRDQKQSPRALPRAWLSLCPTATPPPTPDKAPP

SEQ ID NO: 935715 - protein, 48 aa, Homo sapiens
ITHLNNNFIFRQKLNLSFSKQTAIMPGQAYGWKTGHCRYKDFSKFRNN

SEQ ID NO: 935716 - protein, 36 aa, Homo sapiens
GPFERSRPYSRCFPRIASRGRPRPALELSPLVYNHV

SEQ ID NO: 935717 - protein, 45 aa, Homo sapiens
AEMLCKPATVLITRATWVTVTPVPDERDLFNSGIGSWARDDPDKL

SEQ ID NO: 935718 - protein, 37 aa, Homo sapiens
MELVQGPKTRAAADHRARRVFRGYLRVFFRQIMQGWY

SEQ ID NO: 935719 - protein, 52 aa, Homo sapiens
ISMTITWDNLKGKKSCQRIWQNRWLEHPHGLLYNKINHRFDEFFSEGCAPWK

SEQ ID NO: 935720 - protein, 65 aa, Homo sapiens
KYFQIGTIFDNPADFYHYTNSQEAKKKIYCGGPLCLILNSEDTPEEGTQRSWLKAAIQQEKVRRG

SEQ ID NO: 935721 - protein, 69 aa, Homo sapiens
AHQGFPTSFPAPLKAQAGLESSGPGCSVLKEFASALAGTCESHLTGRAPPGRARRLLSLPRQLAQTTFF

SEQ ID NO: 935722 - protein, 69 aa, Homo sapiens
HRKHFFLGKVESVVRSRSAPTDNKEIVHCCEEQVLTLATEQTYAVEGEDTINRLSCCSLAGSCDQMAVS

SEQ ID NO: 935723 - protein, 110 aa, Homo sapiens
AHAVLEDFAGNLASRVRPRDLPLLRVPAFRRPAWRRWKVSTEREFGLGDFLVKIKSDGIRGLYQGFSVVQGIIIYRAAYFGVYDYGQGMLPDPKNTHIVVSWMIAQTVTA

SEQ ID NO: 935724 - protein, 66 aa, Homo sapiens
PTGPPGTVRHIRGGQVPAEMACRREQGTVVSVQRTGLALPAMNRLAMLDLFVWFLVFEVGFTVLPG

SEQ ID NO: 935725 - protein, 52 aa, Homo sapiens
RLRAPESPRNPQRDPLKLEIMLKLNPYQKTMRRTPFFARPGIKSSGWIRQLL

SEQ ID NO: 935726 - protein, 67 aa, Homo sapiens
PTPHCTHSNRNGIPNAYRTKNSQAIYNYAKAQRCRPYGYYNLLLTHKLFTKSPKTAHLHDLYITARP

SEQ ID NO: 935727 - protein, 74 aa, Homo sapiens
FVRAEDFWSERFLLPDLSVRSRQRNKSVRKPARNNMAFKDTGKTPVEPEWTINRIRITLRRERKILERCVLIDK

SEQ ID NO: 935728 - protein, 85 aa, Homo sapiens
FMDRSSNQPHSLSQRLIQSKALSLCNSMKAERGEEVLEEKLKASRGWFMSLWKDVVSIAEKHKVKQQMLMEKLQQVIQKINLDNG

SEQ ID NO: 935729 - protein, 39 aa, Homo sapiens
YRPPFTKRNAMTVLLISRTRQKYILSTPVAKALAVSKRK

SEQ ID NO: 935730 - protein, 33 aa, Homo sapiens
HIPRHTHHLSKKATIRDNPIYTSEVFSSQDFLS

SEQ ID NO: 935731 - protein, 35 aa, Homo sapiens
VTRDEESTRKEEVTREEMAAVGLTVTVTHSNRSTT

SEQ ID NO: 935732 - protein, 42 aa, Homo sapiens
RLPEVRGGDDFFVPIPKSGMFIVSYSPLFLVDNLHNRQLEVY

SEQ ID NO: 935733 - protein, 40 aa, Homo sapiens
GLSAGKIALAIAGLSGFAVVSAGEFFETTGATLRKLPEQP

SEQ ID NO: 935734 - protein, 32 aa, Homo sapiens
MNKPYPKSRFCRGVPIATITNFDLGGKGKSGR

SEQ ID NO: 935735 - protein, 32 aa, Homo sapiens
MLLRIPENTLAEWHSPIRITYKPHVNLGKCVC

SEQ ID NO: 935736 - protein, 29 aa, Homo sapiens
KWYTLTLTIKGHFASLLNDKSLWTDIPVN

SEQ ID NO: 935737 - protein, 44 aa, Homo sapiens
MKSGIHTLDIKIPRGPPPSRRRYGDVYCRAPKGGYYKTALGPGR

SEQ ID NO: 935738 - protein, 103 aa, Homo sapiens
CKQHSGPRRDGSSDVRSLRTTLANMVKPCLLKIQNISPAWWCTPIIPTTQEEAEAGESLEPGRAQVAVSQDPLHSNLGDRARLPSQKKTKKPLKHKYGWKSFI

SEQ ID NO: 935739 - protein, 54 aa, Homo sapiens
GVGGLCSNGQESRLENLRGKEQEELLKQLDALKEQLSHLPFRQSYKRSAQALKS

SEQ ID NO: 935740 - protein, 68 aa, Homo sapiens
ETICSGDITAPLLDLDYDLQRNYYDEDIQLPSTCTSSYYYCIETVVPYNNVSVVSGNTYTKGKSRLQF

SEQ ID NO: 935741 - protein, 51 aa, Homo sapiens
FDSASQLMEPGRQSMDLVELVSLFPTLAGLAGLRFTGCPSSFTLSCTERQD

SEQ ID NO: 935742 - protein, 38 aa, Homo sapiens
ACGSPQKLIDGFLKHEGPPAEKPLEGTLCFYFRRSRAF

SEQ ID NO: 935743 - protein, 33 aa, Homo sapiens
ALCPLMSQHIHLKVIEQRPEPPVAQEYDVPVLQ

SEQ ID NO: 935744 - protein, 52 aa, Homo sapiens
GYLSSQVSTTRAHNRDRKHIIHNACSPIYYSHRYLHDRRLGTGYSLNPKVNP

SEQ ID NO: 935745 - protein, 40 aa, Homo sapiens
KGELDFHQLANSFREYRPAASKGIKRSLLLPVLWRLQSLN

SEQ ID NO: 935746 - protein, 46 aa, Homo sapiens
MFKMSDKILLCVLERLETLYSFAEYIQKTSTFIDANELFSSTAAAN

SEQ ID NO: 935747 - protein, 66 aa, Homo sapiens
MSKRGRGGSSGGEFRISLVFGRSLVINCADNTRGQKPYIISVKGIKGLAEQNFPLLVLDTCDATVK

SEQ ID NO: 935748 - protein, 82 aa, Homo sapiens
EKKKEVPAVPETLKKSEGISQRLKDQAPQKGSFAQKMLRKARRSLSIKAKHYHRNMADVQTSNRCRMARKAGHSMLPPHPNW

SEQ ID NO: 935749 - protein, 69 aa, Homo sapiens
AKPTSPKSQVTLTKEFPVSILDLNNREKRRRIGVYGDGFLEEKISEETQVMIMFQQAILPSEPVDISTA

SEQ ID NO: 935750 - protein, 62 aa, Homo sapiens
MRRLLQETELVSAAPQRTLPNQAQVRFLKSGAMKEGADLRFARLKASDPMGDVNTVPQCVWK

SEQ ID NO: 935751 - protein, 39 aa, Homo sapiens
MESQTFVKVTLTSEEEAPFKKSPDTLWGDPKGRCNFKGL

SEQ ID NO: 935752 - protein, 34 aa, Homo sapiens
ANRCPMLSPELAAFIGIHGSRYSVIVAALGLDRR

SEQ ID NO: 935753 - protein, 49 aa, Homo sapiens
QDNRFSNKQKETTEAAEICRMPRKKVDMSKVNLEVIKPSDNKRVTEILG

SEQ ID NO: 935754 - protein, 34 aa, Homo sapiens
SYPDTPYTIPHHPTEELIETRSVARSRSSQSHES

SEQ ID NO: 935755 - protein, 35 aa, Homo sapiens
DIVFKPCVAILDGSAVMAQGGQGGPGSPTYFLKII

SEQ ID NO: 935756 - protein, 36 aa, Homo sapiens
QHSLRGIHERPSSVPGEAEAGSFAGRKGADQEEDEA

SEQ ID NO: 935757 - protein, 69 aa, Homo sapiens
LFAKACNVNIGASSAMWGRWTCSSSLVLNQQGGSSPFICLLASAEEKKVEAKKGGFQEFYDDMGFGLFD

SEQ ID NO: 935758 - protein, 49 aa, Homo sapiens
MAVSLTAAETLALQGHRGQERYYYGPKGEDTLLSITPRLPGDHSTTKGS

SEQ ID NO: 935759 - protein, 46 aa, Homo sapiens
KTFTSVYWNTSSNYQKTTGKDLGQTMSISDTRREDDQATRALLSEQ

SEQ ID NO: 935760 - protein, 62 aa, Homo sapiens
PGESRPDVKPVFPGNSRHAKNNLSFPVEMFNPPPVELERPLNTIISVEPQKGHTLYSAPQPF

SEQ ID NO: 935761 - protein, 73 aa, Homo sapiens
RSLQDPGRLSHRRWNRACLLTKISLVDLPPACTPQFRALWHPGSSCLEWELPRWEPPLLPPHTTHTSNKAPKY

SEQ ID NO: 935762 - protein, 68 aa, Homo sapiens
RDFGLRAGRGDWRRCRACFRWRVLGWWDSRPKKHHDFGAQFLDELIGPGPNLSPDEKHRTSVGHESFE

SEQ ID NO: 935763 - protein, 88 aa, Homo sapiens
QTQAQVGGGCGHHSCVNVGQGPVRGTRSCQSWMTELMPSGREHHNLRAVCQAKEEYLLENCKMMIMLGAIFAIIVVVIVSSIAEVAGG

SEQ ID NO: 935764 - protein, 106 aa, Homo sapiens
SKIDDIWNLEVKENFAGEALQRMIILWEHSTKNHLQLEASFSPTENIQGKPPLSMMSALVQAMKSAQSSMISLPCQKCPLTLRTRRSDGKMKSGLGFPDHAEPYAI

SEQ ID NO: 935765 - protein, 86 aa, Homo sapiens
SQLAVTCGGPRDDGLQLKVTGWRTPAPRSPAAALLLTSLFEVLDAFLWVFGAIFKILYGSFCGFRHFLTHVHFDVVVITKSTLLLV

SEQ ID NO: 935766 - protein, 61 aa, Homo sapiens
ERPEDLNLPIAVITRIIKEALPDGVNISKEARSAIFCAASFFVLYVTSCAKTLQLKESGEV

SEQ ID NO: 935767 - protein, 138 aa, Homo sapiens
PRSRHCTLAWATQQDFRLQKKKICLRLIFIQVPTCFQLWGWGVGWEGNDLHTVLPDEESGLALFSLPFLSCHWLSALLHAPACCFSHSQFLPIPFTSLYSLPRSVLGVLLFLFSISGSCLCLSVSVSPQVSLFLGFCD

SEQ ID NO: 935768 - protein, 35 aa, Homo sapiens
MSYQGKKNIPVACPPTLRMASIPQPLILPLTNGNA

SEQ ID NO: 935769 - protein, 101 aa, Homo sapiens
QSPHRPEALCLYPVQEEFPHQGELYSAWQNPHRRDTLSVRPVWKSFTQRGSLAVHQRTLHRGSPLTTFLRESLMIRVHISEMSTYQSMDDEIFRSHIGRQL

SEQ ID NO: 935770 - protein, 42 aa, Homo sapiens
MIDTIMNQDILAILQAQVRFGGDQVLLAVSTKVVHSTATADD

SEQ ID NO: 935771 - protein, 62 aa, Homo sapiens
GVEGSDPSVLVLLPDSPTNSSSGRTAGRFPRGSGSYPSRSSWGDMMRQRRASISSSGARRGA

SEQ ID NO: 935772 - protein, 56 aa, Homo sapiens
MAVDGGFGDTGDWEGLLDPCKEFLERSGPTHTLISTRALISPVLVEHVSLVIDLRL

SEQ ID NO: 935773 - protein, 118 aa, Homo sapiens
NGTSQNSLFGQEGAGKNQKALNLLGAPMLVDCVPLVEVDDMMIMEEADPKCVFTYVCSTTPRTLARMSSLPARMASGNCRPHSPGTVSCLSSAHRCPVCCTLPPDTRSVLINYWFSTK

SEQ ID NO: 935774 - protein, 35 aa, Homo sapiens
LCPHTPHCELVLLCTAISSLLEDCRLLVKAEVAET

SEQ ID NO: 935775 - protein, 95 aa, Homo sapiens
SKSPRRPLNSLSIKTSSGGVGYSATHSQPSPTPSNESTDTASIGSAFNSPLARLIRSANPTRPSSPVTFHISKVLFGEDDSLLRVDCIYNRAVRD

SEQ ID NO: 935776 - protein, 144 aa, Homo sapiens
VNLGSNARILTSYSYALPRHVRWKVLSAQVCPKSREGHGGAATGAFSVEHCAYFPELFAAEAVTADSEVLEERQKRLPYVPEPYPESGWGPPGACLAKMNSREFQRTFANYLVKTGSLQQGIHLGWGVLGGITSFLFHVKTTIH

SEQ ID NO: 935777 - protein, 74 aa, Homo sapiens
HEELLRADLCRDKFSKCGVMASSGLANPWQPPVPGAVELLGCAGILSPGPLGSWASGLPDLVFFPIPCPLFWKR

SEQ ID NO: 935778 - protein, 35 aa, Homo sapiens
SFDPFPDASKGNDLFPLALRVLSPYRLTQKPHRGP

SEQ ID NO: 935779 - protein, 60 aa, Homo sapiens
IHGKETCEWVAEEQWTRESDMRTERFGQGGAGLWVDKGLEEWGLELQQDMVEEKSTKAQT

SEQ ID NO: 935780 - protein, 58 aa, Homo sapiens
MVDGNPVNLGLWIQLDKKVITDSPPILSANRCVLNLLSLVVLPYLKCRQSVLGADPVT

SEQ ID NO: 935781 - protein, 34 aa, Homo sapiens
VGNLCAMRAKLRKKRIQGLKRKRREIRQSSKYTV

SEQ ID NO: 935782 - protein, 133 aa, Homo sapiens
GYADEPQSEMAPAVVSLRPSSASWLGWLQVTGVHTPFHLVIHNESTCEQLAKGNGKAKEPTITASIQGKTFPVDEKALQDQLVLVAAKLDTEDKLRAAMVGMLANFLGFRIYGMHSELWGVVHGAVLFPTAVF

SEQ ID NO: 935783 - protein, 34 aa, Homo sapiens
TEPGLGPDPKTIIDVVGAPLTPNSRRRSASSSSS

SEQ ID NO: 935784 - protein, 85 aa, Homo sapiens
ALDRSTTAYLVVAANDGPAQTREHSLLARQFGVGHVVVYVNKLTLSRISRDVWNCVELEIRELLTEFGYKGGGDPSHRRLFSLSP

SEQ ID NO: 935785 - protein, 39 aa, Homo sapiens
SVRACKDPEKGMWGLVNNDGISTSGMVEFNILENYMHVA

SEQ ID NO: 935786 - protein, 101 aa, Homo sapiens
WSDPTVLSMPGQIPRSCRVRRQWQPMRAPEEVTGAQAGVSGVISARYNHHLLQPALAFQSAEIAASAQPPPRLGSEERLCLAAHRLGCEEPLRPAAAPSEK

SEQ ID NO: 935787 - protein, 69 aa, Homo sapiens
WACVPPRDLGQLDPEGHLWNLLRALASHLPLGGWATWCFPGGTGPLSGACGRRDLGVWEVGGTGPPNYE

SEQ ID NO: 935788 - protein, 115 aa, Homo sapiens
AAAAMVAQLQKRLAFRCPPPFARRRVWLDPNETNYIANSNLPLQIRRLIKDGLIIRKPVTAPFPGLDAGKTPWPAGGQAHGIGSRGLQPMPYTESTWMRDEICAAAERYRNLEVV

SEQ ID NO: 935789 - protein, 56 aa, Homo sapiens
NPCEGGRCESAPSCLSAPAPRVARPMPERWLVQGVGSFCSCLPGAGPRCARDVDEL

SEQ ID NO: 935790 - protein, 49 aa, Homo sapiens
AVDTGVHNYRRCRVLLTLLYKIAKRPRQGKHQPMNPSSPTQQSSVFVSP

SEQ ID NO: 935791 - protein, 55 aa, Homo sapiens
NDSTCSSLSILGPVTCLLLTQPGTLQPPMVSSDFPPLACFLNNILVAFNDLRLCC

SEQ ID NO: 935792 - protein, 67 aa, Homo sapiens
EEQTRKALELDQNENEQKKEAERLEKERRAAEEAKSAIAKQAADQMRIQEQLAAELAEFTAKIALLE

SEQ ID NO: 935793 - protein, 68 aa, Homo sapiens
KESTMRRASWMSFGIIVTRLASKAYLVGLFEDTNLCAIHANVKLSKAIQLARRNVESVLKDSTFDGKH

SEQ ID NO: 935794 - protein, 44 aa, Homo sapiens
LPYGQVITIGNERFLLCLRHSSSPPSFGIESACIMNTYNSSHDV

SEQ ID NO: 935795 - protein, 71 aa, Homo sapiens
SADAPMFVMGVNMRRYDNSLKDHQAMALHHHLLRTPGPRVSLTTFGIREGYCPQALHYCQPGGLDGPSGKL

SEQ ID NO: 935796 - protein, 87 aa, Homo sapiens
ESIVTMWPTSSLSKGELQRHFIMQQHFCFKNKALEVAKSHARCKGHPIFASSWSFQLLNSQELLILPLEKLLRQTGYIHRGSDEGCT

SEQ ID NO: 935797 - protein, 41 aa, Homo sapiens
QRGGRTMTRSYCKRREPAGGFVKDSWQAFLKKVTEAERSNH

SEQ ID NO: 935798 - protein, 56 aa, Homo sapiens
DVGPVCFYNQLYLNPTKNLTHMCPLVLIWSPVQVTHNFQLLFQMFGNQLFGQGNGN

SEQ ID NO: 935799 - protein, 37 aa, Homo sapiens
MPSKRTLQSVQVSDEEDSDTLAHCKRGNGLIKVTGPA

SEQ ID NO: 935800 - protein, 54 aa, Homo sapiens
RGRRVRLFRRLRRRRRRMAYVASYLWLPWGTSSPAPGHKEVLDNWYSGDETAYK

SEQ ID NO: 935801 - protein, 61 aa, Homo sapiens
MLRKRVREEKAVLPSTRVNRDTPSPLQAHPWSGFKKGPPRALKRDSEISIKELDLQFSHFN

SEQ ID NO: 935802 - protein, 61 aa, Homo sapiens
MALRSQFWGSRFAGPWSGSQPCQPASRRQPNLSGPVEIKLCPDSPTGPPDLELLSVARKDG

SEQ ID NO: 935803 - protein, 57 aa, Homo sapiens
LTSTMSYHRELSFGIHRELNSLISPILRLHPRPNLRQNPFNYTYYIGVNLTFLPTQF

SEQ ID NO: 935804 - protein, 78 aa, Homo sapiens
MNDTVNYPHEKVHDQPTTSEETNEVMMSFTREGDSAQDRIRENSQMYKTHLVSSLYLVQTHLVVQTLAWHDYDSWICK

SEQ ID NO: 935805 - protein, 43 aa, Homo sapiens
AKAAKEANGRTVKIEWKIKLPWNWAKPKVKVAYGGRGGSRSVL

SEQ ID NO: 935806 - protein, 52 aa, Homo sapiens
EQEAPSWEETYRHNKDRKFAQEPKSQDIYLRLFVKLYRFLGQKDPPPQFNQV

SEQ ID NO: 935807 - protein, 80 aa, Homo sapiens
MIWGPHPVPVASGLPPWCEAGLCSWHFLLAPTLQQEGFPETPVYVNILASCYLGAWEAGVPMLQTCCPSVYKSWGMPPRM

SEQ ID NO: 935808 - protein, 96 aa, Homo sapiens
HSARDLSGVSNATKGAWGTTLNIATVLTSIQLLMSEPTLMTRSRLTYPQNLNIIDRTSSGNAGQWRRGMQAEPKGCWGEMLYTIPELCSESTLQEK

SEQ ID NO: 935809 - protein, 74 aa, Homo sapiens
LGIELRSEATKRPAEARSKKLEDELVSLQKKLRGTKMNWTNTLRLLKNAQGKLELAEKKATCLSRRSFFEQTHP

SEQ ID NO: 935810 - protein, 38 aa, Homo sapiens
VKADEHVIDQEDMEHFYVMTGTYCQFWYKRLFKPALFG

SEQ ID NO: 935811 - protein, 84 aa, Homo sapiens
NRGVCCFSNEDNILRWKLRLLSGEVESQMDGDKGKSLLIMNTLHLQRWKGAALGGKSLGGKIHHQKGCRATFGGKNFNKATVHD

SEQ ID NO: 935812 - protein, 104 aa, Homo sapiens
MASLGTSWFSVWVSHHGQGESPKEHDPFTYDYQSLQIGGLVIAGLFILGILIVLSRRCRCKFNQQQRTEPDEEEGTFRSSIRRLSTRSGRNTWGDGIRPGGSLG

SEQ ID NO: 935813 - protein, 66 aa, Homo sapiens
HICQSLESARAGTRFPGPQWGVCKPERPGLQIRESQHHVWQLQYRSQRPPMKVLEQSPVLGAGSSI

SEQ ID NO: 935814 - protein, 67 aa, Homo sapiens
KFSQEKAIFSSSAKIVSPMGEPDEFESAISQALLELEMNSDLKAEAQELNIPPPKEIKWYCRKAIII

SEQ ID NO: 935815 - protein, 74 aa, Homo sapiens
WNYRRVSHAQLVFCIFSRDGVSPCWPGWSQTPDLVIRLPASKVLDYSVNHCSWPSSKLLSTGHESALSLEGEVK

SEQ ID NO: 935816 - protein, 398 aa, Homo sapiens
ATLVRHQRTHTGSEAVLHVADCVTAASAESSTAAAPSVRSHQWLMRATCCAATCWQGFRAALLTWCVHQRIHTGCEALRCAPDVLACSAFMVTCSVTITNAPVLHCTLVDECPYRLLNLCVQCWFTVLLSKSQSVALERNQCLATMPQQIAPDVACNGPSAGQPSNAMHFAPGNDCTLWLNWAKAGVAAEVLAQVLQTNMPLSLVTRHSSWVPQAISWLPLTPGDRTGTGFGRIPMFPGNDLCNIGPSRSYSRVVCQVLRHHVEKMAGGGSIHNFRIDTLKGFTRWEWAYWQLEGGYSSLKRGVGVLVAKWQALLISKSARCGNETVDVRQRFRYAFVTGILVGENEGKRTWVGGPSHYHIIPQGITMRWGHKHPHLHGLWTDLMVTIWDTTYNGPIN

SEQ ID NO: 935817 - protein, 62 aa, Homo sapiens
MAMYPDHNALLKAGFSLTRVHEEPPKKTYTTNSQIMGNENIHLTSTGDRISEGYTLVEYNNR

SEQ ID NO: 935818 - protein, 39 aa, Homo sapiens
RRCQMLKLDKGEPPLDRAEQAEADKEGRRRQEPSSLKID

SEQ ID NO: 935819 - protein, 112 aa, Homo sapiens
RSWCRHGPPPARCYRYCKNKPYPSLASAEVSSCKIRIFDLGRKKAKVDEFPLCRHMVSDEYEQLSLSPEAARICANKYMVKVVARWLHIRSLTLHVSHHRCVCLAEGQQDQV

SEQ ID NO: 935820 - protein, 40 aa, Homo sapiens
AIQTEEDPETEGHVARPRLEEGPEGPCGLGNLVLHTTDYT

SEQ ID NO: 935821 - protein, 70 aa, Homo sapiens
MPSKGPLQSVQVFGRKKTATLWAHCKRGNCLIKVNRPPLEMIEPRTLQYKLLEPVLLLGKEPFSGVDIPV

SEQ ID NO: 935822 - protein, 81 aa, Homo sapiens
AGILAGKKYVQGIATTAALKCFDKFCATPVWNASKPIGADLQEVHYKNRFYMTPASAVPSDFTFGQGDFVAKTTVLCTVHI

SEQ ID NO: 935823 - protein, 111 aa, Homo sapiens
GLCSNGQIRARDLRGRRKEELLKQLDELKVELSQLRVGKVTSGPASKLSKIQSRPEIIAVFSQLLTDSEETSGILQGKSTALELRLRDSACARSQDERLRQSSTKERLPLR

SEQ ID NO: 935824 - protein, 95 aa, Homo sapiens
KQDIYFSFLVNIINFVELSDSLTASSLQFFTVPPLFDRPTVSRRSVVQVTTAGREAYTQAAGSSQTATRFVISDIVRRSCRYYSQTLLSFRYLLG

SEQ ID NO: 935825 - protein, 73 aa, Homo sapiens
RPSKEGTGSTATSSSSTAGGQGKGKGKGGSGDSAVKQVQIDGLFGIKDNQTLSRGGTRNLGCSGGLLVCLEIA

SEQ ID NO: 935826 - protein, 65 aa, Homo sapiens
EEADMQTERPTQKQPSISITKMWFPAGRYFQGDASSDYKINGLGFKTPKEAIEGTHTDKMMPLTV

SEQ ID NO: 935827 - protein, 33 aa, Homo sapiens
GRLDLDQISLQDAKLERRQQNVERVNRPYYDAE

SEQ ID NO: 935828 - protein, 38 aa, Homo sapiens
GNLLGRRAASMDNNSKFAKSRSRAAKREGSLQSWPEGA

SEQ ID NO: 935829 - protein, 80 aa, Homo sapiens
APEDPHGEKPYTCSECGKAFSDRSVLIQHHNVHTGERPMSSVSVGRPSATVHTVDHERITPRKALCMYDVEVLFQHYTYQ

SEQ ID NO: 935830 - protein, 34 aa, Homo sapiens
RTFTEVKVVPPYIYSMLVRIINQQLYRITGSISS

SEQ ID NO: 935831 - protein, 40 aa, Homo sapiens
MGKGDPTAAGKMSSYASSSDLRESTRRDTRLFRQFRGFSE

SEQ ID NO: 935832 - protein, 35 aa, Homo sapiens
QAYGVEDPEYAVTQPSSTNHVDQSLGKLSLDKSSG

SEQ ID NO: 935833 - protein, 68 aa, Homo sapiens
WVSLFVSLWWTLLVICRILVSANRSNADLRETLTGKIITLEVEPSDTIENVRSRSRIRRHSPDQQSSS

SEQ ID NO: 935834 - protein, 48 aa, Homo sapiens
NQSAKPCPLLGLTKCKHQPRQLTTRYAASKRAAITEYNDSATDMQQPM

SEQ ID NO: 935835 - protein, 38 aa, Homo sapiens
AKKRRNNGRAKKGRGHVQPIRCTNCAPCVPKHKPISNA

SEQ ID NO: 935836 - protein, 53 aa, Homo sapiens
IWKRLFTALGIRISLGSSSPRSLVSLNRAAVSVSPWASESQKIYSSLYKLLGS

SEQ ID NO: 935837 - protein, 51 aa, Homo sapiens
KVFFSSFFPLAPLLTFAPGSFLADVFLGLGSGLVEQVSLTIQRRRRVPSPL

SEQ ID NO: 935838 - protein, 37 aa, Homo sapiens
HNVEKGGKHKIGQISKVSFGRRTGQALDTLTQRNKTK

SEQ ID NO: 935839 - protein, 34 aa, Homo sapiens
TVITTTIRHPIHGTDLGSMNLRRLLSRQFHPYTI

SEQ ID NO: 935840 - protein, 58 aa, Homo sapiens
DSSHTLQRDWPSRKAGTRAKVAATSKAQRGSSTAFSMFDQPRYQEFIELQLYRQIVCI

SEQ ID NO: 935841 - protein, 333 aa, Homo sapiens
MGHLVVPRSYSLGRSSYLGLPRKHACCVRGRPPFSEGGATIRAAWDLPLLATSRARFPTPFVWLPQATRPHTLWWDPSGWAFLGRPPGFVELPFFPSPDIFCGRKESGETLAAFSHAEKRFPVNTAPRWKGRSPPTIRTLARSDTQGAPTSLRVSTERPQGSPRGGPGPLETPQKVGTPRAPREGDTSGLFRGASCFLEENHFTLPTRNTPHCGGSSPSEEEAAKHAKVETLFGVLGLPQNYPRARHNELLTALAAQGVNNVWLPPPRGARINKGHAGATGTAASLLCSTHRSHHNPCHAQPWETLPQHSPGKKAVASRAPPQCPENKVLLDF

SEQ ID NO: 935842 - protein, 34 aa, Homo sapiens
NTLLALLLLIITFGLPHLNGSHRKFHPYGVRLRP

SEQ ID NO: 935843 - protein, 43 aa, Homo sapiens
IGQGPEQGDEGVADALQIQCKNVLRIRGEEMNHHKYRSCEETR

SEQ ID NO: 935844 - protein, 55 aa, Homo sapiens
AAVGRCSISHGRVFRRMGLGPESRIHLLRNLLTGLVRTNDSAPMARFDEMRATEK

SEQ ID NO: 935845 - protein, 68 aa, Homo sapiens
MNQIEPGVQYNYVYHEDEYMIQEEELDPDLLLDPALEKQQRRTFTAWCNSHLRKGGTRLRTWGSFQEW

SEQ ID NO: 935846 - protein, 55 aa, Homo sapiens
GLTTREFSRPRAGERPGTLAVGARQTPCDRSEAQMLSMAVVSCQVNDIAEKRKAR

SEQ ID NO: 935847 - protein, 58 aa, Homo sapiens
VSKARKKYKGGGILSWYRHGTLKMGHIFNCIQRAHQTTLECILPSYFFYLLEVFTTSV

SEQ ID NO: 935848 - protein, 32 aa, Homo sapiens
PSAVGGSNAEPARADITYESVRKPASTAAAAW

SEQ ID NO: 935849 - protein, 33 aa, Homo sapiens
AQQSDQVEAEEEDLNELALRGPGQGQAGWSWPH

SEQ ID NO: 935850 - protein, 33 aa, Homo sapiens
KRKPCRESKKFTTIVGLKEPPIKKAFKLNTITK

SEQ ID NO: 935851 - protein, 103 aa, Homo sapiens
EGGPLYRHIADLAGTLTSYSSASLQCDHGGSMLEQLAMQEFMILPVGASSSRSHAHWREVYTTSGGHQASMALTDRSDCALRSSVWQYTTHEIESFGTGNLSG

SEQ ID NO: 935852 - protein, 79 aa, Homo sapiens
MAGFGAMEKFLVEYKSAVEKKLAEYKCNTNTAIDLKLVRFPEDLENDIRLSFLSIPINSLGMMNCFWYKGLRSVYYIAV

SEQ ID NO: 935853 - protein, 46 aa, Homo sapiens
EGGGTGLDVGRPAMRPPVSITNRYFDSSDEEPIEDDRLQFIYHGYL

SEQ ID NO: 935854 - protein, 62 aa, Homo sapiens
GPEANSARMRNKAVGQARPQAAVGQPLPEASGRKAQVFPEMPQPVAGARPPPREKLGGPGPG

SEQ ID NO: 935855 - protein, 36 aa, Homo sapiens
QGLAKSRARFNRCVTGTRSPPGGRAHQMLIKPASVP

SEQ ID NO: 935856 - protein, 133 aa, Homo sapiens
MWSKPEAPLNLSFAGLKVPKGLPAKLQSARSQLQQTEQAPPDELPEVDNLTLDGNPFLALELPPPRGLNERRGPSLCTFDLSVGVSEPWCSSKGPGLPKIQDRIMNDSNSLASGEPVRTLSLFDQFNPLPHLY

SEQ ID NO: 935857 - protein, 44 aa, Homo sapiens
CLNEVCFYSLRRVYVINMEICVQYSVFHEELLRADLCRDKFSKC

SEQ ID NO: 935858 - protein, 82 aa, Homo sapiens
SRAYATLTKAPVDLLGVAHNNLMAMAQETGDNLYWGSVTGSQSNAVSPTPAPRNPSDPMPQGPALWIETTALLHLLLHEGKA

SEQ ID NO: 935859 - protein, 82 aa, Homo sapiens
YADKPETTKEQLGEFYEALQTRIPKSDVVYTDWKKDKCEPLEKQHEKERKQEEGESKQTQPWIRTETLAILPSNPTCLSFFP

SEQ ID NO: 935860 - protein, 86 aa, Homo sapiens
EAAVVPIKLRGRRWQPRALEPEREHLDENSPLGTFFGGFWMFLPFQIAIRLRARTTGFCLLISMASVATGPDVAADLQEELQDWVK

SEQ ID NO: 935861 - protein, 68 aa, Homo sapiens
SYMIWDYTSVSILAMREEFGGRALALWRWRPYFANHETKVAMAVPAAAVAMAVAEDFNEDNSLAGEES

SEQ ID NO: 935862 - protein, 34 aa, Homo sapiens
DYQAVDDESRPILRVDISEDDIDDGFRRLFAQWQ

SEQ ID NO: 935863 - protein, 69 aa, Homo sapiens
GVVGVVSRYGEVRFVAAPARELACSCLCDPESFWGAYSPALGATWFVACLIPVRGLLTTTRLENASTVT

SEQ ID NO: 935864 - protein, 74 aa, Homo sapiens
SRELLNPEPRRLEPRVEATAYMITLGDACTTSPTAGRGAAFASSWKTGLASLAVFCHELPHELGGLRRLAARGA

SEQ ID NO: 935865 - protein, 107 aa, Homo sapiens
DPGRDSPSLAQTETRVTPGSGAWGMDPETRDERRPASFSHLGRRMQLPLLTDKTKARLGPPQIRLSAFRVARPQGVESPRASPVDVLQGLAFGTLIFQNPVFLDDEL

SEQ ID NO: 935866 - protein, 81 aa, Homo sapiens
AAAFPEHQPHQPEEKMDADLSQLQTEVEEAVQESRNSEEKPKKPITDAAMMAEELKKEQDTSPHLERMKKNGQPIKAYSTS

SEQ ID NO: 935867 - protein, 135 aa, Homo sapiens
RPYPLFPRDGGNDSSKGIEGALIGKHKVSRSSPLQIDALCPLGKFIVPPSFPPNSLGCVTAKGRDTAKIGLTHWQAHCPGVASNWSFPRGNPFCWQELTQDAIAGLDLLRREELRYLGVIYRSQYDMTPWTTRAA

SEQ ID NO: 935868 - protein, 53 aa, Homo sapiens
PDRRWSSLDTMNHTVQTFFSPVNSGQPPNYEMFKGGPGCFSWAPKTFSPRSTF

SEQ ID NO: 935869 - protein, 83 aa, Homo sapiens
MASRKAGPRGKVAAPKQAHRGSSPVFSMFSDQAQIQGYRGRLPPFPPVPWWSYSAGRPGGPFSLVGGGFPPGGGGRFLTDGPL

SEQ ID NO: 935870 - protein, 39 aa, Homo sapiens
TRLRSYSCASLRFFLRNHVLTKPDMAEIENSICRLRRQT

SEQ ID NO: 935871 - protein, 84 aa, Homo sapiens
PAWIETTAYLLHLLLHEGKAEMADQAAAQSPVSSFQGGFRSTQDVIALDALSAYWIASHTTEERGLNVTLSSTGRNGFKSHALQ

SEQ ID NO: 935872 - protein, 42 aa, Homo sapiens
RKKPVSILLCIRCSCDVVEIGSSRAVLHGELDTMFVVEVPVF

SEQ ID NO: 935873 - protein, 46 aa, Homo sapiens
LVLSPSIPTNPLHKDEVNESSLPSNQIGHMVLTYEYNRLRRINSQL

SEQ ID NO: 935874 - protein, 89 aa, Homo sapiens
SPPFQDESCGLTLASLPDGEPGRHFWQQDEPPQSPWDRVKDLATVYVDVLKDSGRDYVSQFEGSAGGKQLNLKLLDNWDSVTYTFSKLR

SEQ ID NO: 935875 - protein, 57 aa, Homo sapiens
MVGWAEGLLRGRRGQRKRGILTLKYPIENGIVTNWDEMKKIWNKPSKRAALGPERTQ

SEQ ID NO: 935876 - protein, 33 aa, Homo sapiens
MAALRPLVRPEIVKRETKRFIRHQSDLYVQIGR

SEQ ID NO: 935877 - protein, 76 aa, Homo sapiens
RISNPSNITPGLAQFPQLEPPFGEEMPCCFKKPNIKEYQRKFPPNEKFDFPQPTPNITFFVYVSNFTLAHQNSGAN

SEQ ID NO: 935878 - protein, 63 aa, Homo sapiens
YCKYSNADVNRLRVHAMTQHWLQPMLRAPCVRHMLNNQDSTSSLHLPTIHSVATLLGGEVIMT

SEQ ID NO: 935879 - protein, 48 aa, Homo sapiens
TAAYIGECGLCSQGGLTEIRDMLLANKVQLLPCWCHCPMWSTVPDQNT

SEQ ID NO: 935880 - protein, 51 aa, Homo sapiens
IAYMDQASGNVKEGPKADGVKYEGDSGLRELAIHLHSSGGWFHETHWGLEQ

SEQ ID NO: 935881 - protein, 59 aa, Homo sapiens
APSVSVKPPDPGSALPCPAPPRQKYMRGAEMSTQLLARSRANLNLRLNFLTEVLMPFFQ

SEQ ID NO: 935882 - protein, 72 aa, Homo sapiens
ERLSVDYGKKSKLGVLPFYPAPQGFHRLLVEPLQLPFSTTTTTLEHSDCAFNGDNEAILYICVETSISSANL

SEQ ID NO: 935883 - protein, 44 aa, Homo sapiens
MLEEVQKMQGVYPWVQSLPGTFFMLPSILSRYYPRDQHGPTSQV

SEQ ID NO: 935884 - protein, 98 aa, Homo sapiens
VFKVSHFSKYGLQDSDEEEEEHPSKTSTKKLKTSPLPSARQTTALQSRLFNVQTCTSTSGREKRTVYLNRVRDTQLRARAYSSYTAAFMTPGALKSTH

SEQ ID NO: 935885 - protein, 56 aa, Homo sapiens
ELRTRGKYLRHVRTSGHVYGEYKVSWFVCLPTPKCHTPPLYRMRIFASNNVVGKSR

SEQ ID NO: 935886 - protein, 41 aa, Homo sapiens
GAAPMQTGSPNRDGSQGMDGALALEVGPSFLPPPLRQQLLI

SEQ ID NO: 935887 - protein, 53 aa, Homo sapiens
QPAIEGRLTSLMVELAIVPTFNCRGETDVSSDSPLHTPRYFFLSILCWADGFT

SEQ ID NO: 935888 - protein, 65 aa, Homo sapiens
AEAATMPGVTVKDVNQQEFEESLAAFLKKSGTLKVPLWWDTNKLANHKDLSPYDETCSTSELLTQ

SEQ ID NO: 935889 - protein, 89 aa, Homo sapiens
PLLDRGSRAGVRAARTRPFYSPGFPVPRSPWDPFVNIEACQLSFYHHGPIFFGRPKTQKTYFGKTKRPLTVPFGTCPHQKPRPTEKHHT

SEQ ID NO: 935890 - protein, 106 aa, Homo sapiens
MASTDYSTYSQAAAQGALPVLTPPSPLRDIHRPPRHMGNKAMEPMDSPLMSAVTRFSPLHPMADPYALLWTLPLVYTPLPQDKAACQGMHWSYIHTAQYTPGSSAS

SEQ ID NO: 935891 - protein, 67 aa, Homo sapiens
GCGVCCYSPSFEMPPKDGRKKKDAGKSAKKDKDQLTNIRGQGQKEEVVQGKVRDKLNNLALFTRLPL

SEQ ID NO: 935892 - protein, 50 aa, Homo sapiens
MSGVAHRAFENDVDALCNLRGFFNYLPLRRKGPGSRPWVQIPVTLWFLRF

SEQ ID NO: 935893 - protein, 49 aa, Homo sapiens
MVTETQQAAGKMSSYAFFVDLREGPKRTPVISVNSRNSPKVSRIETISP

SEQ ID NO: 935894 - protein, 54 aa, Homo sapiens
RVPPFFRAFPLAAAGRKAEMADEIPSLRSSRPGGDTIFGKIIPQELPPKIIFED

SEQ ID NO: 935895 - protein, 34 aa, Homo sapiens
SRGEGRVLEAGVAGSSLIGVRGLSRSVPGFSLER

SEQ ID NO: 935896 - protein, 54 aa, Homo sapiens
PRVATSFGRPPIPGVIRHQTASTMPPKFDPNEIKVVYLRCTAVRSVPLLPCPKI

SEQ ID NO: 935897 - protein, 44 aa, Homo sapiens
ARAPAGEKIETELRDICNQCTVSLRKVLDPNASQAESKVFYLKM

SEQ ID NO: 935898 - protein, 111 aa, Homo sapiens
GALPILKWPALNEDPITNYCSIIILWALALTQFGGTKYTARIAKVGFFDRYPVTCIYFDRISGYLSDSGAPVAIEMDSKTFFPDFSKVGTLVVFVAFILSYMGVEDPQPTS

SEQ ID NO: 935899 - protein, 43 aa, Homo sapiens
TILGLPAAVLIILFPPLIDPNHPNYSINLAMGHAPYGAVSEVM

SEQ ID NO: 935900 - protein, 129 aa, Homo sapiens
DWEEGGVFAWVSNTLGPRWGFAAISFGYLQIAIGFIPMLFVLGALSYILKWPALNEDPITKTIAALIILWALALTHFGTKYTARIAKVGFFGGILLPAFILIALALIYLHSGPVCYPKWIPKTLPRTCC

SEQ ID NO: 935901 - protein, 97 aa, Homo sapiens
NGQQEGGDRGKVAAPSRPTWFFQRLFMFEQAQIQEFKEASVYRPDRVASSAGRPEADYSSWEGECPERSWTHAAEGKAHHSRLLRSLGELMQTETIL

SEQ ID NO: 935902 - protein, 35 aa, Homo sapiens
LKGVTIASRGVLAQHTLRVLAKKRGSKGKKEAIIT

SEQ ID NO: 935903 - protein, 46 aa, Homo sapiens
RLASRKAGDRGKWQHQAGQRGSYNVFAMSDKPDTEFKSSAVSTRIV

SEQ ID NO: 935904 - protein, 36 aa, Homo sapiens
MAPAKKCGEKKKSRSPCNEVNHDDDNMNMHTRSSAS

SEQ ID NO: 935905 - protein, 34 aa, Homo sapiens
HLLGCRPVGFKSDRILDSQLNLPVCPNCMALILL

SEQ ID NO: 935906 - protein, 64 aa, Homo sapiens
NKGRSPRTSGLLLVLFSPRISGRFGSVSLARVNVEALFPPGPWSPKLLTWKTLPPPPEYEFAPS

SEQ ID NO: 935907 - protein, 31 aa, Homo sapiens
MAAEPSCSCFCLFLLASGTIGLPPGLKGPCR

SEQ ID NO: 935908 - protein, 35 aa, Homo sapiens
VQNGTSKGKERRKTSHQPRTSVAEGENVFGVCHIF

SEQ ID NO: 935909 - protein, 68 aa, Homo sapiens
VPLPGPLEQKDFRGPQACPRCPKEDRGLFPEPQEKGQGLAKERKGRCWAKPRHLVFHGAPRPQKVFDG

SEQ ID NO: 935910 - protein, 152 aa, Homo sapiens
MCERLLVPAHNEHTEAYHRRPFVAPPSHDDLVLSLLGIEGAVITIWGALSFLATQGPYHPRVGGAPHAVSLLPPFATRDHLGMLWATGDPGPHTVVFVRSCCHEKLCETTCAGPPTGDNLCTTGLGQETPHLRRCFALSLSLDTTSAFLCCI

SEQ ID NO: 935911 - protein, 33 aa, Homo sapiens
AAGYDLYSAYDYTIPPMQKHVVETAIQDRRSIH

SEQ ID NO: 935912 - protein, 50 aa, Homo sapiens
AIVSLKAPRRLKVCHFKRGPEICNYSYSTTFLAEAQQAEADSMPGGVLYI

SEQ ID NO: 935913 - protein, 37 aa, Homo sapiens
NVDLTEFQTNLGAYPRYHFQSWPNNAPVNLLLGKPTM

SEQ ID NO: 935914 - protein, 56 aa, Homo sapiens
GSDIVFKPCVAILTHRRDAQGRQGDLEVQLFPEDHRKSRHLLMIIRMFICGADIWV

SEQ ID NO: 935915 - protein, 35 aa, Homo sapiens
PEKTHAADFVFFRTTFTEVSRAFFFLSKNGNLLGK

SEQ ID NO: 935916 - protein, 38 aa, Homo sapiens
ATSERSNFAPVRELAHHRLEPAFSKDGRQNCCLIPPSA

SEQ ID NO: 935917 - protein, 35 aa, Homo sapiens
LLALSKMYTCKHPPFQFEVHPLNNPGPKGQSPKRG

SEQ ID NO: 935918 - protein, 76 aa, Homo sapiens
ETPASAEVIAEEERGFGRETQDEYRGAARDHNCCRGAFVRLASLLRLYAVLRAEAEIHNTKVAGVSAVNIQLLGAS

SEQ ID NO: 935919 - protein, 101 aa, Homo sapiens
QARKAERGAGLGAAKEREVLQLQEEVKNFITRENLEARVEAALDSGRLQLAITREGLVVRPQRRDSSGPSKDSAARPMYVSCEIALPGEAVFAIEFTLSAS

SEQ ID NO: 935920 - protein, 34 aa, Homo sapiens
VTLKTLQQQTFKIDIDPEETAESTVKRGLNSEKG

SEQ ID NO: 935921 - protein, 36 aa, Homo sapiens
RRVLACCQKTFKKKRRDFRRAVRSSALERGLPKRCF

SEQ ID NO: 935922 - protein, 34 aa, Homo sapiens
SNEGTGSADAIDGYEADDAEGGDGTDPGTEPEDS

SEQ ID NO: 935923 - protein, 37 aa, Homo sapiens
EPGYIQQPCPRDLQLGIDLGTTYSCVGVVSTESRDNC

SEQ ID NO: 935924 - protein, 104 aa, Homo sapiens
SLADTQAALGDELVRLRTGQHCIRKQWGRGEMAEVVSILTFRGLFLFVLIFARLILKLMWRTQGCLETKPMTGQSTIFTSLSYCFMIPHVVFAQESLGIRIFEP

SEQ ID NO: 935925 - protein, 58 aa, Homo sapiens
IAIMNDTVTIRTRKFMTNRLLQRKQMVIDVFTPEGDSPKTEIRENKPNVKTQPMSSCI

SEQ ID NO: 935926 - protein, 95 aa, Homo sapiens
VTAPRTLLLAALGGSGLTETWAGSHSMRYFHTSVSRPGPGKPRISVGYVDDTQFVRFDSDAASPRTEPRAPWDRAGGAGVFGDRETQIQDQHTDL

SEQ ID NO: 935927 - protein, 74 aa, Homo sapiens
GTMEGVEEKKKEVLLCQKPLRKAKEFPELKIKLLERSLPKRCFERQEEFILEKQMTSQGLAVDRSIRSRVAEIG

SEQ ID NO: 935928 - protein, 107 aa, Homo sapiens
NFPILVSLEATAGDQGCISVLYLNRIKTDTPSTAIYRPPPRNAFLPQGYSLLGKEFSNISATHTYIYKLSAEEKYGSILPDPQTVRPYGYLPLFLKITVILFFFKVH

SEQ ID NO: 935929 - protein, 112 aa, Homo sapiens
MDRREPDFLALCPLGAGQANSANLSPQARDPTTHRLRPEPAADLDTIKTPKTFIMSQMLWKRFWENPEDPPVAANVKTDAEEDPNCHEQHPSNTATYWGKIKKLFTDGGKKT

SEQ ID NO: 935930 - protein, 46 aa, Homo sapiens
LGCQNQLAIRWTGDKDQLMSLMAKNAPTLFLYSGEGILECKMDSAQ

SEQ ID NO: 935931 - protein, 43 aa, Homo sapiens
GRTLRTTWATTCRFLPAKSGEEDEMEVEDPGELRSQKPNIINF

SEQ ID NO: 935932 - protein, 41 aa, Homo sapiens
AKRIAQQAAGGLSFRAASSLPVSLTLAVSMKAFSPVSPLGK

SEQ ID NO: 935933 - protein, 44 aa, Homo sapiens
GPKKHLKRVAAPKHWMLDKLTRVFAPRPSTVTHKWRECVTPNHF

SEQ ID NO: 935934 - protein, 43 aa, Homo sapiens
LPRAPDDRPDGAFPDFLLVPSPIWQPLKDQLIYTLLKEDRPPR

SEQ ID NO: 935935 - protein, 34 aa, Homo sapiens
ARERSAYNSCAVGYHPHDGGPRTVSSMELARAVP

SEQ ID NO: 935936 - protein, 41 aa, Homo sapiens
EDEKGAGSRSTLGCQLRYEKWKYVLGYKQTVKMIRQGKAKC

SEQ ID NO: 935937 - protein, 78 aa, Homo sapiens
HEQQPGNRASSGAFSIATLLDFGVGKRGIEERIQEEAGFLIDALRELAAQFIDPTFFLSRTVFQMSFSSIVFWGTAFY

SEQ ID NO: 935938 - protein, 49 aa, Homo sapiens
ETYLCRRPDSTWHSAEVIQSRVNDQEGREEFYVHYVGFNRRLDELVKKN

SEQ ID NO: 935939 - protein, 57 aa, Homo sapiens
LSGQLAQRRKPGGKRKPFHKKRKFEFGRPACNTKFGPAAFTQVRVGRVQEFPSPGLD

SEQ ID NO: 935940 - protein, 45 aa, Homo sapiens
DTSYPPVSPSSPSPTIPHAICIHILSPGTALGACTSLCNSGSSMA

SEQ ID NO: 935941 - protein, 49 aa, Homo sapiens
ELGSDKMAGCPQIIKETSVSADQFCIKPTRWEHAVFHVVNAGLRIPLEE

SEQ ID NO: 935942 - protein, 30 aa, Homo sapiens
MVSAALMKKYIHVAKIIKPVLTQESPPTFQ

SEQ ID NO: 935943 - protein, 36 aa, Homo sapiens
KGEPGMPMDIVNNLWAAFFINQQGKITLEVDHCDLQ

SEQ ID NO: 935944 - protein, 31 aa, Homo sapiens
MTCMTFPKLNLPHLSLLCWQMWLNWGVNAAP

SEQ ID NO: 935945 - protein, 63 aa, Homo sapiens
MASRKAGTGASGSTRQAQRGSSNVFSMFDQAQIQEFKSFSPPSTFLRAGASPTLRPHPQASAD

SEQ ID NO: 935946 - protein, 68 aa, Homo sapiens
LTVITKETEKAVPQDIEEGNVKMLGMQIPIKNVEMLASVLVAISVPFCSLFWLLVEWFWYTIDEKLHE

SEQ ID NO: 935947 - protein, 88 aa, Homo sapiens
LGGRYHRSLNPAWQSLTHRRDAQGGQADLEVHLLLRIIHLLDDYRNVSLLEQTLWAQQMQQIRMSFAEGCGADGQTHDAKAIRGTGNT

SEQ ID NO: 935948 - protein, 40 aa, Homo sapiens
DDHLDSQDFHGLGTTLHDVDDTDDSHQSDESHHSDDSDDL

SEQ ID NO: 935949 - protein, 38 aa, Homo sapiens
FSYLSSPSCWASLYYYQNANLNNTFFDPPERRTPFYTT

SEQ ID NO: 935950 - protein, 89 aa, Homo sapiens
SSKSSHCDSPPRSQTPQDTNRASETDTHSIGEKNSSQSEGDDIERGKEVESILKKTQIGYGFVKSAGNIPPGVLFNTLSDGTSAEAELM

SEQ ID NO: 935951 - protein, 46 aa, Homo sapiens
EHILSFPKSRIVRSLPFSPYEPLNFHDMFQPFLEMIHEAQQAMDIH

SEQ ID NO: 935952 - protein, 84 aa, Homo sapiens
MGQFTKEDKATITSLLGKVNVEDAGGETLARLLVVYPSTQTFFDNFCNLSSASPSWQPKVKAHCKKVLDFLGDSIKHLDDLKGT

SEQ ID NO: 935953 - protein, 78 aa, Homo sapiens
LHAKNIIHRDMKSNNIFLMKAEQVKNLEIFGFATVKVTLSCSQQVEQPTGSVLWMGPRGDPHAGNNPFSFQSDVYSSG

SEQ ID NO: 935954 - protein, 85 aa, Homo sapiens
LLLVSHPSFPALEEGTLLFPVFGHPNPGIRKGLNRPEVFSSARGPQLIDAEVAITRHAFRRRFLYSGNSPDFSSCYYEALLPQNL

SEQ ID NO: 935955 - protein, 44 aa, Homo sapiens
PRSTTPGTPFHHRDNPSLDVNSDLVGGRTTQPNAKPISLFLVAK

SEQ ID NO: 935956 - protein, 56 aa, Homo sapiens
MSQDIVKYNTYMRSTSKHQQQNISISSVASRRYAAQSRGDPRPEEDCPTFQTPSRC

SEQ ID NO: 935957 - protein, 104 aa, Homo sapiens
VLVLLISTVDCLAAEGNCTFKKKISRAAFHNAVAVVIYTNKSTEEPVTMTHPGTEDILRYLETNISVHMTIAVDLVCTQTSAVLSSLRVNILYCFDDYFFSMAH

SEQ ID NO: 935958 - protein, 116 aa, Homo sapiens
TNNIPELKYYDKTVRGATEKEKITKKTVRESNFHIHDILFPSVPDTKCVENFPPTHSFYSGKSETEVNNQLLHNLEFSGEKIFCLNAQEVFESTQKGDVPRKARDKVVEVRVPACL

SEQ ID NO: 935959 - protein, 93 aa, Homo sapiens
EERMELENIRRRKRELLVEISAFGRSSVKPEQVEGLEAIRQQTFNDPKMAWQKSSHAPRGYQFLVEITLQTHRESPSSQGRVSQTPRLYSGEE

SEQ ID NO: 935960 - protein, 43 aa, Homo sapiens
DDRLMKIELITVSSPNVANQPPSPGGKSAYASGPQRDNICLYW

SEQ ID NO: 935961 - protein, 73 aa, Homo sapiens
KVAPLHSSLGNKSETSSLIIIIIIIIIIIIIVIMLKVDNHWSIKVGEEVLFAFAVFLLPYHLGQYTEGDADYV

SEQ ID NO: 935962 - protein, 32 aa, Homo sapiens
NNNSSSSSNSGWDQLSKTNLYIQDCSHTRQTV

SEQ ID NO: 935963 - protein, 56 aa, Homo sapiens
MLDKLTGVFAPRHPPGPHKLRECLPLIIFLRDRLKDALAESEGKEVCIQRFIKIDG

SEQ ID NO: 935964 - protein, 67 aa, Homo sapiens
MAHLNIVVAIAEIKCDLIDVREVMERDARTYADSINAILRDQRKNAININDSLYELVESHSTDATCH

SEQ ID NO: 935965 - protein, 39 aa, Homo sapiens
DVHPASSWRSPGAAGLVCSEGGSEPAAVFAGEAPQAGCF

SEQ ID NO: 935966 - protein, 32 aa, Homo sapiens
MSVGQESKTDYISRLMPMCHWHQAIIQPHATL

SEQ ID NO: 935967 - protein, 34 aa, Homo sapiens
MSSIECFSVGRLGHWARDVLTVGGVVVDESRGRV

SEQ ID NO: 935968 - protein, 94 aa, Homo sapiens
ATEVAAIFLLRQSMGRPSRPFVEGPRSSKRDPRRFNPAPVKTDMSKFKRNLAGKPKRHLTTRVRRRFKGQILMPTLVMEHKKQRNRRQSFRSPR

SEQ ID NO: 935969 - protein, 89 aa, Homo sapiens
EKRASQGWLETHGEFGEKGDPRDSLGIPGKSSPKHGPNVCHGPPGAQAPKVNLGDYKATQKIAFSATRTINVPLRRDQTIRFDHVITNM

SEQ ID NO: 935970 - protein, 44 aa, Homo sapiens
MARGPKKHFKRVAAPKHLILDKLPGVFALVIHRSHKLREFLPSS

SEQ ID NO: 935971 - protein, 48 aa, Homo sapiens
MVHITEEDKDYITKPLGKVMKRCWSRTLETLIVYHEPEILDSFAPVSA

SEQ ID NO: 935972 - protein, 49 aa, Homo sapiens
KQGQERLVLSDCVSSPQGKSDQLLPTCAPPSHFVRCIIPMSKVPGVCNP

SEQ ID NO: 935973 - protein, 46 aa, Homo sapiens
GVTVRGAPLANYGNPSQGQPCQRDSQVPWPIGCNCDPQGSVRAQVD

SEQ ID NO: 935974 - protein, 85 aa, Homo sapiens
GDRVQLADITVVCTLLWLYKQVLEPLSASLSNTNRWFLTSINKPSSGCLGEWNCVRDGQFDAKSCRDQPKGHTRKRGLTGESRAQ

SEQ ID NO: 935975 - protein, 69 aa, Homo sapiens
KIETSCLDGENRRVLINTDIGLPNGLTLTRSLNCSSGQMQEPKTGVYTTYGTGRRVSQNNLKHPSASRH

SEQ ID NO: 935976 - protein, 51 aa, Homo sapiens
VVGSMRVVMARLLSEGEQGIPTACAAFAQNPGGRPQSRPCWGRRGGPQYNW

SEQ ID NO: 935977 - protein, 71 aa, Homo sapiens
RRRRFLLFQKTLKKSEEFPELRIKRLRKRFAQKMLRKARRRLIYEKQALSQDYRQMSRPEFEWRGWQESWH

SEQ ID NO: 935978 - protein, 34 aa, Homo sapiens
GRAVRLSSPRSEPCRQGPPAVCQGFRTQEESHTL

SEQ ID NO: 935979 - protein, 37 aa, Homo sapiens
VQVLQQQEWLVLVLVWEQYCWQTLIDWVMTETLALMQ

SEQ ID NO: 935980 - protein, 37 aa, Homo sapiens
KLYLSILICTYDSLKPCRSPDRSGNSTFRSTLETRRY

SEQ ID NO: 935981 - protein, 62 aa, Homo sapiens
MRKGPSPKRRYKNQKFGFVEEERLKVDIGRLYDVSSFQAKKLMAEAQEAGKKGSIRDSQTNR

SEQ ID NO: 935982 - protein, 55 aa, Homo sapiens
VSLLRVTIELQVESRVPLGFSTIAGDMKTQIKSYKTTPLTTAFPPEQTEHLETTM

SEQ ID NO: 935983 - protein, 52 aa, Homo sapiens
MAGEKVEKQILKRRDPKPRRVDAWWQGEKEVTSKLKSPEGEPHCSGTLFLFR

SEQ ID NO: 935984 - protein, 34 aa, Homo sapiens
GYVAIIDPSLTSPPCVQCSIMIHHGTSMARQAEH

SEQ ID NO: 935985 - protein, 42 aa, Homo sapiens
INSQGLVKESYLKPKKYQGLLLTIYTSVLHLNSRQCEYAKVG

SEQ ID NO: 935986 - protein, 63 aa, Homo sapiens
MPGSCKRPAILYALLSSSLKVSPDPVAAAYEANRPVQLCAPHRTCRELDVLAKTVGFPQGTCH

SEQ ID NO: 935987 - protein, 40 aa, Homo sapiens
KLDKLKAELETLVSPFDIFLVGNFETSKDHCDYSFDAPGQ

SEQ ID NO: 935988 - protein, 69 aa, Homo sapiens
THHIGQVGLDLTILASGDPPASASKSVGIMGVRAHGARPVLLFENKYRLLLSRIVDRVYTVFECRLRQS

SEQ ID NO: 935989 - protein, 74 aa, Homo sapiens
QNTGVVKATTKRQNWERKGLISTIVVIGTVDSGRSTTTGHLIYKFGGIAKDHLKFRGGFLHGEGLLQVFLAFDK

SEQ ID NO: 935990 - protein, 73 aa, Homo sapiens
GTGLGCSPKRPRLGTRSEAVVIVVLEGASLETVKVGKTYELLNCDKHKSILLKNGRDPGEARPDITHQSFADA

SEQ ID NO: 935991 - protein, 84 aa, Homo sapiens
DVVKEDAFYSWESSKDPAEQQGKGVALKSVTAFFKWLREAEEESDHNWGLVGPGTWSPMDTQMARLAPGLQGGGRAAVQMGPVD

SEQ ID NO: 935992 - protein, 61 aa, Homo sapiens
APVKKLVVKGGKKKRQVLKFTLDCTHPLEDGFMDAANFEQFFKKGSSDRKSWDLGGGVVPS

SEQ ID NO: 935993 - protein, 40 aa, Homo sapiens
NRSWKQAKEEVQVEIEQYRLQREEDFKAKEAAALGSVQLQ

SEQ ID NO: 935994 - protein, 109 aa, Homo sapiens
VVLMQLSAWGMKVWAPLALSGCAFSFPLPGALGTVLGRGSLFVSFPFTSAEPRASDALWPLRTQPAALSAEQAKVVLAEVIQGFSAPENCSAHGTRFRDKRLATTWGKG

SEQ ID NO: 935995 - protein, 34 aa, Homo sapiens
MPRGPLLTNPYYSHQGYQSPELTIVYRNTETNNS

SEQ ID NO: 935996 - protein, 110 aa, Homo sapiens
RNANQNNKIPFHTSQNGIIKKLKKNRWLQGCGEKWTLIHCWWECKLVQPLWKVVWRFLIEIKQKYHLIQHPLLSMYPRNINCSVIKHMPSMFTAAYYIASMDHLMPLWWT

SEQ ID NO: 935997 - protein, 32 aa, Homo sapiens
HCFPEILWSLNVDLTEFQSNPGAPTAAMHVPS

SEQ ID NO: 935998 - protein, 51 aa, Homo sapiens
QLQTEVEEEDRKSRNAEAQAKKAITDAAMMAEELKTEQDNSRHLEPMKENM

SEQ ID NO: 935999 - protein, 100 aa, Homo sapiens
MGHAFKDEGQEHVGQVEELSKSERREFEGCILMFHHPYFKVTVSSVGTMIFDVGGTSLGETVPPIAGYLATHITSGTMVIVIPKMSPHFSGEDPAGKATS

SEQ ID NO: 936000 - protein, 137 aa, Homo sapiens
MGTLVGSYASVARMLDERKRALVRRRAVNLRRFSVGNRKLRRAHTTDAMPRPSTCADSGGGMMTTLTARPEAITFDPQQSALIVVDMQAFAPGGYLDLAGFDVSTTRPVIANIQTAVTQRERQEMLIIFRNGWDEQY

SEQ ID NO: 936001 - protein, 74 aa, Homo sapiens
LALSPGSYGQNPPGAEPIFIDANFQSTVPGGPIGGQTRVTLRNEHLQYIVTWYGLSAATSYLWFKKFLRGTPGV

SEQ ID NO: 936002 - protein, 49 aa, Homo sapiens
ECGSECRGQASYATPAAEHKILNEGLPNQVLKPFLEDSKSQICCPIVGT

SEQ ID NO: 936003 - protein, 116 aa, Homo sapiens
SELVETGSGLGLYRLAASPNNCVSSIENMENISTAGPRVDPGGTEEKRMSEYITTALRDRTTRRFYDSGAIMLRDEATILGMLDRTEAIDFQLLSKGGSPGTKTPVGHRFTKALKV

SEQ ID NO: 936004 - protein, 69 aa, Homo sapiens
ETSQAPRTVALPRCGSVPLILALSLLPRLGGIRPRNLWDNREWKVLGSRSLEDLTAVHFLDPLQAALTL

SEQ ID NO: 936005 - protein, 57 aa, Homo sapiens
PPYAASAEEVAKDLKSKSGDRSPLLCLQTGPAETEYAPGDAAPQMTGPGYAGPTHFK

SEQ ID NO: 936006 - protein, 60 aa, Homo sapiens
VDEQMLNVQNKNSSYFVEMDPNNVKTAVCDNPPRALKMQSPHCNSTAIKSFQAHLEQFTP

SEQ ID NO: 936007 - protein, 82 aa, Homo sapiens
EESNRLFRAMQLLKEEARKAHQPLAFSGGIKVQHEDLICRNTYYPLGSAVEAIKANCSDNEFTKLYTAAILQSPDPWVYSKD

SEQ ID NO: 936008 - protein, 106 aa, Homo sapiens
YSNEKPFTGFEAFYAAEIDECQVAPGAPTCDHHCNHLGGFYCCREATSCTVSAPAQSRASSLPWSSGLPSRSEATTCWPQLRVGLKNVVPQLPFTHHGPNNKPGPT

SEQ ID NO: 936009 - protein, 42 aa, Homo sapiens
ARHHINETRSTLNTHYQKIPKPYNLTCLTPNFDPIYSPYTTT

SEQ ID NO: 936010 - protein, 32 aa, Homo sapiens
MAEVQVLVLDGRGHFPGPPGNSLAKTGTVGRK

SEQ ID NO: 936011 - protein, 65 aa, Homo sapiens
GQWYGNAQQIGQYMPNGLASSCIWDVWPGMEPAMDLIRHSLLHMDGPIMSHRLRQMQHVPISSGI

SEQ ID NO: 936012 - protein, 42 aa, Homo sapiens
MAGNSILPGCCLYSSRPVSKVILLSSWKGKIKIQSYAPAVTW

SEQ ID NO: 936013 - protein, 40 aa, Homo sapiens
EEAENGRDAPPNGNANKENGEQEADNKVDEEEERLGEERR

SEQ ID NO: 936014 - protein, 127 aa, Homo sapiens
GVWLRFPSGLLGAGGEITVCAGLSSLSDDEVPLGNRGTVLKTPGRGSAEDLSLEEEARFSSQQPPAQLSHRHRGARCCGQREALQLPGIRRWRRPFLSAWSQVPVNEDVAVLSWGGAKMHWTQLSGD

SEQ ID NO: 936015 - protein, 83 aa, Homo sapiens
DNHKMAALEAKICHQIEYYFGDFNLPRDKFLKAQITLDEGWVTFGDNHKIQQVDRLTTDFHVIVEHLANPGRTHGNQSDQLKS

SEQ ID NO: 936016 - protein, 62 aa, Homo sapiens
EAFSCIDQNRDGIICKADLRETYYQLGKVSFPEEELDGCCKREGPINERFLYVFWGEVNGTD

SEQ ID NO: 936017 - protein, 34 aa, Homo sapiens
MTLQRLFRLSSVIRSAVSVQLRRTLVLQQCINKD

SEQ ID NO: 936018 - protein, 69 aa, Homo sapiens
PPYAASAEEVAKELKSNLGIEVLCYVFRRVLAETDTAEEKPAPDDGSTGTQAPSHSESALNMTLNVNQI

SEQ ID NO: 936019 - protein, 34 aa, Homo sapiens
VGKTVLIMELINNVAKVHGGYSVLLGFGDPTLKA

SEQ ID NO: 936020 - protein, 35 aa, Homo sapiens
KWKYERPDGSPVFIALRSSKKKSVQYDDVPDYKSD

SEQ ID NO: 936021 - protein, 33 aa, Homo sapiens
LNPQDFWNCGCQIIAMNFPDSGSNDGPSHGLGS

SEQ ID NO: 936022 - protein, 78 aa, Homo sapiens
GGGRRRALLGPECVRRVHLCPVCGESFASKAVRNRPVLHAAQVFPCKYCPATFYSSRLTRHINKCHPSENRQVILLQV

SEQ ID NO: 936023 - protein, 66 aa, Homo sapiens
KTLTGKTITLEDEPSDTIEMKAKIQDKEGFLLISRDLSFAGKQLEDGRTLSDYNIQRVYSSSVLRL

SEQ ID NO: 936024 - protein, 102 aa, Homo sapiens
MVWNASVPALKPQDGRVAGGLVPGGTSLGVSNVCSSRAGTFLNIKKGVFNFFCKVFGLLLGVLFCAVNVRSVRSPDVLPWLGDCTRVQAHGNCIACNNVIKS

SEQ ID NO: 936025 - protein, 35 aa, Homo sapiens
SLHIPLCTYSPQLAPKKPDAKKDDARQAPKQLQLP

SEQ ID NO: 936026 - protein, 114 aa, Homo sapiens
MLLCPLFPFGKRCFRRKPLANGAPFLLPSPTVMQNFPPSSPSPVTLRTIDRVPPKAWLCPRSPRNYHELPCPLEGCAGAGLVGGARERRGQGGVRGRGGYKNGGKMRERKGRGG

SEQ ID NO: 936027 - protein, 101 aa, Homo sapiens
WEVSVAPGVRSLSGCGSPRAMALAVRVVLLWRLRLQVQVSSAQEKLEDEFPGRLDICGEGTPRPPGSLNDGSRKLIHSKKKGDGYVDTEAVLSWCRHQAAC

SEQ ID NO: 936028 - protein, 53 aa, Homo sapiens
ALKANSDEEAAVQGKRPLVGKKGKRLLFGFRRQKRLLVEKRQAATRKPALKGG

SEQ ID NO: 936029 - protein, 48 aa, Homo sapiens
MAQPTVFLDIAVDGGALGREFSFELFADKGPKTAEIFRALALREGLWY

SEQ ID NO: 936030 - protein, 113 aa, Homo sapiens
GGAGGGGFEFAAKYSVALETQPQPPFHAMDLTLRSALLLQFGFSRSKVLKLTRKIDNVETSWALGAIFYIDSLNRQKPASSGRASLPSAVSVCHPSCPGRDFILRSHSTGRGH

SEQ ID NO: 936031 - protein, 36 aa, Homo sapiens
GGSYIVFKPCVAIPERTVVMSREDRLDLEGPTYFLK

SEQ ID NO: 936032 - protein, 46 aa, Homo sapiens
MLDLSKPLVDRALSLSVDVETYHFRLGKSVNLDVQFSDSLKESDSI

SEQ ID NO: 936033 - protein, 49 aa, Homo sapiens
DFRACLISMGYNMGEAEFARIMSIVDPNRLGVVTFQAFIDFMSRVTVYK

SEQ ID NO: 936034 - protein, 33 aa, Homo sapiens
ALKGEGKKEEQVISLGPQVAEERCICVCISCIL

SEQ ID NO: 936035 - protein, 37 aa, Homo sapiens
MVFRRFVEVGRVANVSFGPHAGKLVAILDVIDHDRAL

SEQ ID NO: 936036 - protein, 75 aa, Homo sapiens
MTLCMWKDYDHIIFHQKTLMALRKLCYAPGSPEHILFTCFKAFGKVITYLTGKFNCIASRSPFPTVQWGPHLPLE

SEQ ID NO: 936037 - protein, 79 aa, Homo sapiens
AAQVNGATGHCALFAGSPGSGEQLMSSAVQDMNCIRQPTMCPAAQWWRGRRLVVLLSLVLLVTGLTLAGWRRPCPCSAA

SEQ ID NO: 936038 - protein, 42 aa, Homo sapiens
ARAWTQKQVKSLQSLLKDTQIQLDDAVRANDDLKENIAIVER

SEQ ID NO: 936039 - protein, 44 aa, Homo sapiens
MDDIYKAAGSSSDKRSRKMTFKAASDIFVLALRMAASAPRSWQG

SEQ ID NO: 936040 - protein, 50 aa, Homo sapiens
VERDRPTEAVSEKPALASAKVISSRRDHELATPWTCCYLQPAWAHCQCNF

SEQ ID NO: 936041 - protein, 57 aa, Homo sapiens
REEPETRPEAELGLLQDWPGFPAGFNKETQRFHAEPAPAIKPTRLEQRRYFNVGIAC

SEQ ID NO: 936042 - protein, 69 aa, Homo sapiens
SKELWLYIGINTFDYLDSEDRAQVRHIDPCRSHMGPVQDPSSGGLSQVKVSVGDNESPSVQSPGLFCLT

SEQ ID NO: 936043 - protein, 302 aa, Homo sapiens
RREQGCPGPPVISSATLPTVASDSGERPPWPQEHAVSSFLDSPPCPKAAAGGRAAAWVAAAGSCPPGPLAEPAPADRAPQPEVEARATRAPARDPSPAAPPPRPTRTPAAAHSPPHSAEYWSPQSPDCGLQPPPPAGGLLLLPVLQLLLEQGERRVVLGGQGAWPQPGGQDPQQQQQQDTPGGARGGHSAAPEAAAAAAAGRCHLPSRRMCDNPVPGSQASPPLTYGGQVDRGKGAGQGEKIFVVGMVVPARPARGRLAGAGTTNPNKPARRKSSGLASDVLPSTESEVLDCSGVEMGNGGR

SEQ ID NO: 936044 - protein, 36 aa, Homo sapiens
MAKTHINIVVIRHVESGKSTTTGHLSYKYGGIDIVS

SEQ ID NO: 936045 - protein, 61 aa, Homo sapiens
RLQRHGPSQEVLRCGETVKMNGAEEEFGELIGTLNAAKVPPTLVFVLPYCYIDFAAELDPR

SEQ ID NO: 936046 - protein, 84 aa, Homo sapiens
KTVTSASNNETYCRSFYPAHSIKEWLIGMELVSVVLGFPGAFPSPLSLSSTSLLAKAILGVQVPGEAKEREGHFFSGGGSLFLG

SEQ ID NO: 936047 - protein, 34 aa, Homo sapiens
IFNGRKSPVLGQLETVVVTQITFTKGKLFFRNYS

SEQ ID NO: 936048 - protein, 121 aa, Homo sapiens
PGLTWEMLTGQERVALETRKRECGNPLTSGRTSSGNSYDLAIKAITSSAKVDMTFEEEAQLLQLKVKCLNNLGGPPESSTTTAQPAFLQPCASTSQTTSRLFFRKGKVLAQQGVTVRPSPS

SEQ ID NO: 936049 - protein, 56 aa, Homo sapiens
RLFSGAAFFISSAFSLPKCGSAPDGKDSDGHGHEAPLGPQELSFRGVELKGDKGII

SEQ ID NO: 936050 - protein, 35 aa, Homo sapiens
ARAHEGKGKALFQVNQWLTWLETAEEEESEEKLTK

SEQ ID NO: 936051 - protein, 103 aa, Homo sapiens
ELARLQGHGPRPARCYRYCKNKPYPKSRFCRGVPDAKIRIFDLGRKKEKWMSFRFVAKWCKMNEQLSSEALEAARICANKDKEKGCGKMASISGRAPPFQVIR

SEQ ID NO: 936052 - protein, 106 aa, Homo sapiens
MLHPQRRRIWGVGPGCRASAVASSAADALFSTGASSAERGEALLHRRGCVVPRRQHFVISHQRRGGCCPLSESSLSGDTLFSLCGEIPPQQRRVAAWDDTTGFSTS

SEQ ID NO: 936053 - protein, 51 aa, Homo sapiens
KLELARRCFSKATLRMMTRWLLRLSAQHHHCPANSGRISPRSTRVQELDGD

SEQ ID NO: 936054 - protein, 38 aa, Homo sapiens
DEGNVIVGKRRNKTHTLCRSCGYKDLNTTEVDIWQMWL

SEQ ID NO: 936055 - protein, 59 aa, Homo sapiens
VPLGLLGAALSSFTLYTRKLAGTMGKNKTGESGGGLERRKRICGGKVLDRRVVKGKVEY

SEQ ID NO: 936056 - protein, 89 aa, Homo sapiens
VLLEFLSASFLENPTYGSSLIRFSMSSVVAAALVHFYGVSNLQEFRSRPEKAAVLMTPFSEPSHLRGGARSYQVLLKITTLLSERRSEL

SEQ ID NO: 936057 - protein, 62 aa, Homo sapiens
MTLPTALQPVRGRDDVLESPAAITAQFPGGPSTVFLVAVIALTFVMSAFQVTKLSWMTLAQG

SEQ ID NO: 936058 - protein, 97 aa, Homo sapiens
ILPWGEFGTSFFQRRNTIYFKEDIQMAQKAHEKVLNIISPLGKCKFKTHIENTPLPYPNRMTKIKESQMLIKMWKQPSVVAHTCNPSILGGRGEQIT

SEQ ID NO: 936059 - protein, 38 aa, Homo sapiens
LRHEAYFKASGLLTASSRDLKVNVPDLLCVLGSSIDIK

SEQ ID NO: 936060 - protein, 31 aa, Homo sapiens
ELRRTTAIALDKTLATRQGGSVSHVSSQSPQ

SEQ ID NO: 936061 - protein, 58 aa, Homo sapiens
LLEVSFQEITLSDDTPSSPRSPVALAGGKCSYPYHTLSQSSDEFLDEPLPPVHHYTSQ

SEQ ID NO: 936062 - protein, 51 aa, Homo sapiens
MTEPLKPNHHQNKKTPQQAQRDGPGSRAQVVKEELLAVGKLTQTSGESTHT

SEQ ID NO: 936063 - protein, 38 aa, Homo sapiens
MIYGMISDDLVLSIRRPRDGLESAYIPQQESLPMRIGG

SEQ ID NO: 936064 - protein, 39 aa, Homo sapiens
NREGKDKEIGSVSSSETPPPPPPPNEINLSSTYMEEEED

SEQ ID NO: 936065 - protein, 49 aa, Homo sapiens
TQEFERRQQEREEAQRQYTKRTMEVFRILNTKINRGQPNLIVHMEYLLH

SEQ ID NO: 936066 - protein, 39 aa, Homo sapiens
LGELFCVPVVDVVGDWQDPGISLTGQMQDFVKTVTGKAI

SEQ ID NO: 936067 - protein, 32 aa, Homo sapiens
FRVREYSRPLPCIIVRVAGTEPTWQRGRAIFI

SEQ ID NO: 936068 - protein, 56 aa, Homo sapiens
RRWHLSAPWLLPAVQPLRCSAEACLEPQIPFLLHISTLYFTETVYIVEIFLTCKTG

SEQ ID NO: 936069 - protein, 47 aa, Homo sapiens
MVYYPDLFVLGKSRTISNRAWRKAPKGASCPKENPRDVSTVLLIHGS

SEQ ID NO: 936070 - protein, 98 aa, Homo sapiens
QGTHWPRRPPAPLPRALTRLPGPRQDGREAEETKIIFVVGGLAQEGHPVSEKIVQKYGYTTFHRDLLRSEVSSGSPGQRACGIMKKGSLFHGDSFDIV

SEQ ID NO: 936071 - protein, 44 aa, Homo sapiens
LAGKGCSSLGGNPEPAPEPKVLATSLLQGALPAGQCFYNPAQWH

SEQ ID NO: 936072 - protein, 48 aa, Homo sapiens
TDEVNDSFLYHQIQFGHHWYCTYEYTDYGGLIFNCYILPHYSYEPGDC

SEQ ID NO: 936073 - protein, 68 aa, Homo sapiens
YILLSTLEPTDAGILGRLRTHQAGSAHGASSIIFMMESGPVRLSSGGAAQLGLRWGYIIHSWDVRAHH

SEQ ID NO: 936074 - protein, 68 aa, Homo sapiens
NFSGRGGFGGSRGGGGYGAVGYGYNGFGNDGKQFWEVVELQCIWGITTISLQIVRPMEGGYFGRQKLS

SEQ ID NO: 936075 - protein, 36 aa, Homo sapiens
DPSNASTTAMPVTQSVKKPRKACKKNHAFKMFGRPS

SEQ ID NO: 936076 - protein, 130 aa, Homo sapiens
PPTMPTETLQTGSMVKRSAPRFTSAVALRILNKGPDYRSRPSQPQEAQVERLETRYVKSQEVINAKQEPVKPAVLAKPPGRCQGALGSPTLKVFGNHKTESGVQRENLKLEILKNIINSSEGSSSGSGHK

SEQ ID NO: 936077 - protein, 49 aa, Homo sapiens
RKLRRREEEVKRKKGPQKNKLPKDAKKSSTPLSEAKKPAALKPKVPKKE

SEQ ID NO: 936078 - protein, 36 aa, Homo sapiens
TAELAGVTHSVAGFHFGLLSQGLIGGANRDISILTT

SEQ ID NO: 936079 - protein, 73 aa, Homo sapiens
KLENGLPQQKTVASISPLLQQQWRDGSTETTQTLSQELVNLRGELVTASTTCEKLENSQDEYKQCMKHSSSST

SEQ ID NO: 936080 - protein, 77 aa, Homo sapiens
MMKMLLDPMGGIVMTNDGNAFFERFKSSIQRPSPVLVLSQNTKRESGRKVHSGNIIAAKTIADIIRHVWHTSVLFSQ

SEQ ID NO: 936081 - protein, 67 aa, Homo sapiens
QVITIGNERFGFEAAVQLPFWYGIFGIHETTFNFIMSVTWTSQDLYANRFFWAAPPFTGIAQYSEGD

SEQ ID NO: 936082 - protein, 49 aa, Homo sapiens
MVGVNGFGRIGAWSPGLLLTSGKVDIVPSMTLPLNLNYHGFTSSHMIHH

SEQ ID NO: 936083 - protein, 49 aa, Homo sapiens
VETSPSIYRQRVHVKPGSNVSLDITFSDPSLYGPKSESLGGPSDPKRRQ

SEQ ID NO: 936084 - protein, 53 aa, Homo sapiens
MDDKSYKGLRVEQLDKKSRKNEVQGSLRQSSCWALRMASFDQGAGQGNEGLGQ

SEQ ID NO: 936085 - protein, 57 aa, Homo sapiens
VQLPSTCTSSSSYCSGCSALETVKRVSGNHSQKGPKVASILKSGPAGISHAGKVKRS

SEQ ID NO: 936086 - protein, 44 aa, Homo sapiens
AAAVPEEDEVSSTSETAARVGHPSPCGLCAAVVWALLLVSAVYP

SEQ ID NO: 936087 - protein, 45 aa, Homo sapiens
DGKSKVTHVMIRCQELKYDVGREDRFDLLTDLVDNYKRIPMVEPL

SEQ ID NO: 936088 - protein, 85 aa, Homo sapiens
PGSFGARRLCRPLTFNFQDLPSAMSSEEGKLFVGGLNFNTDEQALEDHFSSFGPISEVVVVKDRETKDPGVLAYTLQPRACLDAM

SEQ ID NO: 936089 - protein, 120 aa, Homo sapiens
SGFSFHRFKDQELRGSSLLSRTQFRACPTLGIDAVISSLSLCNSSSLTESILKSQERNKGRKDSKGRLLAFSFKRLADHIPDSGLSQRGWPQRCRSGRDLRLASCLMTDLRQFLGQRKRA

SEQ ID NO: 936090 - protein, 119 aa, Homo sapiens
ARRLVVWFWDFPNSMAPKRQSPLPPQKKKPRPPPALGPEKTSASAGRKKGGKEQQEAIEHIDEVNVITCPMWGDFEGTEFFQPPTIFSEEVRFDRQNPKFLGNNICQPSTSVCTAWGGR

SEQ ID NO: 936091 - protein, 100 aa, Homo sapiens
ATQVWIGVHHHARLTFVFLVETGFRRVGHAGLGVLTSGDLPASASQGAGIAGVTPIPGPPGIGGSGPAWPAMVGPCLYWEYRDWPAMVTHFCGPKLLWEA

SEQ ID NO: 936092 - protein, 139 aa, Homo sapiens
ASDAVAVTFADQIFGVFNWIIPVAVAFSCFGGLNASIVAASRLLFVGSREGHLPDAICMVHVERFTPVPSLLFNGVLSLVYLCVEDIFQLINYYSFSYWFFVGLSIVGQLYLRWKDPDRPRLSSSAFPSHHLLPLAPSS

SEQ ID NO: 936093 - protein, 133 aa, Homo sapiens
LEQDLADSKIADLEPSTMRAQRGLILLLLLLAVFCSTAVSLTCYHCFQPVVSSCNMNSTCSPDQDSCLYAVAGMQVYQRCWKQSDCHGEIIMDQLEETKLKFRCCQFNLCNKSDGSLGKTPLLGTSVLVAILN

SEQ ID NO: 936094 - protein, 132 aa, Homo sapiens
MSVSALSPTRFADSLSGFLQVASVLGLLLLLVKAVQFYLHRQWLLKAFQQFPSPPFHWFFGHEKFKGDQELQEIVSCIENFPSAFPRWFWGSKAYLTVYDPDYMKVILGRSDPKANGAYRLLAPWIGYGLLL

SEQ ID NO: 936095 - protein, 71 aa, Homo sapiens
LAGVELTESGKVWLQAELKPSQLLWFQLLGKEDSALFATYLVNKGGYFNVNPEMKEDFGRKKAFGATRPFG

SEQ ID NO: 936096 - protein, 123 aa, Homo sapiens
SWAQASAYLSLIKCWNCRCEPLHLAKNLVFLISKLISSVICSQGDPFSIYVSRVLGGSDCPHLFCPATKPSADSAECRPHLCILLIPFPVLKVGALCLSLRTLTGSSLKAYFVQSIVLSTVCV

SEQ ID NO: 936097 - protein, 68 aa, Homo sapiens
RGPEGVLDRLYGHPCHNVWLSSGSSHPLAKNWVMRMVFLGSKPFATWLVSCWVKEGSARLREGKYGLL

SEQ ID NO: 936098 - protein, 46 aa, Homo sapiens
MSCTIEKALADAKALVERLRDHDDAAESLIEQTTALSKRKWKRMKQ

SEQ ID NO: 936099 - protein, 131 aa, Homo sapiens
PAPWAERALREPAAVWLTLTAAFLLTLLLSCSAPGLRDLQDLIRYGKTKCGRRAPPPAEPLMSQEIFHFYISVLWNGFLPLVPYSISVPGNTFSKLASWFAQNSRGQFREGELALSAFLVLVFLWLTTKTL

SEQ ID NO: 936100 - protein, 130 aa, Homo sapiens
RQCSRSVPSPLSPNSSCSSHGPAMGARHGFTLAPSWGASWAPLCHGEGLRWYAGHAEASWHPHWVHGPCLGHALLSHGVRLLPWSGKKLGGFTKAVVPPGPLHWAGPELGMAPIFFGADKWAGLGGSAGQ

SEQ ID NO: 936101 - protein, 102 aa, Homo sapiens
MGYYMPSAGICGMIRAYGMSGFNTSGLLMMYVISKVHLLLPVYNLALTDRPDYKRQVKNISCFALERSEDKRLYKFCFIIRLLLQTGCLYYTYCPYAHQSYV

SEQ ID NO: 936102 - protein, 31 aa, Homo sapiens
MPFEREQLDPDELETITMHKILETTTFFQRA

SEQ ID NO: 936103 - protein, 123 aa, Homo sapiens
SPPVSRPTRARIAGALRLPARLLSVPRSVPAAPPRGPACSKGSGDPSSSSSSGNPLVYLDVANKPLRRVVLELKAVVPNTSELKPCALVRKGFGYKGSTFRVIPSFMCQAGDFNHNGTRELRP

SEQ ID NO: 936104 - protein, 138 aa, Homo sapiens
WLGFGHGGAQGFTSKADPQGSGGSRCGDRAPGASVDFGSREWRELEKAIAFADRYAAVDTDGVEPWNRSWRQMSIPEIRQCGRRQLCLMNYYKTPIASWKEYFCWPPPGNISFAKAGLNKKPFPHSLSSSFLERGGTL

SEQ ID NO: 936105 - protein, 101 aa, Homo sapiens
MGAGPKLGAMSYQPRGLDGHQEAAGAEQALVRPRASMCPLRIHAPALGFCYFSLSHWASSIFWSETNMPRPPPLPTLKLGEGKVLILEWLPLLEQIKDDWP

SEQ ID NO: 936106 - protein, 104 aa, Homo sapiens
PEAPFDPSKPPVIEGFSRTVYSNPEAFKEKFIRKTRENLNGAYRVSGDGGCLTYGLYCFHRGQSTDPNIMMRTRIAAQGFTVRSHLVGVSGICYEVSSLSIAGS

SEQ ID NO: 936107 - protein, 40 aa, Homo sapiens
RLQLPEQQPQHQEQERQSDGGASPTPIPTVTAPSLAAEAA

SEQ ID NO: 936108 - protein, 134 aa, Homo sapiens
WVGQWDWVLDRMALMDQRLFPGGENQALIPDLASIMKKLLTKYDNLFETSFPYSMGWHGAPTGLKTGATCDHLAAPAHYYPPLLAIRNLSGKFMVGYENACPRPSVTFTPRNKAAEKIKGRFPRRYTNLPWRRK

SEQ ID NO: 936109 - protein, 46 aa, Homo sapiens
LASKCPKCDKTVYFHDGKPFCHKPCYATPVWNPKAFNIGGGLLHLR

SEQ ID NO: 936110 - protein, 58 aa, Homo sapiens
WRAQEACGGNVGHWIRSASAMVAPPVFQKWRLSIGFVFGSFIGSWYKGRRREQDGLPG

SEQ ID NO: 936111 - protein, 33 aa, Homo sapiens
MSHGKQTEFFDNTVDCIPWPASPLSSYADKAKD

SEQ ID NO: 936112 - protein, 306 aa, Homo sapiens
YGRVRFRVRPLRGVSPRPPKCPCLGNLPTSARPSHTCAPAGLLSGGVELRPPPIFRRPKMSSICAWGEFWPIAPLHLAHPFVWGVFLASPPTSSMRCPLRHILQPLGHHCLARALYHFWGSTRGAPSEAYLVRAPKHFPWKAPSVATNTWGGTDRPPLSPPLVCGLYHQLRPAPLLSALQAAFVGVSSAAHRHRCTPGPLQMLAPPRPLVVSVPSFPEVDLSLQNPSVHLWSPPYAGTSHFLWHTCWLDMRPHGRNSCFFPPLLPAPHVLVEWLTTRPLDDHFHRAGPPGKPPGFFAPKKPPRPHN

SEQ ID NO: 936113 - protein, 38 aa, Homo sapiens
MDRMMVEHLLRCYYNTAVWRARAAEDLVNIEMFLTAKE

SEQ ID NO: 936114 - protein, 58 aa, Homo sapiens
MSRSSASRSCSGDGHNDTGTTPEARNALNCYMRSAVPAATAGQEVLGVWPPVDTRGGG

SEQ ID NO: 936115 - protein, 78 aa, Homo sapiens
AHEILGEQGFQSLMETVDTEIVTQLQEFFKDSKSTCHVATIPSEKKLSNPACHPFMSLPEIRSFVYEYKETKTINFLL

SEQ ID NO: 936116 - protein, 115 aa, Homo sapiens
IEPGERASARRGLSRAGCLALTLPALLLVTHQVPAERSHGGTALESLIEMGPGDARRRLWPHREPGHRGCDGLADGARRRPRCGRAFRDSPWTYPVDGSPSRTRRPFERIWVLLA

SEQ ID NO: 936117 - protein, 141 aa, Homo sapiens
RTQPTCTQVIKSFIAHTKPVWWSLHTDNMKFGAVTRIGGPPGRINPLSSCSLLREKDPPTTSGPQTDQPNEHLTNFKSGPTQSALLILDLDETDTLRRPQQNQLLGLCEQNDRECGDPPHGEATEPVFFLKSNRGTNFQGL

SEQ ID NO: 936118 - protein, 52 aa, Homo sapiens
MLSGGFGYSPSSASQMATCQGPGLQPDAAGWSCLPFWIAGNVGWFMDMFGMM

SEQ ID NO: 936119 - protein, 80 aa, Homo sapiens
KFDSTQTLVAMPVKTMAYRGAQNAVQRRIEEAVARLRQHNIRQAAAPVHPPVDNPRSLSPAISAAGFTHGFQGVRFMKIR

SEQ ID NO: 936120 - protein, 138 aa, Homo sapiens
HHGLRNGRQAPLTSSTPDAAHPHEGLDEEDFLSFPPKHVPHEPLCKYGGANLWSAFIILLLLLLLRRLQAGVQVAQSRSLQPQPLGSSDSPASASASRVAGTTGVHHQAWLIFVFLVEMEFNHVGQAALELLASSDPP

SEQ ID NO: 936121 - protein, 142 aa, Homo sapiens
RLTAKVVEFADDDQRHIVRRVPGLAHLLQLLLGQVPDLKPLRAFQAQASHPADCWRCGPGLAVEKTLQTRVMATVLALDHAFGGVDRIVVNAGLGQQTEQQVEHFALILRRGFDDERGVGVAGERVPLTAQRLMRSSRPPPS

SEQ ID NO: 936122 - protein, 110 aa, Homo sapiens
FAKKHNKKLKKMQANNAKAVSARAEAIQGPGEPQAIKPKMPKGPKLKRLAFIAHPKLGKRIRSYMAKGQSSANRSLRSKPRQGPKLQLRPRLQLQLRLPKVLPPKVPRPL
